United States Patent 10,696,975 (GENES AND USES FOR PLANT ENHANCEMENT) - sequence listing, part 19

SEQ ID NO: 85183 - protein, 184 aa, Arabidopsis thaliana
MSNYAAGLGKPGSGKRRIRDLLNQPDNRVCADCGASVPKWAYISILQSRSLFMLGVVLTSCFQISKYQSIHLLKSCGVHRSLGTHILKVLSVTLDEWSDEEVDSMIETGGNASANSIYEAFVPDTCSKPGPDVNHDQRMRFISFNRYLQLDGVILGADTRATEGPIVADKNCGKIHYMAPNIYC

SEQ ID NO: 85184 - protein, 254 aa, Coprinopsis cinerea okayama7#130
MLLFNITFECQLNGTPVRSRLPSPPASSRPCPHHPLVHIIDFGLAKKFRDSVSQIHIPFSQHPTGLHGVGTSLFASINTHLGMEASRRDDLESLAYMLIYFLRGTLPWRKMRAPSNLPSSILAAISNSEERREAQEHYNPVSATWDLIRDSKLEHEATLTEGLPEEFHVLYTYARNLEFDDLPDYEGLRNCFRGLAARLGIEYDGVFDWSVKGPGEGGSKGPGIASKKIRRGRQCLACDARAKAKAEEAERRKS

SEQ ID NO: 85185 - protein, 165 aa, Zea mays
VSVVQVAKAIGSILPGKQQQLQAPRAGDGSEARKRELEAMEAQRAAIDAAAAAQVRRELWCGLGLLATQTLGFMRLTFWELSWDVMEPVCFYVTSLYFMSGYFFFMRTATEPSFEGFFRSRFASRQRRLMRARGFDVDRYNALRKGQGLGPLGDPDACRHVSHAQ

SEQ ID NO: 85186 - protein, 488 aa, Wolinella succinogenes DSM 1740
MDNLELYLLISALLMLLSVVSSKLSDKFGIPALFIFLGLGMLAGSDGILGIYFDNAKLAQSVGTLALIFILFGGGLDTSWKAIKPVLGAGLALATFGVIFTALFVALSVRYLLDFTWQESLLLGAIISSTDAAAVFAILRAQGISLKKRLAPLLELESGSNDPMAIFLTVAILQMILLPESSSLGEWIGKFFLQFLVGGIMGYLFGILLPPIFNRIHLGHYGLYPVFSIAWVLLLFSASSFLGGNGFLAVYIAGIASNAREFVHKKNLIGFHDGLAWIMQIAVFLTLGLLVFPSDLPAIAPAAIGISLWLIFVARPLGVFLTLTFSSLSLQEKSFISWVGLRGAVPIILATYPFLAGLESSSLIFNTIFFIVLTSILIQGTTLPRVAKWLKVEESKESKVPEPSIIASPLLHHTLKQFYITKNSSVIGKSIAELELPSEFLILLIKREKEQIKPTGSTLFEEGDMLLIQCEDPALFRQIVRSFAPLES

SEQ ID NO: 85187 - protein, 421 aa, Chlamydophila pneumoniae TW-183
MAIQKAGAFLRCLPSESRPYLEHAMRRNPHFSLLKPQYLFSEISKKLAQFRKENPEISVIDLSIGDTTQPLCRSITQAIKEFCVSQEKQETYRGYGPETGLEKLRTKIASEVYENRISPEEIFISDGAKPDIFRLFSFFGSEKTLGLQDPVYPAYRDIAHITGIRDIIPLACRKETGFIPELPNQQSLDILCLCYPNNPTGTVLTFQQLQALVNYANQHGTVLIFDAAYSAFVSDPSLPKSIFEIPEAKYCAIEINSFSKSLGFTGMRLAWNVIPKELTYDNNEPMINDWKRLFATTFNGASLLMQEAGYYGLDLFPTPPAISLYLTNAQKLKKSLETAGFSVHGGDHAPYLWVELPEGISDEEAFDFFLHQYHIAVTPGHGFGSCGQGFVRFSALTQPQNIALACDRLCTASLKETMVLA

SEQ ID NO: 85188 - protein, 237 aa, Wolinella succinogenes DSM 1740
MACDTGVKAIDSNNEKTSVSNDQNLSTKENKNMSSSLVLRKMPAFETMAYDAATGHYKKVSSQDYEGKWTLICFYPADFTFVCPTEIAAMNAHLDEITGELGVEVLAASTDTHFSHKRFVETEPILKGLKMTIAADPKGDMARAFGVMIEEEGLALRGRFLVNPEGVVVAQEVQAPMVGRNVQELIRQIRAWQHATQTGEVCPAGWRPGKKTLPVNTDAEKMTGRVGDYITLEELLS

SEQ ID NO: 85189 - protein, 399 aa, Pseudomonas syringae pv. tomato str. DC3000
MSGNRGVVYLGAGKVEVQSIPFPKMEDPRGKRIEHGVILRVVSTNICGSDQHMVRGRTTAQTGLVLGHEITGEVLEAGRDVEHLKVGDLVSVPFNVACGRCRSCKEQNTGVCLTVNPARPGGAYGYVDMGDWVGGQAEYVLVPYADFNLLKLPDRDAAMEKIRDLTCLSDILPTGYHGAVTAGVGPGSTVYVAGAGPVGLAAAASARLLGAAVVIVGDVNPTRLIHAKAQGFEIADLSQDTPLHEQIAALLGEPEVDCAIDAVGFEARGHGHAGAQAEAPATVLNSLMGVVRVAGKIGIPGLYVTEDPGAVDAAAKMGSLSIRLGLGWAKSHSFHTGQTPVMKYNRQLMQAIMWDRIKIADVVGVEVISLDDAPRGYGEFDAGVPKKFVIDPHGLFGGV

SEQ ID NO: 85190 - protein, 336 aa, Streptococcus oralis
MVVKVGINGFGRIGRLAFRRIQNVEGVEVTRINDLTDPVMLAHLLKYDTTQGRFDGTVEVKEGGFEVNGKFVKVSAERDPEQIDWATDGVEIVLEATGFFAKKAAAEKHLHAGGAKKVVITAPGGNDVKTVVFNTNHDVLDGTETVISGASCTTNCLAPMAKALQDNFGVVEGLMTTIHAYTGDQMILDGPHRGGDLRRARAGAANIVPNSTGAAKAIGLVIPELNGKLDGSAQRVPTPTGSVTELVAVLEKNVTVDEVNAAMKAASNESYGYTEDPIVSSDIVGMSYGSLFDATQTKVLDVDGKQLVKVVSWYDNEMSYTAQLVRTLEYFAKIAK

SEQ ID NO: 85191 - protein, 698 aa, Bordetella bronchiseptica RB50
MTYLVLARKWRPRSFDTLIGQDHVVRALTHALDTQRLHHAWLFTGTRGVGKTTLSRILAKSLNCENGITSKPCGQCRACTEIDAGRFVDYLELDAASNRGVEEMTQLLEQAVYAPGAGRFKVYMIDEVHMLTGHAFNAMLKTLEEPPPHVKFILATTDPQKIPVTVLSRCLQFNLKQMPPDAIVGHLQAVLGEEQIGFEVPALRLIGQAAGGSMRDALSLTDQAIAYSAGNLSEEAVRGMLGTIDQRHLVRLLDALASGDAAGVLAVADELAVRGLSYAGALADLAVLLSRVAIEQRVRGALPQDDPLTEDITRLAAALHPDAVQLFYSVAVHSRGELTLSPDEYAGFVMACLRMLALNGEAGPATAVQAPRADTTPRAAAPAAAAPAETRPEPTPALAPQAAAAPRAVARSESKPQPAPEPEPEPEPEPEPASRPAATPVAATPPAVAEPEPVAAPAVQARAAEPAPVPPWEDLPEAVAAPAPAQPAAAPAPVVADDDGPPAWVDEAIPDEAGGGFAPEHSFTADPDDEFETLAPAPAPAAMPAPRAPTPRRESGGRGRAARSRLADMSPAGWPELAARLPVTGLAAELARQSEWAGVQGDAVLLRVAVRTLAESESRVRLQTVLCEHFGQGLRLEIEVGVTGDGTAHAVAQIERAARQQAAEDAVAVDPFVQALVADFGGRVVPGSIRHVDNPPAA

SEQ ID NO: 85192 - protein, 528 aa, Alkaliphilus metalliredigens QYMF
MITVTNVSLRYGERKLFEDVSLKFTPGNCYGVIGANGAGKSTFLNILSGELEPNTGDISIPPDIRMSVLKQNHYQYDQNQVLETVVMGNPRLFEIMQEKDALYAKENFSDEDGIRASELEGEFAELDGWEAEAEASSLLQGLGIGTELHDKQMVDLIGAEKVKVLIAQALFGKPGILILDEPTNHLDIKSVKWLEEFLINFSGTVIVVSHDRYFLNNVCTHMVDVDFGKIKLFVGNYDFWYESSQLALRLMKDQNKKKEEKVKDLQAFIARFSANASKSKQATSRKKLLEKITIDDIEPSTRRYPFVGFTPLREVGNDILIVDGLSKTIDGKKVLNNVSFTVNKGDKIAFVGANEFENTVLFKILTGEMEPDSGTFKWGVTITTANFPKDNAEFFTGVDLDLVDWLRQYSEEKSESYLRGFLGRMLFSGEEALKQANVLSGGERVRCMLSRMMLSSANVLVLDQPTNHLDLEAITALNNGLRDYASNILFASHDHQFIQTVANRIIEITDTGVIDKKMTYDEYLETKA

SEQ ID NO: 85193 - protein, 381 aa, Oryza sativa
  misc_feature (213)..(213): Xaa can be any naturally occurring amino acid
  misc_feature (238)..(238): Xaa can be any naturally occurring amino acid
MEDQSLKPIRCKAAVCRAASEPLIVEEIVVDPPKAYEIRIKIICTSLCHTDVTLWHKVDPAFPRILGHEAYGVVESVGENVEGLAAGDTVVPTFMGQCDSCASCAAEWTNQCTAVPFTMGPGMRRDGTTRFWDGEGKPLSDTVAVTSFSQYTVVDVNQVVKVDPAVPPKIACLLGCCGGTGVGAAWRLAKVQPGSSVVVFGLGSVGLAVVQGXAKMCGATKIIGVDLNPNKEEVGKEXFGVTDFVNPSQLGDKSVSEVINAMTDGGADYSFECIGISSVMTEAVRSTKSGRGKTIILGVEKDSQPLCLPSFEFLFGKCVMGSLFGGAKPKTDIPILAEKCMNKELELEKLVTHEVGLTEINTAFDLLLQGKSLRCIIWMDK

SEQ ID NO: 85194 - protein, 441 aa, Bacillus pumilus SAFR-032
MPKEIFMPKLSSTMEIGTLLQWFKEEGDSVEIGEPLFEIMTDKINIEVEAYDDGIFLKKYYEADDQIPVNAVIGYIGEANEQVPSEPPAQADEDSSESGESSSPDTVSSSSTEVPKTSNEKVRATPAARKTAKDHHVEIQEVSGTGPKGRVQKRDVEAVVHSSEKDQRISPLAEKVAAREGIDLAAVSGSGAHGKIMKSDVQAAATQTTEASPVKTQKLAGMRKVIADRMSQSAFTAPHVTLTSEIDMTKAKEVRQQLLPAIEKETGYRLSFTEIIIHAVSHVLTRHPQINMTFEQNELHFHEDVHIGLAVAVKDGLMVPVISHANQKGLKQLTKEAKEIGRNARDQKLLPDQLKGSTFTISNLGMYAIDAFTPIINQPEVAILGVGRIQDKPVAVDGEIQVRPMMGVSLSFDHRVVDGAPAAAFLTDLKKVLEQPFELLM

SEQ ID NO: 85195 - protein, 506 aa, Vibrio vulnificus YJ016
MTQQLEQNLATAQKYLARFRDNTLGHFINGEWTLGSKGETFDNLTPTDNTSLGKVVKGTAEDVDAACEAAQQAFTAWAEMSGAERKKILHKLADKIEQRAEEIALVESMDCGQPLRFMRQAAIRGAANFRFFADKSPEAKNGLSLHQDTHTNYTIRTPIGPVGVITPWNTPFMLSTWKIAPALAAGCTVVHKPAEFSPLTAAILAECAKEAGLPDGVWNMVNGFGEVAGKTLTEHKAIKAVAFVGETVTGSMIQAQGAPTLKRVHFELGGKNPVIVFDDADFERALDAVVFMIYSLNGQRCTSSSRLLIQNGIKPKFIEALKQRVESLQVGHPLDPETEVGPLVHQSHYNKVMSYMTAAEEDGATIAVGGRKLPEKGAGNYLTPTLFTDADNTMRIAREEIFGPVLTCIGFDSEEEALEIANDTDYGLSGYIWTSNTGRAMRMATKVEAGMIWVNSENNRNLPSPFGGVKMSGIGRDGGDWSFDFYMETKNVCIAHDLHRVPTLGK

SEQ ID NO: 85196 - protein, 281 aa, Photobacterium angustum
AQERNDIEVVGINDLIDVEYMAYMLKYDSTHGRFNGTVEVEGGNLIVNGKTVRVTAERNPEDLKWDAINVDVVAEATGLFLTDETARKHITAGAKKVVLTGPSKDATPMFVMGVNQDTYAGQDIVSNASCTTNCLAPIAKVLNDKFGIESGLMTTVHATTATQKTVDGPSAKDWRGGRGASQNIIPSSTGAAKAVGVVLPELNGKLTGMAFRVPTANVSVVDLTVNLKNGASYETICAAMKEASEGALKGVLGYTEDQVVSQDFIGETQTSVFDAKAGIAL

SEQ ID NO: 85197 - protein, 460 aa, Bacillus pumilus SAFR-032
MTKTYDLTVIGGGPGGYTAALQAAERGQKVALIEEDFLGGTCLNRGCIPSKTLLKHAEVIESIEKAKSWGIETGDMILSFDKMRKRKDDVIEKLRGGIAFLLKQGKIDVYNGRGTAVTKHRIEIEKQDGSESIETKELIIATGSTPAIPPIPGLKDISFDTSDTIFDIPDIPASVVIIGGGVIGLELACIFQSLQSKVTIIEAAPSIIPQEDEEASKLLERELKKKGIHIAKKTTVTEVTESEGVKAVHATDDKGETHIFTAERLLVCVGRKPNVSAVSQLDLQLDGPFIKVNDQMQTSAEGVYAVGDVAGGYQLAHAAMAEAAVAVSNICGVPEKMNADIMPRCIYTLPEVASVGLTEKEAKAKGLSVQTERFDLAASGKALAAGVQSGFIKLVYDTTYGEVIGATMVGPHVTEMISEASSFMYLEGTAEEMAKMIHPHPTISEGFYEAALEIVSKLRK

SEQ ID NO: 85198 - protein, 577 aa, Arabidopsis thaliana
  misc_feature (66)..(66): Xaa can be any naturally occurring amino acid
MATHSMIIPSPSSSSSSLATAASPFKETLPLFSRSLTFPRKSLFSQVRLRFFAEKHSQLDTSNGCXATNFASLQDSGDQLTEEHVTKGESTLSITVVGASGDLAKKKIFPALFALFYEGCLPQDFSVFGYARTKLTHEELRDMISSTLTCRIDQREKCGDKMEQFLKRCFYHSGQYNSEEDFAELNKKLKEKEAGKISNRLYYLSIPPNIFVDVVRCASLRASSENGWTRVIVEKPFGRDSESSGELTRCLKQYLTEEQIFRIDHYLGKELVENLSVLRFSNLVFEPLWSRNYIRNVQLIFSEDFGTEGRGGYFDQYGIIRDIMQNHLLQILALFAMETPVSLDAEDIRSEKVKVLRSMKPLRLEDVVVGQYKGHNKGGKTYPGYTDDPTVPNHSLTPTFAAAAMFINNARWDGVPFLMKAGKALHTRGAEIRVQFRHVPGNLYKKSFATNLDNATNELVIRVQPDEGIYLRINNKVPGLGMRLDRSDLNLLYRSRYPREIPDAYERLLLDAIEGERRLFIRSDELDAAWDLFTPALKELEEKKIIPELYPYGSRGPVGAHYLASKYNVRWGDLGEA

SEQ ID NO: 85199 - protein, 491 aa, Bartonella henselae str. Houston-1
MVSKIIPVSPFDCIVFGGNGDLAARKLIPALYHCQCVGQLSEPTRIIGVSRSSLSGEEYQNFVRASLEKYVHPKDLNRIELNRFLARLTYISVDITSNRGWRDLALPLSEDPSDIRVFYLAVGSSLFGDIAMRLGQNGLVTQKTRIIIEKPIGCNVKTAVQLNDTFASVFDEDQIFRIDHYLGKETVQNLMALRFVNTLYEPLWNSNYIDHVQITVAESLGLEGRIEYYESAGALRDMVQNHMLQLLCLVAMEVPFTNSANAVRDEKLKVLHSLMPLDVRNVEQYTVRGQYLSGILDDVCVKSYLDDLGKEVSRSETFVALKIKVDNWRWADTPFYLRTGKRMSTRMSEIVIVFKPIPHNIFETDSNEIFSNRLVIRLQPDEGVKQWLMIKDPGPGGIRFRHIPLDMSFASTFSQRNPDAYERLLMDVIRGDQTLFMRRDEVEAAWRWIDPILEGWEAIKQPVHGYSAGSWGPSASKLLMERDGRIWNNLV

SEQ ID NO: 85200 - protein, 262 aa, Rhodopseudomonas palustris CGA009
MTASSPHVALVTGAARGIGLAAAKRFLADGWSVALLDRDDDGLRAAMQALALPERTIALHCDVADRGSVARDIAAVTERFGRLDALVNNAGIAVFKPLMETTPDEWQRVMDVNLTGPFLMTQAAVPLMRDSGGGAIVNITSISSLRASTLRVAYGSSKAGLAHFTKQCAVELAALGIRVNGVAPGPVDTAMAKQVHTADIRSDYRDAIPMARYGLEEELAEAIFFLCSDRASYITGQILAVDGGFDAAGIGLPSLRGERKNS

SEQ ID NO: 85201 - protein, 664 aa, Zea mays
MEATLAFSQDSPPISIICAAKFVGLPLTIDPSLASGLAPTLRFASGESLHGVNPILLYIASGATIPCFSGKNDIEFGHVVEWLEYVPIFLSGSEFENACLFVDGFLASRTFLVGHGLTIADIVVWSNLAGIGQRWESLRKSKKYQNLVRWFNSIDSEYSDTLNEVLAAYVGKRGIGKSPAPSLKEKVHVSKDPSAPEVDLPGAKVGKVCVRFAPEPSGYLHIGHAKAGLLNKYFAERYQGRLIVRFDDTNPSKESNEFVENVLKDIETLGIKYDAVTYTSDYFPKLMEMAGSLIKQGKAYIDDTPKEQMRKERMDGIESRCRNSTVEENLSLWNEMVNGTERGMQCCVRGKLDMQDPNKSLRDPVYYRCNIDPHHRVGSKYKVYPTYDFACPFVDALEGVTHALRSSEYHDRNAQYYRILQDMGLRRVEIYEFSRLNMVYTLLSKRKLLWFVQNKKVEDWTDPRFPTVQGIVRRGLKIEALIQFILQQGASKNLNLMEWDKLWTINKKIIDPLCARHTAVLKDQRVIFTLTNGPEKPFVRILPRHKKFVGAGKKATTFANRIWLDYADAAAISKGEEVTLMDWGNAIVKEIKLEEDDDFLENLNPCTRRENPALGDANMMNLKRGEIIQLERKGYYRCDAPFIRSLKPVVLFAIPDGRQQALLN

SEQ ID NO: 85202 - protein, 336 aa, Cicer arietinum
MAPNHAFIFLVLLSFSPQLFFTLSSAQQDNGLLMNYYKESCPQAEEIIKEQVKLLYKRHKNTAFSWLRNIFHDCAVQSCDASLLLTSTRRSLSEQEHDRSFGLRNFRYIDTIKEAVERECPGVVSCSDILVLSARDGIVSLGGPYIPLKTGRRDGRKSRVDLLEEYLPDHNESISAVLDKFGAMGIDTSGVVALLGAHSVGRTHCVKLVHRLYPEVDPALNPEHIPHMLKKCPDSIPDPKAVQYVRNDRGTPMILDNNYYRNILDNKGLLSVDHQLAHDKRTKPYVKKMAKSQDYFFKEFSRAITLLSENNPLTGTKGEIRKQCSVANKQHFDEQP

SEQ ID NO: 85203 - protein, 490 aa, Hordeum vulgare
MVVTVAATGPDTAETLHSTTFASRYVRDQLPRYRMPENSIPKEAAYQIISDELMLDGNPRLNLASFVTTWMEPECGKLIMDSVNKNYVDMDEYPVTTELQDRCVNMIAHLFNAPIGEDETAIGVSTVGSSEAIMLAGLAFKRKWANKMKEQGKPCDKPNIVTGANVQVCWEKFARYFEVELKEVKLTEGYYVMDPKKAVEMVDENTICVAAILGSTLTGEYEDVKLLNDLLVEKNKETGWNVPIHVDAASGGFIAPFLQPELEWDFRLPLVKSINVSGHKYGLVYPGVGWVIWRSKDDLPEELIFHINYLGADQPTFTLNFSKGQQIIAQYYQLIRLGFEGYKHIMENCKLNAAVLKEGIDATGRFDVLSKADGVPLVAIRLKDSTNFSVFDISENLRRFGWIVPAYTMPADAEHVAVLRIVIREDFNRSLAQRLLADINKIIGELDAHAVHAIKLSTAAAGGDGASKSAVDAATEAFKDLAGKKKAGVC

SEQ ID NO: 85204 - protein, 1094 aa, Gibberella zeae PH-1
MDRPAKRQRSTEFEAHAPESLQRSISPPRKRARKPVAIPSPWQLTWIQDLPESENKDAVSLRDLLGDPLISECWEFNFLHDIPFLMNAFDPDTRHLVNVHLVHGFWKHEDKNRIALENAAAKFENVNVHIAPMPEMFGTHHSKMMILFRHGDTAQVIIHTANMIPKDWTNMTNGVWKSPLLPRMSKTQTPASSPEEFLVGSGERFKIDLLNYLKFYDKRKIICKPLSDKLKQYDFSTIKAALIASVPGRHDAHDMSETSWGWAALKRCLRHVPCHQHGDSDIVVQVSSIATLGPKDDWLQKTLFDHLGRCKDTGLRRPRFKVVFPTADEIRRSLDGYASGLSIHTKIQSPQQAKQLEYLRPMFHHWANDSPGGTKLPDGPVLESGRKRAAPHIKTYVRSNKSSIDWGLLTSANISKQAWGEAARPTGEMRIASWEVGVLIWPELLEPGSVMKPPLVLFLVPSLLLHLSLISCNQRIALRRGAGVSPYGTPRGSGAHPALSSSWRVGSPLAEAALAADIAACSDEEYDDSAIDDDVSVSDLPGDPIMYRRPSGVAFGGSRPIMNPQIYDEPGLTALERKQSRNAERSLLRDNHVLPPKHGHRQQDGFFTRIYQRLFSTKIPQDEEQAPAISVQPPSETDPLLGSRVDAVSPEHLNETWEHAVAEHRIKTTWQREAKTIASYSAPLIVTFLLQYSINVTSIFAVGRIGKLELGAVSLANMTAAITCLAPFQGLATSLDTLCAQAYGSGHKHLVGLQFQRMTCFLFVLAVPVAVFYWFSEGVIRALVPEPESARLAGMYLRVMIFSIPGFILFEGGKRFTQAQGLFRATTYVLLIVAPFNVFLSWLLVWKLEWGFIGAPAAVAISTNLLPIFLFLYVRFINGRQCWGGFSRRALSNWWIMIRLALPGMIMVEAEWLAFEILTLMASRFGPEYLAAQSVVTTITTLSYEIPFPMSIAASTRIANLIGAGLVEPAKKTGVVAFAAACLIGMFNLTLYTTLRYKLPLLFTKDDDVIELVAEVMPIVSVMQVFDGLAAGAHGLLRGIGKQSIGGPANILSYYALSLPVSLALAFGLGWKLEGLWIGVTCGTISEINEKFEH

SEQ ID NO: 85205 - protein, 130 aa, Magnetococcus sp. MC-1
MAYNEKVLDHYEKPRNVGSMDKDADDVGTGMVGAPSCGDVMKLQIKVDDNGVIEDAKFKTFGCGSAIASSSLVTEWIKGKTIDEALTIKNKDVAEELALPPVKVHCSVLAEDAIKAAVKDYREKQQKKGA

SEQ ID NO: 85206 - protein, 403 aa, Magnetococcus sp. MC-1
MSMPIYMDYQATTPMDPRVFEAMTPWFVEKFGNPASRSHPYGWEADTAVENARQQVASSIGADPREIIFTSGATESDNLAIAGVAKFYKDKGNHIITPVTEHKAVLDTCRYLEQEGFEVTYLPVQKDGLVNMAELEAAITDKTVLVSIMAVNNEIGVIQPLAQIGALCRRKKVFFHCDAAQGVGKMPIDVNEMNIDLMSISGHKIYGPKGIGALYVRRRPRVRVNAIIHGGGHERGMRSGTLSTPLIVGLGEACRLATEEMVVEEARVLRLREKLRTALESQMTHVQTNGSLEHRIAGNLNISFEYVEGESMMMAIKDVAVSSGSACTSASLEPSYVLRSLGLNDEMAHTSIRFGLGRFTTEEEVDAVIKIVTGAVDKLREMSPLWEMVQEGIDLSSIKWAEH

SEQ ID NO: 85207 - protein, 214 aa, Pasteurella multocida subsp. multocida str. Pm70
MNQSILSPFGQSEERAIAAINAFKQGNGVLVLDDEDRENEGDLIFPAETITVEQMTMLIRYGSGIVCLCLSDEICQQLDLPPMVTENTSVNKTAFTVTIEAAKGVSTGVSATDRVTTIRAAVADNAKPSDLSRPGHIFPLRAMTGGVLKRRGHTEASVDLARLAGYKAAGVICEITNDDGSMARAPEIVTFAQKFGFPVVTIEDLVAYRQKYDV

SEQ ID NO: 85208 - protein, 552 aa, Neptuniibacter caesariensis
MYQYNEVDQKLVDERVEQFRDQTRRFLAGELSEDDFLALRLMNGLYVQRHAPMLRVAGPYNMYNSAQFRKLAHIARTYDKGYAHFTTRTNLQFNWPKLEEVPDILAELATVQMHSIQTSGNCIRNTTTDQFAGVIAEEVEDSRPYCEIIRQWSSLHPEFAYLPRKFKIAISAAPDDRAATQVHDIGLHIIKNEAGEVGFEVIVGGGLGRTPMIGKQINPFLAKEDLLSYLEAIIRVYNMNGRRDNKYKARIKILVQAMGIDKFREEVEAEWAHIRDTDLKLPQEEIDRVKAFFKPFDYDESAAQDNSLEAKLAEDEAFNTWYERNTVAHKVDGYRIAYVSLKPYLKPAGDITADQLDLVADLADRYSFGEIRATHNQNLVLADVKKADLYAVWQVLAEAGLARPNMGTITDMTVCPGGDFCALANARTIGVADQINEKFESLDYLHDLGELKLNMSGCMNACSHHHVGHIGILGVDKKGEEWYQITLGGDDGSDAALGKVIGRAVASDQVANTLEKVVEVYVEKRLEGERFIDTFHRIGMAPFKEYVYAPAN

SEQ ID NO: 85209 - protein, 383 aa, Magnetococcus sp. MC-1
MSIYLDHNATTPTRPEVVEAMLPYFSDKAGNPSSVHSAGRAAREGLDRARRQVAHLLGVHFSQVLFTSGGTEANNLALFGMAAQFGFAGHMVTTTVEHPAVGRVVDALEARGMRVTRLQPDQQGRIGTEALQAALQEETRLVSIMAANNETGVLLPVVEMAALCRARGVLLHSDAVQWVGKMPLDLAATPISLVSLSAHKFGGPKGVGALVVDSAIAPHAQLLGGGQERGRRSGTENLTGIVGLGRAAELAMAEMTEQAQRWRTLRQDMEQQLVTALPELVIYGAQAPRLPNTTMLGLPGMDGETLVMQLDLAGVAVSSGSACSSGRTEPSHVLKAMGVDTETARGAIRVSLGAESQQSDINQLVQALISSVKRLKDMAGMRV

SEQ ID NO: 85210 - protein, 516 aa, Wolbachia endosymbiont of Callosobruchus chinensis
MKQPYQNLFGLHTHFLFVLSEAMNIALKHRPSSFKDLVGQDILVRVLENAFILNKIPQSILLSGSSGVGKTTTARIIALCLNCSLGPIFEPCGSCENCLAIKNSSHPDVIEIDAASHTSIDDVKVILGDICYSPISSKFKVYIIDEVHMLSSSAFNALLKTLEEPPSSVKFILAPPEIKKIPITIIARCQRFDLHNIPVAKIVERLNDVAQKESYSIEKGALELIARHSGNSMRNALFLMNQAVLYSKDGAISTKNVIDILGLVDKDIIFDLLGAILEGDLQKALSVFDKAIKTANPLSIFEGLLQTIQLVCRFLITKEIDNAVTEYEKNRIKDLSIKKSLIFFSRLWKVLLKGIQDIKTSTCNDVAAEMMLISLCYLSDLPSPEQVVKKILSQNAQQGNTHSIGNGQQQNYDFDKVLQLLRRSNQIYLYKQLCNNLQLIDCKPGYLKLKAVSKLDSNFCNDLKNYLNQVTQQEWVITVDTGYINREVSNLNYAPAVKDILDTFKGAKVVNIENKE

SEQ ID NO: 85211 - protein, 786 aa, Oryza sativa
MDSTKQDFQPRTFSIKLWPPSESTRLMLVERMTKNLSTESIFSRKYGLLGKEEAHDNAKRIEEVCFASADEHFKEEPDGDGSSAVQLYAKETSKLMLEVLKRGPRTTVEPEVPVADTPLEPADSVFDISGGKRAFIEADEAKELLSPLIKPGNAYKRICFSNRSFGIGAANVAGPILESIKKQLTEVDISDFVAGRPEDEALDVMRIFSKALEGAVLRYLNISDNALGEKGVRAFEELLKSQDNLEELYVMNDGISEEAAQALSELIPSTEKLKILHFHNNMTGDEGAMFIAEMVKRSPNLESFRCSATRIGSDGGVALAEALGTCTRLKKLDLRDNLFGVEAGLALSKTLSKLPDLVELYLSDLNLENKGTVAIINTLKQSAPQLEVLEMAGNEINAKASQALAECLTAMQSLKKLTLAENELKDDGAVVIAKSLEDGHQDLKELDVSTNMLQRVGARCFAQAIANKPGFVQLNINGNFISDEGIDEVKDILKSGENSVEVLGPLDENDPEGEAEDDEEEEEEEEDDDQRRGLRHRSPHPHPPPPLAITLQQIGNLAGGGGGGAGKRADTGDEREEEEEEEGEDGGDAVAARRRDRPRDGHRRGIHRLRWEDKLPRLPPQGGSPRHLQRGRLHTPLQHHQRHVGLVFAVAMEGGAIKLFDSRSYDKGPFDTFLVGGDTAEVSDIKFSNDGKSMLLTTTNNHIYVLDAYGGDKRCGFSLESSPNVATEAAFTPDGQYVISGSDCLLEQSHRSYHCFEVGSPSSNVCNCVNCPNFLDSQQFQFELGA

SEQ ID NO: 85212 - protein, 237 aa, Magnetococcus sp. MC-1
MFKTIRDDIAVIFDRDPAARNVLEIVLCYPGVHAMIAYRFSHKLWQWNFKLAARFISHVGRVLTGIEIHPGAKIGKGFFIDHGMGVVIGETCEIGDNCTLYHGVTLGGTTWNKGKRHPTLKDGVVVGAGAKVLGPITLHEGARVGSNAVVVKDVPHDTTVVGIPGREVRAKKELSPDQAHAFPSYGVEGQMPDPVAKAVTCVLEQMHQMERRLHTLEEEKRALVAQETEQQPDKKRA

SEQ ID NO: 85213 - protein, 386 aa, Thermus thermophilus HB27
MHGAEHLLEIFYLLLAAQVMAFIFKRLNQPVVIGEVLAGVLVGPALLGLVHEGEILEFLAELGAVFLLFMVGLETRLKDILAVGKEAFLVAVLGVALPFLGGYLYGLEIGFETLPALFLGTALVATSVGITARVLQELGVLSRPYSRIILGAAVIDDVLGLIVLAVVNGVAETGQVEVGAITRLIVLSVVFVGLAVFLSTLIARLPLERLPVGSPLGFALALGVGMAALAASIGLAPIVGAFLGGMLLSEVREKYRLEEPIFAIESFLAPIFFAMVGVRLELSALASPVVLVAGTVVTVIAILGKVLGGFLGALTQGVRSALTVGVGMAPRGEVGLIVAALGLKAGAVNEEEYAIVLFMVVFTTLFAPFALKPLIAWTERERAAKE

SEQ ID NO: 85214 - protein, 537 aa, Kineococcus radiotolerans SRS30216
MRAAPVIVASDLELRAGARLLMEGVNFRVAAGDRIGLVGRNGAGKTTLTKVLAGEGQPASGTVTRSGEIGYLPQDPRAGDPEMLSRDRILAARGLDEIIAKLRKAEVDMASEDEKVRDRAMDRYTKLDARFVALGGYTAESEAARICANLNLPDRILDQQLKTLSGGQRRRVELARILFSASETLLLDEPTNHLDADSISWLREHLKNYAGGLIVISHDVELLEVVVNRVFHLDANRATIDLYNVGWKNYLKQRETDEKRRVRERSNAEKKAGTLLAQAAKMGAKATKAVAAQNMAKRAERLLGELEDVRVQDKVAKLRFPKPAPCGKTPLIARGLSKSYGSLEIFTSVDLAIDRGSRVVILGLNGAGKTTLLRMLGGVEQPDTGEIIGGHGVKIGYYAQEHETLDHDRSVLENMRSASPDLDDTRVRTVLGSFLFSGDDVDKPAGVLSGGEKTRLALATLVVSSANVLLLDEPTNNLDPASRAEILDALKHYEGAVVLVTHDEGAVEALGPERVVLLPDGVEDLWNAGYQELVSLA

SEQ ID NO: 85215 - protein, 631 aa, Oryza sativa
  misc_feature (571)..(571): Xaa can be any naturally occurring amino acid
MESGLVASHRLRVPFAAAHHRHHPAAPPHLLRQRRGSVAATPLRLGLHLPTPTPLRLPAALPLRPSLPPLRAAAASAAAPEPVGSASPKFLGVETKTLKKIVPLGLMFFCILFNYTILRDTKDVLVVTAKGSSAEIIPFLKTWVNLPMAIGFMLLYTKLADVLSKEALFYTVIFPFIAFFGAFGYLLYPMRDAIHPTALADRLLAALGPSFLGPVAILRVWSFCLFYVMAELWGSVVISVLFWGFANQITTVEEAKEFYPLFGLGANVALIFSGRTVKYFSNMRQNLGPGVDGWAISLRGMMSIVVLLGLVIAGIYWGVNKFVIDKSAAPVVERKKKDKPKLSMGESLKVLVSSRYVRDLATLVVAYGISINLVEVTWKSKLKAQYPSPNEYSSFMGDFSTATGIATFTMMLLGRVILRKFGWGVAATITPAVLLLTGVGFFSLILFGEPLTPLMATLGMTPLLAAVYVGAMQNIFSKSAKYSLFDPCKEMAYIPLDEDMKVKGKAAIDVVCNPLGKSGGALIQQFMILSFGSLANSTPYLGGILLVIVLAWLGAVRSLDSQFSPLAKQEXLEKEKMLKAKTVETTAQVVGSGNGSLQETLASENSANGSAIKVSQEPESTTSEKSGQQSQ

SEQ ID NO: 85216 - protein, 382 aa, Thermus thermophilus HB27
MHPSLEAFALAAGLLALGAALVHRFGFPPLPVYLLTGLVVGERLPVEDLEPLPSLGLLLLLFSVGLEFGPDRLRELSGKALRAGFFDALALPLGFLLGLLAGLDLRGALLLAGVIYISSSAVIVKLIIDLRRAANPESEVVLGVLVLEDLVIALLLALLGGQGPAGFLGGVALALAYFLFARFLGPRLVRFMEGLSDELVLLLGAAFTAGTALLFHAVGASEGVGAFLSGVIAAGLGLRERFEHLFGPVRDLGVALFFLVVGAEALGLLRGLTPWAVGLVLLGLLLKLPLNHLGGARAGLGRKRRLYSALYLVPRGEFNLVLGALALGQGYPLVAQVAVLLVLVSIPLGALLIRYAPEIAQALYPEARPRKRAKRAEGSPVK

SEQ ID NO: 85217 - protein, 65 aa, Brassica napus
IYATALYLPSIIIPLFCALYVRNKLLTLLAIILEFSGLIWYSLSYIPFARTMVSKVFMTCFDTEF

SEQ ID NO: 85218 - protein, 644 aa, Alkaliphilus metalliredigens QYMF
MNLLSAENISKSYSEKELLNNINLGINEGDKIGVIGINGTGKSTLLKMIAGAEKPDEGRVIKVNNIQIEYLSQNPYFDPEATVLVQIFKGNSPIMALIRDYQKALQDPNTSSERIIKLSNDMDVMDAWSLESEAKSILTKLGVLDFNAKVGTLSGGQRKRIALAAALINPSDLLILDEPTNHLDNDTIDWLEQLLNTRKGSLLMITHDRYFLDRVVNKIVEVDRGGLYSYEGNYSSFLGKKIERQEMESVHDKKRQSLLKKELAWMRKGAKARTTKQKARIGRYEDLKEHGTDIAEDKIEISVGSSRLGKKVIELAHVNKSYDKDKLIEDFSYIVLRDDRVGIVGPNGAGKSTLLNIIAGELAPDSGSREVGETVKIGMFSQETQHMNDELRVIEYIKEVAEYLTTSDGSKITASQMLERFLFPSAAQWTPIGKLSGGEKRRLYLLKVLMDAPNVLFLDEPTNDLDIETLTILEDYLDEFPGAVLTVSHDRYFLDRIAERIFAFEANGQVVEYTGNFSDYKEKTSIRKGFSGDVKGSHNVEKAPSTKEEQTTDEFSHHKKKEKPLKFSFKEQKEYEEIDDVIARIEGQIEETEKQIGETAADYTLLQQLVVEKQGLETQLQEKMERWVFLNDLADKIEAEKKNK

SEQ ID NO: 85219 - protein, 307 aa, Wolinella succinogenes DSM 1740
MRHFLTLKDFSAQEILEILALSKEIKDDLKKGIRPPLMQGKVLGMIFEKSSTRTRVSFESGIYQLGGMGMFLSNRDIQLGRGEPMKDTARVISRMVDMVMIRTSGHERIEEFAKYSQVPVVNGLTDSYHPVQLMADYLTMMEQGKDQNPIVAYVGDGNNMTHSWLMLASKLGFELRVATPRGYEPNLKIFEEAQKIASLSGAKITLTNDPKRAVEGADVVTTDTWASMGQEEEKEKRARDFQGYCVDSALMGLAKSDAIFLHCLPAYRGQEVSEEVLEGPQSLIFDEAENRLHVQKGIMVWLDRKRS

SEQ ID NO: 85220 - protein, 370 aa, Xanthobacter autotrophicus Py2
MATHKLLLLAGDGIGPEVMAEVKRVAAWLDQAGLASFAIEEDLVGGCAYDAHGAAISEDAMVRAKAADAVLLGAVGGPKWASVPYEARPEAGLLRLRKDLQLFANLRPAICYPALADASSLKREVVEGLDILIVRELTGGVYFGEPKTIMDLGNGQKRAIDTQVYDTYEIERIAAVAFELARTRRNKVTSSEKHNVMKSGVLWKEVVTALHERAYKDVELEHNLADSLAMQLVRWPKQYDVIVTDNLFGDILSDIAAMLTGSLGMLPSASLGAADPVTGKRAALYEPVHGSAPDIAGKGIANPIAMIGSLAMALRYSFNQGEVADRIDQAIAGVLASGKRTGDIAGPGTETIGTQDMGKAIIAELDAATA

SEQ ID NO: 85221 - protein, 454 aa, Ipomoea nil
MKERTGKGGQPSVDEKYTQWKSLVPVLYDWLANHNLVWPSLSCRWGPLVEQATYKNRQRLYLSEQTDGSVPNTLVIANCEVVKPRVAAAEHISQFNEESRSPFVKKYKTIIHPGEVNRIRELPQNKNIVATHTDSPEVLIWDVEAQPNRHAVLGAVASRPDLTLIGHSENAEFALAMCPTEPFVLSGGKDKSVVLWSIQDHISTLSTDAQKPAGFIKPATTSIKAGDNPSIQARGIFQGHEDTVEDVQFCPSSSQEFCSVGDDSCLILWDARVGTSPVVKVEKAHNADLHCVDWNPHDGNFIITGSADNSVRLFDRRSLTSNGVGSPVHIFENHKAAVLCVQWCPDRSSVFGSTAEDGRLNIWDYDKVGEKDNETPAPGLFFQHAGHRDKIVDFHWNVADPWTIVSVSDDCDSTGGGGTLQIWRMLDLLYRPEEEALAELQKFKSHVSKCARKI

SEQ ID NO: 85222 - protein, 196 aa, Hyacinthus orientalis
PTPGSTRCSTRGCATTPTVVTKKILDTYKGFGDLATLVDVGGGVGGTINMIVKKHPHIKGTNFDLPHVISEAELIAGVEHVGGDMFESVPGGDAIFMKWILHDWSDEHCLKLLKNCWRALPDNGKVILMESILPVYPEPTAAAQGVIHVDMIMLAHNPGGKERTEQEFESLAKDAGFAGSKVVCGYANSWVIEFHK

SEQ ID NO: 85223 - protein, 282 aa, Photobacterium damselae subsp. damselae
AQERNDIEVVGINDLIDVEYMAYMLKYDSTHGRFNGTVEVEGGNLIVNGKTVRVTAERNPADLKWDAINVDVVAEATGLFLTDETARKHIEAGAKKVVLTGPSKDATPMFVMGVNHETYAGQDIVSNASCTTNCLAPIAKVLNDNFGIESGLMTTVHATTATQKTVDGPSAKDWRGGRGASQNIIPSSTGAAKAVGVVLPEVNGKLTGMAFRVPTANVSVVDLTVNLKNGASYETICKAMKDASEGSLKGILGYTEDAVVSTDFNGDTRTSIFDAAAGIALS

SEQ ID NO: 85224 - protein, 483 aa, Vibrio vulnificus YJ016
MNLNYPELFQQRCYIDGQWVAESGQTQAVTNPSTGKVIGEIPVFGEQQAKECITAAQAAFELWKKTTADYRADVLRRWYELMMVNIDDLAAILTLEQGKPFTEAKGEITYAASFVQWYSEEARRAYGEIIPSHRENGKIVVTKEPIGVVAAITPWNFPAAMITRKAAPAFAAGCSMVLKPAQETPFTALALAKLAEDAGLPKGLFNVITGDSRSIGGVFTSDKRVRKVSFTGSTNVGKILMNKSASTIKKLALELGGNAPFIVFEDADIDAAVEGAMIAKFRNAGQTCVCANRLFVHHAVYDEFAEKLANRVKQLKVGDGFADGVAIGPLINSSSVAKVQEHVDDAVAKGAKVLCGGLLNDEQLFVAPYVLTDMSDDMLVAEEETFGPVAPLFRFKDEAEVLERANDTESGLAGYFYTRSLGRAWRVADALEVGMVGINEGLISTAAAPFGGIKESGLGREGSRHGMDEYMEMKYMLMGGLDS

SEQ ID NO: 85225 - protein, 145 aa, Hyacinthus orientalis
RSWGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIASKG

SEQ ID NO: 85226 - protein, 516 aa, Lactobacillus acidophilus NCFM
MAKNLEDFDKIIVLDFGSQYNQLITRRIRDFGIYSELLPHDLSIEKIKEMNPKGIIFSGGPNSVYDDGALKVDPEIFKLGIPILGICYGMQLMSYDLGGKVERAENKEYGRANITVEDPDSALFKGLPTKQYVWMSHGDLVTQAPEGFEVTASSKNCPIAAIANPDKKFYGIQFHAEVRNSEYGLDILKHFAFDVCGAVANWTMADFIDMQVDEIRKEVGDKKVILGLSGGVDSSVTATLLHKAIGDQLTAIFVDHGMLRKDEGDQVMKALNKDLGVNIIRVNAQERFLNKLKGVTDPEQKRKIIGKEFIEVFNEEAKKLKDVDFLAQGTLYTDVIESGTNTAQTIKSHHNVGGLPEDMNFKLIEPLRKLFKDEVRELGEKLGIPHDLVWRQPFPGPGLGIRVLGEVTEDKLKIVRESDAILREEIKKAGLQEKIWQYFTVLPGIRSVGVMGDGRTYDYTIGIRAVTSIDGMTADFAQIPWDVLGHISDRIVNEVDNVNRIVYDVTSKPPSTIEWE

SEQ ID NO: 85227 - protein, 279 aa, Photobacterium frigidiphilum
QERTDIEVVGINDLIDVEYMAYMLKYDSTHGRFNGTVEVEGGNLIVNGKTVRVTAERNPEDLKWDAINVDVVAEATGLFLTDETARKHITAGAKKVVLTGPSKDATPMFVMGVNDSTYAGQDIVSNASCTTNCLAPIAKVLNDNFGIVSGLMTTVHATTATQKTVDGPSAKDWRGGRGASQNIIPSSTGAAKAVGVVLPEINGKLTGMAFRVPTANVSVVDLTVNLEKGASYEAICAAMKAASEGELKGILGYTEDAVVSTDFNGDTRTSIFDAAAGSH

SEQ ID NO: 85228 - protein, 360 aa, Alkaliphilus metalliredigens QYMF
MKAYLLLEDGTIFEGSAFGSHEEKIGEVVFNTSMTGYQEIFTDYSYAGQTLVMTYPMIGNYGINKEDVESAKPMIRGLVVREFCKGPSNWKSEMTIEDYLIKNNIMGIEGIDTRMLVKHLRDHGTMKGIITKSLDDKMELIAKLKGEAALAKSFTAQVSTPKPYVIPGKGPKIALMDFGVKLNIIRILQSYGCEITILPYDTSADTILKMNVDGIFLSNGPGDPQSLQVAVKNIKKLMQCKPIFGICMGHQLLALASGAQTYKLKYGHRGANHPVKDLMTNKVYMTSQNHGYSVDEETIDEQQFTVTHKNLNDGTVEGLRHKYLPVFSVQYHPEAAPGPQESRYLFDQFLNLMCSEREAV

SEQ ID NO: 85229 - protein, 441 aa, Bacillus pumilus SAFR-032
MNKEQPALKQDIGLFFALSLVIGTIIGSGVFMKPGNVLSYSGSSDIALFAWLLGGILTLAGGLTVAEIGTQIPRTGGLYAYLEEVYGEFWGYLCGWVQIIIYGPAIIGALGLYFGSLLANLFSLSSLWSTTIGIITVLFLCLINIMGTKYGGFVQGLTTIGKLVPIAAIIVFGLWKGNENILMAVNDSIAQMNFGAAILATLFAYDGWILLAALGGEMKNPEKLLPRAMAGGILIVTACYLFINVALLHVLPADQIVQLGENATSTAATMLFGPIGGKVISIGIIISIFGCLNGKVLSFPRVIFAMAERKQIPFANAISRIHPTFKTPWIAVFVQILIAIVFMIVSNPEKLSEVSIFMIYIFYVMAFFAVFKLRKQNKGIERAYSVPLYPLTPIVAIIGSLFVLISTMITDWKSCLISMLIGIAGLPLYYYMKRAHKKAER

SEQ ID NO: 85230 - protein, 279 aa, Photobacterium damselae subsp. damselae
QERNDIEVVGINDLIDVEYMAYMLKYDSTHGRFNGTVEVEGGNLIVNGKTVRVTAERNPADLKWDAINVDVVAEATGLFLTDETARKHIEAGAKKVVLTGPSKDATPMFVMGVNHETYAGQDIVSNASCTTNCLAPIAKVLNDNFGIESGLMTTVHATTATQKTVDGPSAKDWRGGRGASQNIIPSSTGAAKAVGVVLPEVNGKLTGMAFRVPTANVSVVDLTVNLKNGASYETICKAMKDASEGSLKGILGYTEDAVVSTDFNGDTRTSIFDAAAGIA

SEQ ID NO: 85231 - protein, 208 aa, Zea mays
  misc_feature (25)..(25): Xaa can be any naturally occurring amino acid
  misc_feature (136)..(136): Xaa can be any naturally occurring amino acid
MAGEEQRRRWSLQDKTALVTGGTKXHVIVEELAGFGAIIHTCARDEAHLNECLSDWKKKGFQVTGSACDASSWTGREKLMQTVSTLFDAKLSILINNVGGIRSKPTIENTAEDFSFHISTNLESAYHFSQLAHPLXKSSGCGNIVFISSVAGVVSFGVSSIYCATKGAMNQLARNLACEWASDGIRANAIAPAVIATPLAEAVRSNCS

SEQ ID NO: 85232 - protein, 399 aa, Alkaliphilus metalliredigens QYMF
MEIQKIINNGNQYLMSTYGRTPIAFLDGKGSTLTDTEGNEYLDMVAGLAVNSLGHSHPAVVEAIKNQAEKLLHTSNLYWIEGQVALAQKLVQNSFGDKVFFCNSGAEANEAAIKLARKYAYKKYGSHKNEIIAMTGSFHGRTLGTLSITNNPKYQEGYGPLPEGFKFSEFNNLEALKGVITENTCGIIIEPIQGEGGVTPVEATFLKAVKEICVKNDILLIFDEIQCGLGRTGKLFAYENYEIEPDIMTLAKALAGGVPIGAVIATDEVAKAWCPGDHGTTFGGNPLVCAVGLAVIDTILQEKLSDQAKQIGMYFAEKLQGFVNQYSWVKKVKGMGLILGLELEIEGTPIVAEAFKQGVLINCTAGKILRFLPPLIITEKEVDQTINTLAKIFKEMEGV

SEQ ID NO: 85233 - protein, 316 aa, Alkaliphilus metalliredigens QYMF
MNLSPNQKADVLIESLPYIKKFYNEIVVIKYGGSAMVNDELKESIIKDIVLMKYVGMHPVVVHGGGPEITNMLKVFDKESKFVDGLRVTDQATMEITEMVLLGKVCQEIVTRINQNGVRSIGICGKDGSMIKTVPKDPELGLVGGITSIDTDLIKTIIEKGYIPVISPIGCGPAGESHNINADEVAGKLAAALGAKKLMLITDVAGVLRDQHDEASLISDIKTNEIEEYIETGVIKGGMIPKISCCFDAVANGVERAHIIDGRKSHSMLLEIFTDQGVGTMITHGGDQNGNSKNNKQWKSIFNEHLWENAYSLPGR

SEQ ID NO: 85234 - protein, 161 aa, Xanthobacter autotrophicus Py2
MPISVGDKLPNATFRVPTEDGPVPKTTDEIFKGKKVVLFAVPGAFTPTCHKNHLPGYVHEADAIKAKGVDAIAVVSVNDPFVMGAWEKASGADGKIVFLADPDAAFSTALDLTFDGSAAGLGVRSKRYSMVVEDGVVTSLNVEDVPSKADISGAPALLAQL

SEQ ID NO: 85235 - protein, 161 aa, Hyacinthus orientalis
ETGAATVGAGSGNKLLEILNVRVVGSGSKVVVLSHGFGTDQSVWSKIVPFFQRDHRIVLYDLACAGSVNPDHFDFARYTSLDAYVDDLLSIIDALRIDRCSLVAHSFSAMVGVLASIRRPQLFHKLILVSFSPCFLNDRGYYGGFERGEVVKVLEAMNTNY

SEQ ID NO: 85236 - protein, 279 aa, Photobacterium iliopiscarium
QERTDIEVVGINDLIDVEYMAYMLKYDSTHGRFNGTVEVEGGNLIVNGKTVRVTAERNPEDLKWDAINVDVVAEATGLFLTDETARKHITAGAKKVVLTGPSKDATPMFVMGVNDSTYAGQDIVSNASCTTNCLAPIAKVLNDNFGIVSGLMTTVHATTATQKTVDGPSAKDWRGGRGASQNIIPSSTGAAKAVGVVLPEINGKLTGMAFRVPTANVSVVDLTVNLEKGASYAAICAAMKEASEGSLKGVLGYTEDAVVSTDFNGDTRTSIFDAAAGIA

SEQ ID NO: 85237 - protein, 273 aa, Bacillus pumilus SAFR-032
METIGIIGYGSMADMMVQKWLEKEVLNAHQIMIHTRSETDRLLQLKDRHQEINICSLNELSACDVLFICVPPLAVLDVLDQLPSAAKSVHTVSVAAAVTLDKLSKHTTQPISRYIPTLTSAVGTGVSLVAHGETAGEEEKARLHRLLSAFSIVREIEEDQFDAASNLTSSSPGFIAALFEEMAKAAVRNSELSLEEAYEFLTYALLGTGQVLVERGLTFAETVDRVATKGGITGEGAEVIQKQAPQMFDDLYTQTMKKYEQLKSQINEADKHH

SEQ ID NO: 85238 - protein, 279 aa, Photobacterium indicum
VERNDIEVVGINDLIDVEYMAYMLKYDSTHGRFNGTVEVVDGNLVVNGNTVRVTAERNPEDLKWDEIGVDVVAEATGLFLDDTTARKHITAGAKKVVLTGPSKDATPMFVMGVNHATYAGQDIVSNASCTTNCLAPVAKVLNDKFGIESGLMTTVHATTATQKTVDGPSAKDWRGGRGASQNIIPSSTGAAKAVGVVLPELNGLLTGMAFRVPTANVSVVDLTVNLKTAATYEAICAAMKEASEGELKGVLGYTEDAVVSQDFIGEVQTSVFDAKAGVA

SEQ ID NO: 85239 - protein, 641 aa, Gibberella zeae PH-1
MSAQAPQVLSRRANGGSQTSANQNSESTKPANESETPKPTKTKAHNEGEKLTIRRLPPGMTEAEFASILGSEWEVGKGKVDWFCFAEGKISTDPSKPSRPGRAYVHVMRKDDILPLSEAVRNAVWEDAKASFNSPSLIGPPGLDIAIYKKVPSAKKRTDARQGTIDQDPDFMAFLEELANPTPPKETVEGEEGDDFGKSENKVTTTPLIEYLKEKKAKNVKDGTSSKNSKHGQGDSRSGKGKNASKEDDSGRKRGKDTKPDKADRAPKETVKILTKKAASEQNADGSKANAKSQANDANAQEAAPKSRRAGILAAARILQRDLGLSPGSAHRKARQDAAKADADTKTTPEKENQALTDSKASNPEPPASPIKSNETETPAAKGRGAAGNSSKQQQPNRRTRGGKNADKNKERDNEKDNTREKDKNKGGPSGQTQAAPSPPIVLLKKKGNEAESSQPAKPATSTPQPPATQGGRSKTENSAGSFKGASNKGASAQKKPPTVSPDATRGFVKHANPSQGVTEALLKQTLSTFGTITFVEIDKRKGFAYVDFAEHDGLVKAVTASPIIVAQGTVQVLERKDKKPTNANSPAPATTPAAASPAPEKTSGRGRRGRGGGSKVKDSGGNNQGATAATATNSNPTNGG

SEQ ID NO: 85240 - protein, 323 aa, Arabidopsis thaliana
MGEPKDSLALFLCHESESSLNEDDDETIERSDKQEPHFTTTIDDEDYVADLVLKENLRFETLPSKTTSSSDRLIAIDWILTTRTRFGFQHQTAYIAISYFDLFLHKRFIGLQKDETWAMRLLSVACLSLAAKMEERIVPGLSQYPQDHDFVFKPDVIRKTELLILSTLDWKMNLITPFHYFNYFLAKISQDNHSVSKDLVLLRSSDSLLALTKEISFTEYRQFVVAAVTTLLASSSTSSDIRLTREEIANKFGSISWWTSNENENVYLCYQRTLEIEERKHMTPPPEIAVSREPPASGSGAKRRLSFDDSDQSSPPAKRMRRL

SEQ ID NO: 85241 - protein, 120 aa, Magnetospirillum magnetotacticum MS-1
EMVIPSLLPVLTPIVLFFVIQAIAGKSQAFATVGASLLGVILTGLYVAISMTSGGGAWDNAKKFIEDGHHGGKGSDAHKAAVTGDTVGDPYKDTAGPAVNPAIKITNIIALLLLAVLAHA

SEQ ID NO: 85242 - protein, 253 aa, Cytophaga hutchinsonii ATCC 33406
MSITTEAELDGMKKVSEAVAYTLKEMRNYAQPGLTTKQLDDFGGKILMDLGAKSAPYETYGFPGFTCISTNKEFCHGIPSDKKILHEGDLINIDVSAELNGFWSDNGASFVLGKDVNNHQKLIDASRHVLRKAIDHITGGVRISDIGFLMETEAKKHGFKVIKNLTGHGVGRSLHEEPSEIANYRDPFNRKRFTKNSVVAIETFIATASTYAETLEDGWTMVGNRGGFMAQHEHTIVVTDGKPVVLTAMNEIW

SEQ ID NO: 85243 - protein, 90 aa, Picea sitchensis
MALRQFYNEIRGLKVKDVPGYIKPMLSKDFIKTKVTQALDDYNAKYIQTSSIQPLNHIVYGGLLFSYLAALPEERRHLEHEKHKKEHGGH

SEQ ID NO: 85244 - protein, 180 aa, Streptococcus mutans UA159
MAKKENIPNLLTLIRILLIPVFLLLTSVTSSVTWHIIAAIIFAVASLTDYLDGYLARKWKVVTNFGKFADPLADKMLVMSAFIILVGLNLAPAWISAIIICRELAVTGLRLLLVETGGEVLAAAMPGKIKTATQMFSIILLLCHFEFVGTILLYIALFFTLYSGYDYFKGAGFLFKDTFK

SEQ ID NO: 85245 - protein, 427 aa, Neptuniibacter caesariensis
MSASSFAELALCPELQFTLKNLGYEQPTPIQSQAIPLVLRGDDLLAEAQTGTGKTASFALPIIEKLSKNPIDGYRPVRALVLAPTRELAIQVADNTLEYGRDLGMRVISVYGGVPVENQIKRLKRGTDILVATPGRLLDLLRQKAISLEKLEYLVLDEADRMLDLGFIDPIQKIMDYAADDRQTLLFTATADESVEVLAEFYLNNPTKIKVTPRNSTAKQIRQFAYQVDYGQKADILSYLITEGKWGQTLVFVRTKKRVDELTQYLCKEGINAAAIHGEKSQRERVRMLNEFIAGDLHVLVATDVAARGLDIESLPYVVNYDLPNQPEAYVHRIGRTGRAGETGEAVSLVAPAEREFLQRIEKLIKQKIKLRPVPRIEDGKRLEIDDFADKPMKRKPAKAKQQKRKKVESYQPDKSKKAIRPSLFNK

SEQ ID NO: 85246 - protein, 166 aa, Pasteurella multocida subsp. multocida str. Pm70
MANIEKQAGELQEKLIAVNRVSKTVKGGRIMSFTALTVVGDGNGRVGFGYGKAREVPAAIQKAMEKARRNMINVALNEGTLQHPIKGAHTGSRVFMQPASEGTGIIAGGAMRAVLEVAGVRNVLSKAYGSTNPINVVRATIDALANMKSPEMVAAKRGKTVDEILG

SEQ ID NO: 85247 - protein, 165 aa, Rubrobacter xylanophilus DSM 9941
MGGYRVGLGVDVHAFADPAEGRQLVLGGVRIPSERGLRGHSDADVLAHAVTDALLGAAGLEDIGHYFPDTDERFRDADSIWLLREARRIVGGGWEVVNVDAVVICERPRIREHREKMRENLAAALGVEASRVSVRGTTSERLGFTGRGEGIAAQAVCLLERAVGT

SEQ ID NO: 85248 - protein, 196 aa, Alkaliphilus metalliredigens QYMF
MIDNYDSFTYNLTQYLACLKEEVLVYRNDCITLEEIEALKPEVIVLSPGPCTPNKAGICIDVVERFKGEIPILGICLGHQTIGQVFGGNVIRAIEPVHGKVHPIHHKSVGVFSGLKNPLNVTRYHSLVVERESLPQCFEITAETNEGEIMGIRHREYMIEGVQFHPEAILTEMGMELLNNFLIAARVQYEQVKKCI

SEQ ID NO: 85249 - protein, 378 aa, Oryza sativa Japonica Group
MARRSAPLLQRLLSPTPSPSPSPPHPLAAAAVSRRTVTYMPRPGDGAPRAVTLIPGDGIGPLVTGAVRQVMEAMHAPVYFESYEVRGDMPTVPPEVIDSIRRNKVCLKGGLATPVGGGVSSLNVQLRKELDLYASLVNCFNLPGLPTRHDNVDIVVIRENTEGEYSGLEHEVVPGVVESLKVITKFCSERIAKYAFEYAYLNNRKKVTAVHKANIMKLADGLFLESCREVATKYPGIQYNEIIVDNCCMQLVAKPEQFDVMVTPNLYGNLVANTAAGIAGGTGVMPGGNVGQDHAVFEQGASAGNVGNVKVVEQKKANPVALLLSSAMMLRHLQFPSFADRLETAVKRVIAEGKYRTKDLGGSSTTQEVTDAVIAHLD

SEQ ID NO: 85250 - protein, 513 aa, Kineococcus radiotolerans SRS30216
MSPARVTPAENPLRDPRDRRLPRIAGPCGMVMFGVTGDLARKKLMPAIYDLANRGLLPPGFALTGFARRDWVDQDFGKIVYDSVRQHARTPFRESVWAQLAEGFRFVPGEFDDDEAFDQLAATVADLDRVRGTGGNHAFYMSIPPKFFPVVAKQLARSGLSAQHGDQWRRVVIEKPFGRDLKSARELNAVVEDVFPPDSVFRIDHYLGKETVQNILALRFANQMFEPLWNANHVDHVQITMAEDIGIGGRAGYYDGIGAARDVIQNHLLQLLALTAMEEPVSFEAADLRAEKAKVLSAVRPLKDLARSTARGQYASGWQGSEQVKGYLDEDGIPASSTTETFAAIELEIDTRRWAGVPFYLRAGKRLGRRVTEIAVVFKRAPHLPFELTATEELGQNALVIRVQPDEGITMRFGSKVPGTAMEVRDVTMDFGYGHAFTESSPEAYERLILDVLLGDPPLFPRHEEVELSWKILDPITAFWAKNGKPEPYASGTWGPPSAHAMLERTGRQWRRP

SEQ ID NO: 85251 - protein, 280 aa, Thermus thermophilus HB27
MAAKKDYYAILGVPRNATQEEIKRAYKRLARQYHPDVNKSPEAEEKFKEINEAYAVLSDPEKRRIYDTYGTTEAPPPPPPGGYDFSGFDVEDFSEFFQELFGPGLFGGFGRRSRKGRDLRAELPLTLEEAFHGGERVVEVAGRRVSVRIPPGVREGSVIRVPGMGGQGNPPGDLLLVVRLLPHPVFRLEGQDLYATLDVPAPIAVVGGKVRAMTLEGPVEVTIPPRTQAGRKLRLRGKGFPGPAGRGDLYLEVRITIPERLTPEEEALWKKLAEAYYARA

SEQ ID NO: 85252 - protein, 151 aa, Alkaliphilus metalliredigens QYMF
MKEKTYYKPSEKELKEKLTDIQYRVTQEGATERPFKNEYWDHQEDGLYVDISSGEPLFTSQDKFDSSCGWPSFTKTVEEERIVEKKDRGHNMIRTEVKSKAGDSHLGHVFPDGPKEAGGLRYCINSASLRFIPVSELENEGYGEYVKLFEK

SEQ ID NO: 85253 - protein, 78 aa, Candidatus Blochmannia floridanus
MSIVEEKVKTIIAEQLGVKQEEVVNHASFVDDLGADSLDTVELVMALEEEFDIEIPDEEAEKITTVQAAIDFIHTNQK

SEQ ID NO: 85254 - protein, 280 aa, Photobacterium leiognathi
ERNDIEVVGINDLIDVEYMAYMLKYDSTHGRFNGTVEVEGGNLIVNGKTVRVTAERNPEDLKWDAINVDVVAEATGLFLTDETARKHITAGAKKVVLTGPSKDATPMFVMGVNQDTYAGQDIVSNASCTTNCLAPIAKVLNDKFGIESGLMTTVHATTATQKTVDGPSAKDWRGGRGASQNIIPSSTGAAKAVGVVLPELNGKLTGMAFRVPTANVSVVDLTVNLKNGASYEAICAAMKEASEGELKGVLGYTEDQVVSQDFIGETQTSVFDAKAGIALT

SEQ ID NO: 85255 - protein, 273 aa, Photobacterium lipolyticum
DIEVVGINDLIDVEYMAYMLKYDSTHGRFNGTVEVEGGNLIVNGKTVRVTAERNPEDLKWGEIGVDVVAEATGIFLTDETARKHITAGAKKVVLTGPSKDATPMFVMGVNHETYAGQDIVSNASCTTNCLAPIAKVLNDKWGIESGLMTTVHATTATQKTVDGPSAKDWRGGRGASQNIIPSSTGAAKAVGVVLPELNGKLTGMAFRVPTANVSVVDLTVNLKEAASYAEICAAMKAASEGEMAGVLGYTEDAVVSQDFIGEVQTSVFDATAG

SEQ ID NO: 85256 - protein, 281 aa, Photobacterium phosphoreum
AQERTDIEVVGINDLIDVEYMAYMLKYDSTHGRFNGTVEVEGGNLIVNGKTVRVTAERNPEDLKWDAINVDVVAEATGLFLTDETARKHITAGAKKVVLTGPSKDATPMFVMGVNDSTYAGQDIVSNASCTTNCLAPIAKVLNDNFGIVSGLMTTVHATTATQKTVDGPSAKDWRGGRGASQNIIPSSTGAAKAVGVVLPEINGKLTGMAFRVPTANVSVVDLTVNLEKGASYAAICAAMKAASEGELKGILGYTEDAVVSTDFNGDTRTSIFDAAAGIAL

SEQ ID NO: 85257 - protein, 395 aa, Xanthobacter autotrophicus Py2
MRRARAVPATSLANLTLLPRYRPAAKPERSMGFKCGIVGLPNVGKSTLFNALTQTAAAQAANYPFCTIEPNVGDVAVPDPRLDTLAEIAGSGAIIPTRLTFVDIAGLVRGASKGEGLGNQFLANIRECDAIAHVVRCFEDGDVTHVEGKISPVDDIETIETELMLADLESLEKRAAALEKKAKGADKEAKETLDLMNRALVLLREGKPARLAQVKPEEEKLFSQLGLMTAKPVLYVCNVEEASAKEGNSLSAQVFERAKLEGAKAVVVSAKIESEIAVLPPEEQKDYLEAIDLDEPGLNRVIRAGYDLLQLLTYFTVGPKEARAWTITAGTKAPAAAGVIHSDFEKGFIRAETVAYDDYVKFKGEGGAREAGRFRLEGKEYVVADGDVLHFRFAN

SEQ ID NO: 85258 - protein, 220 aa, Hyacinthus orientalis
ADLNIAIGTHHEVSHPGALKAALAEFISTLIFVFAGQGSGIAFSKLSGGGPATPAGLISAALSHAFALFVAVSVGANISGGHVNPAVTFGAFLGGNITLFRGLLYWVAQLLGSTAACLLLRFSTGEETGSFGLSGVSVWNALVLEIVMTFGLVYTVYATAIDPKKGSLGTIAPIAIGFIVGANILAGGAFDGASMNPAVSFGPPLVSWEWPNHWVYWAGP

SEQ ID NO: 85259 - protein, 993 aa, Delphinium 'MagicFountains dark blue'
MKSIFKKLHIGSSSRSSSSTNHDPNRSNELSSSQSLPATTSDHGTNSVQFTTAPTPLTSSYPGIPVSTPATLASDRTDYFSSEEEFQLQLALAISASSNSEFREDPDKDQIRAATLLSLDRNRNDLRRQENESAESLSRRYWDYNVLDYMEKVVDGFYDIYGLSSNPSSQGKMPSLVDIQRDHGDPNFEVVMVNRAVDPALVELEQIAHCIVLDCPSSNVGLLVQRLADLVTEHMGGPVMDANIMLARWMERISNLRTSLHTSVIPIGSVNIGLSRHRALLFKVLADNVGVPCRLVKGSHYTGIDDDAVNIIKLENQREFLVDLMAAPGTLIPADFLSTNDSSGNSYNPRLSETLTSWATQESEVGRSRGETSFGEHNGGDRKSAINYETALDRKSSFDKVPEPSVPIASSGLPFVSFGNGYSEDSKGVDSAKQLYIGSSFPYKGNQEGTSVGDVFKTFDAPPYTQDNVDSKALFADLNPFQMVGVGKDSVKSKPTESDGNNLQRQKERLNLGPGRPPLPLVWKNRSANEVPRTKQYGFVEGPFPKNNQEDRGYNTSIPLSSSGNLEKLYPNVNAAEFSGVSSVARKSIGDGSSSHHGNSTSESSANQHNRLHADRVGNTDTTQTSNQFRDENHHQRDGEILRNSIVDETKECEKNFLAEHDRRKYTHDRYMGGRVIAMDTGGNSSSVDSGRSRPDPMLDDVAELEIPWEDLSIGERIGLGSYGEVYRADWNGMEVAVKKFLDQDFYGDALDEFRSEVRIMRRLRHPNIVLFVGAVTRPPNLSIVSEFLPRGSLYRILHRPNCQIDEKRRIRMALDVAMGMNCLHTSIPTIVHRDLKSLNLLVDDNWNVKVCDFGLSRLKHNTFLSSKSTAGTPEWMAPEVLRNEPSNEKCDVYSFGVILWELATLRLPWTGMNQMQVVGAVGFQNRRLDIPKELDPLVATIIRECWQTDPNLRPSFSQLTAALQSLQRLLIPSHQDQQSFPLPQEISVSSTP

SEQ ID NO: 85260 - protein, 280 aa, Photobacterium phosphoreum
ERTDIEVVGINDLIDVEYMAYMLKYDSTHGRFNGTVEVEGGNLIVNGKTVRVTAERNPEDLKWDAINVDVVAEATGLFLTDETARKHITAGAKKVVLTGPSKDATPMFVMGVNDSTYAGQDIVSNASCTTNCLAPIAKVLNDNFGIVSGLMTTVHATTATQKTVDGPSAKDWRGGRGASQNIIPSSTGAAKAVGVVLPEINGKLTGMAFRVPTANVSVVDLTVNLEKGASYEAICAAMKAASEGELKGILGYTEDAVVSTDFNGDTRTSIFDAAAGIALN

SEQ ID NO: 85261 - protein, 526 aa, Vibrio vulnificus YJ016
MSLIGWAHPLSRIQAHNKYLVFKGKMMVIPENSSIVIFGASGDLTYRKLIPALYHLYASKQLPENFAILGVSRTEYSDESYREKLKRSLQEMEKTEPAILDSFIDHLHYQAINTSDTQDYAKLVVRLDELAAQYQFEQRNTLFYLATPPSLYSVIPSSLAHHGLNSEEDGWKRLIIEKPFGYDLASARQLDKEIHDCFQEHQIYRIDHYLGKETVQNLLVFRFSNAMFEPLWNRNFIDYVEITGAEFLGVEERGGYYDGSGAVRDMFQNHLLQVLAMVGMEPPAQINADSMRDEVVKVLQCLKPLEEDDLRNNLVLGQYTASDVRGQHLLGYREENGVADDSRTETYIGLKAYINNWRWNGVPFYVRTGKRLPTRVTEVVIHFKQTPHPVFGQNAPENKLIIRIQPDEGIQMSFGLKEPGAGFKAKEVKMNFHYASLQETQMLTAYERLLLDALNGDATLFARSDAVEACWKYVQPILDFKQDPQALFGYACGTWGPKESDDLLQRDDRAWRFPCKNLTDTDYCEL

SEQ ID NO: 85262 - protein, 280 aa, Photobacterium rosenbergii
ERNDIEVVGINDLIDVEYMAYMLKYDSTHGRFNGTVEVEGGNLIVNGKTVRVTAERNPADLKWDEIGVDVVAEATGIFLTDETARQHITAGAKKVVLTGPSKDATPMIVMGVNQDTYAGQDIVSNASCTTNCLAPIAKVLNDKFGIESGLMTTVHATTATQKTVDGPSAKDWRGGRGASQNIIPSSTGAAKAVGVVLPELNGKLTGMAFRVPTANVSVVDLTVNLKTGASYEAICAAMKEASEGELKGVLGYTEDQVVSQDFIGEVQTSVFDAKAGIALT

SEQ ID NO: 85263 - protein, 244 aa, Glycine max
  misc_feature (182)..(182): Xaa can be any naturally occurring amino acid
METDRPDGRTPNQLRPLAYSCSILHRAHGSASWAQGETKVLAAVYGPKAGTKKNENPEKASIEVIWKPKTGQIGKMEKEYEMILKRTLESICIRTIYPNTTTSVIVQVVHDDGALLPCAINAACAALVDAGIPLKHLAVAICCSVTDSGCIILDPTKDEEEKMKAFANLVFPNTIVSVLPEXRSLQVGSEPMENGIMTSVTQGAMSVNDYLHCLERGRAACASLSEFVRKNIGTKSTSEPSKAG

SEQ ID NO: 85264 - protein, 119 aa, Streptococcus pyogenes
MDKIVLEGCRFYGYHGAYKEEQTLGQIFLVDLELSVDLQAASLSSQLTDTVHYGMVFDSVRQLVEGEKFILIDGLAGAICEQLFNEFPPIEAIKVAIKKENPPIAGHYKAVGIELERQR

SEQ ID NO: 85265 - protein, 539 aa, Streptococcus mutans UA159
MLTVSDISLRFSDRKLFDNVNIKFTAGNTYGLIGANGAGKSTFLKILSGDIEPTTGHVSLGPEERLSILRQNHFDYEEERAIDVVIMGNQDLYNIMKEKDAIYMKPDFSDEDGVRAAELEGQFVELNGWEAESEASQLLQNLNIPEELHYQNMSELTNGDKVKVLLAKALFGKPDVLLLDEPTNGLDIQSINWLEDFLIDFENTVIVVSHDRHFLNKVCTHMADLDFGKIKLYVGNYDFWKESSELAAKLQADRNAKAEEKIKELQEFVARFSANASKSKQATSRKKMLDKIELEEIVPSSRKYPFIKFQAEREIGNDLLSVENLSVKIDGESILDNISFTLNPGDKTAIIAQNDIQSTALIRALMGDIDYEGTIKWGVTTSQSYLPKDNTNDFASGESILEWIRQFANKEDDDNTFLRGFLGRMLFSGDEVNKSVSVLSGGEKVRVMLAKLMLLKSNVLVLDDPTNHLDLESISSLNDGLKDFKESIIFASHDHEFIQTLANHILVISKNGVIDRIDETYDEFLENEEVQAKVAQLWQ

SEQ ID NO: 85266 - protein, 333 aa, Gibberella zeae PH-1
MTGSPTCVLMILKTTLFGTCSRFSVLLAERLTQTMLESTVFRGEANFVWKCKNCKRESSASVKSGPAAYEQTEPAKAQKIIEFDCRGLEFVEFKAEGEWLAEGAETSTKFTAIDLEEGEWFEYDEKSNEEVSINEIKWEMHQQSFKSLIMSLAEIPGTIDFLTDAAHLLRTTAPETSAHLMSHRGNLLSQFGVSPSDVQRQHVCGGCGLIMIPGQETILKLEARKSMRPKTKGKKSGINSTPKDNNEGPCKILHCDNCQRDTKIVFPAPAPAVRRKTAQNKVKKTVAPVEPPKQTSNASSKKRARNRKAGLQALLSGQKQQSANPLSLSHFMK

SEQ ID NO: 85267 - protein, 111 aa, Picea sitchensis
MEIKKAVHACILLVMLFGLLNLVVCSVEDEINGFSLGQPQTLHKDRHLLALNCGSACGKRCALASVKDRCLKYCGICCSSCQCVPPGTYGNKNACPCYRDLKNAKGKPKCP

SEQ ID NO: 85268 - protein, 119 aa, Alkaliphilus metalliredigens QYMF
MDKIILKNLGFYGYHGVLPEENRLGQKFFVDIELYADLKTAGNSDDVKDTINYAEVYDVTKDIVENQTFQLIEALAETIAAKVLKDFSRVNEILVTIRKPEAPVNGIYDYFGVEIRRKR

SEQ ID NO: 85269 - protein, 405 aa, Vibrio parahaemolyticus RIMD 2210633
MAGVLGMILAGGEGSRLRPLTESRSKPSVPFGGSYRLIDFALNNFVNADLMRIYVLTQFKSQSLFHHLKKGWNINGITDRFIDPIPAQMRTGKRWYEGTADAIYQNLRFMELEEPDQVCIFGSDHIYKMDIKQMLNFHTEKKASLTVSALRMPLKEASQFGVIEVDAEGRMIGFEEKPANPKSIPGEPDFALVSMGNYVFEAQVLFSELVEDADNEASSHDFGKDIIPKMFPRGDVFVYDFSTNRISGEKEEVYWRDVGTIDAYWQAHMDLLEKDAPFSLYNRKWPLHTYYPPLPPATFTDSDNGRVQIIDSLVCNGSYVRGSRIEKSVLGFRSNIASACDISECILLGDVKIGEGCVLRRVIVDKDADIAPGTQIGVNLQEDKKHFHVSEEGIVVIPKGARVGY

SEQ ID NO: 85270 - protein, 261 aa, Kineococcus radiotolerans SRS30216
MSRTPLIAGNWKMVLDHQQGTLLVQKLDWTLKDAKHDYSAVEVAVLPSHTSLRTVQTLIEGDKLSIALGAQDVSEHDSGAYTGEVSAAMLAKLGVTYVAVGHSERRQYHGETDATVRAKAAKALAAGLTPIVCVGEALEIRKAEQHVEFTVGQVTQALTGLTAEQAAGLVLAYEPVWAIGTGEVATPEDAQEVCAALREAVAELFDRATADAVRVLYGGSVKPASIAAIMRQPDVDGALVGGASTDAGDFAAIVRFRDHPA

SEQ ID NO: 85271 - protein, 412 aa, Kineococcus radiotolerans SRS30216
MKTLDDLETQLGGFAGRRVLVRSDLNVPLDHDRRDGAGQPVITDDGRLRASVPTLRRLLDAGARVVVTAHLGRPKGAPEAKYSLAPVHARLAELLPGVEVGFCPVTVGAQATAAVDALADGELLLLENIRFNAGETSKDDEEREAFADELAALADAFVSDGFGAVHRKHASVYDVALRLPHAAGGLVATEVEVLQRLTAHPERPYAVVLGGSKVSDKLGVIDNLLGSLLGEGDRLLVGGGMVFTFLKAQGYEVGKSLLETDQLDRVAGYVRTAREKGVELVLPTDVVAATAFAADAEHDVVAVDAIPADRLGLDIGPDSGAAFAARLADARTVFWNGPMGVFEMEPYSHGTRAVAQALVDGGAFSVVGGGDSAAAVRTLGFADERFGHISTGGGASLEYLEGKHLPGLDVLS

SEQ ID NO: 85272 - protein, 362 aa, Bacillus coagulans
DPEGNSYMDMLSAYSAVNQGHRHPKIIEALKNQADKVTLTSRAFHNELLGPWTKRMAKLTKKDKVLPMNTGVEAVETAIKAARRWAYQVKGVTENQAEIIAADGNFHGRTLNAISLSNDPDATKNYGPFVPGINKVSYGDINAIEKAITENTAAIILEPIQGEAGIIIPPEGYLKKVRELCSERNILFIADEVQTGFARTGKMFACEWENVEPDIYVMGKALGGGVFPISAIAANNEIMDVFTPGSHGSTFGGNPLACAVSMAAIDVIEEENLVNKSLESGKYFADKLRAINFEGIKEVRARGLFIGMEFHQPVRAICEKLKDKGILCKETHVNTIRFAPPLLITKNEMDWAIQRIEEVLTN

SEQ ID NO: 85273 - protein, 334 aa, Kineococcus radiotolerans SRS30216
MTTRVGINGFGRIGRNFFRAALAQNADFEIVAVNDLTDAKALAHLLKHDSILGKLAEDVRVEGDSIVVGSRTIKVLADRDPANLGWGDLGVDVVVESTGFFTDGEKAKAHLTAGAKKVVVSAPATNDDVTVVMGVNDSDYDGSKHAIISNASCTTNCLAPLAKVLDDAFGIERGLMTTVHAYTADQNLQDGPHKDLRRARAAALNIVPTSTGAAKAIGLVLPQLKGKLDGYALRVPVPTGSATDLTVTVGREVTVDEVNAAYRAAADGPLKGYLTYSDEPLVSSDIVTDPSSCIYDSGLTKVIGNQVKVVGWYDNEWGYSNRLVDLVTLVGASL

SEQ ID NO: 85274 - protein, 455 aa, Prochlorococcus marinus str. AS9601
MYSLLAELSAHDLEVAETLIGVIRFLLIFLAARALAEVLVRLSLPTIVGELLAGVVIGASGFHLLIPPSAGTELNEGLVNVISSLASIPPEAVPDVYFESFPSLQAVATLGLYALLFLTGLESELEELVAVGAQAFTVAMAGVILPFAFGTLGLMFIFQVDLIPAVFAGASMTATSIGITASVFGELGYLKTREGQIVIGAAVLDDILGIVILAVVVALAAGGSLEIAPIIKLVAAAVVFVIAAIALSRTAAPGFDWLLDRLKAPGAVVVASFVILVLCCFVATAIGLEAALGAFAAGLILSSSKNNHAIQQSVLPLVSLFATIFFVLVGAGMDLSVINPLDPTSRSALVVAGFLLVVAIIGKIAAGWVFSSDKPTNRLVVGLGMMPRGEVGLIFLGLGTSAKLLTPSLEAAILLMVIGTTFLAPVLLRIVLKDKPPNDGNKISDDVAADPVGLL

SEQ ID NO: 85275 - protein, 558 aa, Arabidopsis thaliana
  misc_feature (66)..(66): Xaa can be any naturally occurring amino acid
  misc_feature (548)..(548): Xaa can be any naturally occurring amino acid
MASRRVLSSLLRSSSGRSAAKLVNRNPRLPSPSPARHAAPCSYLLGRVAEYATSSPASSAAPSSAXPAKDEGKKTYDYGGKGAIGRVCQVIGAIVDVRFEDQEGLPPIMTSLEVQDHPTRLVLEVSHHLGQNVVRTIAMDGTEGLVRGRKVLNTGAPITVPVGRATLGRIMNVLGEPIDERGEIKTEHYLPIHRDAPALVDLATGQEILATGIKVVDLLAPYQRGGKIGLFGGAGVGKTVLIMELINNVAKAHGGFSVFAGVGERTREGNDLYREMIESGVIKLGEKQSESKCALVYGQMNEPPGARARVGLTGLTVAEYFRDAEGQDVLLFIDNIFRFTQANSEVSALLGRIPSAVGYQPTLASDLGALQERITTTKKGSITSVQAIYVPADDLTDPAPATTFAHLDATTVLSRQISELGIYPAVDPLDSTSRMLSPHILGEEHYNTARGVQKVLQNYKNLQDIIAILGMDELSEDDKLTVARARKIQRFLSQPFHVAEIFTGAPGKYVDLKENINSFQGLLDGKYDDLSEQSFYMVGGIDEVVAKXAEKIAKESAA

SEQ ID NO: 85276 - protein, 190 aa, Candidatus Blochmannia floridanus
MFKYYGVFNIPMYLTLFRIIMVPCFVAVFYWPIYWSPMLCTLIFFIAAITDWFDGFLARRWNQTSRIGGFLDPIADKIMIITALILISEHFHVWWMTLPISSIIIREILISSLRECIARVDNKNNISVIWLSKVKTFAQMLALIALLCRLNEWTVIMGVISLYTAMLLTLWSMCYYVYSVSSILLQYKLK

SEQ ID NO: 85277 - protein, 404 aa, Listeria innocua Clip11262
MGLVVLKFGGTSVSTVDKIGKTADQAIYEKKQGNKVIVVVSAMGKSTDKLVAMAEEISEAPDKREMDMLLSTGEQITIALLAMTLKEKGHDAISYTGWQAGIETEAVHSNARIADIDSARIESALEAGQIVIVAGFQGITTDGEITTLGRGGSDTTAVAIASALKAEKCAICTDVVGVFTTDPRYVKKAQKLEQLTYDEMLELANLGAGVLHPRSVEYAKNFRIPLEVRASHELEPGTMIEEDLTMENTKVVRGIAFEDQITRVTIHWKQKEAMRVSKVFTKLAENNIDVDIIIQGITGLGHGNLSFTIKTSELLATLAVLEESKELLQIEKLESEQELAKVSIVGSGMVSNPGVAAKMFEALTENNIPIKMISTSEIKVSTVVPARKMVEAAQVLHDQFELDK

SEQ ID NO: 85278 - protein, 375 aa, Xanthobacter autotrophicus Py2
MRIRAAVLRASPVSKPYGQTRPLSIETVELAPPQAGEVLIKIAAAGLCHSDLSVINGDRPRQLPMVLGHEASGVVVEPGPGVTDLAPGDHVVMSFVPTCGTCPSCLDGRAQMCGPGQAANGAGTLLGGGRRLTCDDGTDAYHLCGISGFGEYAVISRRSIIKIDPEMSLVDAALFGCAVMTGVGAIVNTCGVRPGQSVAVVGLGGVGLSAVMGAVAAGAEQIVALDLSPAKLDIARSLGATDTFLANDPDVVDAVKAATKGGVDHAVEMAGSAPAFELAYKITRRGGTTATGGLANPNARVSLPPVHLVAEERTIKGSYMGSCVPPRDIPRFMALYQRGKLPVNRLLSSTGPLDEINEGFDRLDRGEVVRHVIVY

SEQ ID NO: 85279 - protein, 482 aa, Vibrio vulnificus YJ016
MKGDIGVIGLAVMGQNLILNMNDHGFKVVAHNRTAAKVDEFLEGPAKGTNIIGAYSLEELVEKLETPRKVMLMVRAGAVVDQFIDALVPLLDKGDIIIDGGNTNYPDTNRRVAALREKGIHFIGTGVSGGEEGARFGPSIMPGGAPEAWEAVKPIFQGISAKTDAGEPCCDWVGNDGAGHFVKMVHNGIEYGDMQLITEAYQFMKDGLGMSADEMQAVFADWNKTELDSYLVEITADILGYKDEDGEPLVEKILDTAGQKGTGKWTGINALDLGIPLTLISESVFSRCLSALKDQRVEAEKLFGKTITPVEGDKQEWVDALRQALLASKIISYAQGFMLMREASNENGWDLNYGNVALMWRGGCIIRSAFLGNIRDAYEANPDLAFLGSDDYFKGILQNSLVAWRKVAAKSLEAGIPMPCTTSALTFLDGYTTARLPANLLQAQRDYFGAHTYERIDRERGEFFHTNWTGTGGNTASTTYDV

SEQ ID NO: 85280 - protein, 242 aa, Enterovibrio coralii
EGGNLIVNGKTVRVTAERNPTDLKWDEVGVDVVAEATGIFLTDETARQHITAGAKKVVLTGPSKDATPMFVMGVNHNSYEGQDIVSNASCTTNCLAPIAKVLNDKWGIESGLMTTVHATTATQKTVDGPSAKDWRGGRGASQNIIPSSTGAAKAVGVVLPELNGKLTGMAFRVPTANVSVVDLTVNLKEAATYAEICAAMKAASEGEMAGVLGYTEDEVVSQDFIGETQTSVFDAKAGVALT

SEQ ID NO: 85281 - protein, 406 aa, Candidatus Blochmannia floridanus
MFKSMIMAPPDPILGLSKIYHSDTKKNKINLGIGVYIEKFHAAPILESVKQAEDLLLKKEISKNYLAIEGSNDFNNANQTLLFGPNDSIISKNRIRTVQAPGGTGALRIAAECIAKYDNTINKKRRIWISEPSWVNHKNIFFAAGLEVCTYPYYQKSTHSIEFDKLIDTFNNIVKPGDIVLLHGCCHNPTGMDPTIEQWKMLSECAEKNRWIPLFDLAYQGFDNGLQEDLIGLHMFCKNNPELIVCNSYSKNFGLYNERVGACTIITENNNHADCVLSQLRATIRAIYSNPPAHGAAIVSTILQNKTLRFIWEKELKNMRDHIKNMRKLLFNTLNKYKNSKVINQDFSFINNQKGMFAYIGLNSNQVIKLREELGIYLVDSGRLNLAGLSHKNIDYICNAICNLYI

SEQ ID NO: 85282 - protein, 393 aa, Chlamydophila pneumoniae TW-183
MIFEFRFPKIGETSSGGSIVRWLKNLGDHVARDEPLIEVSTDKIATELPSPKAGRLVRFCVNEGDEVASGDVLGLIELEEISEADDESTSCPLTSCETKSEAGSSSSSVWFSPAVLSLAQREGIGLDNLQKIAGTGKGGRVTRQDLEAYISESQQVSIPEIFQGEVNRIPMSPLRRAIASSLSKSSDEVPHASLVVDVDVTDLMHLISGERQRFLDTHGVKLTITSFIVQCLAQTLRQFPLLNGSLDGTTIVMKKSVNVGVAVNLNKEGVVVPVIHNCQDRGLVSIAKALADLSSRARLNKLDPSEVQDGSVTVTNFGMTGALIGMPIIRYPEVAILGIGTIQKRVVVRDDDSLAVRKMVYVTLTFDHRVLDGIYGSEFLTSLKNRLESVTMG

SEQ ID NO: 85283 - protein, 303 aa, Enterovibrio norvegicus
GFGRIGRFVFRASVERNDIEVVAINDLIDVDYMAYMLKYDSTHGRFNGTVEVVDGNLVVNGKTVRVTAERNPTELQWDAVGVDVVAEATGIFLTDETARQHITAGAKKVVLTGPSKDATPMFVMGVNHASYAGQDIVSNASCTTNCLAPIAKVLNDKWGIESGLMTTVHATTATQKTVDGPSAKDWRGGRGASQNIIPSSTGAAKAVGVVLPELNGKLTGMAFRVPTANVSVVDLTVNLKEAATYAEICAAMKAASEGEMAGVLGYTEDEVVSQDFIGEVQTSVFDAKAGVALTDKFVKVVSW

SEQ ID NO: 85284 - protein, 440 aa, Zea mays
MEEEKQVMEGAATAARRRLVIGVGFWVQGFRLFPWLGVNFFLKDGMGVAASSLQILQASANLPMVAKPLIGLLSDAVPIRGHRRLPYVAIGALLQAISWLAIALWQDISLQVLTIFLLLSNFGASICEVANDAIVAESGKKAASSSGSGQLQSFAWMFGSSAGALGNLLGGIALSYFSPKVMFLFFAILLLLQFFTTVAIPEGSLKLPKVATSTNLSALTSIRKQVKELSCALSMPEMFWSIIWFTASYAAIPFLLGTMFFYQTEVLRLDSSVIGLSKVFGQVALLAWSMSYNKYFKTMSARKLLSVLQFVTALVMLSDVLFVQGVYRKVGIPDSIYTIVFSGLLEGLMFFKVLPFSVHVAKLCPAGCEGSVMAFVMSALALATIVSGYLGVALAAFMGVSGDDFSALPACLLIEAACTMLPLCCSSLIKERREKEKKQE

SEQ ID NO: 85285 - protein, 237 aa, Vibrio aerogenes
IVNGKTIRVTAERNPADLKWNEIGVDVVAEATGLFLTDETARKHIEAGAKKVVLTGPSKDATPMFVMGVNHASYAGQDIVSNASCTTNCLAPIAKVLNDNFGIESGLMTTVHATTATQKTVDGPSAKDWRGGRGASQNIIPSSTGAAKAVGKVLPELNGKLTGMAFRVPTANVSVVDLTVNLEKAASYDDIKAAMKKASEGELAGILGYTEDAVVSTDFNGDTRTSIFDGAAGIALT

SEQ ID NO: 85286 - protein, 544 aa, Arabidopsis thaliana
MASLQLYGVKTPGLALSSKRLEFASKGACFSVTLPSSSAVFRDVEHSCRNIGLRVSCEALRVDLLQRKEPETCDSSGTGKELTCVMKFGGSSVESAERMKEVANLILSFPDERPVIVLSAMGKTTNKLLKAGEKAVTCGVTNVESIEELSFIKELHLRTAHELGVETTVIEKHLEGLHQLLKGISMMKELTLRTRDYLVSFGECMSTRLFSAYLNKIGHKARQYDAFEIGFITTDDFTNADILEATYPAVSKTLVGDWSKENAVPVVTGYLGKGWRSCAITTLGRGGSDLTATTIGKALGLREIQVWKDVDGVLTCDPNIYPGAQSVPYLTFDEAAELAYFGAQVLHPLSMRPARDGDIPVRVKNSYNPTAPGTVITRSRDMSKAVLTSIVLKRNVTMLDIASTRMLGQYGFLAKVFTTFEDLGISVDVVATSEVSISLTLDPAKLWGRELIQRVNELDNLVEELEKIAVVKLLQRRSIISLIGNVQKSSLILEKVFQVFRSNGVNVQMISQGASKVNISLIVNDEEAEQCVRALHSAFFETDP

SEQ ID NO: 85287 - protein, 199 aa, Candidatus Blochmannia floridanus
MQLKRVAEAKLPTFWGDFLIIGFKENQTEHNHIALTYGDLTGSNPVLTRIHSECLTGDALFSSRCDCGIQLSTALRYITEEGQGILIYHRQEGRNIGLLNKIRAYSLQDHGADTVEANQCLGFNADERDFTVCADILKLLNIQTIRLLTNNPQKIEILNKSHIIVTERVPLIVGRNPKNSKYLDTKALKLGHLFSSYYK

SEQ ID NO: 85288 - protein, 493 aa, Zea mays
MVLSHGVGGSDESVHSTFASRYVRTSLPRYRMPEQSIPKEAAYQIINDELMLDGNPRLNLASFVTTWMEPECDKLIQASVNKNYVDMDEYPVTTELQNRCVNMIAHLFNAPLGDAETAVGVGTVGSSEAIMLAGLAFKRRWQNKMKAAGKPCDKPNIVTGANVQVCWEKFARYFEVELKEVKLSDGYYVMDPQKAVDMVDENTICVAAILGSTLNGEFEDVKLLNDLLTKKNAETGWDTPIHVDAASGGFIAPFLYPELEWDFRLPLVKSINVSGHKYGLVYAGIGWCIWRTKEDLPEELIFHINYLGADQPTFTLNFSKGSSQVIAQYYQLIRLGFEGYKNIMENCQENATVLKQGLEKTGKFNIVSKDNGVPLVAFSLKDSSRHSEFEISDFLRRFGWIVPAYTMPPDAQHVTVLRVVIREDFSRTLAERLVLDIEKVLHELNALPARVPSGDLAALAAAESSEREMEKQRQVISLWKRAVLAKKKTNGVC

SEQ ID NO: 85289 - protein, 159 aa, Streptococcus mutans UA159
MKVKLITVGKLKEKYLKDGIAEYCKRLKRFTKFELEELPDEKIPNNASQAQNTYILEKEGQRILNKISNREFVIVLAIEGKQFSSEKFSQLLSATMLKGYSDLTFVIGGSLGLSQEVKKRASILMSFGLLTLPHQLMRLVFVEQIYRAFMIQEGSPYHK

SEQ ID NO: 85290 - protein, 339 aa, Brassica napus
  misc_feature (46)..(46): Xaa can be any naturally occurring amino acid
  misc_feature (136)..(136): Xaa can be any naturally occurring amino acid
MAGGKIKIGINGFGRIGRLVARVVLQRDDVELVAVNDPFITTEYMXYMFKYDSVHGQWKHNELKVKDEKTLLFGEKPVTVFGIRNPEDIPWGEAGADFVVESTGVFTDKDKAAAHLKGGAKKVVISAPSKDAPMFXVVGVNEHEYKSNLDIVSNASCTTNCLAPLAKVINDKFGIVEGLMTTVHSITATQKTVDGPSMKDWRGGRAASFNIIPSSTGAAKAVGKVLPQLNGKLTGMSFRVPTVDVSVVDLTVRLEKAATYDQIKKAIKEESEGKLKGILGYTEDDVVSTDFIGDSRSSIFDAKAGIALSDNFVKLVSWYDNEWGYSTRVVDLIVHMSKA

SEQ ID NO: 85291 - protein, 292 aa, Vibrio aestuarianus
GRFVFRAAQERNDIEVVGINDLIDVDYMAYMLKYDSTHGRFNGTVEVEGGNLVVNGKTVRVTAERNPEDLKWDAIGVDVVAEATGLFLDDATARKHITAGAKKVVLTGPSKDATPMFVMGVNHESYAGQDIVSNASCTTNCLAPIAKVLNDNFGIVSGLMTTVHATTATQKTVDGPSAKDWRGGRGASQNIIPSSTGAAKAVGVVLPELNGKLTGMAFRVPTANVSVVDLTVNLEKGASYEAICAAMKQASETTLKGVLGYTEDAVVSQDFIGEVQTSVFDAKAGIALTDNF

SEQ ID NO: 85292 - protein, 436 aa, Hyphomonas neptunium ATCC 15444
MRVAIIGTGYVGLVSGACFADFGHTVTCVDKDAAKIEKLKNGIMPIFEPGLESLVAKNVKEERLFFTTEAREAIQDADAVFIAVGTPSRRGDGHADLSYVYGAAEEIAQLMDGFTVVVTKSTVPVGTGDEVEEIIRKTRPDADFAVVSNPEFLREGAAIKDFKIPDRVVVGTDDERARDVMRELYRPLFLNETPILFTSRRTSELIKYAANAFLAVKITFINEMADLCEKVGANVQEVSRGIGLDGRIGAKFLNAGPGYGGSCFPKDTLALTKTANDYGSPVRIVDTVIEVNADRKKAMADKVIAAMGGSVTGKTIGVLGLAFKQNTDDMRDAPSLDILPALQAAGARVVAYDPEAMKEAAHLLKDIEFVDSPYKAVDGADAMVIITEWDQFRALDLNRLKTAMKGNVVVDLRNIYHPDDLAKHGFAYTSIGRPAV

SEQ ID NO: 85293 - protein, 150 aa, Glycine max
  misc_feature (79)..(79): Xaa can be any naturally occurring amino acid
MSMHFLQWQHLGFFVSRDNLCKNCKRPGHYARECPNVAICHNCGLPGHIASECTTKSLCWNCKEPGHMASSCPNEGICXCGKAGHRARECSAPPMPPGDLRLCNNCYKQGHIAAECTNEKACNNCRKTGHLARDCPNDPICNLCNVSGHV

SEQ ID NO: 85294 - protein, 176 aa, Hyphomonas neptunium ATCC 15444
MAIYEIDGVAPQLPDEGKFWIAGSAEVMGNVVLKENASVWYGCVLRGDNDPIIIGENSNIQDLTVIHTDIGAPVTIGKNVTVGHRVILHGCEIGDDTLIGMGSTILNRVKIGRNCIIGANALIPEGKEIPDNSLVMGAPGKVVKDVSEMQLQVIKMSAIHYVENWQRHARGMKRLG

SEQ ID NO: 85295 - protein, 291 aa, Vibrio agarivorans
GRFVFRAAQERADIEVVGINDLIDVDYMAYMLKYDSTHGRFNGTVEVEGGNLIVNGKTVRVTAERNPEDLKWDEIGVDVVAEATGLFLTDETARKHITAGAKKVVLTGPSKDATPMFVSGVNFDTYAGQDIVSNASCTTNCLAPIAKVLNDKFGIESGLMTTVHATTATQKTVDGPSAKDWRGGRGASQNIIPSSTGAAKAVGVVLPEVNGKLTGMAFRVPTANVSVVDLTVNLKNGASYEAICAAMKEASEGEMAGVLGYTEDQVVSQDFIGEVCTSVFDAKAGIALNDK

SEQ ID NO: 85296 - protein, 210 aa, Zea mays
MKPAVEAAADERAAEEMAPKKAAAAKKAAEEVEVEEVVDGDEAVDGEGDGDEDDDGEGGDEEDDDEEVDGEEKEAAGVVEISDEDDDDGDGEADDDDDDDGDDDDDDDEDSDDEEEVDGEDDQEAGLGTEYLVQPLGRAEDEEHSSDFEPEENGEDADDEEIDEEDDDGEDSVKAQTSTKRKRSGDDEEDDDDGDDDGDDDDDGRPPSKR

SEQ ID NO: 85297 - protein, 534 aa, Saccharomyces cerevisiae YJM789
MSSDEEDFNDIYGDDKPTTTEEVKKEEEQNKAGSGTSQLDQLAALQALSSSLNKLNNPNSNNSSSNNSNQDTSSNKQDGTANDKEGSNEDTKNEKKQESATSANANANASSAGPSGLPWEQLQQTMSQFQQPSSQSPPQQQVTQTKEERSKADLSKESCKMFIGGLNWDTTEDNLREYFGKYGTVTDLKIMKDPATGRSRGFGFLSFEKPSSVDEVVKTQHILDGKVIDPKRAIPRDEQDKTGKIFVGGIGPDVRPKEFEEFFSQWGTIIDAQLMLDKDTGQSRGFGFVTYDSADAVDRVCQNKFIDFKDRKIEIKRAEPRHMQQKSSNNGGNNGGNNMNRRGGNFGNQGDFNQMYQNPMMGGYNPMMNPQAMTDYYQKMQEYYQQMQKQTGMDYTQMYQQQMQQMAMMMPGFAMPPNAMTLNQPQQDSNATQGSPAPSDSDNNKSNDVQTIGNISNTDSGSPPLNLPNGPKGPSQYNDDHNSGYGYNRDRGDRDRNDRDRDYNHRSGGNHRRNGRGGRGGYNRRNNGYHPYNR

SEQ ID NO: 85298 - protein, 575 aa, Saccharomyces cerevisiae YJM789
MVNVGPSHAAVAVDASEARKRNISEEVFELRDKKDSTVVIGGEAPVRTFTSSSSNHEREDTYVSKRQVMRDIFAKYLKFIGPGLMVSVAYIDPGNYSTAVDAGASNQFSLLCIILLSNFIAIFLQCLCIKLGSVTGLDLSRACREYLPRWLNWTLYFFAECAVIATDIAEVIGTAIALNILIKVPLPAGVAITVVDVFLIMFTYKPGASSIRFIRIFECFVAVLVVGVCICFAIELAYIPKSTSVKQVFRGFVPSAQMFDHNGIYTAISILGATVMPHSLFLGSALVQPRLLDYDVKHGNYTVSDEQDKVKKSKSTEEIMEEKYFNYRPTNAAIKYCMKYSMVELSITLFTLALFVNCAILVVAGSTLYNSPEADGADLFTIHELLSRNLAPAAGTIFMLALLLSGQSAGVVCTMAGQIVSEGHINWKLQPWQRRLATRCISIIPCLVISICIGREALSKALNASQVVLSIVLPFLVAPLIFFTCKKSIMKTEITVDHTEEDSHNHQNNNDRSAGSVIEQDGSSGMEIENGKDVKIVYMANNWIITVIAIIVWLFLSLLNVYAIVQLGMSHGDIS

SEQ ID NO: 85299 - protein, 439 aa, Hyphomonas neptunium ATCC 15444
MTEPSAYPVRSLTTRYVVVVTIAMVIGAGIFKSPALVAANAGSETAVYLLWLAGGFISLMGALCYSELAAAFPHAGGDYHFLERAWGRRFAFLFAWARFAVINTGAIALLGFVIGDYMNRVIDLGAHGPAIYAFASVLGLSALKLRPTGEAGDSGLVIILVVGLLVLVAAGAKIALSGTPPLAPGAPYMPGFGGIGYGLVFVLLAFGGWTESATLSSEVKDGERGMVRALVIAISLITGLYLLTAWAMLRGLGLDGLAGADAPAADLMALAFGESAGVVLALAVVAAAVTSVNATIIVGARTTYAAAARLPALSWLGRWNETTRSPRNAILAQGAISLALVGFGAAYRGFETLVDYTAPVYWVFLIASGMALIRLRMKEPAAARPFRVPLYPLVPALFILSSGAMLVSAILYVQGGAFFGLGVLVAGLALLPVLGRSGR

SEQ ID NO: 85300 - protein, 356 aa, Triticum aestivum
MARPLLVLLHLSCASTALQVTSSTSQSAPAAGMASSAAADVVETELLPFIRVYKSGRVERLLGTDTVPASFDAPTGVASKDVVIDPATGVSVRLYLPPAAAASGGEGKKLPVLVYFHGGGFMVETAASPTYHRYLNALAAHAGVLAVSVEYRRVPEHPLPAAYDDSWAALAWAVAGTAPGCPEPWLAAHGDASRVFLAGDSAGANIAHNVALRAAAEGLPRPCAAIVGVLLVHPYFWDPTNAMTPALEVRIRREWRFMCARPDAEVDDPRFCPTCAEAAPLLAALPCKRAMLAVAGDDFLAVKGRAYYAALLASGWRGEAELVDTPGQDHVFHLMRPGTEAAAEMLDRVAGFISRA

SEQ ID NO: 85301 - protein, 336 aa, Streptococcus pyogenes
MVVKVGINGFGRIGRLAFRRIQNIEGVEVTRINDLTDPNMLAHLLKYDTTQGRFDGTVEVKEGGFEVNGNFIKVSAERDPENIDWATDGVEIVLEATGFFAKKEAAEKHLHANGAKKVVITAPGGNDVKTVVFNTNHDILDGTETVISGASCTTNCLAPMAKALHDAFGIQKGLMTTIHAYTGDQMILDGPHRGGDLRRARAGAANIVPNSTGAAKAIGLVIPELNGKLDGAAQRVPVPTGSVTELVVTLDKNVSVDEINSAMKAASNDSFGYTEDPIVSSDIVGVSYGSLFDATQTKVMEVDGSQLVKVVSWYDNEMSYTAQLVRTLEYFAKIAK

SEQ ID NO: 85302 - protein, 362 aa, Bacteroides fragilis NCTC 9343
MKPYLLLTPGPLTTSETVKETMMTDWCTWDEDYNLHIVESLRKELVGIATRNTEEYTSVLLQGSGTYCVEAVIGAAIGKNDKLLICSNGAYGDRMGNIAEYYHIDYELLAFDETEQVSVDYVDDYLSNNSDVTHVAFVHCETTTGILNPLKELAHVVKMPGKKLIVDAMSSFGGIPMDVSELGIDFLISSANKCIQGVPGFGFIIARRSELVRCKGVARSLSLDIYDQWETMEKGHGKWRFTSPTHVVRAFKQALTELIEEGGVEARHRRYCENHRVLVEGMRSLGFVTLLDDAIQSPIITSFLYPKTGFDFKAFYTALKSKGFVIYPGKISKADTFRIGNIGDVHPEDFARLVEVVRETEY

SEQ ID NO: 85303 - protein, 86 aa, Oryza sativa Japonica Group
MDSFSSPSSAGSTASTEHLMEQIKAQLAQAYAQEFLETVGNKCFAKCVTKPGTSLSGSESSCISRCVDRYIEATGIVSRALFSSQR

SEQ ID NO: 85304 - protein, 183 aa, Fagus sylvatica
DGHGGSHVAMRCRDRLHDIVKEEVESVTEGMEWKDTMEKSFDRMDKEVQEWLVPIKTTNCRCDVQTPQCDAVGFTAVVAIVTPEKIIVSNCGDSRAVLCRNGVAFPLSSDHKPDRPDELVRIQDAGGRVIYWDGARVLGVLAMSRAIGDNYLKPYVISEPEVTITDRTAEDECLILASDGLWD

SEQ ID NO: 85305 - protein, 355 aa, Pseudomonas syringae pv. phaseolicola 1448A
MDKGSDGFYKGWVAKALVDSSQAGKGIITQADLDHYKTRELAPVECDYRGYHVVSAPPPSSGGVVICQILNILEGYPMKELGFRSAQGMHYQIEAMRHAYVDRNSYLGDPDFVKNPVEHLLDVKYAAKLREAIEPQKAGDSNKIKPGVAPHEGSNTTHYSIVDKWGNAVSVTYTLNNWFGAGVMASKTGVILNDEMDDFTVKVGVPNMYGLVQGEANAIAPGKTPLSSMSPTIVTKDGKAVMVVGTPGGSRIITATLLTMLNVIDYGMNIQEAVDAPRFHQQWQPEATNIDTFAVSPDTLKILESWGHKFAGPQPLNHVAAILVGAPSLGGKPVGNNRFYGANDPRRNTGLSLGY

SEQ ID NO: 85306 - protein, 503 aa, Glycine max
MVLSKTASESDVSVHSTFASRYVRTSLPRFKMAEESIPKEAAYQIINDELMLDGNPRLNLASFVTTWMEPECDKLIMAAINKNYVDMDEYPVTTELQNRCVNMIAHLFNAPLEETEAAVGVGTVGSSEAIMLAGLAFKRKWQNRRKQEGKPYDKPNIVTGANVQVCWEKFARYFEVELKEVKLRDDYYVMDPEKAVELVDENTICVAAILGSTLNGEFEDVKRLNDLLIEKNKITGWDTPIHVDAASGGFIAPFIYPELEWDFRLQLVKSINVSGHKYGLVYAGIGWVIWRSKQDLPEELIFHINYLGADQPTFTLNFSKGSSQVIAQYYQLIRLGFEGYRNVMENCRDNMLVLKEGLEKTGRFSIVSKDNGVPLVAFTLKDHTHFDEFQISDFLRRFGWIVPAYTMPPDAQHVTVLRVVIREDFSRTLAERLVSDVEKVLHELDSLPARVISSTTVTLSAEENGKVVVAKKNPMETQREITAIWKKFVLERKKNNDKMNGVC

SEQ ID NO: 85307 - protein, 187 aa, Zea mays
  misc_feature (44)..(44): Xaa can be any naturally occurring amino acid
  misc_feature (49)..(49): Xaa can be any naturally occurring amino acid
  misc_feature (60)..(60): Xaa can be any naturally occurring amino acid
  misc_feature (91)..(91): Xaa can be any naturally occurring amino acid
  misc_feature (124)..(124): Xaa can be any naturally occurring amino acid
  misc_feature (138)..(138): Xaa can be any naturally occurring amino acid
  misc_feature (150)..(150): Xaa can be any naturally occurring amino acid
MHIIKHLQRPVADSERDSTFMMIKSDRGQRPLIGDTSHRFEKKXGFYLXALNLENAEKPXDDKDYRDLASQIFFQRLQDYIISGPVEDMLXDGNSDGTTGRMIFVVTDPLDTEHETIQGHYDVXIDRNVILGNDTDVXEGNIEIVLWFPXGPDDWQRSHDPWIYQNETWKSLSLSVRARGSMSPFVL

SEQ ID NO: 85308 - protein, 327 aa, Pasteurella multocida subsp. multocida str. Pm70
MIQNQPHFYRGRFSVAPMLDWTTRHCRYFHRQFSQHALLYTEMVTTGAIIHAKYDHLEFSPAENPVALQLGGSDPTQLAQCAKIAQQRGYTEINLNVGCPSDRVQNGMFGACLMAKADLVADCVSAMQTEVSIPVTVKTRIGIDDLDSYEFLCEFVQKVHEAGCQEFIIHARKAWLSGLSPKENREIPPLDYERVYQLKRDFPHLLMSINGGIKTLEEMQQHLQYMDGVMVGREAYQNPSLLGYIDQALFDPTCPVVTPREAVEKMFPYIEQQLSQGVYLNHVVRHMLGAFQSCKGARQWRRYLSENAHKAGAGLEVVEKALSFVAS

SEQ ID NO: 85309 - protein, 274 aa, Bradyrhizobium sp. ORS278
MSYIEATDTAARKNGQIKLHGPSGFAGMRKAGALVSKCLDALTDIVKPGVPTSRIDDVVRDFAFSHGAYPATLMYRGYRYSTCTSINHVVCHGMPNDRPLKEGDIINVDVTFIVDGWYGDSSRMYAIGPISRKAERLIEVTYESMMRGIAAVKPGATTGDIGHAIQSFVEPQGMSVVRDFCGHGLGRLFHDEPNIIHVGRPGEGVLLKPGMFFTIEPMINLGKPHVKILSDGWTAVTRDRSLSAQFEHSVGVTNDGVEIFTLSERHGEKPLTQV

SEQ ID NO: 85310 - protein, 322 aa, Neptuniibacter caesariensis
MNIYEDNSLTIGNTPLVHLKRLAPGLNIFGKIESRNPAGSVKCRIGANMIWSAEKSGALKPGMTMVEPTSGNTGIALAFVAASRGYDIVFTMPSSMSLERRKIMKALGATIVLTEPAKGMKGAIEKAQEIVDQNPDTHMMLQQFENPANPEIHEKTTGPEIWNDTDGTVDILVAGVGTGGTITGTSRYIKKEQGKAITSVAVEPVDSPVITQTINGDEVKPSPHKIQGIGAGFVPKNLDLELVDQVEQVSNEDAIATARLLMEKEGIMAGISCGAALCAALRVAKQPGNEGKNIVVILPDSGERYLSSALFEGMFSDNEMVQ

SEQ ID NO: 85311 - protein, 146 aa, Escherichia coli
MRVLVTGGSGYIGSHTCVQLLQNGHDVIILDNLCNSKRSVLPVIERLGGKHPTFVEGDIRNEALMTEILHDHAIDTVIHFAGLKAVGESVQKPLEYYDNNVNGTLRLISAMRAANVKNFIFSSSATVYGDQPKIPYVESLLPIPGQ

SEQ ID NO: 85312 - protein, 79 aa, Prochlorococcus marinus str. AS9601
MSQEILEKVCSIVSEQLSVEAGEVKSDSNFQNDLGADSLDTVELVMALEEAFDIEIPDEAAEGIATVGDAVKFIEEKKG

SEQ ID NO: 85313 - protein, 390 aa, Thermus thermophilus HB27
MALPLYLVGLSHKTAPLEVRERAALDPVVALPAALSALGKGVVLSTCNRTELYGVGSPEKARAFLLSRGVVPRHLYVKEGVEALRHLYRVAAGLDSLVVGEAQILGQVREALFLARRQGATESLLEKAFQSAIALGKRARSETGIGMGAVSVAYAALDLALAVYGDLSGLSVAVLGAGEMAELFLTHLKAHGVGRILVVNRTEEKAQALAERFGGEAFGLPALPQVLRQADLVVASAAAPHYLVGPEDLPKRAKPLFLIDIALPRNIDPRVGDLPHAYLYNLDDLKRVVDRNLRARAGEIPKVEALIEKALGDYMEWYAGHRVREAIRALEAWARVQAAKAQPEAGPVELEKAAGRLAHPFILGLKRRALDRVGGPPCPEDCLLYRLSRT

SEQ ID NO: 85314 - protein, 214 aa, Zea mays
MSEEDKAAASAEQPKRAPKLNERILSSLSRRSVAAHPWHDLEIGPGAPAVFNVVVEITKGSKVKYELDKKTGLIKVDRVLYSSVVYPHNYGFIPRTLCEDNDPMDVLVLMQEPVVPGSFLRARAIGLMPMIDQGEKDDKIIAVCADDPEYRHYNDISELSPHRLQEIKRFFEDYKKNENKEVAVDAFLPATTAQEAIQYSMDLYAQYILQSLRQ

SEQ ID NO: 85315 - protein, 219 aa, Thermus thermophilus HB27
MVRALTFDVGNTLILASPRFWLLPLLEARGLRPRGDVRKAALEAFRFYEENHLKARDLETALGLWREFHRRLLVGMGLEDHAEALSRELVARWKDPATWPLVPGAEATLKALKAKGYPLAVVSNWDATLPEILEVVGLGRYFDHLSVSALSGYAKPDPRLFREALEALGVSPEEAVHVGDAEADLLGAEAVGMRALLFDPLGENPKALPRLERVLDYLP

SEQ ID NO: 85316 - protein, 159 aa, Alkaliphilus metalliredigens QYMF
MERHVVSILVEKHDGVLNRVAGLFSKRGYHIDSFSFGETENPELSRMTVVFTGDHQFFDQITKQLSKLVDVRQIEELKHEESDYREMVLIKIKAEEKDRTSILEQLEAYKGKIISVATEYLTVEMTGDQQKVDTFIDLMTKHGIKEMARTGVMALGHVN

SEQ ID NO: 85317 - protein, 278 aa, Nocardia farcinica IFM 10152
MAADPIADLPELLTVAGEILDGAAARFVAGIGAPSAVSKGRNDFATELDLELERTVSAALRERTGFPVHGEEFGGPQLTSGTAWVLDPIDGTFNYSAGHPLSGMLLALVHDGEPVLGLTWLPLLGRRYAAMRGGPLLLDGAPLPPLPAGKLAESMIGFGTFNVDSDGRIPGRFRFDLLGPLSRLSSRVRMHGSTGIDLAFTASGVLGGAIVFGHHPWDNAAGVALVRAAGGVVTDLAGEPWTITSGSVLAAAPGVHAELLEMICAVADPAGAEEGVNR

SEQ ID NO: 85318 - protein, 414 aa, Alkaliphilus metalliredigens QYMF
MSYLNQNPLPQLQPLTASLDFQEAKKRLSGVLKETKLIYSPVFSQEFCNEVYIKPENLQITGSFKIRGAYNKIAKLTLKQKQDGLIASSAGNHAQGVAYAAKELGVEATIVMPNTAPLVKVEATKSYGANVVLWGDCYDEAYAKACQLQKKYGYTFIHPFDDLDVIEGQGTLALEILEELPDADCLLVPIGGGGLISGIAAAAKAINPNIKIIGVEPEGAKAMKVSVDCNKLTHLDSVHTIADGVAVQKPGDLTFPIIQDLVDEIITVSDLDIMEAFILLLEKHKLVGENSGVLSLAGLKKIQETYKKVVCIVSGGNIDVLTISSQVNRGLVSRGRTFCFTVALPDKPGELLKVSEILTRLNGNVIKLDHNQFKNLDRFMEVELEVTVETNGHQHINQITTELNKAGYNILKVY

SEQ ID NO: 85319 - protein, 181 aa, Wolinella succinogenes DSM 1740
MNIEKICYGENPDKLNAVIEIPYGSNIKYEIDKESGAVVVDRVMYSAMFYPANYGFVPNTLADDGDPADILVLNEYPLQAGSVIKCRLIGVLVMEDEAGMDEKLLAVPVTKIDPRYEGIQTYQDLPKITLDKIKNFFETYKMLEPNKWVRVKEFKDKDEAAALLEKAIKAYGGEGSCCCGK

SEQ ID NO: 85320 - protein, 285 aa, Vibrio cholerae
RAAQERNDIEIVGINDLIDVDYMAYMLKYDSTHGRFNGTVEVKDGNLIVNGKTVRVTAERNPADLKWGEIGVDVVAEATGLFLTDETARKHIEAGAKKVVLTGPSKDKTPMFVMGVNHKTYAGQDIVSNASCTTNCLAPIAKVLNDNFGIESGLMTTVHATTATQKTVDGPSAKDWRGGRGASQNIIPSSTGAAKAVGVVLPELNGKLTGMAFRVPTANVSVVDLTVNLQKAASYDDIKAAMKAASEGELAGILGYTEDAVVSTDFNGDTRTSIFDADAGIALTD

SEQ ID NO: 85321 - protein, 442 aa, Alkaliphilus metalliredigens QYMF
MSKVIVSKFGGSSLADSKQFNKVKEIVLSNKNRRYIVPSAPGKRHEKDYKMTDLLYLCQQHVEQGVPFDEVYKIIEKRYIDICLELGLTLDMKTILNEIKDNITAGASADYAASRGEYLNGLILASLLKYEFIDASELIIFSENGQFDSEATQKRVNQTLKSIEKAVIPGFYGAMESGQIKTFSRGGSDVTGAIIARGVGAHLYENWTDVSGFCMADPRIVENPQYIKKITYRELRELSYMGASVLHEEAIFPVKRESIPIRIKNTNAPEDVGTLIVDDLSPVNYTRTITGIAGKKDFTVIAIEKMLMNAEKGFIHKLLTILEANGISAEHMPSSIDSISLVISDKGLKNNIQKVINEIRVQTNPDSIVAYPNMALIAVVGRGMIKTKGISAKVFGALAKEGINVRMITQGSSELNIIVGIENSDFERGISVLYKVFQKKEA

SEQ ID NO: 85322 - protein, 291 aa, Vibrio alginolyticus
GRFVFRAAQERNDIEVVGINDLIDVDYMAYMLKYDSTHGRFNGTVEVEGGNLIVNGKTVRVTAERNPEDLKWDEIGVDVVAEATGLFLTDETARKHITAGAKKVVLTGPSKDATPMFVNGVNFDTYAGQDIVSNASCTTNCLAPIAKVLNDKFGIESGLMTTVHATTATQKTVDGPSAKDWRGGRGASQNIIPSSTGAAKAVGVVLPEVNGKLTGMAFRVPTANVSVVDLTVNLVNGASYEDICKAMKEASEGELKGVLGYTEDAVVSQDFIGEVCTSVFDAKAGIALTDK

SEQ ID NO: 85323 - protein, 755 aa, Xanthobacter autotrophicus Py2
MRGALGGPRVLLRRLREVMAEQVSAQDRLDKIVVLIAANMVAEVCSVYVLRVDQTLELYATEGLNRDAVHLTVMRVDEGLVGHVAREAESLALSDAHAHPEFSYRPETGEEVYNSFLGVPILRAGNTLGVLVVQNRARRTYTEEEIEALQTTAMVLAEMIASGELTALAKPGAEPAVRRPLHLKGVALADGLGLGHVVLHEPRIKVTNVIADDVVKETARLDAAIGKLRHSIDLMLEDDGLAKAGEHRDILEAYRMFAHDRGWMHKMREAVLSGLTAEGAVERVQSDTRARMMRASDPYLRERLHDLDDLANRLLRELTGRNRGSEREALPENAILVARNMSPAALLDYDRTRIRGLVLEEGGTTSHVTIVARALGIAAVGQVENAAGLADPGDPVIVDGQAGEVHLRPPGDVEEAYAEKVRFRARRQAQYAALRTRPSVTKDGVHIELHLNAGLLVDLPHVSETGAAGIGLFRTELQFMIASAFPRISEQLKLYRAVLDAAGEKPVTFRTLDIGGDKVLPYMRTVEEENPALGWRAIRLGLDRPGLLRSQLRALLRAGAGRDLRIMFPMVAAVEEFDRARAIVERELTHLRKHGHGLPEKVYVGAMVEVPSLLFQLDEILSRADFLSVGSNDLVQFLYAADRSNVRVADRFDPLSPPALRAFRMVAEAGQRHGKPVTLCGELASRPLEAVALAALGYRALSVSPASIGPVKAMMLELDVSAARKVLLPLLEDKTGTADPRAALAAFAKASGLPI

SEQ ID NO: 85324 - protein, 285 aa, Listonella anguillarum
RAAQERNDIEVVGINDLIDVDYMAYMLKYDSTHGRFNGTVEVEAGNLVVNGKTVRVTAERNPEDLKWDAIGVDVVAEATGLFLDDATARKHITAGAKKVVLTGPSKDATPMFVMGVNHASYAGQDIVSNASCTTNCLAPIAKVLNDKWGIESGLMTTVHATTATQKTVDGPSAKDWRGGRGASQNIIPSSTGAAKAVGVVIPELNGKLTGMAFRVPTANVSVVDLTVNLQNPASYAEICAEMKRASENEFAGVLGYTEDAVVSQDFIGEINTSVFDAKAGIALTD

SEQ ID NO: 85325 - protein, 106 aa, Brassica napus
RASAHINILSKMDLLQDKSNIDNYLDPEPRTLLAELNQKMGPRYAKLNKALIEMVGEYGMVNFIPLDIRKERSIQYVLSQIDVCIQFGEDADVKIKDEDEDFGDDQ

SEQ ID NO: 85326 - protein, 419 aa, Xanthobacter autotrophicus Py2
MARLVMKFGGTSVANIERIRNVARHVKREVEAGYQVAVVVSAMSGKTNELVGWCKDASALYDPREYDAVVASGEQVTSGLLAIVLQEMGLSARSWQGWQLPISTDDAHGSARILDIDSEKLGAAIDGGQVAVIAGFQGIHLPTGRLTTLGRGGSDTSAVAVAAALKAERCDIYTDVDGVYTTDPRVVPKARRLDRIAFEEMLEMASLGAKVLQVRSVELAMVHNVRTFVRSSLVDPDAPETANVEKAGTLICDEEEIVANQMESQVVTGIAFSKDEAQVSIRRVADKPGIAAAVFGPLADAHINVDMIVQNVSADGFTDITFTVPTADFERAKAVIEKARDTIAHQVVEGATDVTKVSVIGIGMRSHAGVAAQAFQALAGKGINIRAITTSEIKISFLIDAAYTELAVRTLHSLYGLDS

SEQ ID NO: 85327 - protein, 281 aa, Vibrio calviensis
VERNDIEVVAINDLIDVDYMAYMLKYDSTHGRFNGTVEVVEGNLVVNGKTVRVTAERNPTELQWDAVGVDVVAEATGIFLTDETARQHITAGAKKVVLTGPSKDATPMFVMGVNQDTYAGQDIVSNASCTTNCLAPIAKVLNDNFGIESGLMTTVHATTATQKTVDGPSAKDWRGGRGASQNIIPSSTGAAKAVGVVLPELNGKLTGMAFRVPTANVSVVDLTVNLKESATYEAICAAMKAASEGEMAGVLGYTEDEVVSQDFIGEKQTSVFDAKAGVALT

SEQ ID NO: 85328 - protein, 232 aa, Zea mays
PPDDVTSLGAGRGACTEHAAAVCRAAGEPLTIEEIVVDPPKAYEIRIRVVCTSLCHTDITFWKAKVAPVFPRILGHEAYGVVESVGEHVEGFAAGDTVVPTFLGQCERCASCASEHSNVCDAVPFVIGPGMRRDGTTRFRDARGSPLHDLLAVSSFSEYTVVDVNQVVKVDPAVPPKLACLLSCGAGTGVGAAWRSAKVEPGSTVAIFGLGSVGLAVVQGAKMCGASKIIGV

SEQ ID NO: 85329 - protein, 159 aa, Hyacinthus orientalis
TKQTAPLQQKKMEQTFIMIKPDGVQRGLVGEIISRFEKKGFYLKAMKLITVERSFAEKHYEDLSSKPFFGGLVEYIISGPVVAMVWEGKNVVLTGRKIIGATNPADSAPGTIRGDYAIMVGRNIIHGSDAVESARKEIGLWFPEGISNWQSSLNPWIYE

SEQ ID NO: 85330 - protein, 175 aa, Burkholderia sp. 383
MPLFEFNGMRPRVDPSAYVDPSAVVIGDVTIGARCYIGPHASLRGDFGAIVVEDGSNVQDGCVLHVGIGETCRLGVNSHIGHGAIVHGATLEPDTMIGMNAVVMDSATIGATTIVAACAFVKAGYDVPRGVLLAGMPGRVVRRLSDAEIDAKANGTRIYQQLAADCLRTIRRIDG

SEQ ID NO: 85331 - protein, 284 aa, Vibrio cholerae
AAQERNDIEIVGINDLIDVDYMAYMLKYDSTHGRFNGTVEVKDGNLIVNGKTVRVTAERNPADLKWGEIGVDVVAEATGLFLTDETARKHIEAGAKKVVLTGPSKDKTPMFVMGVNHKTYAGQDIVSNASCTTNCLAPIAKVLNDNFGIESGLMTTVHATTATQKTVDGPSAKDWRGGRGASQNIIPSSTGAAKAVGVVLPELNGKLTGMAFRVPTANVSVVDLTVNLQKAASYDDIKAAMKAASEGELAGILGYTEDAVVSTDFNGDTRTSIFDADAGIALTD

SEQ ID NO: 85332 - protein, 289 aa, Clostridium thermocellum ATCC 27405
MRVRKAIIPAAGLGTRFLPATKAQPKEMLPIVDKPTIQYIVEEAIKSGIEDIIIISGRSKRAIEDHFDKSYELEQELEKKGNHDLLKLVQDISNLANIHYIRQKEAKGLGHAIYCAKSFIGNEPFAVLLGDDIVDSEVPCIKQLMDVYDKYRTTVLGVQKVPEDQVSKYGIVGGEIVSDRVYKVKDLVEKPDTASAPSNIAILGRYIITPRIFDYLENAKPGKGGEIQLTDALRELMGEEEMYAYDFIGKRYDVGNKLGFLQATVEFALARDDLKEEFEAYLKEIICKL

SEQ ID NO: 85333 - protein, 137 aa, Zea mays
PDVKIMSLSILSPGRPDIVLPLPVEPNAKGVWFTFKEGSPYRLKFTFSVSNNIVSGLRYTNTVWKTGLKVDRAKEMLGTFSPQLEPYTYVTPEDTTPSGMFARGSYFARTKFLDDDRKCYLEIKYTFDIRREWPWTS

SEQ ID NO: 85334 - protein, 597 aa, Bradyrhizobium sp. ORS278
MTSLDAVSIAILLGAVLVMAGILSSLLALRFGAPLLLVFLVIGMLAGDSGPGHIEFQDVRTTYLVGSVALALILFDGGLRTRFQSIRTVLAPSMVLATIGVLLTAFITAPVAKYALDLDWTEAMLVGAVIASTDAAAVFLLVHAQGLRLRPRVGATLEAESGSNDPFAVFLTLMLVELISVGHGSIGHFLFELVREAVLGALFGIVGGRLVVIGLNKVALPQGLHAPFVTTAALVIFGAAQIAHGSGFLAVYLAGIIIGNRPTRAHNSVVAFLDAATWLAQIVMFVLLGLLVSPQRLLDSLLPAIAVALVLMLVARPAAVFLCLHPFRFNWREKAFIAWTGLRGAVAIFLASIPMLVGLSKAYLYFDVAFVVVIISLLAQGWTLGVAARKLHVALPRTDRGPRRVELDLPGQLEQQLVGYSVRSKSLYYRRGLIPSWSKPTLVIRNQQILSPNEAEPIAPGDYLYLLAPPEKAESLDRFFVDMPPSSSPDPHLLGDFMVSAEHTLDEVAGIYGVKLGEGEDKLTLADYFDIHLDNAPKEGSTVALDTIVLVARSISGGRVNVVGLRLPEDEEPQPVLTRKEQVRRKLADVWATVVGV

SEQ ID NO: 85335 - protein, 420 aa, Vitis vinifera
  misc_feature (269)..(269): Xaa can be any naturally occurring amino acid
MGLNWRLWSLHKHNHLLVKVAVSILLMGLAFRLLFVHSTVPETPFVEKPVIPNPPVSEDVPEIRDPIPEKEKCDLFTGDWIPNPSGPVYTNESCQLIETHQNCMKNGRPDSAYLYWRWSPRDCELPQFDPYRFLELMRNKAWALIGDSITRNHVQSLLCILSKVEQPDHVYHDKGYKSRRWVFPSYNFTISVLWSPFLVEAAIFEDMNGVSTSEVELHLDQLDKKWVDQYQNLNYMIISTGKWFLKNTIYYENGTVVGCHSCSNKNLTXLGFDFAYQKALSFVFNFIVTSKHKGMILFRTATPDHFESGEWFSGGVCPKAEPVKEGEIEFKGLHSILRDIELEEFAKAEKKAQENGVNLKLLDLSKISLLRPDGHPGPYRFFYPFASDKNATVQNDCLHWCLPGPIDSWNDVIMEMVVNG

SEQ ID NO: 85336 - protein, 145 aa, Triticum aestivum
MAHMRVVHRDEEGHKVAEKVPVPETRRPDTARHVERKLEEQGLHRLERHPANAPRGVGIGAPPPKSGRGGKYTWEGPEGLVDSELDPAPAAIDRNDPNYEEEEEGGAQDEAVVGEVEVAKVAQARAGVARVEVAPPLLQEHDHQK

SEQ ID NO: 85337 - protein, 314 aa, Azoarcus sp. BH72
MRLHLKPVSDQTIVVTGATSGIGLATVRMAVAQGARVVMAARNAQALATLAEGFHHLGRSAVAVPADVANVQDVQRIRDAALEAFGGFDTWVNNAGVSIFGRYEDVPLQDMRRLFETNFWGVVHGSMIALEILRERGGALINLGSEVSDIALPLQGMYSASKHAVKGFTDSLRMEVEAAGYPVSVTLIKPAAIDTPFVPHAANYMDVQPRLPSPLYAPEVVADAILYAAHQPKRDIYVGGAAKAFSASNRMMPRVMDKVSERFMIDQQRSERPVAHPTQATLYHPGGGLREMRGDSRPVHHRSLYTRLTTSIGR

SEQ ID NO: 85338 - protein, 341 aa, Salmonella enterica subsp. arizonae serovar 62:z4,z23:--
MKALSKLKAEEGIWMTDVPEPEVGHNDLLIKIRKTAICGTDVHIYNWDEWSQKTIPVPMVVGHEYVGEVVGIGQEVKGFNIGDRVSGEGHITCGHCRNCRGGRTHLCRNTTGVGVNRPGCFAEYLVIPAFNAFKIPDNISDDLASIFDPFGNAVHTALSFDLVGEDVLVSGAGPIGVMAAAVAKHVGARHVVITDVNEYRLELARKMGVTRAVNVAKESLTDVMAELGMTEGFDVGLEMSGAPPAFRTMLDTMNHGGRIAMLGIPPADMSIDWTKVIFKGLFIKGIYGREMFETWYKMAALIQSGLDLSPIITHRFSIDDFQKGFDAMRSGQSGKVILSWD

SEQ ID NO: 85339 - protein, 349 aa, Physcomitrella patens subsp. patens
MERKKENDEETPLKAPFCNCGPKLLRPQFCGLDCAFLWHCFGAVSEPPSAQLIVHCPVETWLFAKTTWPCLHIAPLAFRAPVGFLVSVNARLHDNLGLSVTDCMLLLLSLSMLPFRVVRKCVSVLRSDLVCISFVNSESEGFVVSLPVMGSDETKRNSQWDDEDKEEEPQEEKKKHTGWSDGGSLSPQEVGSKPKEHEKSNKTADDDGVVSDPLVEKLRQQRSVEEADYQNTSELFGIKSRGGVSLNDFIPKSEDDILEYAEMISRKIRPFERSFHYMTLLRALLRHSVASMKGSDAKEVASSMTAIVNEKLKAERKAAAGKKKTSTCIPISSVKLLKIVLKLYFLSEN

SEQ ID NO: 85340 - protein, 605 aa, Propionibacterium freudenreichii subsp. shermanii
MAENNNLKLASTMEGRVEQLAEQRQVIEAGGGERLVEKQHSQGKQTARERLNNLLDPHSFDEVGAFRKHRTTLFGMDKAVVPADGVVTGRGTILGRPVHAASQDFTVMGGSAWRDAVHEGRRDDGTALLTGTPFLFFYDSGGRIQEGIDSLSGYGKMFFANVKLSGVVPQIAIIAGPCACASYSPALTDFIIMTKKAHMFITGPQVIKSVTGEDVTADELGGAEPIWPSRAIYFVAEDDDAAELIAKKLLSFLPQNNTEEASFVNPNNDVSPNTELRDIVPIDGKKGYDVRDVIAKIVDWGDYLEVKAGYATNLVTAFARVNGRSVGIVANQPSVMSGCLDINASDKAAEFVNFCDSFNIPLVQLVDVPGFLPVQQEYGGIIRHGRKMLYAYSEATVPKITCLATPTAAPTWPCATVTLVPTPCTPVPSAEIAVMGAEGAANVIFRKEIKAADDPDAMRAEKIEEYQNGSTRRTWRARGQVDDVIDPADTRRKIASALEMYATKRQTRPAKKPWKLPLLSEEEIMADEEEKDLMIATLNKRVASLESELGSLQSDTQGVTEDVLTAISAVAAYLGNDGSAEVVHFAPSPNWVREGRRALQNHSIR

SEQ ID NO: 85341 - protein, 264 aa, Pasteurella multocida subsp. multocida str. Pm70
MPLAVWTDIRQEAKTLAENEPILASFFHATILKHHNLGNALSYILANKLANTIMPAIALREIIEEAYQADPDIIASAACDIRAVRQRDPAVELYSTPLLYLKGFHALQSYRITHYLWQQERKALAVYLQNQISVAFDVDIHPAAKIGCGIMFDHATGIVVGETSVIENDVSILQGVTLGGTGKECGDRHPKVREGVMIGAGAKILGNIEVGRYAKIGANSVVLQPVPEYTTAAGVPARVIARDQAAKPAFDMNQYFNDDHASKV

SEQ ID NO: 85342 - protein, 337 aa, Pasteurella multocida subsp. multocida str. Pm70
MNTTVATSPITVLGAGSYGTALAIAFSRNGFPTYLWGHDPVHMQRLSEERQNNAFLPNIAFPDALHIEFDLASALSQSRDLLIVVPSHVFGEVIDKIKPYLRPDHRIAWATKGLERNTGRLLQEVIEEKLGTQHPLAVLSGPTFAKELAAGLPTAIALASNNEQFALEFQARIHCSKHFRVYINQDMIGVQLGGAIKNVIAISAGMSDGMGFGANARTALITRGIAEISRLGASLGANPNTFMGMSGLGDLVLTCTDDQSRNRRFGIMLGQGFSAQTAMDNIGQVVEGFYNAKEAYLLAQRQGIEMPITEQVYQVLFCGKNAQDVAASLLGRERKGE

SEQ ID NO: 85343 - protein, 498 aa, Arabidopsis thaliana
MAMIEQRPKTKIVCTLGPASRSVPMVEKLLRAGMNVARFNFSHGSHEYHQETLDNLHQAMLNTGILCAVMLDTKGPEIRTGFLKDGKPIQLKQGQEITISTDYDLKGDENTICMSYKKLAVDVNPGMVILCADGTISLLVLSCDKENGTVRCRCENSAMLGERKNVNLPGVVVDLPTLTEKDKEDIMQWGVPNQIDMIALSFVRKGSDLVQVRKLLGKHAKNILLMSKVENQEGVANFDDILVNSDAFMIARGDLGMEIPIEKIFLAQKVMIYKCNIQGKPVVTATQMLESMIKSPRPTRAEATDVANAVLDGTDCVMLSGETAAGAYPELAVRTMAKICVEAESTLDYGDVFKRIMLYSPVPMSPLESLASSAVRTANSARATLIMVLTRGGSTARLVAKYRPGMPILSVVVPEIKTDFFDWSCSDESPARHSLIFRGLIPVLYAGSARASHDESTEEAIEFATQYGKEKELCKTGDSVVALLRVGNASVIKILTVK

SEQ ID NO: 85344 - protein, 444 aa, Mycobacterium smegmatis str. MC2 155
MFGTGYLGATHAAGMAELGHEVIGVDIDPGKVAKLASGDIPFYEPGLRKVLNDNLSAGRLRFTTDYDEAADFADVHFLGVGTPQKKGEYGADLRHVHAVIDTLVPRLRRNAVIVGKSTVPVGTAADLAQRAALLAPPGVDVEIAWNPEFLREGFAVHDTLHPDRVVLGVQPGSTRAEAAVRDLYGPLIADGVPFLVTDLQTAELVKVAANAFLATKISFINAISEVCEAADADVTVLADALGHDPRIGRRFLNAGLGFGGGCLPKDIRAFMARAGELGANHALTFLREVDSINMRRRTAMVELATRACGGSLLGANIAVLGAAFKPESDDVRDSPALNVAGMLQLNGATVNVYDPKAVENSRRLFPTLTYATTVAEACERADAVLVLTEWSEFVDLDPAALDGTVRAKVVVDGRNCLDIDRWSRAGWRVYALGRRLERQNVREL

SEQ ID NO: 85345 - protein, 333 aa, Candidatus Blochmannia floridanus
MITKIGINGFGRIGRVIFREAQERTDIEIVAINDLLNIEHIAYLLKYDSTHGKFQGNIKTYSDHLIINDKTIHYTSKKKPIDLNWKNLGVDVVIESTGMFLTQEYAQGHILSGAKKVILTAPPKDDNIPMFVMGVNHDSYQGSKIISNASCTTNCLAPIAKIIHDHFGIIEGFMTTIHAVTSTQKTVDSPIHKDWRSGRSAYQNIIPSSTGAAQALGKVITDLHGKLTGMAFRVPILNVSVIDFTVRLKKSVSYKNICDVIKDASEHTFKDIIGYTEEKLVSSDLNGEKLISIFDAKSSMLLNNHFVKLISWYDNETGYSNKVIDLSNYIMKN

SEQ ID NO: 85346 - protein, 286 aa, Xanthobacter autotrophicus Py2
MIRRITFQGEPGANSHIACREVFPDFEAVPCATFEDAFAGVESGAATYAMIPIENSVAGRVADIHHLMPQSSLSIIGEHFLPLSHQLMAVKGASLSTLKSVQSHVMALGQCRKAIRTLNLTAVIGADTAGSAREIAEAGDVSRAAIASRLAADIYGLDILAENIEDEAHNTTRFIILSRGGEWTPAGNGPVVTTFVFRVRNVPAALYKALGGFATNGVNMTKLESYQLDGRFTATQFYADVDGHPDDRPVKLALEELAFFSREMRILGVYPAHPYRAQFAAEQETF

SEQ ID NO: 85347 - protein, 284 aa, Arabidopsis thaliana
MKIMMMIKLCFFSMSLICIAPADAQTEGVVFGYKGKNGPNQWGHLNPHFTTCAVGKLQSPIDIQRRQIFYNHKLNSIHREYYFTNATLVNHVCNVAMFFGEGAGDVIIENKNYTLLQMHWHTPSEHHLHGVQYAAELHMVHQAKDGSFAVVASLFKIGTEEPFLSQMKEKLVKLKEERLKGNHTAQVEVGRIDTRHIERKTRKYYRYIGSLTTPPCSENVSWTILGKVRSMSKEQVELLRSPLDTSFKNNSRPCQPLNGRRVEMFHDHERVDKKETGNKKKKPN

SEQ ID NO: 85348 - protein, 185 aa, Gibberella zeae PH-1
MPPLTHDCGIDAEPLYRYEPGGYHPVELGDILKDGRYKVLHKLGWGSFSTTWAAKDQENTSYVAVKVKVSEAKDTRELDVLQAISALPKHHLGSSHVNQMLDHFTLGGPNGSHECLVLELVGPSVSDAIEFYCNIHRLPVKVAKSFAKQALRGLDFLVANDIAHGAVPDLKSLNEEDFMATLGKF

SEQ ID NO: 85349 - protein, 314 aa, Streptococcus thermophilus CNRZ1066
MDRKPVSVKSYANIAIVKYWGKADADRMIPSTSSISLTLENMYTETKLSFLPKDATSDVMYIGDELQGEKETTKASKVLDIFRTNPNQHVKIETWNNMPTAAGLSSSSSGLSALVKAANELFQVGKTQSELAQIAKFASGSSSRSFFGPLAAWDKDSGEVYPVETDLKLAMIMLVLTDQKKPVSSRDGMKLCTETSTSFPEWIRQSELDYKDMLAYLKANDFQAVGELTEANALRMHQTTSTANPPFSYLTEASYQAMDKVKALRASGEQCYFTMDAGPNVKVLCMEEDLDRLAEHLRKDYQVIVSRTKELPDA

SEQ ID NO: 85350 - protein, 290 aa, Vibrio cincinnatiensis
GRFVFRAAQERNDIEVVGINDLIDVEYMAYMLKYDSTHGRFNGTVEVKDGNLIVNGKTVRVTAERNPADLKWDAIGVDVVAEATGIFLTDETARAHITAGAKKVVLTGPSKDKTPMFVMGVNHESYAGQDIVSNASCTTNCLAPIAKVLNDNFGIESGLMTTVHATTATQKTVDGPSAKDWRGGRGAAQNIIPSSTGAAKAVGVVLPELNGKLTGMAFRVPTANVSVVDLTVNLEKPASYEEIKAAMKAASEGALAGVLGYTEDAVVSTDFNGDTRTSIFDAAAGIALTD

SEQ ID NO: 85351 - protein, 284 aa, Zea mays
  misc_feature (51)..(51): Xaa can be any naturally occurring amino acid
VREEPVRHGHGAAAAGAPPPLAAGALGARCRGPGSRAAPSAPPSCWHTFLXFLLAYLALGVTFYAAAPANFSSSAGPTHPVADALYFCIVTLCTIGYGDITPATPAAKLFSISFVLIGFGFVDILLSGMVSYVLDLQEHLLITALKNPTSARKHRHNYIFDVKKGRMRIRMKVALALGVVAVCVGVGAAVLRRVESLGWLDAVYLAVMSVTTVGYGDQAFRTLAGRLFASAWLLVSTLAVARAFLYLAEMRIDKRHRAMANWVLSRDMTVSEFLAADIDNNGYV

SEQ ID NO: 85352 - protein, 252 aa, Zea mays
  misc_feature (246)..(246): Xaa can be any naturally occurring amino acid
MAPHRKARASQPQQPPPSDYETDVIPSVDVPLPPPRSNEELNLSVLRRQYPALTSIEHVTPYAALYTFNLETQQWEKMGVEGTLFICQLTPSPLGAERYCAIILNRRGLDNFYEELTSSDEMEISDPYVIIQGEQVYGIWIFADPPPSSTANCRQETAAKMMAVADRAKASRAALHGSPDAVSSTPMGRQLSLRELFGQQREQDADFSLHHHDSHPMPSMHHPPQQHQHQQQPYMTHASPAQPDVXGQLMRA

SEQ ID NO: 85353 - protein, 367 aa, Arabidopsis thaliana
MESDSEMVPFPQLPMPIENNYRACTIPYRFPSDDPKKATPNEISWINVFANSIPSFKKRAESDITVPDAPARAEKFAERYAGILEDLKKDPESHGGPPDGILLCRLREQVLRELGFRDIFKKVKDEENAKAISLFPQVVSLSDAIEDDGKRLENLVRGIFAGNIFDLGSAQLAEVFSRDGMSFLASCQNLVPRPWVIDDLENFQAKWINKSWKKAVIFVDNSGADIILGILPFARELLRRGAQVVLAANELPSINDITCTELTEILSQLKDENGQLLGVDTSKLLIANSGNDLPVIDLSRVSQELAYLSSDADLVIVEGMGRGIETNLYAQFKCDSLKIGMVKHLEVAEFLGGRLYDCVFKFNEVQS

SEQ ID NO: 85354 - protein, 291 aa, Vibrio coralliilyticus
GRFVFRAAQERSDIEVVGINDLIDVEYMAYMLKYDSTHGRFNGTVEVEGGNLIVNGKTVRVTAERNPTDLKWDEIGVDVVAEATGIFLTDETARQHITAGAKKVVLTGPSKDATPMFVMGVNDSTYAGQDIVSNASCTTNCLAPIAKVLNDKFGIESGLMTTVHATTATQKTVDGPSAKDWRGGRGASQNIIPSSTGAAKAVGVVLPELNGKLTGMAFRVPTANVSVVDLTVNLKEGASYEAICAAMKEASEGELKGVLGYTEDQVVSQDFIGEVQTSVFDAKAGIALTDN

SEQ ID NO: 85355 - protein, 290 aa, Vibrio diazotrophicus
GRFVFRAAQERNDIEVVGINDLIDVDYMAYMLKYDSTHGRFNGTVEVEGGNLIVNGKTVRVTAERNPEDLKWDAIGVDVVAEATGLFLDDATARKHITAGAKKVVMTGPSKDATPMFVNGVNFDTYAGQDIVSNASCTTNCLAPIAKVLNDKFGIESGLMTTVHATTATQKTVDGPSAKDWRGGRGASQNIIPSSTGAAKAVGVVLPAVKGLLTGMAFRVPTANVSVVDLTVNLKNAASYEEICKAMKEASEGEMAGVLGYTEDAVVSQDFIGEKCTSVFDAKAGIALTD

SEQ ID NO: 85356 - protein, 831 aa, Aspergillus nidulans FGSC A4
MTQLDLVEVDSLEAHVLIDNDLDPLSTISPDTVQVSGLMGHLAMNSPHHLKDRGDAHRELQMEDICCSAHGLSIILTATKGDQQHSILFDAGPEEEAWERNVRRMKPDLSSIELVQLSHWHRDHSGGLLRAVRMITEAKEAKGLSKDLIADLHPNRPDYRGFSIGENIISLQADPSFEELEAAGATVQKHDSAHTVLDDFFLISGEIPRRTPYEAGLKHGMRFDKEDNEWTSDEAIADERFIMCNVKADKGIVMLTGCSHAGVVNCTQHALELAGGSIPLHAVIGGFHLATSDANQIERSIKDLLKFDPAVLLPGHCTGWRAKFAIEKRQPGLLLLPTEYSKRPIRLFLYDRRFYLKGGIHAPMIPRDIISVTRFFFAVVKAQNEHRLYEFFKKSLEHGDPASPNCVESNIFGSFRVIQTREPEHLKAVLTGKFADFGKGELFHKLWIPFLGDSIFTTDGKEWQGSRNLIRPMFIKDRISDLDIFERKTQTMLSLYSPCGEPTDVVDLFYRMTLDAITEFLLGKGINSLENPQADFALAFADVQRIQTLLTMLGPAQYLYPRGRYNQGLKVINDFVWPFVHDTLGFQADDLKSSDKSFTFLHALANYTRSPKTIRDQVVSILLAGRDTTAATLSWAFYELSHYPEAYSKLRAEILDKVGPTRAPTYDDLKNMPYLRHTINEVLRLYPAVPYNIRFALTDTTLPIGGGVNGDLPITILKGDAVAYSTYAMQRRADLYPPVSEKFADPAIFSPERWEVWSPKPWHYVPFNGGPRICIGQNFALAEMGYTIVRILQRYERIEYVGDWERQFHKSEIVGTPGMGVKLRLYEARKP

SEQ ID NO: 85357 - protein, 411 aa, Enterococcus hirae
MQSLFTTNKIINVIIYLRLLNKERFDYLMEFIGILCLILVATTIGSHISRRFGIPAVIGQLLVGVLLGQAGLGWVHPNILVHDFSEIGVILLMFLAGLESDLSLLKKYFKPGMFVALLGILFPVFFGWLTGEAFQVANNEAIFFGIILAATSVSISVEVLKELNVVNTKEGSTILGASVVDDILVVLVLSFSLSFLTGKSTSNLPLPLLLLEQLFYFLFIFLLVKWIAPFLMSLAEKIYANSAIIIMSLVICLGMSYLADLIGLSSVIGAFFAGIAVSQTKVKHEVYNNVEALGYAVFIPVFFVSVGLEVDFSKFSEQILFILILTLVAILTKLIGGYIGAKFSSFSSNSALMVGAGMISRGEMALIILQIGQQSNLIENHYYSPLVIVVLLSTLISPLILKYFTKKVYAN

SEQ ID NO: 85358 - protein, 292 aa, Vibrio fluvialis
GRFVFRAAQERNDIEVVGINDLIDVDYMAYMLKYDSTHGRFNGTVEVEGGNLIVNGKTVRVTAERNPEDLKWDAIGVDVVAEATGLFLTDETARKHITAGAKKVVLTGPSKDATPMFVNGVNFDTYAGQDIVSNASCTTNCLAPIAKVLNDKFGIVSGLMTTVHATTATQKTVDGPSAKDWRGGRGASQNIIPSSTGAAKAVGVVLPELNGKLTGMAFRVPTANVSVVDLTVNLDKAASYADICKAMKEASEGELKGVLGYTEDAVVSQDFIGETCTSVFDAAAGIALTDKF

SEQ ID NO: 85359 - protein, 258 aa, Vitis vinifera
MEACVARCSDGVFFRCLNRFNFRRSFKPMASIHAASDGGRWFNRAYDGLLLDAGGTLLQLAKPVESTYADIGRKYGLTASSAEIKQGFRRAFAAPWPEKLRYQGDGRPFWKLVVSEATGCANNDYFEEVYEYYANGDAWHLPTGASETMFLLKDAGVKLAVVSNFDTRLRKLLKDLNVLDLFDAVIISSEVGYEKPDAKIFKAALDQIGVEAGKAVHVGDDQEADKVGASAVGIDCWLWGTDVKTFSDIQKQILISEH

SEQ ID NO: 85360 - protein, 230 aa, Saccharomyces cerevisiae YJM789
MRQVLQKDKRDVQLSKALSYLLRHAAVKEKLTIDSNGYTPLKELLSHNRLKTHKCTVDDIHRIVKENDKQRFHIKTLGADEEWICATQGHSIKSIQPSDEVLVPITEASQLPQELIHGTNLQSVIKIIESGAISPMSRNHVHLSPGMLHAKGVISGMRSSSNVYIFIDCHSPLFFHTLKMFRSLNNVYLSSSIPVELIQKVVVKGNLKDEEKLDTLRRILHERNIPLEKI

SEQ ID NO: 85361 - protein, 288 aa, Zea mays
  misc_feature (92)..(92): Xaa can be any naturally occurring amino acid
  misc_feature (192)..(192): Xaa can be any naturally occurring amino acid
MAAQGSLVMWRAVFAALGLLMVATLVYTLATDGSPFRLELFTPWMVATLADFYVNVIAISAWVIYKEANWVSSAVWVVLLFCFGRYLTPYIXYFWTHFIASLCASILLFDWMGIVDLMVSTLFYSFIFSVLSLALILLTGKLLEVTSAGSSQDPLDLLFIRQGNLSQRKCSYVVIGRVIFSILGIFMAAVAXYTVITDGLPFRKELLTPWMAATLIDFYINVFAISVWVAHKESSWISTTIWIVLLICFGSITTCGYIVIQLFKVSYQDPIYHVLLNSHSKYGIPTSL

SEQ ID NO: 85362 - protein, 292 aa, Vibrio fortis
GRFVFRASVERADIEVVGINDLIDVEYMAYMLKYDSTHGRFNGTVEVKDGNLIVNGKTVRVTAERNPTDLKWDEIGVDVVAEATGIFLTDETARQHITAGAKKVVLTGPSKDATPMFVMGVNQDTYAGQDIVSNASCTTNCLAPIAKVLNDKWGIESGLMTTVHATTATQKTVDGPSAKDWRGGRGASQNIIPSSTGAAKAVGVVLPELNGLLTGMAFRVPTANVSVVDLTVNLKEAASYEAICAAMKEASEGEMAGVLGYTEDQVVSQDFIGEVNTSVFDAKAGVALTDKF

SEQ ID NO: 85363 - protein, 733 aa, Vitis vinifera
MGSQKKRNFQIEAFKHRVVVDPKYADKTWKILEHAIHEIYNHNASGLSFEELYRNAYNMVLHKFGEKLYSGLVSTMTSHLKDISKFIEAAQGGLFLEELNRKWADHNKALQMIRDILMYMDRTFIPSTHKTPVHELGLNLWRDNIIHSSKIQTRLLNTLLELVLRERNGEVINRGLMRNIIKMLMDLGSSVYQEDFEKPFLEVSADFYRVESQKFIECCDCADYLKKAERRLNEEMERVSQYLDAKSEVKITNVVEKEMIANHMLRLVHMENSGLVNMLLDDKYDDLGRMYNLFRRVPNGLSTIREVMTSHIRDTGKHLVTDPERLRDPVEFVQRLLDEKDKYDRIIGSSFNNDKTFQNALTSSFEYFINLNPRSPEFISLFVDDKLRKGLKGVSEEDVEIILDKVMMLFRYLQEKDVFEKYYKQHLAKRLLSGKTVSDDAERSLIVKLKTECGYQFTCKLEGMFTDMKTSQDTMQGFNSAHGADLGDGPTLAVTVLTTGSWPTQPSITCNLPTEMLALCEKFRSYYLGTHTGRRLTWQTNMGTADIKATFAKGQKHELHVSTYQMCVLMLFNNADRLSYKEIEQATEIPASDLKRCMQSMACVKGKNVLRKEPMSKDIGEDDVFFVNDKFTNKLYKVKIGTVVAQKETEPEKQETRQRVEEDRKPQIEAAIVRIMKSRRVLDHNNLIAEVTKQLQSRFLANPVEIKKRIESLIERDFLERDNVDRKLYRYLA

SEQ ID NO: 85364 - protein, 407 aa, Populus trichocarpa
MESSSVFANIVRAPEDPILGVTVAYNKDSSPHKLNLGVGAYRTEEGKPLVLNVVRRAEQMLVNDSSRVKEYLPIVGLADFNKLSAKLIFGADSPAIQENRVTTVQCLSGTGSLRVGAEFLARHYHQLVIYIPNPTWGNHTKIFGLAGLSVKAYRYYDPSTRGLDFQGLLEDLGAAPSGSIVLLHACAHNPTGVDPTIEQWEQIRQLMRSKGLLPFFDSAYQGFASGSLDADAGSVRMFVADGGECLAAQSYAKNMGLYGERVGALSIVCKKADVASRVESQLKLVIRPMYSNPPIHGASIVATILKDRDMYNEWTVELKAMADRIISMRQQLFDALSARGTPGDWSHIIKQIGMFTFTGLNTEQVAFMTKEYHIYMTSDGRISMAGLSSRTVPHLTDAIHAAVTRVG

SEQ ID NO: 85365 - protein, 532 aa, Zygophyllum xanthoxylum
MAPELFRMLATSDHSSVVSMNLFVALLCGCIVIGHLLEETRWMNESITALVIGVCTGVVILLISGGKSSHLLVFSEDLFFIYLLPPIIFNAGFQVKKKQFFRNFITIVLFGAVGTLISCTIISLGVIQFFKGIDVGPFDIGDYLAIGAIFAATDSVCTLQVLHQDETPLLYSLVFGEGVVNDATSVVLFNAIQSFDLTNINTQSAFHFLGQFLYLFLTSTLLGAFTGLLSAYIIKKLYFGRHSTDREVALMMLMAYLSYMLAELTNLSGILTVFFCGIVMSHYTWHNVTESSRITTKHAFATLSFVAEIFLFLYVGMDALDIEKWRFVSDSPKTSVAVSSVLMALVMAGRAAFVFPLSFLSNLAKKSPNDKITFREQIVIWWAGLMRGAVSMALAYNKFTTSGHTNVRGNAIMITSTISVVLFSTVVFGLLTKPLISCLLPHPKHTTSMLSDNGTPKSMNMPLLEQDSEADLGGREVPRPRSIRDLLSTPTHTVHYYWRKFDNAFMRPVFGGRGFVPFVPASPTERNEGQWA

SEQ ID NO: 85366 - protein, 171 aa, Vitis vinifera
MGSENFLTVVAKNFDVFAGPLVALVYPLYASIKAIETKSRADDQQWLTYWVLYSLITLFELTFAKLLEWFPIWPYAKLIATCWLVLPSFNGAAYVYKHFIRPFYMSPQTSQIWYIPRKKDIFGKPDDVLTAAEKYIEEHGTEAFERMISKADREARARRSNYMIFEEDYGY

SEQ ID NO: 85367 - protein, 753 aa, Zygophyllum xanthoxylum
MGQVKDSLTQSLIPIAAFVGIGFALFQWYLVSRVKVSRRYNTRLMSHEEDGVDNADVEYKCAEIQNAISVGATSFLYTQYKYLGIFTGLFSLVIFFFLGSVNKFSTKSQPCVYNTGQLCKPALANAIFTTIAFLLGALTSVLSGFLGMKIATYANARTTLEARKSVGKAFSTAFRSGAVMGFLLAANGLFVLYVSINLFRLYYGDDWEGLYESITGYGLGGSSMALFGRVGGGIYTKAADVGADLVGKVEQNIPEDDPRNPAVIADNVGDNVGDIAGMGSDLFGSYAESSCAALFVASISSFGINDDYAAMSYPLMISSMGIIVCLVTTLFATDFFEIKEVRQIEPSLKRQLLISTILMTVGISIVGYISLPAEFTLFNFGHLKVVRRWQLFFCVSIGLWAGLAIGYTTEYYTSNAYSPVRDVADSCRTGAATNVIFGLALGYKSVIIPIFAIAAAIYVSFRLAAIYGIAMAALGMLSTIATGLAIDAYGPISDNAGGIAEMAGMSHEVRERTDALDAAGNTTAAIGKGFAIGSAALVSLALFGAFVGRAGIEFVDVMSPEVFIGLLVGAMLPYWFSAMTMKSVGSAALKMVEEVRRQFRTIPGLMEGRVKPDYATCVKISTDASLKEMIAPGALVMFTPLIVGTFFGVETLAGVLAGSLVSGVQVAISASNTGGAWDNAKKYIEAGASQHAKSLGPKGSDAHKAAVIGDTVGDPLKDTSGPSLNILIKLMAVESLVFAPFFAAHGGLIFKNI

SEQ ID NO: 85368 - protein, 502 aa, Rhizobium leguminosarum bv. viciae 3841
MLHQKIVESPFKLKYGNYIGGEWREPVEGKYFENLTPVTGGKLCDIPRSNEKDINLALDAAHAAKEKWGRTSAAERSNILMKIAQRMEDKLELLAQAETWDNGKPIRETMAADIPLAIDHFRYFASCIRAQEGSIGEIDHDTVAYHFHEPLGVVGQIIPWNFPILMATWKLAPALAAGNCVVLKPAEQTPASILLWAELVGDLLPPGVLNIVNGFGLEAGKPLATSPRVAKIAFTGETTTGRLIMQYASQNLIPVTLELGGKSPNIFFADVMAEDDDFLDKALEGFAMFALNQGEVCTCPSRALVQESIYDRFMEKAVKRVEAIKQGNPLDTATMIGAQASSEQLEKILAYLDIGKQEGAEVLTGGARNDLGGELANGYYVKPTIFKGHNKMRVFQEEIFGPVVSVTTFKDEKEALEIANDTLYGLGAGVWSRDANRCYRFGREIQAGRVWTNCYHAYPAHAAFGGYKQSGIGRETHKMMLDHYQQTKNMLVSYSPKALGFF

SEQ ID NO: 85369 - protein, 507 aa, Salmonella enterica subsp. arizonae serovar 62:z4,z23:--
MVLVILDGYGYREEQQDNAILNAKTPVMDALWAKRPHTLIDASGLEVGLPDRQMGNSEVGHVNLGAGRIVYQDLTRLDVEIKERTFFANPVLTNAVDQAKNAGKAVHIMGLLSAGGVHSHEDHIMAMVELAAERGAEKIYLHAFLDGRDTPPRSAEASLKKFEDKFAALGKGRVASIVGRYYAMDRDNRWDRVEKAYDLMTLAQGEFQADTAVAGLQAAYARDENDEFVKATVIRAEGQADAAMEDGDTLIFMNFRADRAREITRAFVNADFDGFARKKVVNLNFVMLTEYAADIKTVVAYPPASLANTFGEWMAKNDKTQLRISETEKYAHVTFFFNGGVEEPFAGEERILINSPKVATYDLQPEMSSAELTEKLVAAIESGKYDTIICNYPNGDMVGHTGVMEAAIKAVEALDNCIDQVTKAVESVGGQLLITADHGNAEQMRDPATGQAHTAHTNLPVPLIYVGEKNVKAIEGGKLSDIAPTMLSLMGMEIPQEMTGKPLFIVE

SEQ ID NO: 85370 - protein, 273 aa, Salmonella enterica subsp. arizonae serovar 62:z4,z23:--
MPCEELEIVWKNIKAEARALADCEPMLASFYHATLLKHENLGSALSYMLANKLASPIMPAIAIREVVEEAYAADPEMIASAACDIQAVRTRDPAVDKYSTPLLYLKGFHALQAYRIGHWLWNKGRRALAIFLQNQISVSFQVDIHPAAKIGRGIMLDHATGIVVGETAVIEDDVSILQSVTLGGTGKTSGDRHPKIREGVMIGAGAKILGNIEVGRGAKIGAGSVVLQPVPPHTTAAGVPARIVGKPGSDKPSMDMDQHFNGIHHTFEYGDGI

SEQ ID NO: 85371 - protein, 491 aa, Zea mays
MNLESYTCENCIWQKEETLYHLFLKCNFAKACWTSIGLTSPRIANPEAAANKAPTVQHCQNEFARELHLVMLRAKGRFDSTIPAWLQLWHSARVPRVPTSLPFLPHHFFRPKQEKTKNNPDPPITWAHPPPHHQRPGRRKGKEEPRNPPHRRHRQAGQQIASSDFRRVSDQAAAISLSPHSGIPPPLAASPLVHRPPNARDRPVSVHPRGSWNINLWEVKTGGAMYNNYRNPPGTHMPPQNSQPVQFDNPLYGASSGLIRSGIGVYGEKFLGSSSEFMQSNINRYFSNPQYYFHVNDQYVRNKLKVILFPFFHRGHWTRISEPVGGRLSYKPPIYDINAPDLYIPFMAFGSFIILSGFTLGFMGKFTPEAINLQFTRALIGWGFQLTVLKGLLYSMGGGEVPLLDLVAYGGYLFAGLSLAVVARLVWAYSYYVMMPWMSLCMGVFLVRTMKRVLFTEMRSSERHSSRQHYFLLFMAIVQFPLFFWLGSIGV

SEQ ID NO: 85372 - protein, 473 aa, Nocardia farcinica IFM 10152
MMRRTKIVCTLGPATATEDRIRELVESGMDVARLNFSHGEHSDHAENYKKVRQASDHLGRAVGILADLQGPKIRLGRFAEGRTVWATGEEVRITVDDIDGSHDRVSTTYKQLAQDAKPGDRLLVDDGKVGLTVTRVEGNDVVCRVTEGGPVSNNKGVSLPGMDVSVPALSDKDIEDLEFALDLGVDFIALSFVRSPADVELVHDVMDKVGRRVPVIGKLEKPEAIDNLEAIVLAFDAIMVARGDLGVELPLEQVPLVQKRAIQMARENAKPVIVATQMLESMIENSRPTRAEASDVANAVLDGADAVMLSGETSVGAFPIETVRTMARIVHAVEAESSTRVPPLTHVPRTKRGVISYAARDIGERLNAKALVAFTQSGDTVRRLARLHTPLPLLAFTPLPEVRSQLALTWGTETFIVPTVDSTDAMIHQVDQALLSMGRYSKGDLVVIVAGSPPGTVGSTNLIHVHRIGEEDH

SEQ ID NO: 85373 - protein, 299 aa, Streptococcus pneumoniae
MTSKVRKAVIPAAGLGTRFLPATKALAKEMLPIVDKPTIQFIVEEALKSGIEDILVVTGKSKRSIEDHFDSNFELEYNLKEKGKTDLLKLVDETTGMRLHFIRQTHPRGLGDAVLQAKAFVGNEPFVVMLGDDLMDITDEKAVPLTKQLMNDYEKTHASTIAVMPVPHEDVSSYGVIAPQGEGSNGLYSVETFVEKPAPEETPSDLAIIGRYLLTPEIFEILEKQAPGAGNEIQLTDAIDTLNKTQRVFAREFTGTRYDVGDKFGFMKTSIDYALKHPQVKDDLKNYLIQLGKELTEKE

SEQ ID NO: 85374 - protein, 170 aa, Glycine max
  misc_feature (144)..(144): Xaa can be any naturally occurring amino acid
  misc_feature (161)..(161): Xaa can be any naturally occurring amino acid
MSKLFHSACKAARSLIASSSAPAPRAASSLLADGRNAALATLANLGRNSTLPAAYAHHLHTNASSHGYAWIAAIPAAAYMLQDQDVHAAEMERTFIAIKPDGVQRGLISEIVSRFKRKGYKLVAIKLGGPSKQFAEKHYHDLKXRPFLSGLCDFLSSGPVXLAMVWEGKR

SEQ ID NO: 85375 - protein, 204 aa, Glycine max
MATSENNNARPQRVAKKRAAAAICELHRNAAKRKRVVLGDLTNVSSNYVAVTEKEIQKQKKVKREQPARPVSTPEKVEERHDPQLCGPYVSDIYEVFRVMEVDPSKRPLPDYVQKVQRDVNANMRGVLVDWLVEVAEEYKLVSDTLYFCVAYIDRFLSLNALSRQKLQLLGVASMLIASKYEEIKPPDVEDFCYITDNTYSKGK

SEQ ID NO: 85376 - protein, 363 aa, Methanothermobacter thermautotrophicus str. Delta H
MTYTSGRILGSMCTSSHPLARRVYCDFLESNLGDPGLFRGTRELESGVIGMLGELLSEPDAAGHIITGGTEANLMAMRAARNMAGAEKPEIIVPKSAHFSFRKAADILGLRLREAELDQDYRVDVESVRKLISENTVAVVGVAGTTELGRIDPVEELSEICLDEDIHLHIDAAFGGFIIPFLRETGAELPEFDFKLQGVSSITVDPHKMGLAPIPSGCILFRDASYLDAMSIETPYLTEKQQSTIVGTRTGASAAATWAIMKHMGREGYRKLALRVMGVTRRLRDGLVELDYQLVVEPELNIVAFNHPAMGPHELADRLEELGWAVSVSSCPPAIRVVLMPHIMEEHIELLLRDLEGIRLREE

SEQ ID NO: 85377 - protein, 291 aa, Vibrio furnissii
RFVFRAAQERNDIEVVGINDLIDVDYMAYMLKYDSTHGRFNGTVEVEGGNLIVNGKTVRVTAERNPADLKWNEIGVDVVAEATGLFLTDETARKHIEAGAKKVVLTGPSKDKTPMFVMGVNHTTYAGQDIVSNASCTTNCLAPIAKVLNDNFGIESGLMTTVHATTATQKTVDGPSAKDWRGGRGAAQNIIPSSTGAAKAVGVVLPELNGKLTGMAFRVPTANVSVVDLTVNLEKAASYDDIKAAMKAASEGELAGVLGYTEDAVVSTDFNGDTRTSIFDAAAGIALTDKF

SEQ ID NO: 85378 - protein, 280 aa, Vibrio gazogenes
ERNDIEVVGINDLIDVDYMAYMLKYDSTHGRFNGTVEVEGGNLIVNGKTVRVTAERNPEDLKWDAIGVDVVAEATGIFLTDETARKHITAGAKKVVLTGPSKDATPMFVNGVNFDTYAGQDIVSNASCTTNCLAPIAKVLNDKFGIESGLMTTVHATTATQKTVDGPSAKDWRGGRGASQNIIPSSTGAAKAVGVVLPEVNGKLTGMAFRVPTANVSVVDLTVNLVNGASYADICKAMKEASEGELKGVLGYTEDAVVSQDFIGETCTSVFDAKAGIALT

SEQ ID NO: 85379 - protein, 684 aa, Methanothermobacter thermautotrophicus str. Delta H
MTGARNWLNKPLIFFKFNNHHTASPGDKMVKYVAFFEELGKDDVGIAGGKGANLGELTQAGIPVPPGFVVTAATYDKFMTDTGLQPVVMEMLENLDVNDTKELQRVSAEIKDIITSTEVPEDIQTLIIESYNALCQRIGKDDVYVAIRSSATAEDLPEASFAGQQDTFLNIRGAEDVLDYVRRCWASLFEARAIFYREENNFDHSKVYIAVVVQEMVDAEKAGVMFTVHPSTGEDRILIEGSWGLGEAVVSGSVTPDTYWVDKGTGKLLEFTVGEKNIMFTREDGRTVKKEVPPELRNKRVLSDGEIAALAEMGRRIQDHYGSPQDTEWAIMDGDVYMLQSRPITTLGEATEETEVKSREILVKGLGASPGLASGRVKIIREIHELDKIQIGDILVTVMTTPDMVPAMKRASGIITDEGGVTCHAAIVSRELGIPCVVGTGNATEVLKENQVVSIDGNRGLVYEGSVIEGEKKEAEAETVTVESPLLTVTEVKVNVSMPEAARKAAATGADGVGLLRTEHMMLTTGVHPRKFIEEGREDELVNTLAENILKVADEFYPRPVWYRTLDAPTDEFKTLEGGENEPYEHNPMLGWRGIRRELDEPEILRAEFRAIKKLHEQGYTNIGIMIPLVQHPDELRKAKMIAEEAGLKPHRDVEFGIMVETPAAALIIEDFIEEGIDFVRLEP

SEQ ID NO: 85380 - protein, 291 aa, Vibrio hepatarius
GRFVFRAAQERNDIEVVGINDLIDVEYMAYMLKYDSTHGRFNGTVEVEGGNLIVNGKTVRVTAERNPEDLKWDAIDVDVVAEATGLFLTDETARKHITAGAKKVVLTGPSKDATPMFVMGVNQDTYAGQDIVSNASCTTNCLAPIAKVLNDEFGIESGLMTTVHATTATQKTVDGPSAKDWRGGRGASQNIIPSSTGAAKAVGVVLPELNGKLTGMAFRVPTANVSVVDLTVNLKNGASYDAICAAMKAASEGALKGVLGYTEDQVVSQDFIGEVQTSVFDAKAGIALTDN

SEQ ID NO: 85381 - protein, 342 aa, Populus trichocarpa
MGFAASMSSPPPPLQLSSSSSSSSSWSKSALFSVTPVSFSPPTGKNAQYRKRLVVLSKRVSPLEEGMRIRRERELQKTVKFRKRPPLRRGRVSPRLPVPDDIPKPPYLGSNELPDISSEHQIHDSEGIVKMRAACELAARVLDNAGKLVRPSVTTNEIDKAVHQMIIDAGAYPSPLGYGGFPKSVCTSVNECMCHGIPDSRQLQDGDIINIDVTVYLNGYHGDTSKTFLCGNVNDALMRLVKVTEECLERGIALCKDGASFKKIGKRISEHAEKYGYGVVERFVGHGVGTVFHSEPLILHNRNDRPGIMVEGETFTIVQTIVGYMVSSLVHFIRCLPSLHLI

SEQ ID NO: 85382 - protein, 291 aa, Vibrio hispanicus
GRFVFRAAQERNDIEVVGINDLIDVDYMAYMLKYDSTHGRFNGTVEVEGGNLIVNGKTVRVTAERNPEDLKWDAIGVDVVAEATGLFLTDETARKHITAGAKKVVLTGPSKDATPMFVNGVNFDTYAGQDIVSNASCTTNCLAPIAKVLNDKFGIESGLMTTVHATTATQKTVDGPSAKDWRGGRGASQNIIPSSTGAAKAVGVVLPEVNGKLTGMAFRVPTANVSVVDLTVNLVNGASYEAICAAMKEASEGELKGVLGYTEDAVVSQDFIGEVCTSVFDAKAGIALTDK

SEQ ID NO: 85383 - protein, 558 aa, Photobacterium profundum SS9
MYENNKTLYLPYAGPTLLENALLNKGSAFSPEERQNFSLMGLLPAAIESITEQEERAYSQYQTFNDDMDKHIYLRNIQDTNETLYYRLIDNHIEEMMPIIYTPTVGAACEQFSNIYRRGRGLFLGYPDKGNIVDILNNAARQDVKIIVITDGERILGLGDQGIGGMGIPIGKLALYTACGGINPANTLPIVLDVGTNNTQLLSDPMYMGWRHPRITGQEYDDFVEEFIQAVKSRWPNALIQFEDFAQKNAMPLLNRYKDKVCCFNDDIQGTAAVTVGSLLAACKAAGSELSEQRITFVGAGSAGCGIAEAIVAQMIAEGLSDSAARARIFMVDRWGLLTDNMQNLLDFQQKLAQKSATVSQWNETGNISLLDVVSNGKPTVLIGVPGLFSQEVIMEMHAHCKRPIVLPLSNPTSRVEATPSDIIRWTEGDALIATGSPFDPVIFNEKTYPIAQCNNSYIFPGIGLGVLASGATRVTDEMLMESSRVLAECSPLAQNGNGALLPPLKDIHQVSHCIALAVAKKAVEQNKAPQRTEKQLLEKIESYFWKPEYLKYKRTAL

SEQ ID NO: 85384 - protein, 170 aa, Triticum aestivum
  misc_feature (30)..(30): Xaa can be any naturally occurring amino acid
MAAEEGEKKMITLKSSDGEEFQVEEAVAMXSQTIRHMIEDDCADNGIPLPNVDSKILSKVIEYCKKHVQASPKPADSGAAVDASSSTSTAAAAPTEDLKSFDAEFIKVDQNTLFDLILAANYLNIKGLLDLTCQTVADMIKGKTPEEIRKTFNIKNDFTPEEEAEIRKEN

SEQ ID NO: 85385 - protein, 292 aa, Vibrio ichthyoenteri
GRFVFRAAQERNDIEVVGINDLIDVEYMAYMLKYDSTHGRFNGTVEVVDGNLIVNGKTVRVTAERNPEDLKWDAIGVDVVAEATGLFLDDATARKHITAGAKKVVLTGPSKDATPMFVMGVNDSTYAGQDIVSNASCTTNCLAPIAKVLNDNFGIVSGLMTTVHATTATQKTVDGPSAKDWRGGRGASQNIIPSSTGAAKAVGVVLPELNGKLTGMAFRVPTANVSVVDLTVNLEKGASYEAICAAMKAASEGELKGVLGYTEDQVVSQDFIGEVQTSVFDAKAGIALTDNF

SEQ ID NO: 85386 - protein, 159 aa, Brassica napus
MAQRTEKEETEFKVLESLTTPATATTTLCSNNCGVTANPATNNMCQKCFNASIAAAGVDSGSTLKRASRSVNLRPTPAKVVIRPREIDPVKRDQQTVNRCSGCRKKVGLTGFRCRCGDLFCSEHRYSDRHECSYDYKTAGREAIARENPVVKAAKTVKV

SEQ ID NO: 85387 - protein, 143 aa, Cytophaga hutchinsonii ATCC 33406
MNIFVGSLPFSLEENELREFFEEYGEVSSVKIISDKFTGRSKGFGFVEMPDDAAAQKAIDELNGAEVNGRTIVVNKSEEKKDGPRRSGFSGGGNRGGGGGYSGGGNGGGGYGGNRSGGGGYGGGGNSRGFGGSGTGRNSRGDR

SEQ ID NO: 85388 - protein, 1041 aa, Oryza sativa Japonica Group
MAGSFDGRMPTRGVEQAIVALKKGAHLLKFGKRGKPKFCPFRLSSDEKTLVWYSKDREKHLSLNSVSTVVLGQKTICRDRDQAECWFLGLTALTSSPYSPLPLAGSKSGRQINSCAISPRSYLQRKCRLSAALDTPRHTQVYPSYGSPKIQKKIFGGNLDSSEALFYPRHPTSCDIDSYIEKLNPKIATPVKHGLKDIMVANRRAQNITHTPKLKTFEGPRVACRLDSLKDVFLWGSVLGSMLGSEDIPKSLPRLVGSAKMLDVQSIACGENHAAIITKQGEVYTWGSYSSGRLDQKVNVNASCPKMVESLASVHVKAVAFGSKHTCAITVSGELFEWGEGAHSLGLMNDWYGRNQWFPHKFLGPMDNISVSKIACGEWHTAIITSSGQLFTYGDGTFGVLGHGDTQGVARPKEVESLKGSRVKSVACGPWHTAAIVEVMSSFKGNAPSGKLFTWGDADRGKLGHADRKMKLLPTCVDSLTAYDLIQVSCGTAVTVVLTVTGMVFTIGSSRHGQLGNPKADGESICSVEGPLKTEFVREISSGSSHVAVLTMSGKVFTWGKGAEGQLGLGDYSNRSSPTLVEALEGRDVESVVCGFNFTAAICLHKTMSMKDQSVCSSCQMVFGFTRKEHNCYNCGSMFCSSCTSNKITMAALAPDTNRRYRVCDACFYQLQKVVDSSKDKSRLKISKGEMFKLELKAYTPKLSRLFKEANFFAEKMASVQGTNQRNEEPATAVQTKTERWGQVECPALFISAQDSFQTQPVSNSEGCAISFSQRMHDSAVLKSGVSLRFTDAQREEIEMMQTELQGQVKQLHSQVAVLTEQCQQKSVMVQLYKQKLDDTWLVVRDEAARCKAAKDIIKVLTDQCNALSEKLSIGQLSENSKITPNSIPMQPTKIELQGNTGRNLVTRKLGQLNNTQNHGSSIQTEKECVPLSNAVVPEDVPFSQQNGARKFSSDGYTTEAPLAAPPTDSVTEQIEHGVYVTFSTSSCGKKDIKRIRFSRKHFGEKEAQHWWEHNKTRVYDNYKVEQMATPSVTLSCSSTR

SEQ ID NO: 85389 - protein, 494 aa, Cytophaga hutchinsonii ATCC 33406
MLNGIMIQFFHWYSRDNGSLWNYLKDEAPRLAGLGVTAVWLPPASKGSLGMESRGYDVYDLYDLGEFDQKGTVETRYGSKDEYLACIKALQENGITAIADIVLNHKGGADETQKVWVKKVDPENRNEFISDRYEIEAYTKFTFPGRNKKYSDFIWDSQCFSGVDYDEQTKETAIFSIQNEYGDGWEEVIDVEKGNFDYLMCADIEYRNPAVRDEIKNWGKWYLETTGFHGIRLDAIKHISPRFIIEFIDYMRSLKNDLFVVGEYWAPGDLPLLKRYIEATEGRMTLFDASLHHNLYAASQQGKDYNMAAIFDGSLVQEVPDLAVTLIDNHDTQPLQALEAPVNPWFKGLAYALILLREKGYPCVFYPDLYGTSYKDKGKDGNEYEINMPKCDALEGLLKARKEFAYGYQRDYFDHPNCVGWTREGKEDDDKTGCAVLLSNGEDGFKHMEIGARHTGKTFYDYLGHVQEEVHIAENGWAEFKTKGGSVSVWVQRI

SEQ ID NO: 85390 - protein, 348 aa, Saccharomyces cerevisiae YJM789
MSIPETQKGVIFYESHGKLEYKDIPVPKPKANELLINVKYSGVCHTDLHAWHGDWPLPTKLPLVGGHEGAGVVVGMGENVKGWKIGDYAGIKWLNGSCMACEYCELGNESNCPHADLSGYTHDGSFQEYATADAVQAAHIPQGTDLAEVAPVLCAGITVYKALKSANLMAGHWVAISGAAGGLGSLAVQYAKAMGYRVLGIDGGEGKEELFRSIGGEVFIDFTKEKDIVGAVLKATDGGAHGVINVSVSEAAIEASTRYVRANGTTVLVGMPAGAKCCSDVFNQVVKSISIVGSYVGNRADTREALDFFARGLVKSPIKVVGLSTLPEIYEKMEKGQIVGRYVVDTSK

SEQ ID NO: 85391 - protein, 330 aa, Alkaliphilus metalliredigens QYMF
MTKPRIAIIFTGGTISMSVDPRVGAAIPSLSSEQIMSLVTNIDRYAHIESINFSELPGPHMVPKLMFQLRNLVLETLSREEIDGIIVTHGTDTLEETAYLLDLTINSPKPIVVAGAMRNSSELGYDGPSNLAAAVCTAISPQSRCKGVLVVMNNEVNAASEVTKTNTLSLDTFKSLEFGPLGIVDNDQVIYHRNMVSRQFIETDEVNDQVDLIKCVAGMDDRFLKFSVDSGAKGIILEAMGRGNIPPAMIPGVEYAIKNNVAVVMISRCPTGRVLDTYGYEGAGRHLRNIGVILGGSLPGQKARIKLMLALTVSADLLALRELIESDQYR

SEQ ID NO: 85392 - protein, 321 aa, Moorella thermoacetica ATCC 39073
MATKKNRSLLEIIPKYFTLWVIVFAALALLSPNSFQFLGKYISYLLGVVMLGMGMTLTMGDFAGVLQQPLNVVVGVALQFIIMPLLGFAIATILRLPPELAAGVVLVGCVPSGTASNVMTFIAQGDVALSVTISSITTLIAPFITPYLYLLLGGKFIPVEPLALLIDIAKIVLLPIIIGLVIRQVLGNERARVVNQVMPSVSVIAIVIIIAAVVAGSAAKLVNVAGAVILAVILHNGLGFLMAYFVARYLCRMTEAQARAVSFEVGMQNSGLGAALAMKFLTPVAALPSAIFSVWHNLSGSFLANFWARRAPAPAARLARR

SEQ ID NO: 85393 - protein, 439 aa, Bradyrhizobium sp. ORS278
MRIAMIGTGYVGLVSGACFADFGHEVTCVDKDESKIAALHRGEIPIFEPGLDALVAANVKAKRLDFTTDLKQPVADADAVFIAVGTPSRRGDGHADLTYVYAAAREIAASLTGFTVVVTKSTVPVGTGDEVERIIRETNPAADVVVASNPEFLREGAAIRDFKWPDRIVVGTDDERGRKALGDIYRPLSLNQAPIMYTARRTAELIKYAANAFLATKITFINEVADLAEKVGADVQEVARGIGLDNRIGSKFLHAGPGFGGSCFPKDTRALIKIAQDYDTQLRIVESVLAVNDNRKRAMARKVAHAVGGNLRGKTVAVLGLTFKPETDDMREAPSIPLVTGLLDMGAKVRAHDPVGIEQAKKELPEIAYFEDPYACATGADAIVLVTEWVQYRAMDLDRLKQVMARPVVVDLRNVYRPDEMAAHGFVYESVGRPSAKGA

SEQ ID NO: 85394 - protein, 267 aa, Shewanella sp. MR-7
MHTDINALFAALWQDYIQMTPSAAKVHELLGHGKPIINDHIALRTFNIAKVNLAVLAEHFTSLGYVACGDYKFEQKKLVAKHFEHPDATQPKVFISELLVEEFSPSLQSTIQGLIAQVDEQATKADNFIYSGRHWSLDAKTYETLLEESEYAAWVAAFGYRANHFTVSINHLEGFETLESVNDALKQAGFVLNSSGGEIKGSPEVLLEQSSTMADKIAVEFSDTTVEIPSCFYEFALRYPKANGELYTGFVAASADKIFESTNAKKA

SEQ ID NO: 85395 - protein, 244 aa, Prochlorococcus marinus str. AS9601
MLRTFKSDIEIIRERDPAARGIIEIFLCYPGFQSIVIHRFTHKLWQLKIPLIPRILSHLNRLATGIEIHPGAKIGKRVFIDHGMGVVIGETAEIGNNCLLYQGVTLGGTGKSHGKRHPTLMENVVVGAGAKVLGSITVGPNTRIGAGSVVVRNVDGNSTVVGVPGRVVHQSGVKVNPLAHSALPDAEANVIKNLMDRIDSLENEILKLQRTLQCIASSESIDISKLGDSQNLKDKEIFEYLGDD

SEQ ID NO: 85396 - protein, 496 aa, Thermus thermophilus HB27
MPLITTETGKKMHVLEDGRKLITVIPGDGVGPECVEATLKVLEAAKAPLAYEVREAGASVFRRGIASGVPQETIESIRKTRVVLKGPLETPVGYGEKSANVTLRKLFETYANVRPVREFPNVPTPYAGRGIDLVVVRENVEDLYAGIEHMQTPSVAQTLKLISWKGSEKIVRFAFELARAEGRKKVHCATKSNIMKLAEGTLKRAFEQVAQEYPDIEAVHIIVDNAAHQLVKRPEQFEVIVTTNMNGDILSDLTSGLIGGLGFAPSANIGNEVAIFEAVHGSAPKYAGKNVINPTAVLLSAVMMLRYLEEFATADLIENALLYTLEEGRVLTGDVVGYDRGAKTTEYTEAIIQNLGKTPRKTQVRGYKPFRLPQVDGAIAPIVPRSRRVVGVDVFVETNLLPEALGKALEDLAAGTPFRLKMISNRGTQVYPPTGGLTDLVDHYRCRFLYTGEGEAKDPEILDLVSRVASRFRWMHLEKLQEFDGEPGFTKAQGED

SEQ ID NO: 85397 - protein, 158 aa, Prochlorococcus marinus str. AS9601
MAIFEGSFTTASTLKVGIVIARFNDLITNKILSGCLDCLKRHGLDTSELSNQVDIVWVPGSFELPIAAKTLMKKKSYDVVIALGAVIRGETSHYDVVISEASKGISQVSNENNVPIIFGVLTTDTMQQALERAGIKNNLGWNYALQAIEMGSLIKNLN

SEQ ID NO: 85398 - protein, 360 aa, Nocardia farcinica IFM 10152
MSDAKAVRLGLIDGDGIGPEVVRATRAVVDEALVAAGGAAVVWVPLLIGHRAIEEYGTPLPQQTLDGLAAVDAWILGPHDNASYPGEHRGAVPPGGAIRKHFDLYANIRPARALPGVRAAAPDIDLVIVRENSEGFYADRNMVAGSGEFQPSIDLAMAVAVVSRQATERIAHEAFRLAQTRRKKVTIVHKANVLPRTMGLFRDVCYEVAASYPGVVVDDEHVDAAAAHLVRAPGDYDVVVTENLFGDILSDLAGQLSGSLGTAASLNCSATRAMAQAVHGAAPDIAGHNRANPVALQCSAAMLLRWLAIRRGESVLSRAAERIERAVAATFAAGIATADLGGQASTAEFTEQVCARVHRR

SEQ ID NO: 85399 - protein, 227 aa, Zea mays
MVTGDVKLIGSWASVFVMRARIALNLKSIRYEFLQETYGTKSELLLKSNPVHKKIPVLIHDDKPVCESNIIVQYIDEAWSSYGPSILPSQPYDRAIARFWAAYVDDKWFIALRSILTARGEEEKKAAIAEVEGRTDHLEKAFIECSNGKPFFNGDHIGYLDIALGSFLGWWKVVELDANHILLDETKTPSLFKWAERFCNDPDVKPLMPETAKLAEFARKLFPKPQA

SEQ ID NO: 85400 - protein, 711 aa, Arabidopsis thaliana
MNGSSAATPPPPPNSKNSSTSCNRTCGGISIPFPFGIGGKDCYLNGWYEVVCNATTSGSSGTTVPFLSRINREVVNISLPEGNNEQYGVVHIKGPVTSLGCSSNTSQVPQKSLPDLNVTGKGSPYFITDENRLVAVGCGTKALMTDIESEILGCESSCKDSKSSQEVTNLLCDGYKCCQARIPVERPQAVGVNIESSGGDGCKVAFLSSKRYSPSNVTIPEQFHAGGYVVVELGWYFATTDSRFRNPLGCINLTYSGSYLSGDSCLCEYGYFSEMSYRNCYCSLGFTGNPYLRGGCIDNDDCKGPNICEEGTCVNVPGGYRCDPKPKIIKPAKPLVLQGVLLGLMGLLFLVVGTLGLIIFIKKRRRIISSRKFFKRNGGLLLKQQLTTTNDGNVDMSRLFSSEELKKATDNFSVKRVLGKGSQGTVYKGMMVDGKIIAVKRSKVVDEDKLEKFINEIILLSQINHRNIVKLIGCCLETEVPILVYEYIPNGDMFKRLHDESDDYAMTWEVRLRIAIEIAGALTYMHSAASFPIYHRDIKTTNILLDEKYGAKVSDFGTSRSVTIDQTHLTTMVAGTFGYMDPEYFLSSQYTDKSDVYSFGVVLVELITGEKPLSRIRSEEGRGLATHFLEAMKENRVIDIIDIRIKEESKLDQLMAVAKLARKCLSRKGIKRPNMREASLELERIRSSPEDLEAHIENDDEEDQVMEISRE

SEQ ID NO: 85401 - protein, 524 aa, Aspergillus nidulans FGSC A4
MSKTKSVVKKGAESAGKLADKALSKVKDAGVTKATQSPKAKSKQIAREIASKEKKPKSKKKEPTPSSSSESESESESESDSSSSESESEDEKPVKKEVKKEAKKAESSSESESDSSDSDEEMKDASSSESDSESESEEEKKPAKSAKAEPKVVKKAESSESESSDSSDSDSDDESSEEEEVPKAKAKAAESSDSEDSDSESEEEAPAKAKGDAKTSKEESDSDSDSSESSSDSDEESGSSGSESEDSDKPADSKKRKAEEEPAAASKKSKTEEGASANLFVGNLSWNVTEEWLHQEFEQFGELSARIMTERDTGRSRGFGYVEFTNAADAAKAYEAMKEHEIDGRKINLDYATGRPANKDQGGFKERAQNRARSFGDQTSPESDTLFVGNLPFSANEDSVHEVFGPQGNVLGIRLPTDMESGRPKGFGYVQYSSVDEARKAYNELQGAEIDGRPIRLDFSTPRANNGGGGGGRGGFGGRGGRGGPRGGGRGGRGGFGGRGGGAGGAPNRARGGIPEFKGTKMTF

SEQ ID NO: 85402 - protein, 586 aa, Prochlorococcus marinus str. AS9601
MALLVKKFGGTSIGDIKKIKNIASSICQSKEAGNEIVVVVSAMGQTTDDLNCLAESISKNPNRRELDMLLSTGEQVTIALLSMALNECGIPAISMTGSQVGIITESIHGKARILDIKTERIQNYLNQGFVVVVAGFQGTTLSHTGSMEITTLGRGGSDTSAVALSTALGAETCEIYTDVPGVLTTDPRIVPNAKLLDEISCEEMLELASVGASVLHPRAVEIARNYGIKLCVKSSQSDSSGTLLESQIQPLPLKRGSLELTKTVNSLEVLENQAVFSLSNIPDRPGIAAQIFEKLSEASINVDLIIQATNDGNKNDITFTVGELEVQKTAEQCELITSQLGGEFNLKTNMTKLSIQGAGIMGRPSVSADLFDTLSQANINVRLIATSEIKVSCVIEVNNIPKAIRFVAEKFKLSETQIFVNPINEKQDQPEVRGIALDRNQVQVSFRKLPDRPGVAASICLALAENNLLIDTIVQSERISTLKTKDISLTMNKQDRDKANLVFEALTKKLPGSYVEDGPAIAKVSTVGAGMAFKVGTAGKIFRALADQNINIEMIATSEIRTSCIVLEKDCDKAVNAIHNHFELEK

SEQ ID NO: 85403 - protein, 204 aa, Zea mays
MATASLLEATRLLSTPRPPRRSLHTHLLRTPRLSALRAHLHRSATLDAQEPTARPGALLVLDALRRSVVDSLAALKRPALALLLAGALLAAASMGGPHAAALAASGGRVGGSAFSSRSSSPPSYGYSAPAPRGGYTAAPYYSPSPFVSFGPAVGIGFGGSGFLVTLIGFAAFLYLAGFLSDSSGGTSVLTETDKTTVLKLQYLS

SEQ ID NO: 85404 - protein, 289 aa, Vibrio logei
TFVFRASVERNDIEVVGINDLIDVEYMAYMLKYDSTHGRFNGTVEVVDGNLVVNGKTVRVTAERNPEELKWDAINVDVVAEATGLFLTDETARKHITAGAKKVVLTGPSGDVPMFVMGVNAADYAGQDIVSNASCTTNCLAPIAKVLNDKWGIESGLMTTVHATTATQKTVDGPSAKDWRGGRGASQNIIPSSTGAAKAVGKVIPELNGLLTGMAFRVPTANVSVVDLTVNLKTAATYEEICAEMKRASENEYAGVLGYTDEAVVSQDFIGETQTSVFDAAAGVALTDK

SEQ ID NO: 85405 - protein, 245 aa, Oryza sativa
MAGRSELVVSFGEMLIDFVTLRADGEREFMFYRNPSADMLLTHAELNVELIKRAAVFHYGSIGLIAEPCRSAHLRAMEIAKEAGALLSYDPNLREALWPSREEARTKILSIWDQADIVKVSEVELEFLTGIDSVEDDVVMKLWRPTMKLLLVTLGDQGCKYYARDFRGAVPSYKVQQVDTTGAGDAFVGALLRRIVQDPSSLQDQKKLEEAIKFANACGAITATKKGAIPSLPTEVEVLKLMESA

SEQ ID NO: 85406 - protein, 483 aa, Streptococcus thermophilus CNRZ1066
MIVSTYYPKIFYCDKLILLHLLEESMKNHNYENEGQFQRKMTSRHLFMLSLGGVIGTGLFLSSGYTIAQAGPLGAILSYLVGAVVVYLVMLSLGELAVAMPVTGSFHTYATKFISPGTGFTVAWLYWICWTVALGTEFLGAAMLMQRWFPSVPAWIFAAFFALVILGINALSVRSFAEAESVFSSIKVIAILVFIILGLGAMFGLVRFEGHHEAIMFKHLTANGLFPNGGLAIVSVMLAVNYAFSGTELIGIAAGETDNPKEAVPRAIKTTIGRLVIFFVLTIVVLASLLPMKEAGVSSAPFVDVFDKMGIPFAADIMNFVILTAILSAGNSGLYASSRMLWSLANEGMLNKKLVTINKHGVPMTALLISMAGAVLSLFSSIYAADTVYLALVSIAGFAVVVVWLSIPMAQINFRKQWKLEHSEDELDYKTPFNPILPYITIVLLAISVLGIAWDSSQRAGLYFGIPFMIFCYLYHYLCFNKW

SEQ ID NO: 85407 - protein, 435 aa, Alkaliphilus metalliredigens QYMF
MNHILKEKITKKNAHICVIGLGYVGLPLAIESAKTGFSVTGIDHNQNRVQQVNNGENYILDTKDKELEELISSGKLRAETNYSSVKDVDIIVVCVPTGLTQNLTPDLQHIENVAHNIVSILKKGQLICIESTIYPGTTEEIILPILETSGLVVEKDFYLCHSPERVDPGNQNFMTKNINKVVGGIGPQSLDVAECFYEQFIEHVVSVSNVKVAEMSKVHENTFRAINIALVNELALLCDKMDISVWEVLDAAFTKPFGIMAFYPGPGVGGHCIPIDPHYLEWKAREYNFITKFIGIAGEINRRMPEFVREKVLRGLNAIGIAPSKSKVLILGMAYKKDTPDCRESPVISIVELLLKDGIDISYHDPYVDQIEIASQVLQSVPLNKITIQGVDIVLIATDHSKIDYHWLVKTAEKIIDTRNITKNIPDRENNVILM

SEQ ID NO: 85408 - protein, 286 aa, Vibrio mediterranei
RAAQERNDIEVVGINDLIDVEYMAYMLKYDSTHGRFNGTVEVEGGNLIVNGKTVRVTAERNPEDLKWDAIDVDVVAEATGLFLTDETARKHITAGAKKVVLTGPSKDATPMFVMGVNQDTYAGQDIVSNASCTTNCLAPIAKVLNDEFGIESGLMTTVHATTATQKTVDGPSAKDWRGGRGASQNIIPSSTGAAKAVGVVLPELNGKLTGMAFRVPTANVSVVDLTVNLKNGASYEAICAAMKAASEGALKGVLGYTEDQVVSQDFIGEVQTSVFDAKAGIALTDN

SEQ ID NO: 85409 - protein, 362 aa, Clostridium thermocellum ATCC 27405
MGKYKIAVLPGDGIGPEVIEQAVKVIEAVGEIYNHSFELKEGLLGGCAIDATGEPFPKETLELCKSSDAVLLGAVGGPKWDNLPGDKRPEAGLLGIRGALGLYANLRPAVIYQALKGASPLRSDIVKDGIDIMVVRELTGGMYFGERGRVQTENMGQAAFDTEKYSEFEVERIARLAFETAMKRNKKLTSVDKANVLESSRLWREVVNRVASDYPEVELNHMYVDNAAMQLVRNPAQFDVIVTSNMFGDILSDEASMITGSIGMLPSASLGEGSLGLYEPIHGSAPDIAGQDKANPIATILSVAMMMKYSFGLEDAFRAIENAVVNVLGMGYRTADIASPDTPRENIVGTKEMGRLIISKLK

SEQ ID NO: 85410 - protein, 291 aa, Vibrio metschnikovii
GRFVFRAAQERNDIEVVGINDLIDVEYMAYMLKYDSTHGRFNGTVEVKDGNLIVNGKTVRVTAERNPEDLKWDAIGVDVVAEATGLFLDDATARKHITAGAKKVVLTGPSKDKTPMFVMGVNHNSYAGQDIVSNASCTTNCLAPIAKVLNDKFGIVSGLMTTVHATTATQKTVDGPSAKDWRGGRGASQNIIPSSTGAAKAVGVVLPELNGKLTGMAFRVPTANVSVVDLTVNLEKGASYAEICSAMKEASEGELKGVLGYTEDAVVSQDFIGEVQTSVFDAKAGIALTDN

SEQ ID NO: 85411 - protein, 424 aa, Populus trichocarpa
MGKDEEEMRGEIEERLINEEYKIWKKNTPFLYDLVITHALEWPSLTVEWLPDRDEPPGKDYSVQKMILGTHTSENEPNYLMLAQVQLPLDDAENDARHYDDDRSDFGGFGAANGKVQIIQQINHDGEVNRARYMPQNPFMIATKTVSAEVYVFDYSKHPSKPPLDGACTPDLRLRGHNTEGYGLSWSKFKEGYLLSGSDDAQICLWDINATPKNKSLDATQIFKVHEGVVEDVAWHLRHEHLFGSVGDDQYLLIWDLRTPSVTKPVHSVVAHQSEVNCLAFNPFNEWIVATGSTDKTVKLFDIRKINTALHTFNCHKEEVFQVGWNPKNETILASCCLGRRLMIWDLSRIDIEQTPEDAEDGPPELLFIHGGHTSKISDFSWNPCDDWVIASVAEDNILQIWQMAENIYHDEDDIPADESTKDS

SEQ ID NO: 85412 - protein, 285 aa, Vibrio mimicus
RAAQERNDIEVVGINDLIDVDYMAYMLKYDSTHGRFNGTVEVEGGNLIVNGKTVRVTAERNPADLKWGEIGVDVVAEATGLFLTDETARKHIEAGAKKVVLTGPSKDKTPMFVMGVNHKTYAGQDIVSNASCTTNCLAPIAKVLNDNFGIESGLMTTVHATTATQKTVDGPSAKDWRGGRGASQNIIPSSTGAAKAVGVVLPELNGKLTGMAFRVPTANVSVVDLTVNLQKAASYDDIKAAMKAASEGELAGILGYTEDAVVSTDFNGDTRTSIFDADAGIALTD

SEQ ID NO: 85413 - protein, 755 aa, Rhizobium leguminosarum bv. viciae 3841
MRDLSGGPRVLLRRLRELMAEPLEPQDRLDRIVRQIAGNMVAEVCSVYVLRADGVLELYATEGLNREAVHLAQLKMGQGLVGTIAASAQPLNLSDAQSHPAFRYLPETGEEIYHSFLGVPILRTGRSLGVLVVQNKASRNYREEELEALETTAMVLAEMIATGELKKITKPGLELDLTRSVTVDGDTYNDGIGLGYVVLHEPRIVVTNLLNEDAEKEIRRLAEAMGSLRISIDDMLSRRDVSMEGEHREVLETYRMFAHDQGWVRKLEEAIRNGLTAEAAVEKVQSDTKARMMRLTDPYLRERMHDFEDLANRLLRQLTGYTGRTTGEGFPSDAIILARAMGAAELLDYPRSNVRGLVLEEGAVTSHVVIVARAMGIPVIGQAAGVVALAENGDAVIIDADEGHVHLRPMADHRRSYEEKVRFRARRQEQFRALRAVEPVTKDGQRIALMMNAGLLVDLPQLSESGAEGIGLFRTELQFMIASTMPKAEEQEQFYRNVIKQAAGRSVTFRTLDIGGDKVVPYFRGHEEENPALGWRAIRLSLDRPGLLRTQLRALLKASADTELKLMVPMVTEVSELKMVRELLQKEVQHLSRFGHGLPRKLQFGAMLEVPALLWQLDELMEAVDFVSVGSNDLFQFAMAVDRGNARVSDRFDPLGKPFLRILRDIVRGADRNKTPVTLCGELASKPISAMALLGIGFRSISMSPASIGPVKAMLLGLDVGALTKAMDEVLDDHHALTPMREVLARFAESHNIPL

SEQ ID NO: 85414 - protein, 294 aa, Vitis vinifera
MDRVAPKRRLREGASRCSEPRHIAFKLEEKGQSLLNCVHKSIYCTHKQIELQSLPGFQKLQEDPGIAVDICNMGKSWADDMILSYNDVVLRRSDLDILSGPRFLNDRLIEFYFSYLTSCYPSPDISLVPPSIAFWIMNCPDTGSLRDFIEPLKLSEKKLVIFPINNNDDVEQAEGGTHWSLLAFEENANVFVHHDSCGGLNEAHARKLYKAVVGFMGNSNSSRAQYLECKDSPQQANCYDCGLYVAATAKAICCWYGSGQPGEGLWFSVVKEQVTSSVVADLRSEMLGLIRNLQ

SEQ ID NO: 85415 - protein, 424 aa, Rhizobium leguminosarum bv. viciae 3841
MARIVMKFGGTSVADLDRIKNVARHVKREVDAGHEVAVVVSAMSGKTNELVGWVQGTPKVIGANSPFYDAREYDAVVASGEQVTSGLLAIALQAMDINARSWQGWQIPIRTDNAHGAARIMEIDGSDIVKRMGEGQVAVISGFQGLGPDNRIATLGRGGSDTSAVAIAAAVKADRCDIYTDVDGVYTTDPRIVPKARRLKKIAFEEMLEMASLGAKVLQVRSVELAMVHKVRTFVRSSFEDPDAPGMGDLLNPPGTLICDEDEIVEQEVVTGIAYAKDEAQISLRRLADRPGVSAAIFGPLAESHINVDMIVQNISEDGSKTDMTFTVPSGDVEKAIKVLGDHKEKIGYDVVQNESGLVKVSVIGIGMRSHAGVAATAFRALAEKGINIKAITTSEIKISILIDGPYAELAVRTLHSCYGLDKN

SEQ ID NO: 85416 - protein, 365 aa, Streptomyces coelicolor A3(2)
MAVRTAVRAAVVPAPGAPLEVTGIELPEPGPGRVRVRLAAAGVCHSDLSLSNGTMRVPLPAVLGHEGAGTVVAVGEGVTHVAPGDEVVLNWAPSCGACHACSLGEVWLCAHALAGAADVHARRADDGTDLHPGLNVAAFAEETVVAASCVLPAPEGIPLTEAALLGCAVLTGYGAVHHSARVREGETVAVFGVGGVGLATLQAARIAGASKIVAVDVSPEKEELARAAGATDYLLASDTTAREIRALTGKQGVDVAVECVGRAVTIRTAWESTRRGGRTTVVGIGGKDQQVTFNALEIFHWGRTLSGCVYGNADPARDLPVLAEHVRAGRLDLGALVTERIALDGIPAAFDNMLAGKGGRALVVF

SEQ ID NO: 85417 - protein, 462 aa, Streptomyces coelicolor A3(2)
MKAHDGMYIDGAWRPADGRDTIDVVNPVDEQVIGKVPAGSALDVDTAVRAARAALSGWAATPPAERAARLAALRDVLVARKDEIAETVTAELGSPLKFSQAVHAGAPIAVAGSYAELAATHAFEEKVGNSVVHHEPVGVVGAITPWNYPLHQIVAKAAPALAAGCTMVLKPAEDAPLVAQLFAEAVHEAGIPAGVFNLVTGLGPVAGQALVEHPGVDLVSFTGSTAVGRRIGATAGAAVKRVALELGGKSANVILPSADLAKAVNVGVANVMSNSGQTCSAWTRMLVHRDQYDEAVSLAAEAAAKYGDRIGPVVNAEQRERVRGYIGKGVAEGARLVAGGPEAPREQGYFVSPTVFADVTEEMTIAQEEIFGPVLSILRYEDEDDALRIANGTVYGLAGAVWAGDEADAVAFARRMDTGQVDINGGRFNPLAPFGGYKQSGVGRELGAHGLTEYLQTKSLQF

SEQ ID NO: 85418 - protein, 484 aa, Bacillus licheniformis ATCC 14580
MEQSNTNRQNFQRKMQTRHLIMLSLGGVIGTGLFLSSGYTISQAGPAGTILAYLAGALIVYLVMLCLGELSVAMPVTGSFHMYASRFIGPGTGFTVAWLYWLTWAVALGSEFTAAGLLMQRWFPDTSVWMWSAVFAALIFALNAVSVRFFAESEFWFSSIKVLAIILFIILGGAAIFGIIPIQNADAAPLLSNFAGEGGLFPNGFLPIFMAMLSVNFAFSGTELIGIAAGESAEPEKNIPKAIKTTLWRLVLFFIGTIFVLSCLIPVKEAGVIKSPFVDVFDRIGVPYAADIMNFVILTALLSAANSGLYACSRMLWSLSKEKTLHPVFQKLTSRGIPLNALIFSMLGGILSLLSSVFAPDSVYIVLVSISGFAVVAVWMSIAASQFMFRRRFLAEGNTADDLKYRTPLYPAVPIAAFLLCLASCIGIAFDPNQRIALFCGVPFMALCYTIYYATNRKNSWNPSEPVKNASLHVSFSEYEEKKN

SEQ ID NO: 85419 - protein, 300 aa, Glycine max
MCAFCEFLQYEKVEKIGEGTYGVVYKGRDRVTNETIALKKIRLEQEDEGVPSTAIREISLLKEMQHRNIVRLQDVVHDEKSLYLVFEYLDLDLKKHMDSSPEFAKDPRQVKMFLYQILCGIAYCHSHRVLHRDLKPQNLLIDRSTNALKLADFGLARAFGIPVRTFTHEVVTLWYRAPEILLGSRHYSTPVDIWSVGCIFAEMVNQRPLFPGDSEIDELFKIFRIMGTPNEDTWPGVTSLPDFKSAFPKWQPKDLKNVVPNLEPAGLDLLSSMLYLDPSKRITARSALEHEYFKDIKFVP

SEQ ID NO: 85420 - protein, 368 aa, Erythrobacter sp. NAP1
MKTRAAVAFEAKKPLEIVELDLEGPKAGEVLVEIMATGICHTDAYTLDGLDSEGIFPSVLGHEGAGIVREVGAGVTSVAPDDHVIPLYTPECRQCKMCLSGKTNLCSAIRATQGQGLMPDGTSRMSYRGETIYHYMGCSTFSNFIVLPEIAVAKIRTDAPFETSCYVGCGVTTGVGAVVNTAKVEPGDNVVVFGLGGIGLNVIQGAKMAGADRIVGVDINPAKREWGEKFGMTDFVNPKETSDVVAHLVELLDGGADYSFDCTGNTDVMRDALECCHKGWGTSIIIGVAEAGKEIATRPFQLVTGRNWRGTAFGGAKGRTDVPKIVDWYMNGKIAIDPMITHTLSLEEINKGFDLMHAGESIRSVVVY

SEQ ID NO: 85421 - protein, 336 aa, Neptuniibacter caesariensis
MALRIAINGYGRIGRNILRALYESKHRNNLQIIAINDLCDPEVNAHLTEYDSVHGKFKHKVSSSDNKLIVDGDQITVFREKALSALPWGGLDIDIVFECTGLFTDKTTAMQHIHNGAKRVLVSAPAKDADATVVYGVNHTSIKTEDIVISNASCTTNCLAPMAKVINDRFGITSGTMTTIHAYTNDQHLTDAFSGDLYRARAAATSMIPTRTGAAQAVGLVLPELEGKLSGMAVRVPTSNVSLVDLSFIPNKPCSVEDLNQLLLEAASNQFKEIIAYNDKPLVSVDFNHHSESCIFDATQTISCDNLKKVFAWYDNEWGFSNRMLDTASYLGRFLR

SEQ ID NO: 85422 - protein, 307 aa, Thermus thermophilus HB27
MEIRLFSGSAHPDLARRVAEALGVPLGKALVDRFPDGEVRVRLLESVRGEDVYLIQPTCPPVNDHLMELLLLADAARRSSAGRINAVIPYFGYARQDKQTEGREPISARLVAGLLERVGVERVIAIDLHAPQIQGFFDIPVDHLSAVRLFARYLREKGYVENAVVVSPDAGRAEEARRLAERLGLPLAMLAKRRLGPRETSVTYVIGDVEGKRPILVDDIVSTGGTIRRGVEALLQAGALPEVVVMATHAVLVGGAKENLAHPAVREVVFTDTIPLKDGGYTVLSTAELLAQAIRHVHTNQSVSALI

SEQ ID NO: 85423 - protein, 503 aa, Thermus thermophilus HB27
MVLVLDFGSQYTRLIARRLRELRAFSLILPGDAPLEEVLKHRPQALILSGGPRSVFDPDAPRPDPRLFSSGLPLLGICYGMQLLAQELGGRVERAGRAEYGKALLTRHEGPLFRGLEGEVQVWMSHQDAVTAPPPGWRVVAETEENPVAAIASPDGRAYGVQFHPEVAHTPKGMQILENFLELAGAKRDWTPEHVLEELLREVRERAGKDRVLLAVSGGVDSSTLALLLAKAGVDHLAVFVDHGLLRLGEREEVEGALRALGVNLLVVDAKERFLKALKGVEDPEEKRKIIGREFVAAFSQVARERGPFRFLAQGTLYPDVIESAGGHGAAKIKSHHNVGGLPEDLEFELLEPFRLLFKDEVRELALLLGLPDTLRLRHPFPGPGLAVRVLGEVTEERLEILRRADDIFTSLLREWGLYEKVAQALAVLTPVRSVGVAGDERKYGYVLALRAVTTEDFMTADWARLPLEFLDEAARRITRRVPEIGRVVYDLTSKPPATIEWE

SEQ ID NO: 85424 - protein, 214 aa, Prochlorococcus marinus str. AS9601
MNSEKKHLIQSSISSYESNNKTIAAVPTVIEQSGRGERAFDIYSRLLRERIIFLGTGINDQVSDSLVAQLLFLEAEDPEKDIQIYINSPGGSVTAGMAIYDTMQQISPDVVTICFGVAASMGAFLLSGGAKGKRLALPNSRIMIHQPLGGAQGQAVEIEIQAKEILFLKKTLNSLLAEHTGQPLEKINEDTERDYFLSPSEAVEYGLIDKVIKK

SEQ ID NO: 85425 - protein, 277 aa, delta proteobacterium MLMS-1
MWEYTDKVRDHFMNPRNVGEIPDADGVGEVGSLACGDALKLYIKLGADGRISDAKFKTFGCASAIASSSALTEMIKGMTLEEAEKVTNEDIANALGGLPKEKMHCSVMGREALEAAIANYRGVPLPMAEGEVVCECFGVTDLEIRRAIQESKLKSVEEITNFTKAGGGCGRCVDRLEEILRQERHDIQDIIPDQRQRKLTNIKKIKMIEDVLEREIKPALRKDGGDIELVDLDGDFVTVSLRGACASCKKSQTTIKDYVEKKLREQVLDSLIVEEER

SEQ ID NO: 85426 - protein, 399 aa, delta proteobacterium MLMS-1
MSSEQPARVIYMDNNATTRVAPEVLEEMLPYFSELYGNPSSMHTFGGQVGRQLRVARSRVAELLGAQPEELIFTSCGTESDSTAILAALQAHPDKRHIVTTRVEHPAVKNLCEHLDQLTGHKHRVTQLPVDSQGMIDLARYEAALGEDTALVSVMWGNNETGVIFPVEEMAQIAKSRGILFHTDAVQAVGKIPINLAASAIDYLSLSGHKLHAPKGVGALYVRKGAPFAPLIIGGHQEESRRGGTENVAAIIGLGRACQLAAARMDEENGRVKALRDKLEQGLLAKIPNALLNGHPEQRLPNTTNISFEYVEGESILLHLDQHGICASSGSACTSGSLEPSHVLRAMGVPFTAAHGSVRLSLSVYNSEEEVDFVLAKLPDIIANLREMSPFWQENRGRT

SEQ ID NO: 85427 - protein, 584 aa, Prochlorococcus marinus str. AS9601
MPNIHKPFHQKYRPNNLDELVGQKFISITLKQALLTKKIAPAYLFNGPRGTGKTSSARIFAKSLNCQAFDQPTITPCCKCDLCRQITEGSALDIIEIDAASNTGVENIREIIERARFAPTQARWKVYVIDECHMLSTAASNALLKTIEEPPSRVVFILATTNPERVLNTIKSRCQKFDFRRISPSDIFQHLSEISEKESIKYEVQALKMIAKRSNGGMRDAQSLLEQLNLLPEGITINGIQNLLGEVSESELTNLIKSLVENNPESLIDTCNKLYDSGNEPLQIIIGLLNITRDLLLHTTNNKYSDLYYTSDEFRDELDKISKTINKSKIVNWHNNLRNIEYQIKSSDNPRLWLEIHLTGLLDSQEINSLENKKESKNNTTEEHESRKNIPINKENISHEIPKPSIQEEITHKELIEKKEEKLEKFEVLEKESIENISENNQNNPRSNLKDKWELILSKVELPSTRMLLSQQAELESFDSEKITIALSPNWENMIKSRKVIIEDTVKKIFGDGIILNFSTKQLNKSNPTNTPEITQNEVNNFRPIKKIEPKTNSTTKISNEETYDDSSKNLANFFNGEIIDLDE

SEQ ID NO: 85428 - protein, 126 aa, Zea mays
  misc_feature (54)..(54): Xaa can be any naturally occurring amino acid
RARRTSPSKHDCSYYDEVVENNNHYVAQPPTDDNRQELSKELFYTLLASLPGRXYEPFWNELDCVKNLCKNMKDLTVDDLDIARLSEDYLYVWVRIDEIDTRGTTLIGYNDYMISTVKVLVYPCDY

SEQ ID NO: 85429 - protein, 257 aa, Legionella pneumophila subsp. pneumophila str. Philadelphia 1
MKYTMLVKTPEEIKKMRVAGQLAASVLEMIEPYVIAGTSTKELEQICRQYIVEDLKAIPSTLNHYGFPACICTSINHVVCHGIPSEKKLKNGDIINIDVTVQKDGYIGDTSKMFLVGNIKPFAKKLVEVTQECLYKAISIVRPGAHLGDIGNIIQTHAEQHGYSIVREFGGHGIGKSMWEDPHIMHFGKPNTGLRLQAGMTFTIEPMLNLGRKEVKTLGDGWTVVTKDHKLSAQWEHTILVTDNGHEILTLRADEHL

SEQ ID NO: 85430 - protein, 56 aa, Populus trichocarpa
MRKFDPWPVFFKREWNRNWPFLVGFAITGALITKFSLSLTEEDAKNSPFVQRHKKH

SEQ ID NO: 85431 - protein, 542 aa, Oryza sativa
MPCINAEARRHERGNQERTPASRKLNSHRPMEKLKSELWMTAVATCMSLLLYLTILRRRHASGGRSLALPPGPTPLPLIGNLLCLGGIFHQTLAKLARVHGPVMTLKLGLTTAVVVSSAEAAREAYTKHDQRLAARPVPDAFRANGFSERSIVFSPSSDPQWKNLRGIHATHIFSPRALAALRGIRERKVRDIVGYIRTVAGEEMCVREVVHNGVLNLISTSFFSMDMADVRSESARGLRGLIEDIIATVAGPNVSDFFPFLRQLDLQGLRRQTGSHLGIVFGLLDDIIDRRMAETRDHPDKQRHGDFLDALISLASAGKIPRYHITYLLFDVFAAGADTMTTTVEWAMAELLRNPRVMAKVRAEVTDALGGRESFDEGDAASLTYLQCVFKEAMRLHPVGSILVPHLAVQDGVEIGGYAVPKGTTVIFNAWAIMRDPAAWESPDQFLPERFLHKEESSSPPLELRGKDYEYIPFGSGRRLCPGLPLAERAVPFILASLLHAFEWRLPDGMSPDDMDMTEKFATANVLATPLKAVPVASHTS

SEQ ID NO: 85432 - protein, 1294 aa, Saccharomyces cerevisiae YJM789
MSQQENGDVATELIENRLSFSRIPRISLHVRDLSIVASKTNTTLVNTFSMDLPSGSVMAVMGGSGSGKTTLLNVLASKISGGLTHNGSIRYVLEDTGSEPNETEPKRAHLDGQDHPIQKHVIMAYLPQQDVLSPRLTCRETLKFAADLKLNSSERTKKLMVEQLIEELGLKDCADTLVGDNSHRGLSGGEKRRLSIGTQMISNPSIMFLDEPTTGLDAYSAFLVIKTLKKLAKEDGRTFIMSIHQPRSDILFLLDQVCILSKGNVVYCDKMDNTIPYFESIGYHVPQLVNPADYFIDLSSVDSRSDKEEAATQSRLNSLIDHWHDYERTHLQLQAESYISNATEIQIQNMTTRLPFWKQVTVLTRRNFKLNFSDYVTLISTFAEPLIIGTVCGWIYYKPDKSSIGGLRTTTACLYASTILQCYLYLLFDTYRLCEQDIALYDRERAEGSVTPLAFIVARKISLFLSDDFAMTMIFVSITYFMFGLEADARKFFYQFAVVFLCQLSCSGLSMLSVAVSRDFSKASLVGNMTFTVLSMGCGFFVNAKVMPVYVRWIKYIAFTWYSFGTLMSSTFTNSYCTTDNLDECLGNQILEVYGFPRNWITVPAVVLLCWSVGYFVVGAIILYLHKIDITLQNEVKSKQKKIKKKSPTGMKPEIQLLDDVYHQKDLEAEKGKNIHITIKLEDIDLRVIFSAPFSNWKEGNFHHETKEILQSVNAIFKPGMINAIMGPSGSGKSSLLNLISGRLKSSVFAKFDTSGSIMFNDIQVSELMFKNVCSYVSQDDDHLLAALTVKETLKYAAALRLHHLTEAERMERTDNLIRSLGLKHCENNIIGNEFVKGISGGEKRRVTMGVQLLNDPPILLLDEPTSGLDSFTSATILEILEKLCREQGKTIIITIHQPRSELFKRFGNVLLLAKSGRTAFNGSPDEMIAYFTELGYNCPSFTNVADFFLDLISVNTQNEQNEISSRARVEKILSAWKANMDNESLSPTPISEKQQYSQESFFTEYSEFVRKPANLVLAYIVNVKRQFTTTRRSFDSLMARIAQIPGLGVIFALFFAPVKHNYTSISNRLGLAQESTALYFVGMLGNLACYPTERDYFYEEYNDNVYGIAPFFLAYMTLELPLSALASVLYAVFTVLACGLPRTAGNFFATVYCSFIVTCCGEALGIMTNTFFERPGFVVNCISIILSIGTQMSGLMSLGMSRVLKGFNYLNPVGYTSMIIINFAFPGNLKLTCEDGGKNSDGTCEFANGHDVLVSYGLVRNTQKYLGIIVCVAIIYRLIAFFILKAKLEWIKW

SEQ ID NO: 85433 - protein, 324 aa, Bacteroides fragilis NCTC 9343
MYTASQLLDKINSHISDIRFTRTPAGLYDPIKYVLSMGGKRIRPVLMLMAYNLYKEDVSSIYDPATAIEVYHNYTLLHDDLMDRADMRRGKTTVHKVWNDNTAILSGDAMLVLAYQYMAASSSEHLKEVMDLFSLTALEICEGQQMDMNFESREDVKEEEYLEMIRLKTAVLLAASLKIGAILGGASPEDAENLYDFGMQIGVAFQLQDDLLDVYGDPAVFGKNIGGDILCNKKTYMLIKALERADRDQLEGLNHWLSATSFCPEEKISAVTELYTQIGIKAVCENKMREYYTRAMTSLGAVSVIEDKKSELKKLMKHLMYREM

SEQ ID NO: 85434 - protein, 389 aa, Corynebacterium glutamicum
MSTLETWPQVIINTYGTPPVELVSGKGATVTDDQGNVYIDLLAGIAVNALGHAHPAIIEAVTNQIGQLGHVSNLFASRPVVEVAEELIKRFSLDDATLAAQTRVFFCNSGAEANEAAFKIARLTGRSRILAAVHGFHGRTMGSLALTGQPDKREAFLPMPSGVEFYPYGDTDYLRKMVETNPTDVAAIFLEPIQGETGVVPAPEGFLKAVRELCDEYGILMITDEVQTGVGRTGDFFAHQHDGVVPDVVTMAKGLGGGLPIGACLALRAAELMTPGKHGTTFGGNPVACAAAKAVLSVVDDAFCAEVARKQLFKELLAKVDGVVDVRGRGLMLGVVLERDVAKQAVLDGFKHGVILNAPADNIIRLTPPLVITDEEIADAVKAIAETIA

SEQ ID NO: 85435 - protein, 201 aa, Corynebacterium glutamicum
MTSQPQVRHFLADDDLTPAEQAEVLTLAAKLKAAPFSERPLEGPKSVAVLFDKTSTRTRFSFDAGIAHLGGHAIVVDSGSSQMGKGESLQDTAAVLSRYVEAIVWRTYAHSNFHAMAETSTVPLVNSLSDDLHPCQILADLQTIVENLSPEEGPAGLKGKKAVYLGDGDNNMANSYMIGFATAGMDISIIAPEGFQPRAEF

SEQ ID NO: 85436 - protein, 541 aa, Bacillus cereus ATCC 10987
MITVSNVSLRFADRKLFEDVNIKFTPGNCYGLIGANGAGKSTFLKILSGEIEPSTGDIHITPGERLAVLKQNHFEYEEFPVLETVIMGHTRLYKVMQEKNAIYMKEDFSDEDGMRAAELEGEFAELNGWEAESEAAILLKGLGIGEDLHDKKMSELTGAEKVKVLLAQALFGQPDILLLDEPTNHLDLKAIQWLENFLMNFENTVIVVSHDRHFLNKVCTHMADLDFGKIQLYVGNYDFWYESSQLALKLTQDANKKKEEKVKELQNFIARFSSNASKAKQATSRKKLLDKITLDDIKPSSRRYPFVGFTPEREVGNDLLTVEGLSKTIDGEKVLDNVYFTLNKGDKVAFIGRNDIAMTTLFKILMGEMEPDSGSFKWGVTTSQSYFPRDNSKYFENSDYNLVEWLRQFSPQDESESFLRGFLGRMLFSGEEVKKNVSVLSGGEKVRCMLSKMMLSGANVITLDDPTNHLDLESITALNNGLIAFKGTILFTSHDHQFVQTIANRIIEVTPNGVIDKEATYDEFLENEELQKQVDAMYKGQ

SEQ ID NO: 85437 - protein, 382 aa, Moorella thermoacetica ATCC 39073
MAKRDYYEVLGVSRDASEAEIKKAYRQLARKYHPDMNPGDKEAEEKFKEVQEAYEVLSNAEKRARYDQFGHAGTEAGGGPGFGGFDFGGAGADFGFGDIFDMFFGGGFGGAARRQGPQRGDDLRLDLEISFEEAAFGVEKEVGIPRQEKCPECGGSGAAPGTHPKTCPTCHGTGQIRIAQRTPLGQFQTIRTCHQCHGQGTIIETPCPRCRGRGVVQRTRKIRVKIPPGVDTGARLRMAGEGESGLRGGPPGDLYIYINVRPHKLFRRDGYDVFCEVPVSMVQAALGDSIKVPTLDGKEELHIPPGTQSGTSFRLKGKGIPRLNGVGRGDQHVRIHVETPTNLNEKQKELLREFARLYGSEPRGAREQDKGFFRKVKDAFMG

SEQ ID NO: 85438 - protein, 289 aa, Bacteroides fragilis NCTC 9343
MERKLAVITGADGGMGTEITRAVACAGYDVIMACYSSSKAETKCRELVKETGNEKIEVWQIDLASLASVRAFADRMLRQKTPVALLMNNAGTMETGLHITEDGLERTVSVNYVGPYLLTRLLLPLMGEGTRIVNMVSCTYAIGKLDFPDFFLWGRKGSFWRIPIYSNTKLALLLFTIELAERLRARGITVNAADPGIVSTNIIRMDQWFDPLTDIFFRPFIRTPLQGAATAIGLLLDAEVEGRTATFNLNNHCRLLPEKYTRPDRRAQLWEETERILSEKGFLPINDKR

SEQ ID NO: 85439 - protein, 362 aa, Oryza sativa Japonica Group
MERPPRRPSAARPRPRSLQRAAAALFLAIFVALPFAVLYRGPVSRSLHDSWEWDPLPSLDASEEDGAARDDDLDSQDLKLEQVLQKASMGDNTVILTTLNSAWASPGSVIDLFIDSFRSGVRTSSLINHLVIIAFDWNAYKQCLKIHPYCFALGTDGVDFSEEKRFLTSGYLEMMWKRIDFLRLVLESGFSFIFSDADIMWFRSPFPYFYPDGDFQIACDHYFGNATDLRNIANGGFNYVKSNERSIEFYSFWYSSRLRYPGLHDQDVFNVIKHDPYVSDIGLKIKFLSTSYFGGFCEPSRDLNKVCTMHANCCIGLQSKVPDLRVMMEDWRSYLSLPPSLKRLSALAWRVPQNCSLSWSHQ

SEQ ID NO: 85440 - protein, 522 aa, Salmonella enterica subsp. arizonae serovar 62:z4,z23:--
MEYLYNKELVMTNNPPSTRIQPGEYGYPLKLKARYDNFIGGNWVAPAGGEYYQNLTPVTGQPLCEVASSGKKDIDLALDAAHKAKDKWAHTSVQDRAAILFKIADRMEQNLELLATAETWDNGKPIRETSAADVPLAIDHFRYFASCIRAQEGGISEVDSETVAYHFHEPLGVVGQIIPWNFPLLMASWKMAPALAAGNCVVLKPARLTPLSVLLLMEVIGDLLPPGVVNVVNGAGGEIGEYLATSKRIAKVAFTGSTEVGQQIMQYATQNIIPVTLELGGKSPNIFFADVMDEEDAFFDKALEGFALFAFNQGEVCTCPSRALVQESIYERFMERAIRRVENIRSGNPLDSGTQMGAQVSHGQLETILNYIDIGKKEGADILTGGRRKELDGELKEGYYLEPTILFGKNNMRVFQEEIFGPVLAVTTFKTMEEALEIANDTQYGLGAGVWSRNGSLAYKMGRGIQAGRVWTNCYHAYPAHAAFGGYKQSGIGRETHKMMLEHYQQTKCLLVSYSDKPLGLF

SEQ ID NO: 85441 - protein, 327 aa, Bacillus licheniformis ATCC 14580
MNEVLEERYDARFWQSRLEDLVEHYRPFSSSGRNAEYIPALGKIDSNQLGICVIGSDQTMIKAGNSDVSFTLQSISKVISFIAACLTKGISYVLDRVDVEPTGDAFNSIIRLEMHKPGKPFNPMINAGALTVSSILPGESALGKIESLHDVIEKMIGKRLEINEEVFRSEWQTAHRNRALAHYLKETGFLEADVEETLEVYLKQCSMEGSTEDIALIGMILANDGYHPFRREHVIPKDVARLTKALMLTCGMYNASGKFAAFVGIPAKSGVSGGIMCAVPASVKREQPFQHGCGIGIYGPAIDDYGNSMTGGMLLKHIAREWDLSIF

SEQ ID NO: 85442 - protein, 304 aa, Solanum lycopersicum
MAKLKIVNIVFFVLLGIGICSAARTLLTYDHVGVGGEVGAYAGGGGGGSGGGGAYAAGGHDGGYAGGGGSGSGAGGGHAGGGYAGGGGGGSGAGGTHAGGGHDGGYASGGGEGGGAGGGHAGGGYAGGGGGGSGAGGAHAGGEHDGGYAAGGGEGGGSGYGGAGSADGGYAAGGGGGSGGGGGGAVAGGGAHGGGAYAGGSGGGTGGGYGAGGAPGGGYGGGGGHGGGGGSAYAGGEGGASGGGYGSGGGAGGGAGGAHGGAYGGGGGSGAGGGGAYAGGEHAGGYGGGAGGGEGGGHGGGYAP

SEQ ID NO: 85443 - protein, 362 aa, Streptomyces viridochromogenes
MSLTIGIVGLPNVGKSTLFNALTKNDVLAANYPFATIEPNVGVVGVPDARLTKLAEIFSSQRILPATVDFVDIAGIVRGASEGEGLGNKFLANIRESDAICQVIRAFKDENVVHVDGKVSPKDDIETINTELILADLQTIEKVLPRLQKDSRIKKDLAPKVKAVEEAKEILERGDTLFAHGIVQGTERNELLHDLHLLTTKPFLYVFNVDEDELIDEDFKNEQRALVAPAEAIFLNAKLEADLAELDDDEALELLQSVGQDEPGLATLARVGFNTLGLQTYLTAGPKESRAWTIKKGATAPEAAGVIHTDFQKGFIKAEVISFTDLVETGSVAEARAKGKARMEGKDYVMQDGDVVEFRFNV

SEQ ID NO: 85444 - protein, 175 aa, Physcomitrella patens subsp. patens
MVPDRLPLIILLLRFVVKVIPFVVSGEADPQWTLHSHVKSTFCSESSCREVDNCYKGEKQEGGMATAVASNPPQCKVGEIISKFERKGFQIIGLKLFRPPKELVEALEGSSVVAAARKFIGATNPLKAEPGTIRGDFAIDVGRNVVHGSDSPENGFQELGELFSYVSCPTLSHVF

SEQ ID NO: 85445 - protein, 80 aa, Zea mays
  misc_feature (20)..(20): Xaa can be any naturally occurring amino acid
IHLQALSNGKPTVVEFYANXCEVCRELAPDIYKVEQQYNWDPSCCTTDRTSEHHGQRRQAGPLIALGRQELQQRWCHDRH

SEQ ID NO: 85446 - protein, 252 aa, Bacillus subtilis
MRKPIIAGNWKMNKTLGEAVSFVEEVKSSIPAADKAEAVVSPALFLEKLASAVKGTDLKVGAQNMHFEESGAFTGEISPVALKDLGVDYCVIGHSERREMFAETDETVNKKAHAAFKHGIVPIICVGETLEEREAGKTNDLVADQVKKGLAGLSEEQVAASVIAYEPIWAIGTGKSSTAKDANDVCAHIRKTVAESFSQEAADKLRIQYGGSVKPANIKEYMAESDIDGALVGGASLEPQSFVQLLEEGQYE

SEQ ID NO: 85447 - protein, 553 aa, Thermus thermophilus HB27
MLETALRPEDRESPTFKANKDAWVALVRDFRESLERVRQGGGPKAVERQHKKGRLTARERIQKLIDPGTEFYELMAFAGWGMYEEWGGAPAGGVITGIGRIAGRDWMIVANDATVKAGAFFPITAKKVIRAQTIALENRIPTVYLVDSAGVFLPLQDEVFPDQDDFGRIFYLNARMSALGIPQISAIMGNCVAGGAYLPVMTDVLIMTEGSGLYLAGPALVKAAIGQEVTSEELGGARMHYEVSGTVDFYEPTDEAALARIRELAALYPPPRLAPWAEGRKAPKEPLYPIEDLYGLVSPDGSRPYDLREVIARIVDGSEFLEYKGGYGETLVTGFARIGGYPVGIVGNQRLVLKKRGRIEVGGVIYAEAADKAARFILEVNQMGIPLLFLQDVTGFMVGKESEQAGIIRRGAKLVNAVSNSVVPKITLILGGSFGAGNYALAGKAYAPRFLFAWPSAKYAVMGGAQAAKTLLELEVEKLRREGKEPSDEELKELYERIKGRYEETLDPRYAAARLWVDGVIFPHETRKWLIKALEACALNPEREPFRIGVFQV

SEQ ID NO: 85448 - protein, 511 aa, Bacillus subtilis
MSKKPAALIILDGFGLRNETVGNAVALAKKPNFDRYWNQYPHQTLTASGEAVGLPEGQMGNSEVGHLNIGAGRIVYQSLTRVNVAIREGEFERNQTFLDAISNAKENNKALHLFGLLSDGGVHSHINHLFALLKLAKKEGLTKVYIHGFLDGRDVGPQTAKTYINQLNDQIKEIGVGEIASISGRYYSMDRDKRWDRVEKAYRAMAYGEGPSYRSALDVVDDSYANGIYDEFCIPSVITKENGEPVAKIQDGDSVIFYNFRPDRAIQISNTFTNKDFRDFDRGENYPKNLYFVCLTHFSETVDGYVAFKPINLDNTVGEVLSQHGLKQLRIAETEKYPHVTFFMSGGREAEFPGEERILINSPKVATYDLKPEMSAYEVKDALVKEIEADKHDAIILNFANPDMVGHSGMVEPTIKAIEAVDECLGEVVDAMVAKGGHAIITADDGNADILITESGEPHTAHTTNPVPVIVTKEGITLREGGILGDLAPTLLDLLGVEKPKEMTGTSLIQK

SEQ ID NO: 85449 - protein, 430 aa, Bacillus subtilis
MPYIVDVYAREVLDSRGNPTVEVEVYTETGAFGRALVPSGASTGQYEAVELRDGDKDRYLGKGVLTAVNNVNEIIAPELLGFDVTEQNAIDQLLIELDGTENKGKLGANAILGVSMACARAAADFLQIPLYQYLGGFNSKTLPVPMMNIVNGGEHADNNVDIQEFMIMPVGAPNFREALRMGAQIFHSLKSVLSAKGLNTAVGDEGGFAPNLGSNEEALQTIVEAIEKAGFKPGEEVKLAMDAASSEFYNKEDGKYHLSGEGVVKTSAEMVDWYEELVSKYPIISIEDGLDENDWEGHKLLTERLGKKVQLVGDDLFVTNTKKLSEGIKNGVGNSILIKVNQIGTLTETFDAIEMAKRAGYTAVISHRSGETEDSTIADIAVATNAGQIKTGAPSRTDRVAKYNQLLRIEDQLAETAQYHGINSFYNLNK

SEQ ID NO: 85450 - protein, 120 aa, Glycine max
MAPTVMMASSATAVAPFQGLKSAASLPVARRSTRSLGNVSNGGRIRCMQVWPAYGNKKFETLSYLPPLSTDDLLKQVDYLLRNGWIPCLEFSKLGFVYRENSTSPCYYDGRYWTMWKLPM

SEQ ID NO: 85451 - protein, 361 aa, Alkaliphilus metalliredigens QYMF
MAYQITLIPGDGIGPEVIKEAVRVLETVGDTFGHQFDFEEVLVGGCAYDATGEPLPRESLDSCQKSDAVLLGAVGGEKWDGLPGHQRPEAALLGLRKGLGLYANLRPAILHESLKNACPLRSDIVGEGIDICIVRELMGGIYFGEKGRRTNNDDMGEEAFDVEAYSVGEVERIGRLAFEMALKRDRKVTSVDKANVLESSRLWRSVMIEIAKDYPEVTLEHMYVDNAAMQLIRNPRQFDVLVTTNMFGDILSDEASMITGSIGMLPSASLGEGKFGMYEPIHGSAPDIAGQDKANPIATILSAAMMLRISFDLENEAKEIEEAVTRVLEGGYRTPDIMSDGCKLVGTAEMGNLIIQAMSFE

SEQ ID NO: 85452 - protein, 497 aa, Staphylococcus aureus
MSKVQNESNNVVKRGLKDRHISMIAIGGCIGTGLFVTSGGAIHDAGALGALIGYAIIGIMVFFLMTSLGEMATYLPVSGSFSTYATRFVDPSLGFALGWNYWFNWVVTVAADITIAAQVIQYWTPLQGIPAWAWSALFLVIIFSLNSLSVRVYGESEYWLALIKVITVIVFIAIGLLTIVGIMGGHVVGFEIFNKGEGPILGGNLGGSLLSILGVFLIAGFSFQGTELIGITAGESENPERAVPKAIKQVFWRILLFYILAIFVIGMLIPYDSSALMGGSDNVATSPFTLVFKNAGFAFAASFMNAVILTSVLSAGNSGMYASTRMLYSMSKDKLAFEAFGKTNKNGVPYMSLLVTAIIVVIILVLQSLTKGAYEYIVAASGLTGFIAWVGIAVSHYRFRRAFDKQNYDKSKLKYTAKLFPFGPLFAGFLCIVVIIGQDVDFIKTGDFNFSRFLITYMGIPVFLAFFIYHKLRYKTKKIPLEQVDLRQDVSMDEIKG

SEQ ID NO: 85453 - protein, 630 aa, Oryza sativa Japonica Group
MGTILATAFLLSVLSHGSYIAMASSSWDDQDFFKHCPPSRCSKHGPEIRFPHRLQSSNTPSSCGSSHAKLICSGQDTILHHPFLGPCKVTAIDYKKAVMKIIPFGGSSSPCLLHKFNSTNLSADVNDQNQLYLTEPGRIVRCSKEFTTSRASMIDGYNTVIADKVVRLIPCLRDTTSHFSYLVSTRLYLYALPLDCMVVSKGNIPIPNPYTAGLTFKQMAERIINSAEITLDLLLGSIPYNCTRCEQQGQRCAFSSQRNQTFCMHHGSRVKVIAATSVAAFVAVSLVVATVLYLSLKQRYNEEVHLKVEMFLRTYGTSKPTRYTFSQVKKITRRFKEKVGQGGFGTVYKGKLLNGVPVAVKMLENPTGDGEDFITEVATIGRIHHANIIHLLGFCSEGTRRALIYEFMPNESLEKYIFLHDHNTPQELLSPNKMLDIALGIARGMEYLHQGCNQRILHFDIKPHNILLDYNFSPKISDFGLAKLCPRDQSIVTMTKARGTMGYIAPELYSRNFGEISYKSDVYSFGMLVLEMVSGRRSWDPSIKNQNEVYFPEWIYEKVITGQEFVLSREMTEEEKQMVRQLALVALWCIQWNPRNRPSMTKVVNMITGRLQNIQVPPKPFVSYESHPMP

SEQ ID NO: 85454 - protein, 291 aa, Chlamydomonas reinhardtii
MLACRMQIRSRAGAVQRAWPCRLGVQRAVRCSAAQQVDAAKLAAVRECVDRFVTSNSVVALGSGEMVNLAIEELGRRLAIGSLQNVVGVPACDVAAHEAAFHGVPLLPEAREAEATVALAEADMVDVAARAALLGCAADAPQQPDVPRLLRVLKKAGSGARLVLLTSADRVVKRLGGSLPVWIGAEGWEEWAEELDDVFLGDAELWRRSASGQPENPRGGDMPYVSPDGNTIVDVRFYEGLKLFGEDDEYGKIADEISAISGVVGHGLVVGRAAAVVMARPGQQQPDVVEF

SEQ ID NO: 85455 - protein, 507 aa, Yarrowia lipolytica CLIB122
MKFQLGYYRNKTHTKKMLRGIKRVPRLNVGASKRLYSTEAGDTKIHTLSNGLRVAVRPSPGFFSALGLYVDAGSRFEPRNLSGVSHIMDRLAFKQATQRRSADEVADTIESLGGNFFGSSARESIIYQATVFNKDVETALALLAESVIVPQITEEDVGEKKKTMEFELDQLWKEPSLILPEVVHMTAYDGTLGNPLVCPYEQLPHINARAVNEYRDLFYHPERFVLGFVGVPEENAIELAEKYFGWMKRSDKQLENPASVYVGGEQFMDAADTEFAHIHVAYEGLPADDPDVYALSCLQTLLGGGGSFSAGGPGKGMYSRLYLNVLNRFGYIESCQAFNYHHSDSGIFGISASCVPNAAPYMADVIGRQLALTFTEGEGSLTHQEVERAKNQLRSSLLMQLESKVVQLDDMGRQIQLHGRTVPVTEMCKNIENLTVKDIKRVAQRVLTGNSNNPGNGSGKPTVVMNGVRAWFGDVELVLAKYGLGKQSKGGIHTSSRARNEARKNWW

SEQ ID NO: 85456 - protein, 298 aa, Bradyrhizobium sp. ORS278
MTDATTISPLDQARILSEALPHMQEYDDETIVIKYGGHAMGDEDTAKAFARDIVLLEQTAINPVVVHGGGPQIATMLKRLGIVSEFAAGLRITDAATIEIVEMVLAGSINKQLVGYINEAGGKAVGLCGKDGNMVRAVKATRTMVDPDSHIEKVVDLGFVGEPDKVDLTLLNQLIGYELIPVLAPLATSKEGQTFNVNADTFAGAVAGALKAKRLLLLTDVPGVLDKSKKLIPEISIKDARKLIADGTISGGMIPKVETCIYALEQGVQGVVILDGKVPHAVLLELFTNQGTGTLIHK

SEQ ID NO: 85457 - protein, 318 aa, Glycine max
  misc_feature (192)..(192): Xaa can be any naturally occurring amino acid
MEMEKTGAGVVVLSAKEAFEKLEKVGEGTYGKVYRAREKATGKIVALKKTRLHEDQDGVPPTTLREVSILRMLSRDPHVVRLMDVKQGQNKEGKTVLYLVFEYMDTDLKKFIRSFDQPGQNIPPETIKSLMYQLCKGIAFCHGHGILHRDLKPHNLLMDRKTMMLKIADLGLARAFTVPIKKYTHEILTLWXYRAPEVLLGATHYSMAVDIWSVGCIFAELVTKQALFAGDSELQQLLHIFRLLGTPNEEVWPGVSKLKDWHEYPQWNPKSLSTAVPGLDELGLDLLSQMLEYEPSKRISAKKAMEHAYFNDLDKGHL

SEQ ID NO: 85458 - protein, 1378 aa, Physcomitrella patens subsp. patens
MAKRPKFDRRSDQLALEVDSPFAHNLHTNPPRELLEQARQSQGQATMAPGPLLPDSSVVVATRWTTGGEVAMVDDAGESAAKVANQSLNPVGMQIYWNLSSLKMAVREAAAVALVGELRANQEDFVSSGSEEGIGEALGAKENDELLEGCAPGVQYALRRLVRGLGSSRECARQGFATALTAVIGALPVIRGEALLRIIPSNLEVTSSMKKQDARDGLLGRLFAYGSMIRSRRLIGNCTSSEEKDLAKEIVQQLFNLAKRKTFLREPAVSLVIELASRLPSSAVRETVCAAPLFDEWLRRDVENQSADALVLVLHLYDKLLSKSSPLLPESGNIQDFFKPSHLAKLVPCLKESSSSHPRIHSVWHLLLDRLFSPLDTATKKQANSGSSKDVKVNENLTNFWSVVVDGALLPSSYERKNLAMELLLLVLPRLPTPESVGIVLSNVFVRCILDILSSKDTHLYKSAQRCVGELRLWAENKYTRRVAVIGALQRSSYGKFDTLSKSSTVKTLTNGLITEDGILAFVNNLQELFVSAESNVVTALKVTEELAEGSEDTPMNGHDSPGANDRIWIIEQMHALCRQVKLEPKAKATLYREVIKFLIIHSLFHASSQQNVMDLEKENIRWPQNLLTGSTRKLCAERLHSVLVDAEHWMYTQKSRSNKTGVSGVNDIVTDDEDFSHFAALYCMSVQGSPAAALVQPLKVESAEFVKLLHQTVSSLSSAIEFDTNVDKSRRILAMRTLLSHVLLQSFLEPGSTDGIAAELVICCSKAFSDLSELSKIAASIEEKDENNEVPPVMGVLVDVLLSMLAKLSTPIRNAVEQVFKVYCEDLTIAGLTDILRIINKGSKSGRHKCILDDDDEDFDDDGILEDVEESEGGGEEDIQETTEEGEGEDSDDDDDDDEEEEEEDVEMGDGDTKARTLQQQMRFKRPAEDFDDEAEGSDSDLSDMDDEAMFRADALLANVLMHKKEAIKSTAQTQLGHFKFRVLSLLEYFLQKHPGSSLVLLAVHGLLKAFMCAINQIGTAPEENEVLAKRLESMLQSKVLHAKKYPKGEDVDLPLARTLLKKLLKLASRSSIKRVRKLAQACTLWTLKVLLGNVPDTAEKCDAELLECISTALDDYFTQKKSRLAGSFFIEIFQRHQILGRFSIGKLIEKCGNGRTEFMKCEALRLLTAILKPVTSCKGKKTVAESVECNLLAKAFQQHMGSLGAAISFIVQSPPEKSAYKSIALKFCSSCIDVFTVLYPLKGLHSLLDSKALLAGLKAIDAPSKGKLHNLITKLQNTVTEELTKTSVISDSTKRNANKIASNKANKDSEVLTVIEKASTLLKAKCESSEDEDMSCKNIKARDGEGTMEGQVEDTSFNTKQKGPSFKKVKLSKVIS

SEQ ID NO: 85459 - protein, 219 aa, Bradyrhizobium sp. ORS278
MTTSSDIDERLIEKGRKLFAQAWRFTHASPSIASLPPMGPIEIAFAGRSNVGKSSLINALTGQNALARTSHTPGRTQELIFFQGPDSAPLRLVDMPGYGYAAAAKTKVASWTELIHQFLLGRASLARVYVLIDARHGLKEVDQEILKTLDRSAVSYQLVLTKADQIKPAELASRIAETETALAKHPAAFPQVLATSSRSGTGMPELRAAMVRLLEERGA

SEQ ID NO: 85460 - protein, 333 aa, Erythrobacter sp. NAP1
MSDDPKPSANPADDEARLRAALPIEIHGRLRSLRLKDGRAIVVAEAGDLGAKAREELEGLIENEISKLDDVETVHVALIADRRRRMIIAVGSGKGGVGKSTLTTNLAVALARKGRKVGVIDGDVYGPSQQRLLATDRAKPLTQGDKLVPVDSPHGVKVLSMGHLVPPGKALAWRGPMAGKALGQLVDAAWGDTELLLIDLPPGTGDVQISMMADSKPDGAVLVSTPQDLALLDAARAGQLFEDGEVPIIGLVENMAGYECPHCGEVSDPFGQGGVEKFADALKIPFLGRIPLTIDTRIAGDAGKPPAAGDDEGAAPFMAVADKLDRWLTNGAI

SEQ ID NO: 85461 - protein, 488 aa, Bacillus licheniformis ATCC 14580
MSVAAESKTYFNFINGRWVKAESGGMEQSLNPADTRDIVGLVQKSSIEDVDRAVEAAKQAKKAWRKLSGAERGQFLYKAADIMEQRLDEIAECATREMGKTLPEAKGETARGIAILRYYAGEGLRKTGDVIPSTDSSAFMYTDRVPLGVVGVISPWNFPVAIPIWKMAPALIYGNTVVIKPATETAVTCLKVISCFEEAGIPSGVVNAVTGPGSSAGQRLAEHPDVNGITFTGSNQTGKIIGRTAFERGAKYQLEMGGKNPVIVADDADLDIAVEAVISGAFRSTGQKCTATSRVIVLNGVYDRFKEKLLQQTKEITIGDSLKEDVWMGPIANKQQLDNCLSYIAKGKQEGADLIFGGERLADGKYENGYYIRPAIFDNVTSGMTIAQEEIFGPVIALIKADTLEEALETANDVKFGLSASIFTQNIRRMLSFTDEIEAGLIRVNAESAGVELQAPFGGVKQSSSHSREQGEAAKEFFTAVKTVFVKP

SEQ ID NO: 85462 - protein, 423 aa, Synechococcus sp. CC9311
MMAHAHLPTTGALTGVFESLAFFRDPSFAKRRFRAHGDVFETCLLGQRIVFIQGDQPIADLLAQGGCLEGWWPKSVQLLLGSRSLANRNGDGHKVRRRVVGQLFSSAALRRYTPEISVLVQKLVDELLNSTSPQPLAPRMRRFAFSVIANVVLGLDDRNRDECFADFEIWTKALFSIPISIPGTPFAQAMNARTRLLTRFKQLLANDTPLRGGLDLLRAGVDESGISLDDDDLAEQLLLLLFAGYETTASSLSCLFRALLIDPTVNTWLLSELDAKSAQDDLDRSLPRLDATVLEVMRLTPPVGGFFRRTKAPVILSGIEVSADRVIQVVLTPSSPSDDSDFFDFRPQRHLDGSFHQTLLPFGGGERVCLGKALADLEIRLMALGVLKNIELQLHPNQDLSLQQIPSPTPRDGLVITSQRRLE

SEQ ID NO: 85463 - protein, 475 aa, Erythrobacter sp. NAP1
MATLAKSPEDNTTQEAASEEAAPKHWSEGVPEDDALDHIPGEKGWPLVGNTFRTLADPHAFTSYMVENYGKVYKTHAFGGWNVALIGAEANELVLFNKDKIFSSEQGWGPVLDQLFPRGLMLLDFDHHRIDRRALSIAFKPGPMRHYAGSLNSGISREVAKWEGEMKFYPAIKSLTLDLAADSFLGIPWGPEADAINTAFVDMVQASVAPVRSPLPFTKMKKGVDGRKFMVEFLTAETIRRRKEGGGQDMFSQFATATREDGELLPVDEVVDHMSFLLMAAHDTITSSATSLIYYLAINPEWQEKLREEIVAVTGGPDGDGNPRPLDYDDLGKLELTDMAFKEALRMMPPVPSMPRRALKSFEFGGYRIPAGTHVGINIYWTHYSDEYWDDPQTFDPMRFTPEKVKARHKYAWVPFGGGAHMCLGLHFAYMQVKVLMAQLLQRYRIEAPEGYAPDWQPWPIPQPKDGLKVTFKPL

SEQ ID NO: 85464 - protein, 322 aa, Streptomyces viridochromogenes
MSMFPGFSAGTRLLVTGGAGFIGSHVVDAFLEAGAEVTVLDDLTTGDPERLDPRAVIRRVDVTDAAALDEAVRSARPDVICHLAAQIDVRVSVATPAVDARVNVEGTINVLEAAHAVGARVVFASTGGALYGEGVPVPTNEDTLPRPGAPYGTAKYCAEKYIGLFNRLHGTEHSVLRLGNVYGPRQSPGGEAGVIAIYCGLASEGGVPTVFGDGSQTRDYVYVGDVAAAFVAPYGTVGPASGTSDTGKGSTVLEVLDHIAAASGRDLPPRFAPRRPGEIQHSTLDVTRVAADLGWTASVPLEKGIAATYAWVRSGSPVRQQA

SEQ ID NO: 85465 - protein, 515 aa, Solanum lycopersicum
MAKISRLFGSTVKAAITAQAGFHGKRIPAVSSLQEHIVKSTPARYNSTQACLENDISGTDNKGFKGHDMLAPFTAGWQSTDVDPLIIEKSEGSHVYDMQGRKYIDTLAGLWCTALGGNEPRLVDAATKQLNTLPFYHSFWNRTTKPSLDLAKELLDMFTAKKMAKAFFTNSGSEANDTQVKLVWYYNNALGRPNKKKFIARAKAYHGSTLISASLTGLPALHQNFDLPAPFVLHTDCPHYWRYHLPGETEEEFSTRLAKNLEDLILKEGPETIAAFIAEPVMGAGGVIPPPATYFDKIQAVVKKYDILFIADEVICAFGRLGTMFGSDMYNIKPDLVTLAKALSSAYMPIGAVLVSPEVSDVIHSQSNKLGSFSHGFTYSGHPVACAVALEAIKIYKERNMVERVNRISPKFQEGLKAFSDSPIIGEIRGLGLILATEFANNKSPNDHFPPEWGVGAYFGAQCQKNGMLVRVAGDTIMMSPPFVVTPEELDELIRIYGKALRETEKRVEELKSQK

SEQ ID NO: 85466 - protein, 404 aa, Azoarcus sp. BH72
MIAGKSVLAFVMAGGEGSRLHPLTAERSKPSVPFNGRHRIVDFVLSNLVNSEIYSIYLLVQYKSQSLIEHIRRSWVLTPLIPHHFITVVPPQMQCGPEWFQGTADSVYQNLHLIDLIKPDLVVVFGADHVYRMDIRQMVQYHVDTHADATVAAIPIPLEQVSSFGIIRTDSAGRIRDFQEKPQSAEPMPNRPGVALASMGNYVFSTDVLVDALTRAHSKGGHDFGKNLLPAMCESHRLMAYDFSSNRVPGIRDFEDASYWRDVGTIDAYYAAHFDTLGECPAFCMSNPRWPIYAAPDQTEAAQVHDGHIRSASLGAGVLVRRATIERSLIRREVVVEEGAEVADSIVMDRTVIGAGAKIRRAIIDQNNFIPPGMRIGYDREADRARFHVTDSGIVVVAKGQLKP

SEQ ID NO: 85467 - protein, 348 aa, Synechococcus sp. CC9311
MFGLIGHSTSFEAARRKALELGFDHIAEGDLDVWCSAPPQLVEHLEVTSLTGKKIEGAYIDSCFVPEMLSRFKTARRKVLNAMELAQKKGINITALGGFTSIIFENFNLLKHQTIRSTTLEWERFTTGNTHTAWVISRQVEINAPLLGIDLSKARVAVVGATGDIGSAVCRWLTQRTGIKELLMVARQQQPLKDLQQELEGGRILSLDEALPEADVVVWVASMPRTLEIDSDRLQKPCLMIDGGYPKNLDSRVAGQGVHVLKGGIVEFVSDIGWTMMENAEWQMEKPQRQMFACFAEAILLEFEACHTNFSWGRNNITLEKMDFIGAASVRHGFSTLNLQGQLQAAAA

SEQ ID NO: 85468 - protein, 458 aa, Solanum lycopersicum
MAKTNGFMGHDMLAPFTAAWMIDMGPLVIDKAEGSYVYGVNGKKYLDSLSGLWCTVLGGSEPRLIEAASKQLNKSAFYHSFWNRTTKPSLDLAKELINMFTANKMGKVFFTSSGSEANDTQVKLVWYYNNAIGRPNKKKIISRKNAYHGSTYMTAGLSGLPSLHLKFDLPPPYILHTDCPHYWNYHLPGETEEEYSTRLANNLENLILKEGPETVAAFIAEPVMGGAGVIIPPATYFEKIQAVLKKYDILFIADEVICGFGRLGTMFGCDKYNIKPDLVSIAKALSGGYIPIGAVLVSEEISKVIMSQSNQLGVFCHGFTYSGHPVACAVALEALKIYKEKNITEVVNKLSPKLQEGLKAFIDSPIIGEIRGTGLVLSTEFVDNKSPNDPFPPEWGVGTYFGSQCQKHGMLVSFSGDHVNMAPPFTLSLEELDEMISIYGKALKDTEKRVEELKSQKK

SEQ ID NO: 85469 - protein, 520 aa, Solanum lycopersicum
MAKITSLIGSGIVAATNQVGPHVKHIPAVGNLQKQIVSDQIQVRWSSTETSLKNDISATDVRGYKGHDMLAPFTAGWHSTDLEPLVIQKSEGSYVYDVNGKKYLDALAGLWCTSLGGNEPRLVAAATKQLNELAFYHSFWNRSTKPSLDLAKELLDLFTANKMAKAFFTNSGSEANDTQVKLVWYYNNALGRPDKKKFIARTKSYHGSTLISASLSGLPALHQQFDLPAPFVLHTDCPHFWRFHQPGETEEEFSTRLANNLENLILKEGPETIAAFIAEPVMGAGGVIPPPATYFEKVQAILKKYDILFIADEVICGFGRLGTMFGCEKYNIKPDLVSVAKALSSGYMPIGAVLVSPEVSDVIYSQSNKLGTFSHGFTYSGHPVSCAVALETLKIYKERNIIEQVNRISPKFQEGLKAFSDSPIIGEIRGTGLLHGTEFTDNKSPNDPFPPEWGIGAYFGARCEKHGVLVRVAGDNIMMSPPYILSLEEIDELIIKYGKALKDTENRVEELKSQKKIKSS

SEQ ID NO: 85470 - protein, 442 aa, Coxiella burnetii RSA 493
MLENDMQRLDSQHVWHPCSQMKDYEQFKPLIIKKAYGSYIELSNGQKIIDAISSWWCKSLGHNHPKLKEALKQQLEKFEHVIFANTTNEIIVALSQQLAALLPGLNKVFYAGDGSCAVEIAMKMSLHSRIIQGNKKRKKFIALKNSYHGETVGALSVSDVGLYRAPYSTMLFEPYFIESIPYVLNTQAPEWNDCSAHWDTVERLFEPHAETATAILVEPIVQGASGMKIYSQDFLARLFQWAKNNHIHFIADEIMTGIGRTGKMLACEHAGIIPDFVCLSKGLTSGYLPFSAVLTSDEIYQLFYDDYQTGKAFLHSHTYSGNALAAAVALATLKVFSEEKICARAHKLGKFMLEKMTQVAQETGQLENVRGIGALVAADLIPQPGRLRLGYEVYQEAVKQGVLLRPIGNTLYWLPPLNIDFDLIEVLQKVTKNAIKILSLGF

SEQ ID NO: 85471 - protein, 214 aa, Glycine max
MEAVLTPHATAQKQPFAPNKNIRMKTPKKNGRGNFICANNRSENFDTYAGLLNPPSRAMSFSYSHPLSASSLFTHHCAQQPPLLPLPHVVSPTYGSGQGLVVVVNKNKNRSRDMSLTPKKSKPTKREEAKKRSVTQSDNRWGPDPKDLPKVVLGMGNNHHDVVSGAVFNLAPPPSSLPLPKFSLRSKLGCNAETAAGGVDDGATNNLRRLLRLR

SEQ ID NO: 85472 - protein, 354 aa, Triticum aestivum
LLEQVCTKKQARTGPEFPGYRRPTRPIGCGLPCPHIVNCSTLLGAIISWGFLWPYISTKAGEWYPAGLGSNDFKGLYGYKVFISVSVILGDGIYNLIKIIYATIKEIMNARSKQGRLPLVRAQDDDESSELSSKEKLLNDVFVKDSIPPWLAGSGYVGLAAISTATVPMMFPQLKWYLVLSAYVVAPLLAFCNSYGTGLTDWNLASTYGKIGLFIFASWVGQHGGVIAGLAACGVMMSIVSTAADLMQDFKTGYLTLSSPRSMFVSQLIGTALGCVIAPLTFWLYWTAFDIGNPDGMFKAPYAAIFREMAILGVEGFSALPQHCLAICSFFFFGAYDTLRVSEVSSSCSVLNDY

SEQ ID NO: 85473 - protein, 1442 aa, Saccharomyces cerevisiae
MTASDLLTLPQLLAQYSSSAPQNKVFYTTSTKNSHSSFKGLESVATDATHLLNNQDPLNTIKDQLSKDILTTVFTDETTLVKSIHHLYSLPNKLPLVITVDLNLQDYSAIPALKDLSFPILISSDLQTAISNADSSYKIATSSLTPVFHFLNLEKIGTSTAIEQDIDFPTLEIANEETKVALSEATDSLTNFELVKGKESITTVIVNLSPYDAEFSSVLPSNVGLIKIRVYRPWNFSKFLEILPSSVTKIAVLQGVSKKSQSNEFQPFLLDFFGNFNELVSRNIEQVVLTNIGNVNDYGNVINTVISNINKKEPDNNLFLGESNEKAEEQAEVTQLISSVKKVVNLEDAYIKVLKQLFSSNLQILNQFSSETIEPSNPEFGFGRFLKQEAQREELISLAKTSLDPSLYLSEDANKIVQLLSKWLSFNGRDLDEAQLQEANATGLEIFQLLQSNQDSSTVLKFLKIAPTSDSFIFKSSWLIGSDAWSYDLGHSGIQQVLSSRKNINVLLIDSEPYDHRKQNQDRKKDVGLYAMNYYSAYVASVAVYASYTQLLTAIIEASKYNGPSIVLAYLPYNSENDTPLEVLKETKNAVESGYWPLYRFNPVYDDPSTDKEAFSLDSSVIRKQLQDFLDRENKLTLLTRKDPSLSRNLKQSAGDALTRKQEKRSKAAFDQLLEGLSGPPLHVYYASDGGNAANLAKRLAARASARGLKATVLSMDDIILEELPGEENVVFITSTAGQGEFPQDGKSFWEALKNDTDLDLASLNVAVFGLGDSEYWPRKEDKHYFNKPSQDLFKRLELLSAKALIPLGLGDDQDADGFQTAYSEWEPKLWEALGVSGAAVDDEPKPVTNEDIKRESNFLRGTISENLKDTSSGGVTHANEQLMKFHGIYTQDDRDIREIRKSQGLEPYYMFMARARLPGGKTTPQQWLALDHLSDTSGNGTLKLTTRATFQIHGVLKKNLKHTLRGMNAVLMDTLAAAGDVNRNVMVSALPTNAKVHQQIADMGKLISDHFLPKTTAYHEVWLEGPEEQDDDPSWPSIFENRKDGPRKKKTLVSGNALVDIEPIYGPTYLPRKFKFNIAVPPYNDVDVLSIDVGLVAIVNPETQIVEGYNVFVGGGMGTTHNNKKTYPRLGSCLGFVKTEDIIPPLEGIVIVQRDHGDRKDRKHARLKYTVDDMGVEGFKQKVEEYWGKKFEPERPFEFKSNIDYFGWIKDETGLNHFTAFIENGRVEDTPDLPQKTGIRKVAEYMLKTNSGHFRLTGNQHLVISNITDEHVAGIKSILKTYKLDNTDFSGLRLSSSSCVGLPTCGLAFAESERFLPDIITQLEDCLEEYGLRHDSIIMRMTGCPNGCSRPWLGELALVGKAPHTYNLMLGGGYLGQRLNKLYKANVKDEEIVDYIKPLFKRYALEREEGEHFGDFCIRVGIIKPTTEGKYFHEDVSEDAY

SEQ ID NO: 85474 - protein, 570 aa, Bacillus cereus ATCC 10987
MVLIYCYKYFHEFMEAFDRIQKNIMEAHMKKVIGAATATVFGLGAFTTTATAETIVTADVLNVREKPTTESKVVEKVKNGQELKVINTEDGWSKIELNGKEVFVSSEFTKDIYHVTANLLNVRTEANTESKILGRLKKDDVIESTNQVKDGWLQFEYKGKTAYVNVSFLSSTAPVEKKADEKTKQVAKVQKMVKAKEEAKTQKVTKAKETIKPKEEEKVQEVVKPKEEEKVQEVVKPKEEEKVQEVVKPKEEEKIQEVAKPKEEAKVQEVAKPKEEEKVQEVAKPKEEEKVQEVVKPKEEEKVQEVAKSKEEAKVQEVAKPKEEAKVQEVVKPKEEAKVQEEAKAQEIAKAKEEAKAQEIAKAKEEEKAREIAKAKEEAKAQEIAKAKEEAKAQEIAKAKEEAKAQEIAKAKEEEKAREIAKAKEEAKAQEIAKAKEEAKAREIAKAKEEAKAREAIKAKEESKNNTQSAKRELTVVATAYTADPSENGTYGGRVLTAMGHDLTANPNMRIIAVDPKVIPLGSKVWVEGYGEAIAGDTGSAIKGNRIDVLMGSKSKAMDWGRQTVKVKIL

SEQ ID NO: 85475 - protein, 665 aa, Vitis vinifera
MSVERIFEGKEVPSWREQLTVRAFVVSFVLSVLFTFIVMKLNLTTGIIPSLNVSAGLLGFFFVSVWTKFLDKSGLLKQPFTRQENTVIQTCVVASSGIAFSGGFGSYLFGMSQAIAKQSENAGGNEEYKNPAVAWMIGFLFVVSFLGLFSVVPLRKIMIVDFKLTYPSGTATAHLINSFHTPQGAKLAKKQVRVLGKYFSFSFLWGFFQWFFAAGDNCGFAGFPTFGLKAYKYKFFFDFSATYVGVGMICPHIVNISLLVGGILSWGVMWPLIETRKGDWYPADLPSSNIRGLQGYKIFIAIATILGDGLYNFFKVLGQTLLGLFYQLQYKNMSGVPPIEDRSSPRSSSTSYNDTRRTQVFLKDQIPTSFAIGGYIAIAAISMATLPHIFPQLKWYYILVIYLVAPTMAFCNAYGCGLTDWSLASTYGKLAIFSIGAWAGAAHGGVIAGLAACGVMMNIVSTASDLMQDFKTGYLTLASPRSMFVSQFIGTAMGCVISPCVFWLFYKAFDDLGQSGSEYPAPYALVYHNMAVLGVEGISNLPKNCFTLCCVFFGAAILVNLVRDAVGRKRAQFIPIPMAMAIPFYLGPYFAIDMCVGSLILFIWQRINKAKAEAFGPAVASGLICGEGIWTLPGSILALAGIKQPICMKFLSRATNARVDKFLGA

SEQ ID NO: 85476 - protein, 1029 aa, Chlamydomonas reinhardtii
MSLSWVDAFRIMGPAFLVSVALVDPGNWATAIEAGSRFGYELVWVVVASNLVAILLQTLAARLGIVTGKHLAQVCRESYPPQVCALLWALCEVSIVALDLTMLLGTAIGLNLLLGWPLLPCILLTGLDALLLLLLVPVSQGVKKSEALTVGLLAVVVACFLVDLLVSRPPLRSVAGGLLPRLRRESVYTAVSLLGANVMPHNFYLHSALVAGQARGAAAATAAKTVRALCLYNFLDIGAALGVALVINVAVLLVSAATFHSAGVVVHTLQDAHDLMEQTLSSSIAPAAFGTALLCAGQLSTFTGTIAGQVVLQGFLNIHMPTWLRRLITRTAAIIPAAVLQAVYGDRGTYKFLLIAQVVLALQLPVTLVPLIKATSSRQLMGAHASSRLLAAAAWAAAGLVFIANLGLFVTQLLPQAGLVQSAAASAAHKGLLDKDGPLDAWLDALAAAAWADPGRAAGLLALALAAAAFLALQLWMLVTPLRVAAPLVVYGGFASRQQHQHHYQQQHHHHHQQEQHHAAAGAWGAAGGGGSSTSRGASPRQSADGGGQWYGVDAAANAAAAAALAGAWVIPRSAIEMATARGLWSSGSGGGSGRAGTSASAPSSSRPPHPVTRGGRRQFALLLDEFWSCLYDAHGLPVGTADRVFVAGGAAGGGGSSSSGAGGVGGGAGAATAGGKGGGKGHGPSSQQQHQQHQGTSSGGGKAGGSGRGKGAAGAAASVAAAASSAVSPLVCGHTEGSHLCMGCSQALFEGVQRCLLAVEGGVEGAEAALWGPWPLQLLAPQANQTYAYHRAVLLAARNADFCALSALCAGTFTSTLDRSRLLASTPITTQHQVSHRLPLHMPAAPSQPQGPGAGDREAAAAAGSQALGLPAGPGRNSSSSSSSSAATCSCGGRGVADRAVGGRAALPPPTLSSWCLFGPAVLVSFGVWCAYTLLQWCAAESRPELWGRYAAVLNRLQGVVWDSRLDQNQQQPAPLPASALRLCPAHLALLRRELAAQLAGLEGGGTLERRGPADTAAGEACPAAPLS

SEQ ID NO: 85477 - protein, 422 aa, Yarrowia lipolytica CLIB122
MGSKSASKGVSKPSKTDKKSKVSSKKAEAIEKSIAELSKKKKDESSSESSDSSDDEDEEMSDASSSSDSDSDSSSDSDSDSDSDSDSSDDEKKEDKKVEEKVVKKAKKEDSSDSSDSDSDSSDSDSDSGSDSDSDSDDEKTEEKTEVKAETKAEPAAEPEAAAEPEFKTVFVGGLSWNVDDDWLTKEFADAGAVSARVITEKATGRSKGFGYVDFASGADAQKCVEEFQDKEIDGRTVRLDISTNVRQTPEQKQRDRSSQYGDQLSEPADTLFVGNLSFDTNRDDLFGIFGEYGSVVSIRLPTHPETEQPKGFGYVQFGSVDEAKAALEGLSGYEYLGRSFRLDYTSPKPAGGFNGGGRGGRGGFGGNRGGRGGFGGDRGGRGGFGGRGGRGGFGGRGGRGGFNTGANTAPLGEFKGKKTTF

SEQ ID NO: 85478 - protein, 510 aa, Vibrio vulnificus YJ016
MSAKKPLALVILDGYGYREDTASNAIANAKTPVMDALIANQPNTLISASGMDVGLPDGQMGNSEVGHTNIGAGRVVYQDLTRITKSILDGEFQQTAALVEAIDTAVKAEKAVHIMGLMSPGGVHSHEDHILAAVEMAAERGAEKIYLHCFLDGRDTPPRSAEGSLQRFQDLFAKLGKGRVASLVGRYYAMDRDNNWDRVQVAYDLLTQAKADFTYDSAVAGLAAAYERGENDEFVKATEIKAEGQESAAMQDGDAVIFMNYRADRARQITRTFVADFAGFERAAFPAVNFVMLTQYAADIPLAIAFPPASLENTYGEWLSKQGQTQLRISETEKYAHVTFFFNGGVETEFAGEERQLVASPKVATYDLQPEMSSTELTEKMVAAIKSGKYDTIICNYPNADMVGHTGVYEAAEKAIEALDASVGQVVEAIKEVGGQLLITADHGNAEMMVDPETGGIHTAHTSLPVPLIYVGDKAVEFKEGGKLSDLAPTMLSLAGLEIPAEMTGQVLVK

SEQ ID NO: 85479 - protein, 511 aa, Campylobacter lari RM2100
MKKADILVLDFGSQYTQLIARRLREQGVYAEILPFNVSLDEIKAKEPKGIILSGGPASVYANDAYFCDKGVFDLNIPVLGICYGMQLMAHHFGANVAPAGHKEYGKATIDIQNDSDLFKNLPKKQTVWMSHSDKVENLPQGFEVLATSENSPFCVFGDEKRKFFALQFHPEVQHSEFGKSILKNFAKYACNCDSVWNMGSFAKTQAQKIKEEVGNDKVLCAVSGGVDSSVVAALLASAIKDQVVVVFVDNGLLRSGEKEQVEYMFKHTLGIDLISIDAREIFLSRLAGVRDPEQKRKIIGNTFIEVFEEEAKKHKDVKYLAQGTLYTDIIESSVVGASKTIKSHHNVGGLPEKMNLKLIEPLKEIFKDEVRALGMELGLSKDVVYRHPFPGPGLAIRIMGEVNEPSLELLRKADVILIEELKSSGWYDKTWQAFCVLLNVQSVGVMGDNRTYDNAVCVRVVNASDGMTATFSHLPYELLENISRRIINEVNGINRVVYDISSKPPATIEWE

SEQ ID NO: 85480 - protein, 884 aa, Moorella thermoacetica ATCC 39073
MASKKYVYLFSEGKADMRLLLGGKGANLAEMTNIGLPVPQGITITCEACNEYNRLGQQFPEGLEEEVAARLKDLEAINGKKLGDPENPLLVSVRSGAPVSMPGMMDTILNLGLNDNSVKGLAAQTGDERFALDCYRRFIQMFGNVVLGIEHNDFEAVLEKHKERLGVKFDHELTPDALREVIAEYKDVVKSRSGRDFPQDPREQLYMAIRAVFDSWNNPRAIVYRKINKIPDDLGTAVNVQTMAFGNMGPTSGTGVAFTRNPSTGEKGIYGEYLINAQGEDVVAGIRTPKPISSLKEEMPEVYRQFEDICQLLEKHYRDMQDIEFTIEKGKLFILQTRNGKRTAAAAVKIAVDMVNEGLITKEEAVLRVDADQLIQLMHRRIDPSAKLEVVAKGLPASPGAASGQVVFDADDAEKMGLDGQKVVLVRTETTPDDIHGIVQAQGVLTARGGMTSHAAVVARGMGKPAVTGCDAIKIDVENKRFFIGDLVVKEGDVISIDGSTGNVMLGEVPLIDPQLTGEFETILEWADSFRRLKVRANADTPEDARRSREFGADGIGLTRTEHMFMQVDRLPVVQQMILAKTKEERQAALDKLLPMQQGDFYGILKAMEGLPVTIRLLDPPLHEFLPNIEELLVDVTRLQATNGDSKELEEKQALLREVRARHEFNPMLGHRGCRLGITYPEIYAMQVRAIFQAVAQLVKEGVKVLPEVEIPLVIHVNELQRLHAMVDEVAAAVKKETGVDFDYKVGTMIEMPRACATADEIAREAEFFSFGTNDLTQTTFGFSRDDAEGKFLHQYVDEKILKEDPFIVLDRDGVGKFMKMAVELGRSTNPKLEIGICGEHGGEPSSVEFCHQIGLNYVSCSPFRVPVARLAAAQAALKEKKGK

SEQ ID NO: 85481 - protein, 740 aa, Arabidopsis thaliana
MNNLPRNSQFDSSSIINDLPLDLLDEILFRLEPKSMAMMRCTNNSIKSYLSDPRFGPEYPSWVRPSLFNLGSYGATYVCCHPLVSSCDYMSPGNGVELFDGSADCYIFGSCSGLLLLYIGCLFVANPLTKRFRILDHSGSKLIPMIVNGGLKGLSGISYPGGNVACTERAMCVGFAVNRNLTTKRFKIVGILEMENVYGFEINEGDSWRLSETSITTSSKSDLTTRMKPVYLDNTLHWLRNDGSIMSFNPETEQACLIPSIFHREPDTKLLFAESVKINRLTLISGTIETISVYTLVENHKWTLTRRIKNISIEEETLVYWNIAMYDGKCLVVRVKKMGLEPLASVLHVYDMEANSWGVLVSTLAWPNCVRDFYKLTPSLFFVEEDEQQKVLVASNDRRISYINSIMGLIDTTKKKKSCLERLIEMDNNGVKPAVSAMEAFEKLEKVGEGTYGKVYRAREKATGMIVALKKTRLHEDEEGVPPTTLREISILRMLARDPHIVRLMDVKQGINKEGKTVLYLVFEYVDTDLKKFIRSFRQAGQNIPQNTVKCLMYQLCKGMAFCHGHGVLHRDLKPHNLLMDRKTMTLKIADLGLARAFTLPMKKYTHEILTLWYRAPEVLLGATHYSTGVDMWSVGCIFAELVTKQAIFAGDSELQQLLRIFRLLGTPNEEVWPGVSKLKDWHEYPQWKPLSLSTAVPNLDEAGLDLLSKMLEYEPAKRISAKKAMEHPYFDDLPDKSSL

SEQ ID NO: 85482 - protein, 480 aa, Synechococcus sp. CC9311
MSDANFDFDVIVIGAGYGGFDAAKHAADHGLKVAVLESRDMGGTCVNRGCVPSKALLAASGRVRELADAEHLAGFGIHAAPVRFERKKIADHANQLVATIRANLTKTLERAGVTILRGQGRLEGPQRVGVREVSGVERVLTARDVILATGSDPFVPPGIETDGRSVFTSDEAVNLEWLPRWIAIIGSGYIGLEFADVYTALGCEVTMIEALDRVMPTFDPDIAKIAARKLIDGRDIDARSGVLAKSIQPGSPVQIELVDMQTREPVETLEVDAVLVATGRVPSSKHLNLESVGVETNRGFIPVDDSMRVLVNGAPQANLWAVGDVTGKLMLAHTAAAQGSVAVDNILGHPRQIDYRSIPAATFTHPEISSVGLSEADAKQLAGEEGFELGTVRSYFKANSKALAELESDGLMKLLFNKTSGEVLGAHIYGLHAADLIQEIANAVSRRQSVTQLANEVHTHPTLSEVVEVAYKQAASAVGA

SEQ ID NO: 85483 - protein, 317 aa, Moorella thermoacetica ATCC 39073
MAKVITIGEILVEIMTKYTGQEFTAPGELLGPYPSGAPAIFIDQVARMGVEAGIIARVGDDDFGLLNLTRLRDDGVDTSHIYKTKGYTTGTAFVTYYANGERKFIFHFPHAAAGQLGPADVDENYIKTAEYLHVVGCSLTASASLRQAIWKAVKIAKENKVKVSFDPNLRPELLNEQEIKNVYDDILDAADIILAGKSEMIALSGEGDLVKGIARLKKRDGTMLVLKDGARGASLYYGEECYHVPPVKVQEVDPTGAGDCFDGAFIAALACGKGLKEALQIANVAGALSVTRKGPMEGAAFKEDILALYSRHNSSKV

SEQ ID NO: 85484 - protein, 424 aa, Vitis vinifera
MQKDNTTSALPTPAARVRQRKRSNEVPPEASKANGNHLLADDRNKYRSMWIRARSTVWMIGGFALIIYMGHLYIWAMVVVIQIFMARELFCLLRKTHEDSHLPGFRLLNWHFFFTAMLFVYGRILSQRLVNTVTPDKFLYKLVGNLIKYHMVTCYFLYIAGFMWFILTLKKKMYKYQFGQYAWTHMILIVVFTQSAFTVANIFEGIFWFLLPASLIVINDIAAYIFGFFFGRTPLIKLSPKKTWEGFIGASIATIISAFVLANIMGRFQWLTCPRKDLSTGWLHCDPGPLFKPEYFDLSGWVPRWFPWKEVSILPVQWHALCVGLFASIIAPFGGFFASGFKRAFKIKDFGDSIPGHGGITDRMDCQMVMAVFAYTYHQSFVMAQSCSVEMILEQILMNLTFEEQQDLYVKLGQMFRERQFRQS

SEQ ID NO: 85485 - protein, 1036 aa, Magnaporthe grisea 70-15
MSYDGGYPQQRPYNGPAAPRPPPQRQYPPGPNGPPGRQFAGPPAQNYNSPPQAYDQQYHDGYGGYDDYGGRGGGYGGPEYDQQYDDMNYQRGPPQNYPPHDQYGPGPGPGPMGPGPGRGRPMQGPGGRGGMPPRGPMPPRGGGPGPGPGRGFHNGPVPGRGGGPNPLQRSATADPFAGRGGARGPMLSPQEMGFGGAFPAFPGQRKRTEIDDENKILEKMGGMAIQDRTGLGDAPPPPANRGGPMGPPGPNDGPRGPPQRGFSQDRGYPGQRGPPGSDEGYGAPGDFRDEFGPPQRTMTMPNDPRAGPGPRGPPPGRAETAPYPGPGPGPGPGPGPAGRGMGMGLPARPSTAQGMRGPPRGYPANGMPPPQAPLREDGQYQRGFDDPNDGYGQQAQRPVSFDDFYDYYDNPPQQQQQQQPRNDGIAEIPDFNRSANHLRNGSMDQHMRQQPEGPQERGGLGRQPDLNRTKSQPDLRQPQAAVFEMVGDVPPIPNQYKPYPAGQPNGPGPGPGPDGYGQGYDQGYDQGYDQGYDQRMSGGQGLPMGPAPVRAGSGASTQSAPLPGQNADNLPSHPAPIRPGLMHNSVASQMMNKPPPVRHYNNTPPMNSSMSAPPVSQISAPMAPPRPEPQASVTVEELEHLRAVIKTDPNDQNSALRLAKRLVEAMDVLVPNIPDPRGRQKSRERYANDAHKILKKLSHAQNAEAMFFMADCLGRGVFGPEPDNKEAFTLYQSSAKLGNAAAAYRTAVCCEIGHEEGGGTRKDPLKAIQWYKRAAMLGDTPAMYKVGMILLKGLLGQQKNPREAVGWLKRAAERSDSENPHALHELGLLYESAQPNDAIVRDEGYAFSLFSQAADLGYKFSQFRLGAAYEYGLMGCPIDPRSSIMWYSKAATQEEHQSELALSGWYLTGSEGVLAQSDTEAYLWARKAALAGLAKAEYAMGYFTEVGIGVPANLEDAKRWYWRAAGELLFVFGVLNWIRNQIANSEALVFSLAAQDFPKARERLEDLKRAGKNGPMRQRERISRSTPKQEGECVVM

SEQ ID NO: 85486 - protein, 363 aa, Synechococcus sp. CC9311
MLKAGIVGLPNVGKSTLFNALVANAQAQAANFPFCTIEPNVGTVAVPDDRLQKLSDLSKSKELIPTRMEFVDIAGLVKGASQGEGLGNKFLSNIREVDAIVHVVRCFEDDDVIHVSGSVGPARDAEVINLELGLADLSQIEKRRERLKKQMRTSKEAQVEDEALERIQQVLEAGGAARSIELTEEEALMIKPLGLLTAKPIIYATNVSEDDLAAGNAYCEEVVALAEKEGAESVRISAQVEAELVELGDEECADYLEGLGVSEGGLRSLIRATYRLLGLRTYFTTGEKETRAWTFRAGMTAPQTAGVIHTDFERGFIRAQTIGWEKLLEAGSLSEARNKGWLRSEGKDYLVAEGDVMEFLFNV

SEQ ID NO: 85487 - protein, 307 aa, Helianthus annuus
MANFPVINMENLNGSERGVTMEKINDACENWGFFELVNHGIPHDLLDKVEKMTKDHYKKCMEQRFKEMVAAKALEGVKAEVTDMDWESTFFLRHRPTSNISEIPDLVDEYRELMKDFAGKLEKLAEELLDLLCENLGLEKGYLKKAFYGSKGPNFGTKVSNYPPCPTPDLIKGLRAHTDAGGIILLFQDDKVSGLQLLKDGEWIDVPPMRHSIVINLGDQIEVITNGKYKSVMHRVIAQTDGTRMSIASFYNPGNDAVIYPAPTLLEKEPTEKEQSYPKFVFDDYMKLYAGLKFQAKEPRFEAHESS

SEQ ID NO: 85488 - protein, 142 aa, Zea mays
MGKSKSKGAKFAAVKKIISKKTIKKYKDEVLDPRKKHTEKEKLGRNVPQVSSALFFSYNMALGPPYRVIVDTNFINSSIQNKLDLEKGMMDCLYAKCTPCITDCVMAELEKLGQKYRVALRIAKDPRFQRLACTHKGTYADD

SEQ ID NO: 85489 - protein, 539 aa, Dunaliella salina
MATSAKESLEVPLNAATAGFGAGMPGYDREKWGFDLDGENKAKALLMWKLQSPHVRAFHLSWMFFFSSFVAAFAMAALVPVVRQNLDLTKADLGASGITTVVGAIGARVVIGAVCDTVGPRMATSGVLLLIAPCVFCASLIVDRGGIIAVRFFIGVGLCIFVCNQFWAGTMFSPNCVGTVNATCGGWGNLGGGVTQLIMPLIYTGIKQSGVPGFTAWRWSFMVPGAMFLVLAFGCLCFSQDAPNGSYRDIRKARTVQVDGKKTFLAGIRNYRTWVLTLNYGYCFGVELTINNIIVAYMFDQFGLSIEIAGIVGAVFGLMNIFCRSMGGIASDVAGKYFGMRGRLWTYFCLQLLVGVFSIVLGTVDETLGGTIAVMIIFSAFVQSAEGACYGVVPFVSRRSYGVVAGLVGAGGNTGSAVTQALFFADNEGLKMTTQEGLQWMGVMVMAVTCTISVLHWPAWGGMFTPAKAGATEEDYYLAEWDAEEVAANLHIPSLRFAMESRSMRGKKLLETYLAKEEGLECSSQDAKKTIASIREDSN

SEQ ID NO: 85490 - protein, 114 aa, Triticum aestivum
CSCAADELQGQMEHDYDIGSTIRDKIIPHAVSWFTGEAVQAEDFDDMEDGDEDDDDEDDDDEEDDEEDEDEDEDDDEDEEELSKPTKKVAGKPKGPAKGGAQGNAEQPTECKQQ

SEQ ID NO: 85491 - protein, 415 aa, Oryza sativa Japonica Group
LPFLLLSPLPLSKSPGLLPPLFPAASPRLRLPDSNSPPPPPTHGRRSAPLLRRILSSPAPAPAHHGGAGARRTVTYMPRPGDGNPRAVTLIPGDGIGPLVTGAVQQVMEVMHAPVYFETYEVRGDMPTVPPAVIESIRRNKVCLKGGLATPVGGGVSSLNMQLRKELDLYASLVNCSNFPGLPTRHQDVDIVVIRENTEGEYSGLEHEVVPGVVESLKVITKFCSERIAKYAFEYAYLNNRKKVTAVHKANIMKLADGLFLESCREVASKYPGIQYNEIIVDNCCMQLVAKPEQFDVMVTPNLYGNLVANTAAGIAGGTGVMPGGNVGQDHAVFEQGASAGNVGNENILEQKKANPIALLLSSAMMLRHLQFPSFADRLETAVKRVIAEGKYRTKDLGGTSTTQEVTDAVIANLD

SEQ ID NO: 85492 - protein, 401 aa, Zea mays
MPPPPTAVSSCWRGTRRHRAKNLHPHPAAVSVKQPGSGVRFQQFSSLASAAAPALRVLRYQPASTLYESPSSTPPRQLQAMAMEKAASFLSSLLGGGGGEPAATVKSIFIYPIKSCRGLAVSQAPITSTGFRWDRQWVVVNAKGRAYTQRVEPKLALVQVELPPEAFAENWQPTPDDHLVIRAPGMDTLKIPLITEHATIDDVSVWEWSGSAYDEGAEASEWFSTYFGKPSRLVRFKEASETRPTDPDYAQGYKIMFTDCFPFLIASQGSLDALNEILKEPVPMNRFRPNILVDGCHPYSEDLWKTIKINNLTFLGVKLCNRCKVPTINQEDGVPGTEPTETLQTFRSDQVLRPSHKNKRQVYFGQNLVCKESLSGEGKVIKVGDPVYVVQAFASSNEAPP

SEQ ID NO: 85493 - protein, 125 aa, Helicobacter hepaticus ATCC 51449
MKLLVVDDSSTMRRIIKNTLQRLGYEDILEAEHGVEAWQIMDTTEGIQVLITDWNMPEMNGLDLVKKVRSDERYTSIPIIMVTTEGGKAEVITALKAGVNNYIVKPFTPQVLKEKLEVVLGVNED

SEQ ID NO: 85494 - protein, 530 aa, Burkholderia xenovorans LB400
MNRIVEPGNPLAATASVTGTATRLSVQPVILAGGSGTRLWPLSRERNPKQLIGLMGDESLLERTLRRLDASFAAVEHETPAAGTRLIAAPLVVCCEDLRLQTLERLQRLERPGRPVRMVLEPVPRNTAPALTVAALAARAAAVEGDDPVIVALPADHLIGDHVAFGKALAEALEHAAAGAIVTLGVPPKRAETGYGYIRTGTALGTRGARVIERFVEKPDPELAERYVASGDYWWNSGMFVVRASVWLAAIELCQPAIAAACADAFEQATVDGDGALHLARKAFALCPSDSIDYAVMERVATDARLVGVAVPLVAGWSDVGAWDSVWEASAKDADGNVARGRVMFAGSTDSFAHSEGRLVACVGVSGVMVVETADAVLVVAKDRVQDVKAVVSRLKLEHGAEAQEHRKVGRPWGYYDSLERGARFQVKRIVVKPGGRLSLQMHHHRAEHWIVVRGTARVTRGEECFFLTENQSTYIPLGVTHRLENPGKTSLEMIEVQSGGYLGEDDIVRFDDQYGRDQESGHAGKGTSR

SEQ ID NO: 85495 - protein, 448 aa, Sphingomonas sp. RW5
MSDYDYDLIVIGAGSGGVRAARVAAAHGARVAIVEEYRVGGTCVIRGCVPKKLLIYGAHFAEDLRDARQFGWQVPDCQFDWPTLRDNVLAEVDRLEGLYRNTLGSHGVTILPGRGTIIGPHGVRIAGGQDVTSRMILVATGARPLLPSFDGAEHGISSNEAFHLDDVPRRIAIVGGGYIANEFAGIFNELGSAVTVINRSGQLLRGYDHSVRDRLVEISTRKGIAFRFDASFEKVIKLADGSLSVQLAGEDAFSVDCLMFAIGRVPNSSDLGLEEQGVEIDPLGAIIVDDDGRSTVGSIFAVGDVTNRIQLTPVAIREGQAFADTQFGGKPHRVDYRHVPSAVFSHPPIAFVGLTEQQARDQVGEVKIYTSDFRPMKNVLAKRDERALYKMICDADTDRILGLHMIGPDAPEILQAAAIAVKAGLSKAAFDETIALHPTMAEELVLLR

SEQ ID NO: 85496 - protein, 490 aa, Medicago truncatula
MRLTPTTSDTEVSGLEKKNIGRITQIIGPVLDVVFPPGKMPNIYNALIVQGRDTVGQEINVTCEVQQLLGNNRVRAVAMSATDGLKRGMVVINTGAPLSVPVGGATLGRIFNVLGEPIDNLGPVDTGTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEKNIAESKVALVYGQMNEPPGARMRVGLTALTMAEYFRDVNEQDVLLFIDNIFRFVQAGSEVSALLGRMPSAVGYQPTLGTEMGTLQERITSTKEGSITSIQAVYVPADDLTDPAPATTFAHLDATTVLSRGLASKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFKLILSGELDSLPEQAFYLVGNIDEATAKAANL

SEQ ID NO: 85497 - protein, 322 aa, Magnaporthe grisea 70-15
MQRPQAYGQSPPLHHPVPQHVSTVPQLRSPPPPVSQSAQSGQGYGGSPYPQQQQGGAGPQNMFGQYGQFMNDPAAQVAAHFGSTAFRQGQEIIDQNINRYLSVHLLKHYFNVTNSYVINKIYLVLFPWRHKPWSRKPAMGPGGQEGYLPPRDDVNSPDMYIPVMSLVTYILLSTAIAGLRGQFQPELLGNTAGTALIVVAAEIIILKLGCYIMSISNNSQLLDLVAYSGYKFVGVIVTVAVAEVMNGGKGTGGWSGWSVFIYTFLANSLFLMRSLKYVLLPENADNSRMQTDTRAKRNQRTQFLFFYSYVVQLFFMWILSRP

SEQ ID NO: 85498 - protein, 361 aa, Oryza sativa
  misc_feature (33)..(33): Xaa can be any naturally occurring amino acid
ALPFQSQSPPEPSSDSSISLCDRGNHLPDSVSXMGSSNREPVPARGFGSLVQIPDKIQNSLKVHFGRFLKKNGFGGGSEAEMLPMQMQGTCTTVAPEVRLDKQLQAWKNNPIWSDEPPEIKVTVPQGSLCNLNLKFKAGLPPDAVYNIIIDPENKRVFKNIKEVISRKVVLDEGQRQIVEVEQAAIWRFLWWSGVLSVHVFVDQNRTNHTVKFKQGRTGFMKKFEGCWKIEPLFVDKEACHPLDPCTLEKYDSCTNGTGRVGSSITLDQLIEPAMVPPPPFSWYLRGITTRTTEMLVNDLIAETARLRGLANNAIDKQYVEGKCDTSRDHLTEECNDIKERWRQRRKTGRHGNSLRLTAQG

SEQ ID NO: 85499 - protein, 92 aa, Bacillus sp. SG-1
MWCNCCCSCSNGCCCWWRRCCRKTEFDVVLESAGSQKIKVIKVVREITGLGLKEAKELVDNTPKALKEGVSKDEAEELKAKLEEVGAGVEVK

SEQ ID NO: 85500 - protein, 531 aa, Pleurotus eryngii
MFPGARILATLTLALHLLHGTHAAIGPIADMYIVNEDVSPDGFARSAVVARSVPATDPTPASVSVPGVLVQGNKGDNFQLNVRNQLSDSTMLKTTSIHWHGFFQSGSTWADGPAFVNQCPIASGNSFLYDFNVPDQAGTFWYHSHLSTQYCDGLRGPFVVYDPSDPHLSLYDVDNADTVITLEDWYHVAAPQGAVLPTPDSTLINGKGRFAGGPTSPLAIINVESNKRYRFRLISMSCDPNFTFSIDGHSLQVIEADAVNIVPIVVDSIQIFAGQRYSFVLNANQAVDNYWIRANPNLGSTGFEGGINSAILRYAGATENDPATTSSTSTPLLETNLVPLENPGAPGPAVPGGADININLAMGFDFTNFEMTINGSPFKAPTAPVLLQILSGATPAASLLPSGSIYALAANKVVEISIPALAVGGPHPFHLHGHTFDVIRSAGSTTYNFDTPARRDVVNTGIDANDNVTIRFVTDNPGPWFLHCHIDWHLEIGLAVVFAEDVASIKAPPAAWDDLCPIYDALSDSDRGGIA

SEQ ID NO: 85501 - protein, 305 aa, Miscanthus sinensis var. sinensis
IESVGEGVTDVAPGDHVLPVFTGECKECPHCKSAESNMCDLPRINTDRGVMIGDGKSRFSINGKPIYHFVGTSTFSEYTVMHVGCVAKINPQAPLDKVCVLSCGISTGLGASINVAKPPKGSTVAIFGLGAVGLAAAEGARIAGASRIIGVDLNPSRFEEAGKFGCTEFVNPKDHKKPVQEVLAEMTNGGVDRSVECTGNINAMIQAFERVHDGWGVAVLVGVPHKDAEFKTHPMNFLNERTLKGTFFGNFKPRTDLPNVVELYMKKELEVEKFITHSIPFAEINKAFDLMAKGEGIRCIIRMEN

SEQ ID NO: 85502 - protein, 305 aa, Miscanthus sinensis var. sinensis
IESVGEGVTDVAPGDHVLPVFTGECKECAHCRSAESNMCDLLRINTDRGVMIGDGKSRFSINGKPIYHFVGTSTFSEYTVMHVGCVAKINPQAPLDKVCVLSCGISTGLGASINVAKPPKGSTVAIFGLGAVGLAAAEGARIAGASRVIGVDLNPSRFEEARKFGCTEFVNPKDHKKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHSIPFAEINKAFDLMAKGEGIRCIIRMEN

SEQ ID NO: 85503 - protein, 276 aa, Methanothermobacter thermautotrophicus str. Delta H
MRCIMTEDAQKLAIMEQDVKIVRALSKIKHKIVVMSGKGGVGKSTVTVKLAEEFSRNGYSVCVLDADVHGPDIPKMMRVREPEITLTGNLINPIPTPVGATVMSIEFFLPSEDTPVIWRGPKKTGAIRQLLADVNWEGIDVLIVDNPPGTGDEPLTVLQSIPGIDGVVIVTTPQEVSIHDVEKCINMVNHLKIPVLGIIENMSYLQCPECGKKVFLFGKDGGKYLADKFDLQFLGEIPFETGISGDNESSASSYINNEMVKIFNKLAKYLKDGGAN

SEQ ID NO: 85504 - protein, 418 aa, Salinibacter ruber DSM 13855
MPATTHPTSETASFDAEALRADFPALEQDVYEDTPLAYLDNAASSQKPTPVIERLDTFYREENSNVHRGVHRLSQDATESYEAARESVARFLNAPDPDQIVFTRGTTEGLNLVSSTFGRMVAEEGDEILLTEMEHHSNIVPWQMLAEQVGASIEVLPVTDRGELRMDLLPEMLTDDTALVAISHVSNTLGTINPMEDVIDAAHADGVPVVVDGAQSAPHMPVDVQALDADFFVFSGHKVFGPTGIGVLYGKRELLEAMPPYQGGGDMIDQVSFEESTYDGLPHKFEAGTPNIADAVGLGTAVEYIMDMDWNAVRAHEDDVLRYATEQVGGIEGTQIVGTAPDKTSVLSFVFDDIHPYDAGTVLDREGVAVRTGHHCTQPLLKRYGLPGTIRASFAAYNTHEDVDRLVDGLHKVRHMFG

SEQ ID NO: 85505 - protein, 305 aa, Miscanthus sinensis var. sinensis
IESVGEGVTDVAPGDHVLRVFTGECKECPHCKSAESNMCDLLRINTDRGVMIGDGKSRFSINGKPIYHFVGTSTFSEYTVMHVGCVAKINPQAPLDKVCVLSCGISTGLGASINVAKPPKGSTVAIFGLGAVGLAAAEGARIAGASRIIGVDLNPSRFEEARKFGCTEFVNPKDHKKPVQEVLAEMTNGGVDRSVECTGNINATIQAFECVHDGWGVAVLVGVPHKDAEFKTHPMNFLNERTLKGTFFGNFKPRTDLPNVVELYMKKELEVEKFITHSIPFAEINKAFDLMAKGEGIRCIIRMEN

SEQ ID NO: 85506 - protein, 456 aa, Shigella flexneri 2a str. 2457T
MPAPAGLSELAWVLFGIYLAAIVGLVIKPFPEPVVLLIAVAASMVVVGNLSDGAFKTTAVLSGYSSGTTWLVFSAFTLSAAFVTTGLGKLIAYLLIGKIGNTMLGLGYVTVFLDLVLAPATPSNTARAGGIVLPIINSVAVALGSEPEKSPRRVGHYLMMSIYMVTKTTSYMFFTAMAGNILALKMINDILHLQISWGGWALAAGLPGIIMLLVTPLVIYTMYPPEIKKVDNKTIAKAGLAELGPMKIREKMLLGVFVLALLGWIFSKSLGVDESTVAIVVMATMLLLGIVTWEDVVKNKGGWNTLIWYGGIIGLSSLLSKVKFFEWLAEVFKNNLAFDGHGNVAFFVIIFLSIIVRYFFASGSAYIVAMLPVFAMLANVSGAPLMLTALALLFSNSYGGMVTHYGGAAGPVIFGVGYNDIKSWWLVGAVLTILTFLVHITLGVWWWNMLIGWNML

SEQ ID NO: 85507 - protein, 186 aa, Coxiella burnetii RSA 493
MNIATFLTFVRLSAIPIFGIFYFLPFRWAHPVAALIFIVAGITDWLDGYLARSLSQTTDFGAFLDPVADKLLVSAALVLVVGENYVAYLAVPAAVIICREILISALREWMAELGKRTSLAVTLLSKVKTLLQMLALILLIGYAPGFPAELLWGGVILLWIAAVLTVWTMIIYLKIAWPDLTMPREQ

SEQ ID NO: 85508 - protein, 136 aa, Brassica napus
  misc_feature (119)..(119): Xaa can be any naturally occurring amino acid
ASDYFPDLMAMAEKLMQEGKAYVDDTPREQMQKERMDGIDSKCRSHTIEENLNLWREMIAGSVRGLQCCVRGKLDMQDPNKAMRDPVYYRCNPMSHHRIGDKYKIYPTYDFACPFVDSXKGIPNALRSSEYHDRNA

SEQ ID NO: 85509 - protein, 305 aa, Miscanthus transmorrisonensis
IESVGEGVTDVAPGDHVLPVFTGECKECPHCKSAESNMCDLLRINTDRGVMIGDGKSRFSINGKPIYHFVGTSTFSEYTVMHVGCVAKINPQAPLDKVCVLSCGISTGLGASINVAKPPKGSTVAIFGLGAVGLAAAEGARIAGASRIIGVDLNPSRFEEARKFGCTEFVNPKDHKKPVQEVLAEMTNGGVDRSVECTGNINAMIQAFECVHDGWGVAVLVGVPHKDAEFKTHPMNFLNERTLKGTFFGNFKPRTDLPNVMELYMKKELEVEKFITHSVPFAEINKAFDLMAKGEGIRCIIRMEN

SEQ ID NO: 85510 - protein, 322 aa, Photobacterium profundum SS9
MTTKIILDTDPGIDDAMAILFAEAHPALDLVAITTVYGNATIDNATRNALYLKQKFNFTADIAKGASKPLHRPPVGATVVVHGETGFGDLTAPDDITEQADPRPAYQYIIDTVKANPGEIILVTVGPLTNIALALEAAPEIAGLVKEVVVMGGAFGMNDHRGNVTPYAEANIHDDPHAADIVFCASWPVVIIGLDVTEQSFFTGQYLDELRDDAGEVGQFIWDVSRYYLRFYSQKVGLNGCHVHDPSAIVYVINPDLFTLREGAVRVVTDGPAEGMTIQKFDDRKYMNDEWSSMPNQRVGIAVDDQALLKLYRESLIAYSQQ

SEQ ID NO: 85511 - protein, 321 aa, Clostridium difficile 630
MQVKVKKAVIPAAGLGTRFLPATKAQPKEMLPIVDKPTLQYIIEEAVASGIEEILIITGRNKKSIEDHFDKSVELELDLEKKGKKELLEVVQNISNMINIHYIRQKEPKGLGDAIYCARHFIGDEPFAVMLGDDIVDNDVPCLKQLTDAYEEYRTTILGVQKVNQEDTNKYGIIEAKNIEGRVYKVKDMVEKPESGKAPSNIAILGRYIITPEIFDILKDLPPGKGGEVQLTDALKILSKKEAMYAYNFEGKRYDVGDKLGFLEATVDFALKKEDLKEDFIKYLKHVCSEFDKNNNVLYNNTDEKIDLIEVNEARELEIQK

SEQ ID NO: 85512 - protein, 305 aa, Miscanthus transmorrisonensis
IESVGEGVTDVAPGDHVLPVFTGECKECPHCKSAESNMCDLLRINTDRGVMIGDGKSRFSINGKPIYHFVGTSTFSEYTVMHVGCVAKINPQAPLDKVCVLSCGISTGLGASINVAKPPKGSTVAIFGLGAVGLAAAEGARIAGALRIIGVDLNPSRFEEARKFGCTEFVNPKDHKKPVQEVLAEMTNGGVDRSVECTGNINAMIQAFECVHDGWGVAVLVGVPHKDAEFKTHPMNFLNGRTLKGTFFGNFKPRTDLPNVVELYMKKELEVEKFITHSIPFVEINKAFDLMAKGEGIRCIIRMEN

SEQ ID NO: 85513 - protein, 491 aa, Sinorhizobium meliloti
MSSQIIPVEPFDYVVFGGTGDLAERKLLPALYHRQMEGQFTEPTRIIGASRASLSHDEYRRFASDALKEHLKSGEFNEAEVEKFTSRLYYVSVDAKSEQGWDDLKKLLEEGKDRTRAFYLAVGPAIFSDISEKIRDHKLITRNTRIVVEKPIGRDLASATELNDTIGKVFREEQIFRIDHYLGKETVQNLMALRFANALYEPLWNSAHIDHVQITVSEAVGLENRAGYYDKAGALRDMVQNHILQLLCFVAMEAPTSMDAEAVRDEKLKVLRALKPITASNVEQVTVRGQYRAGASSGGPVKGYLEELEGGVSNTETFVAIKAEISNWRWAGVPFYLRTGKRMAGRMSEIVITFKQIPHSIFDQSAGRISANQLMIRLQPNEGVKQSLMIKDPGPGGMRLTNVPLDMSFAEAFAVRNADAYERLLLDVIRNNQTLFVRRDEVEAAWQWIDPILKAWEATGQQVQGYTAGTWGPSQSIALIERDGRTWNDAI

SEQ ID NO: 85514 - protein, 187 aa, Shigella flexneri 2a
MIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGV

SEQ ID NO: 85515 - protein, 269 aa, Aspergillus oryzae
MLDGGLGKLHKRMKRFGDTTLHLTVTREDMQSLKNDWLTDNIISFWEEYLEREFLVNYKSSNIVLLRPSMSFMILQTPNPHTLREALPDFTRTTHVFLPINDCRNVTEAEGGTHWSLLLISIVDGIAFHYDSLPPGNVREAGTVTMKFGALLNRPIRFIHLQDSPVQENGSDCGVFVCLSMRHLLLKRLLTANASEKVSMSLGGMKVDARGGRKEMTKIIDGFRKEGERRRSYVAEQVHRRDYANLSLNRASLSPLGKKSASPGPPRIE

SEQ ID NO: 85516 - protein, 272 aa, Bacillus cereus ATCC 10987
MDKQIGFIGCGNMGMAIIGGMLNKKIVSSNKIMCSDLNTTNLENASEKYGITITTDNNEVAKNADILILSIKPDLYPLVINEIKEVIKNDAIIVTIAAGKSIESTENAFNKKLKVVRVMPNTPALVGEGMSALCPNEMVTEKDLEDVLNIFNSFGQSEIVSEKLMDVVTSVSGSSPAYVYMIIEAMADAAVLDGMPRNQAYKFAAQAVLGSAKMVLETGIHPGELKDMVCSPGGTTIEAVATLEEKGLRTAIISAMQRCTQKSVELSGQTKK

SEQ ID NO: 85517 - protein, 245 aa, Aspergillus nidulans FGSC A4
MKSPIPLLHGTGSIPPIGLGTWQSSANATCLAVKHALQHGYRHIDTALNYGNEKEVGQGIRDSGIPREEIWVTTKLDNHWHHRVREGLESSLRDLGLEYVDLYLIHFPCSTDPEDRSKHLKDWDFVRTWQEMQKLLGTGKVRNIGVSNFQISHLERLLNDPSCKVIPAVNQIELHPYNPSLRWNLQRGVSVIPKSITPARIDSNIDLEGFELSPDEMGEISAIKTRAKVVGDSWMPIRVFTGDDE

SEQ ID NO: 85518 - protein, 571 aa, Candida glabrata CBS 138
MRGKMDADKESVAAASMSPTLSVGAGTTKSIMNVGGKSGAVVSNTPEPGLKRIPTVTFSDSKIVGSNKFGASDERKPGALGGAESALDSKELESQGMVNLPQILHDKLVDRRTPSNGLPDIQVPLPEKEEHPHFLVEDPLHSPKVRSRANSLSPSTPQVDLNGVPLSTAIVNGNDVKPGIKPITSNPLERDGSVSVSKGSEQPLLESVIEEASSTPGMANIPKRENAKNLDMRLPQDDGKIHILFGATGSMAVFKIKPMVKKLVDIYGKDRISIQVVLTKSAEKFLNKKVVKKVKPHPESNEDPLDVVTNIPGGTINECAKLKNGGADAQGSQQSNGSTNSTPDKTAIGNNPFQLEGGPVIQIWRDQDEWDVWKQRSDPVLHIELRRWADILVVAPLTANTLSKIALGLCDNLLTCVIRAWNPNFPIFLAPSMVSSTFNSVMTKKQLAIIKEEMPWITVFKPSEKVMGINGDIGLGGMMDPNEIVDKVVMKLGGYPKEEDEDEDDEDEDEDEDEENETCQEGENKKDEDEDEDEDDDDDEDDDDDEDEDEDEEDENNGGAEETLQPVENSQ

SEQ ID NO: 85519 - protein, 363 aa, Prosthecochloris aestuarii DSM 271
MSLRCGIVGLPNVGKSTLFNAITAKQAEAANYPFCTIEPNIGTVLVPDERMQELASIVKTPTIIPATLEIVDIAGLVRGASKGEGLGNQFLSHIREVDAIVHVVRCFDDGDVIHVHGKVDPADDISTIETELMLADLESMEKRMDKLRKNARKEKELLPLVELAEKVIKGLSDGIPARALMETDEEKALGSQFFLLSAKPILYAANVSENDLPDGNAYTAEVQRIAEEAGSKMLIISAQTEAEIAELPEEERPEFLESLGLPMSGLDRIIQSAYDLLGLHTYFTAGVKEVRAWTIRKGAAAPEAAAAIHTDFEKGFIRAEVIAYNDMITYGSEQKAKEAGKMRSEGKEYIVKDGDVIVFRFNV

SEQ ID NO: 85520 - protein, 297 aa, Prosthecochloris aestuarii DSM 271
MQASRRRSEAPSSRSATIFSTQWYRSGSMKQGVACITGSTDGIGRAAAFELAAAGHTVVLHGRSFERLEHTRREIEEQTGNHSIHTVLADFTDLCQVRRMADQLEKLCSVIDILINNAGVYMPRCQITTAGIETTFAVNHLAHFCLTTLLEPLLIESRTRVVNVSSVDHHSAGFSANSITGGTRYTGYQAYAFSKLCNVAFTLEHADRLRRTGVTVNTLDPGILATKLLHAGWSLQGDDVSCGAPPLLYLACSSKVADITGTYFENNHPAICSPIAHDPEIRRELWEISEEIVERNS

SEQ ID NO: 85521 - protein, 524 aa, Deinococcus radiodurans R1
MTQPNPTQPSPTQQNHDLARQLRESRLSRGLQHFIGGEWVDAHSGKTFDAHSPVDNDFLVKVAEGDASDIDRAAKAAHDAFQTWREVSGAERRKILHKVADLIEKRAQEIAVLESVDTGQAIRFMKSAAARGAENFRFYADRAPGAQDGQSLPAPGFINYSIRQPIGPVGVITPWNTPFMLSTWKIAPALAAGCTVVHKPAEWSPVSATLLTEIMDEAGLPGGVHNLVHGFGESAGKSLTEHPLVKAVAFVGETTTGSHIMRQGADTLKRVHFELGGKNPVVVFDDADLDKALDAVVFMIYSLNGERCTSSSRVLIQEGIYDEFTRRIAERAANIRVGDPLDPDTEVGPLVHPRHFEKVMSYFECARQEGATIAAGGERVGEAGNFVRPTLFTAARNDMKIAQEEIFGPVLTAIPFKDEADALELANDVNYGLAGYLWTNDLTRAHRFAHGLEAGMIWVNSENVRHLPTPFGGVKNSGIGRDGGDYSFEFYMETKNIAISLGTHKTAKLGVGQAPAVGKKEAGE

SEQ ID NO: 85522 - protein, 283 aa, Picea sitchensis
MAEESKLLGVLNVKIIGSGKPTLVLAHGFGSDQSVWQYILPYLVAHYKVIVFDMVFSGKVDPKNFDFDRYTSLSAYAADLLSILDELKIDKCLYVGHSVSGMVGCLASIERPELFERLILLCASPRYLNEESYHGGFERGEVDSLYYALKSHYAAWASGFAPLAVGVDEPSVVEEFRRTMMNMKPEIALAVAKTIFESDMRSILCDVKTPCSIIQTAKDIVVPMAVPYHMQGNLGGKMNSVIILDAEGHLPQLTAQDLLLQAVKLILEGSKMVLEPTVQNANI

SEQ ID NO: 85523 - protein, 275 aa, Prosthecochloris aestuarii DSM 271
MPGILQDKIAIITGSTKGIGLAIARAYVSQGAKVVITSSSQKNVDAAIREFPAARVLGLVCDVSDSEGVEKLIQETLTHFGALDILINNAGISDPFYNITDSDPAVWGRVIDINLKGTYYGCRAAMNYFLESGRPGKIINLAGSGTDKRSNTPFISAYGSTKAAIARFTYAIAAEYKDTSVSIMLLHPGLVRTEIISTENPTPEMQRQLGTFETIVEIFAQPPTVAARLAIKMASSWSDGKTGIYLSALNGWRKKMLLLSWPLRKLLNRIDRNNY

SEQ ID NO: 85524 - protein, 308 aa, Arabidopsis thaliana
  misc_feature (132)..(132): Xaa can be any naturally occurring amino acid
MERSRVTREAPTGTRILLASLSAMVAESVTFPIDLTKTRMQLHGSGSASGAHRIGAFGVVSEIARKEGVIGLYKGLSPAIIRHLFYTPIRIIGYENLKGLIVRSETNNSESLPLATKALVGGFSGVIAQKCXVVASPADLVKVRMQADGRLVSQGLKPRYSGPIEAFTKILQSEGVKGLWKGVLPNIQRAFLVNMGELACYDHAKHFVIDKKIAEDNIFAHTLASIMSGLASTSLSCPADVVKTRMMNQGENAVYRNSYDCLVKTVKFEGIRALWKGFFPTWARLGPWQFVFWVSYEKFRLLAGISSF

SEQ ID NO: 85525 - protein, 554 aa, Vitis vinifera
  misc_feature (259)..(259): Xaa can be any naturally occurring amino acid
MGEKGKYWKKQKEEWKKQNFHLDLRSLNCILSLPASQVLTLLLYNPYALTHHSLFTTVLALDDRSLETLRCISRPPLEVSELANALSSGLTNTVKFSRVDCSSTRHIMNKENITSAEIEEPTVRITRARAKAATKSGGLLPPKPPIKLDZMQVVRTNSKRPASNENKPSATANAGLQHKRRATLKDVTNVISKRAKRGPSNKSSKVALTVLVETPQVQEDAKTKVTGETSNIRTVETQDSTLLVNLEEDEFIQHTFSSXRTSDVADPTQLEETSIKPAQHQILSEEEEDNLFKAQGSPNGPCIADIDSDHKDPQMCSLYASDIYDNFLCRELDRRPSANFMDSVQRDITPNMRGILVDWLVEVSEEYKLVPDTLYLTVNLIDRFLSKNYIEKQRLQLLGVTCMLIASKYEEICAPHVEEFCFITDNTYTREEVPCVELEFLANYIAELTLVDYSFLKYLHSLIAASAVFLARWTLNQSDHPWNATLEHYTTYKASDLKNVVLAMQDLQLNTNGSSLNAIRDKYKLKKLYDVRAIQQQLAGLPGNAGWASEGELH

SEQ ID NO: 85526 - protein, 151 aa, Triticum aestivum
MDYSNLRRQITFMKKSFFDQGYLDEQFNQLEELQDESSPNFVEEVVALFLKDSPRLLSNIEQTIGKYPQDFYRLDSLVHQLKGSGSSIGAVRMKNECSVFKAHCNDRNLEGCRRSLQKMKREHATLKQKLESYFQLLRQVGPREHAVNSRK

SEQ ID NO: 85527 - protein, 227 aa, Zea mays
MALSKLNSGGWVHIFPEGSRSRDGGKTIAPAKRGVGRLVIVVVGDPINFDDLLIDNCGDTQDIPRGILYDKVTQRIGQRLQELKVEVDRLAAEQEPELQNRNVGDDGYRLWQQVDWEGFGIGSSMLPSEPSAAAQVPSREAEPEPHLEVEQSVSPAPSAATFYDVAVPHWFQRHVDPSELMGFASHGLIKHGKFLEEGYREFQQSATTLHTWWVSRANNAAHRWSTA

SEQ ID NO: 85528 - protein, 246 aa, Arabidopsis thaliana
MSSSNACASPSPFPAVTKLHVDSVTFVPSVKSPASSNPLFLGGAGVRGLDIQGKFVIFTVIGVYLEGNAVPSLSVKWKGKTTEELTESIPFFREIVTGAFEKFIKVTMKLPLTGQQYSEKVTENCVAIWKQLGLYTDCEAKAVEKFLEIFKEETFPPGSSILFALSPTGSLTVAFSKDDSIPETGIAVIENKLLAEAVLESIIGKNGVSPGTRLSVAERLSQLMMKNKDEKEVSDHSLEEKLAKEN

SEQ ID NO: 85529 - protein, 305 aa, Miscanthus transmorrisonensis
IESVGEGVTDVAPGDHVLPVFTGERKECPHCKSAESNMCDLLMINTDRGVMIGDGKSRFSINGKPIYHFVGTSTFSEYTVMHVGCVAKINPQAPLDKVCVLSCGISTGLGASINVAKPPKGSTVAIFGLGAVGLAAAEGARIAGASRIIGVDLNPSRFEEARKFGCTEFVNPKDHKKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHSIPFAEINKAFDLMAKGEGIRCIIRMEN

SEQ ID NO: 85530 - protein, 120 aa, Zea mays
VELLSGFRDNFCQKLDNSAVGIRGTLAKLSQLVAKYDGELQQHLEITTEEFNFADTIHIWDTLLSDPGGPQETLLRICCAMLILVRKRLLAGDFTSNLKLLQNYPPTNISHLLYVANKLH

SEQ ID NO: 85531 - protein, 305 aa, Miscanthus transmorrisonensis
IESVGEGVTDVAPGDHVLPVFTGECKECPHCKSAESNMCDLLRINTDRGVMIGDGKSRFSINGKPIYHFVGTSTFSEYTVMHVGCVAKINPQAPLDKVCVLSCGISTGLGASINVAKPPKGSTVAIFGLGAVGLAAAEGARIAGASRIIGVDLNPSRFEEARKFGCTEFVNPKDHKKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHSIPFAEINKAFDLMAKGEGIRCIIRMEN

SEQ ID NO: 85532 - protein, 305 aa, Miscanthus transmorrisonensis
IESVGEGVTDVAPGDHVLPVFTGECKECPHCKSAESNMCDLLRINTDRGVMIGDGKSRFSINGKPIYHFVGTSTFSEYTVMHVGCVAKINPQAPLDKVCVLSCGISTGLGASINVAKPPKGSTVAIFGLGAVGLAAAEGARIAGASGIIGVDLNPSRFEEARKFGCTEFVNPKDHKKPVQEVLAEMTNGGVDRSVECTGNINAMIRAFECVHDGWGVAVLVGVPHKDAEFKTHPMNFLNERTLKGTFFGNFKPRTDLPNVVELYMKKELEVEKFITHSIPFAEINKAFDLMAKGDGIRCIIRMEN

SEQ ID NO: 85533 - protein, 305 aa, Miscanthus transmorrisonensis
IESVGEGVTDVAPGDHVLPVFTGECKECPHCKSAESNMCDLLRINTDRGVMIGDGKSRFPINGKPIYHFVGTSTFSEYTVTHVGCVAKINPQAPLDKVCVLSCGISTGLGASINVAKPPKGSTVAIFGLGAVGLAAAEGARIAGASRIIGVDLNPSRFEEARKFGCTEFVNPKDHKKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHSVPFAEISKAFDLMAKGEGIRCIIRMEN

SEQ ID NO: 85534 - protein, 170 aa, Zea mays
  misc_feature (122)..(122): Xaa can be any naturally occurring amino acid
  misc_feature (133)..(133): Xaa can be any naturally occurring amino acid
  misc_feature (145)..(145): Xaa can be any naturally occurring amino acid
  misc_feature (151)..(151): Xaa can be any naturally occurring amino acid
  misc_feature (158)..(158): Xaa can be any naturally occurring amino acid
  misc_feature (166)..(166): Xaa can be any naturally occurring amino acid
MTFSMLSSGTVNISPARASMSAPFTGLETSTAYPDSSKTDSDMTSMTRNGGRVNCMKAGAQVSKKKIETVSYLPDLTDGEASNEVDYHLLNKRIPCVKLEEEHEFVYREQINTPTYYDVHNXQMRKFPLDACXDSAHVISQLHEXKNEYPXSFIRIIXFDNNRLVXCINF

SEQ ID NO: 85535 - protein, 211 aa, Oryza sativa Indica Group
MEGSLRLGFLLVLCILAFLRPAAAIRFVIDREECFSHNVDYEGDTVHVSFVVIKAETPWHYTEDGVDLVVRDPNGNQIHDSRDKISDKFEFIVHRRGVHRFCFTNKSPYHETVDFDVLVSHFSYYDQHAKDEHFSALFEQIAKLDEALYNIQFEQHWLEAQTDRQAILNENMSRRAVHKAFFESAALIAASVVQVYLLHLLFERKLGTSRV

SEQ ID NO: 85536 - protein, 305 aa, Miscanthus transmorrisonensis
IESVGEGVTDVAPGDHVLPVFTGECKECPHCKSAESNMCDLLRINTDRGVMIGDGKSRFSINGKPIYHFVGTSTFSEYTVMHVGCVAKINPQAPLDKVCVLSCGISTGLGASINVAKPPKGSTVAIFGLGAVGLAAAEGARIAGASRIIGVDLNPSRFEEARKFGCTEFVNPKDHKKPVQEVLAEMTNGGVDRNVECTGNINAMIQAFECVHDGWGVAALVGVPHKDAEFKTHPMNFLNERTLKGTFFGNFKPRTDLPNVVELYMKKELEVEKFITHSVPFAEINKAFDLMAKGEGIRCIIRMEN

SEQ ID NO: 85537 - protein, 173 aa, Ehrlichia ruminantium str. Gardel
MSKHTNIPMFRIGIGYDVHRFDNINNDDSNTSITICGIEINYHKKIIAHSDGDVGLHALADAILGAVGCGSIGQHFPNTDQKWKNAKSSHFVIEAQKKAQERGYIISNADIIIICEQPKIMPYALEMQHYIAQFTSIDPSFINIKATTTEKLGAIGRNEGIAAQAIVLCSQQY

SEQ ID NO: 85538 - protein, 513 aa, Bacillus cereus ATCC 10987
MTFLFNYLKIITRFHITEYIPQYGKTSNFILSTTKVRKTMAQVNNTNNELKRTMKSRHLFMIALGGVIGTGLFNGSGFIISQAGPGGSVLAFMAGGLLMYFVMLCLGELAVAMPVSGSFQEYATKFINPATGFTIGWLYWLSWANTTGLEFTTAGITMQRWFPDIPVWVWCLIFGVTIFTINALSARSYAETEFWFSSIKVSAIIAFIILGGAAMFGFIDLKGDEPAPLLSNFVNHGGLFPNGLAAILLTMVTVNYSFQGTELVGIAAGESEDPAKTLPRSIRNIIWRTMFFFVLAIFVLVALIPWEEAGLTKSPFVAVFDNIGIPYAADIMNFVILTAVLSVANSGLYAATRMLWSLSKNEMAPAFLKKLSSRGIPLNALIMTIAISAFSLLTSVVAAETVYLWLISISGVITIIVWMSICVSQFFFRKHYLADGGKLEDLKFKTPLYPLVPILGFGLYGIILISLIFIPEQRLGIYCTVPFIIFCYTYYHLKVKKRISTNTNSETKISETM

SEQ ID NO: 85539 - protein, 284 aa, Helicobacter hepaticus ATCC 51449
MKKTLIVVGYGNMAKAILANNSFVTQRYHLIITGRYAHKAYDFITQCALDASVYEAKVESSSSNKSIIDIEGKDILLCTKPAGLESFVFKGQANSVYSVLAGTSIAMIQKHLSASSIVRLMPNIAAHSKLSATAFYYHMLDTKDSAQVLHNEIRPFIESFGVAVQVDSEALIESSIAASGSSIAFLALIAESLIDAGILEGLNEQQSIALVKQTFVGFATELAHKSPNELKYAISSPGGTTIRGLAVLEESGMRGILIKAAHTAAEHARQAIQKYSTQDMPKKR

SEQ ID NO: 85540 - protein, 1647 aa, Issatchenkia orientalis
HIELAKPVFHIGFLAKIKKVCECICMNCGKILLDENTNPQYRAAIKIRDPKKRFNAVWTLCKTKMVCDVDPPEDSDDDEDDEGIHRHRRGGCGSVQPSIRKDGLKLWGTWKKSNVDEETENLERRQITASDILNVFRHISPEDCHRLGFNEEWARPEWMLLTVLPVPPPPVRPSVAFTDSKRSEDDLTYKLADILKANINVQKFEMDGSPQHVISEFEALLQYHVATYMDNDIAGQPQALQKSGRPIKSIRARLKGKEGRLRGNLMGKRVDFSARTVISGDPNLELDQVGVPRSIARTLTYPEIVTPYNIQKLTEMVRNGPNEHPGAKYVIRENGDRIDLRFNKRAGDIQLQYGWKVERHLMDNDPVLFNRQPSLHKMSMMCHRVKVMPYSTFRMNLSVTSPYNADFDGDEMNLHVPQSYETRAELSELCAVPLQIISPQSNKPVMGIVQDTLCGVRKMTLRDTFIEYDQVMNMCYWIPDWDGVVPQPAILKPKPLWSGKQILSLCIPNGIFLQRLDGSLTSPKDSGMLIVNGEIMFGVVNKATVGASAGGLIHTTMREKGPTTCAKMFGNIQKVVNYWLLHNGFSIGIGDAIADPETMKTITETIKEAKDKVQTVIREAQKNLLEAEPGMTLRESFEQKVSKILNEARDAAGKSAETSLKDSNNVKQMVTAGSKGSYINISQMSACVGQQIVEGKRINFGFADRSLPHFTTDDYSAESKGFVENSYLRGLTPQEFFFHAMAGREGLIDTAVKTAETGYIQRRLLKALEDIMVHYDGTTRNSLGDVIQFIYGEDGLDATTVEKQTVDTIPGSNAAFEKKYRVDLMDEKKSIRPDVVEYGSEILGDIKLQKILDEEYEQLLKDREYLRTVVFPDGENNWPLPVNVRRIVQNAQQIFHVDRYKASDLTIEEIVKSVQELCKKFTVVRGDGGCLTEARENSTLLFQCLIRSKLATRRVLEEYKLNKDAFEWVVGTIAQQFARSLVNPGEMVGVVAAQSIGEPATQMTLNTFHYAGVSSKNVTLGVPRLKEILNVAKNFKTPALTVYLEEEYATDIEKAKSIQSAIEHTSLKNVTACTEIYYDPDPRTTVIEEDFDTVEAYFAIPDEKVEENLHKQSPWLLRLELDRAKMLDKQLSMQQVAAKIMENFGDDLFVIWSEDNADKLVIRCRIVREEKALDEEEEDTEDGLLKALEAQMLESITLRGVSGISRVFMMKYDKTYIAEDGDFAKKQEWVLETDGINLADVITVEGIDTTRTYSNSFVEILFVFGIEAARSALYKEILNVIAFDGSYVNYRHLALLVDLMTYKGHLIAISRHGFNRNDTGALMRCSFEETVEILFDAGASAELDTCDGVSQNIILGQMAPFGTGSFDVYLDDEKLAALPSENPVDVISTAKDTKGSMTVYGDDHFKDDIIDIPMAADNVAFSPLITAGSGDDRSGGFTEYGSGNMSAYQPTSPFGYGATSPSYGPTSPSYGPTSPSYSPTSPAYSPTSPAYSPTSPAYSPTSPAYSPTSPAYSPTSPAYSPTSPAYSPTSPSYSPTSPSYSPTSPSYSPTSPSYSPTSPSYSPTSPQYSPTSPQYSPTSPQYSPTSPQYSPTSPQYSPTSPQYSPTSPQYSPTSPQYSPTSPQYSPTSPQYSPTSPQYSPTSPSYSP

SEQ ID NO: 85541 - protein, 626 aa, Physcomitrella patens subsp. patens
MEKKKITRKKKATSRPAETEGEISITAKSLHSVEKYSDTPTTLSSSSAANYDSTLMDLIDQLEGIRLHALAFERWYSPQLKKVHRKHYDSARNLLHYVAFRSLDIANLQERLASSGLSSLEGCEAHTLASVNSISSILRSLLQGSQIQSSCLDGETETGMNIARINCAHDNPEVWKKMVRKIRFFSQLLGTECRISFDLAGPKLRTGPMQPGPSVLKIKPVKNDLGQVVSSACVWIAEEGVKPPEGRIPDTCVPVVATPHWTKKIQIGDVVRFKDARGRSREFNVVQKGSGASKVGIFAECRSVSYIETGCELVISGHGGKKLKVNVGQLPEIEQAIVLRTADKLVLKRESILGSPAKLDKAGNVVSPASVTCTLGKIFDIAKPGEPVKFDDGKIGGVISSVSPDEIYVTITDAGDHKGKKLKGEKAINFPQSDLSMNGLTIKDAEDIDFVVSNADMLALSFVNGPADVRALQDELARRGAENIGIVVKIETELGFQRLPTILLQAMETKNLVGVMVARGDMAVECGWQRLAELQDQILLICESAHVPTIWATQVLEGLAKSGLPSRAEITDAASGSRAECVMLNKGPYILQAVASLDDILCREACHRRKHQAVLHPLQNFEKLGM

SEQ ID NO: 85542 - protein, 188 aa, Shigella flexneri
TMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGV

SEQ ID NO: 85543 - protein, 248 aa, Candida albicans SC5314
MARQFFVGGNFKANGTKQQITSIIDNLNKADLPKDVEVVICPPALYLGLAVEQNKQPTVAIGAQNVFDKSCGAFTGETCASQILDVGASWTLTGHSERRTIIKESDEFIAEKTKFALDTGVKVILCIGETLEERKGGVTLDVCARQLDAVSKIVSDWSNIVVAYEPVWAIGTGLAATPEDAEETHKGIRAHLAKSIGAEQAEKTRILYGGSVNGKNAKDFKDKANVDGFLVGGASLKPEFVDIIKSRL

SEQ ID NO: 85544 - protein, 203 aa, Shigella flexneri
ELKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFSF

SEQ ID NO: 85545 - protein, 300 aa, Helicobacter hepaticus ATCC 51449
MIAQNITELIGNTPILQLQQFAPNLYGKCEFLNPSHSVKDRPAYAMIDEALKTGKITKDTTIVECTSGNMGISLAMICASLGLKIIITMPESMSIERRKMIALFGANLVLTPASEGMQGALNKAQEILDSTPNSFMPSQFDNLANKEMHKRTTALEIYKSFEGSLDYFVAGFGTGGTISGVGEVLKEKIPSIKIIGVEPAASPLLSKGQAGPHKIQGIGANFIPKILNRDVIDSIEVVENEVAIKMAQNLGKIGVMVGISSGANVAAALEIAKNNPNKKVLTMLNDTAERYLSTDLFNTL

SEQ ID NO: 85546 - protein, 202 aa, Shigella flexneri
LKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFSF

SEQ ID NO: 85547 - protein, 197 aa, Physcomitrella patens subsp. patens
MAEELDDDRDEEWFKEVYGTEYTAPARATGATRRAVEPAPPKVANKRAPNPSDSEEDEEQRDPTAVPTDFTSREAKVWEAKAKAVERNWKRRKEEELTCRLCGEVGHFAQGCPTTLGGNRKPGEIVERIPLRDKRLKPRLIGTGGAIIQGIEKETGCRLKLEDNLTVGNGAFFVKITGPDRVAVKMAMTSVNKLVDQ

SEQ ID NO: 85548 - protein, 185 aa, Physcomitrella patens subsp. patens
MMGSFITRAIIMVLGYIYPAYECYKIVERKRPDPEYLRFWCQYWVIIAVVTVVERFADALISWYVVPLYSEAKLAFIIYLWYPQTMGTTYVYNMLLRPLVAQHELEIDRNLNELRTRAGDVVLQWWQRGSVHAQARFSELLQFLAMQSNGSQQRSFPNQGVPQGPARAPAQGHSREYPQVRLLSH

SEQ ID NO: 85549 - protein, 328 aa, Candida albicans SC5314
MASKYTPATLNTVHISSSVLLSLLRHTSEHYPQLFSGALLGFEDESLIDVTHGFPYPYPDQYEGGSFRSRSGGQYQKDLLENFKKLGYGIEFLGWFQSTVSGNFVTNQLIEGLAQQQLINSNAFILINNLSSVGQEVSIKALRLSTGFMNAYVDGKWKSKDLESNKISYLNIFEELNLEISNQKLVDVYLSSLSLKPSTESELDVLNLLSNQNATGQLLESLSGQVDSFNYDQNNFNYYQRQYQKEQSKIQQWKQQRKLENLERAKKGEKELDTEEWKTIFKLPNEPSRYNNMLYSSAIDVLADDILKKCDEELTKSFAIERKLTASE

SEQ ID NO: 85550 - protein, 387 aa, Oryza sativa Indica Group
MDTTASCSLPDAWPEPVVPVQSLSEAGVSAVPPQYIKPPLDRPVLPAQILDVPTVDVAAFLDLDGAAAAEQLKNLAEACSKHGFFQVVNHGVQASTVDRMRGAWRRFFALEMEEKKACSNSPAAPEGYGSRAGVEKGAPLDWGDYYFLNILPSEIKRRNKWPKSPHDLREITEDYGSDLMNLCEVLLKAMSLSLGLGENQLHAAFGSDDGISACMRVNYYPKCPQPELTLGISSHSDAGGIAVLLADDRVKGTQVRKGDTWYTVQPIPNAFLVNIGDQIQIISNDKYKSVEHRAVASSDDARFTVAFFCNPSGNLPIGPAAQLVSSQSPALYTPIVFDEYRRFSRRRGLKGKSQLEALKNSKIAQLEVIAYRDAQINLRNLFTSDKN

SEQ ID NO: 85551 - protein, 126 aa, Synechococcus sp. CC9311
MTIYIGNLSFQAEQEDLLDLFGQYGEVKSASLPLDRETGRKRGFGFVEMATDEDEQKAIDDLQNVEWMGRMIRVNKATPRERTGGGGGGGGRGGYGGGGGNGGGGGYGGGGGGNGGGGGYGGGNRW

SEQ ID NO: 85552 - protein, 399 aa, Oryza sativa Indica Group
MDTTASCSLPDAWPEPVVPVQSLSEAGVSAVPPQYIKPPQDRPVLPAPSLDVPTVDVAAFLDLDGAAAACAAAEQLKNLAEACSKHGFFQVVNHGVQASTVERMRGAWRRFFALEMEEKKACSNSPSAPEGYGSRAGVEKGALLDWGDYYFLNILPREIKRRNKWPKSPHDLREITEDYGRDLMNLCEVLLKAMSLSLGLGENQLHAAFGSDDGISACMRVNYYPKCPQPELTLGISSHSDAGGIAVLLADDRVKGTQVLKGDTWYTVQPIPNAFLVNVGDQIQIISNDKYKSVEHRAVASSDDARFTVAFFCNPSGNLPIGPAAQLVSSQSPALYTPIVFDEYRRFSRRRGLKGKSQLEAMKNSKIAQVELIAYRDAQINLRNLFTSDRKVNRTVRQR

SEQ ID NO: 85553 - protein, 550 aa, Candida glabrata CBS 138
MAEVKEEQPKRFSLWNFWISSLLLKLLLIPDYYSTDFDVHRNWLAITNKLPLRQWYYEHTSQWTLDYPPFFAYFEWFLSQFVPSYVKSDGCLDIVEVGQFGMPTVVFQRLTVIASEILLFVVLQVYINTSKVSERTQSFVVASSIAISPGFLIIDHIHFQYNGFLFAILIASIVAAKNKKYLWCGFFYSVALCFKHIYLYLAPCYFVFLLRAYVLNLKDFKFKSYRDLIFIVKWRHLVKLGSVVIATFAVAFGPFIFDLPQLLTRLFPFSRGLTHAYWAPNFWAIYSTIDKILTMVFLKMPYTYKLASQFISPPLIPASLNEIKAKMAANNNGSKGLVEDVYFVILPQIVPKLTFLLTLLYQVLAVVPVLFDPSFKRFMGSMTLCGLASFLFGWHVHEKAIMLVIIPFSFLVISDRRLLSSFMLLTSAGYVSLFPLLYESQDFLIKTFYTYVWCVIYFFAFRKTTRLSTSVERRVFFLDRLTLVYMFLLIPMVFLIQIRDILGWKYLVLQRFEFLSLMVYSFYCSVGIISAWFGLSWLYNFDEPLWVSNE

SEQ ID NO: 85554 - protein, 372 aa, Pseudomonas fluorescens PfO-1
MPTRREFIKQVSVAVGAGAAVMGLGLSPARVLAASEGRWFMPDEGDKHERAYMAFGAQDAIWEDFTEDVQEALGRIARAIARYEPLTIYCRSGERSLAEEICGSSNITYQIANLDDIWMRDISANFVIDDKNGLGAVDFNFSGWGNKQQHSKDAKIAKRVAADAQATYQRSELVGEGGGIEVDGHGTAIMTESCWVNENRNPGWSKADVEAELKARLGLRKIIWLPGIKGKDITDAHVDFYARFVTPGVVIANLDTDPRSYDNKVTLAHLEILKKATDADGRPLQIHTVSPPLKPRKTKFNKDNDDFAAGYINYFVINGAVIAPEFGDKDADKKAFDLLKKLYPNRDVVQINIDAIAAGGGGIHCVTSHQPA

SEQ ID NO: 85555 - protein, 299 aa, Campylobacter jejuni
MKVHEKVSELIGNTPIIHLKKFGINVFAKCEFLNPSHSIKDRAAFEMIKDALDSKKINQDTTIVEATSGNTGISLAMICADLGLKFVAVMPESMSLERKKMITLFGARLELTPANLGMKGAVDKANEILLNTPNSFMVSQFENISNKNAHRKNTALEILRDLDNELDIFVAGFGTGGTISGVGEILKEKLEKVHIVGVEPLNSPLLSKGEAGSHKIQGIGANFIPAILNKEVIDQVITVSNEDAINTAKELAKIGLMVGISSGANVFAASMLAKKFPDKRILTMLNDTAERYLSTDLFA

SEQ ID NO: 85556 - protein, 401 aa, Pyrococcus furiosus DSM 3638
MKIPDDVRKDIPLTQEVIYFDNTATSLTPKPVIEAMDEYYLKYRANVHRGVHRLSQMATQKYEESRKVVADFINAKFEEIVFTKNTSESLNLVALGLEHTFKKGDKIVTTPYEHHSNLLPWQRLAKKLGLKLEFIEGDDEGNLDLSDAEKKIKGAKLVAVQHVSNALGVIHEVEELGRMAKEEGAIFVVDAAQSVGHMEVDVKKLNADFLAFSGHKGPMGPTGIGVLFISEEYFDVFDPPLIGGGTIEDVDLCCYKLTEPPERFEAGTPNIGGAIGLAAGIKYIEKIGIEKIEKQERKLVKRTTEGLDELEIPWYGPRNLDKHAGVVSFNVPPLHPHDVAAVLDEHKIMVRSGHHCALPVMKKLGINGTVRASFHVYNSVEEVEIFLGVLEDLVRKIRGAL

SEQ ID NO: 85557 - protein, 406 aa, Coprinopsis cinerea okayama7#130
MGCVQSTGVDDEAKARNDEIENQLKRDRMMAKNEIKMLLLGAGESGKSTVLKQMKLIHHGGYSEQEKDSYKEIIFSNTIQSMRAILDALPQLDLALQPANDARRATILAMPGQIEADVFPRDVADAIRNLWRDPAVKEAVRRSREFQLNDSAVYYFNSIDRMSAPGYLPTDQDILRSRVKTTGITETTFKVGELTYKLFDVGGQRSERKKWIHCFENVTALVFLVSLSEYDQMLYEDESVNRMQEALTLFDSICNSRWFVKTSIVSTPLLSSSLFPFLAPPFVVGPYRPRALSTPFPRCVLDTQTPSPLFLHTRPLPTPRAASIAPLLPPMSPSFFPSFHQAFEPLPSFDVTNIISFGLRTSFGLRTPFPFFLGLSRAKEASPFGVFVIWDGGWVLGWCELVTLSG

SEQ ID NO: 85558 - protein, 481 aa, Dechloromonas aromatica RCB
MRHLIIASLLAALPWAASAAPTWQTISSEPGKRIEIDRTSLKREGSTVQAQGRIVLEKELTDAKSGAGYRVIEAITRYDCNTRNANTIKRIFKKNENEVIREEEIKGSDLPVRTGTLDDKVLREVCRPPKESPAELAKKANEAAGELKAANDALLKKEMAKAEKPATIKASDVPDKEAEHGAIPSIRPNLKAATESAKETAPAPTPAAAPAKAVAPAKAATVVVHTTPAPAPKARKPARSEGYMLELTHSEPAAQHAQIHWAYDGAGAPENWPNLDPKNKVCAIGERQSPIDIKDGIKVDLEPIKFKYQPSTFRIVDNGHTVQVEVGDGSISLTGKTYELVQFHFHRPSEEKVNGQRFDMVVHLVHKSDDGQLAVVAVLLERGTENPFIQTLWNNMPLEKNMAVAPPTTTIDLNTLLPATRNYYTYMGSLTTPPCSEGVLWLVMKQPVQVSQDQINIFSRLYKNNARPIQPSGGRLIKEGR

SEQ ID NO: 85559 - protein, 409 aa, Coxiella burnetii RSA 493
MALIVQKFGGSSVANLEGIQNVARLISEARQEGHSVVAVVSAMYGETDRLIKLAQSISGSNWREYDALISTGEQVSAALLSMALEARNCPAHSYTAAQIRLRTTNEHKKARIVDIDPEILHSDLKEGRVPVVAGFQGVSDAGDITTLGRGGSDLTAVALAAALEADECQIFTDVDGVYTSDPKIVPQARRIPKITFDEMMEMSSLGAKVLQNRCLEFAGKFKVPVRVLSSLRKGPGTLITFEWDSAEQPLVSGIAFDRRQAKLTIQGIPERPGLASYILGPISKANIEVDMIVQNVPTIDANIDFSFTLPRDDYKDAFSIMKQVANELAAGAVLGSDQVAKISLVGVGMRSHAGIASQMFSALGQEGIHIHLITATEVKISAVIDEKYLELGARTLHSAFKLNQEIKFT

SEQ ID NO: 85560 - protein, 305 aa, Miscanthus transmorrisonensis
IESVGEGVTDVAPGDHVLPVFTGECKECPHCKSAESNMCDLLRINTDRGVMIGDGKSRFSINGKPIYHFVGTSTFSEYTVMHVGCVAKINPQAPLDKVCVLSCGISTGLGASINVAKPPKGSTAAIFGLGAVGLAAAEGARIAGASRIIGADLNPSRFEEARKFGCTEFVNPKDHKKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHSVPFAEINKAFDLMAKGEGIRCIIRMEN

SEQ ID NO: 85561 - protein, 464 aa, Oryza sativa Indica Group
MASSGAAAAAMAVFLAMALVLSGTEARHEPRKSFFVCVYQQSNYPICIWHKEQEFFLQGRFIFGPDVRSLFLTIFLILAPVLVFCIFVARHLINDFPDHWGVSVMVVVVVFTIYDLTLLLLTSGRDPGIVPRNTHPPEPESIDGGSDMGNGQTPQQLRLPRTKDVFVNGVIVKVKYCDTCMLYRPPRCSHCSICNNCVERFDHHCPWVGQCIGRRNYRFFYMFVFSTTLLCLYVFGFCWVYIVKIRDAENSTIWKAMLKTPASIVLIIYCFICVWFVGGLSVFHFYLMSTNQTTYENFRYRYDRRANPYNRGMVNNFLEIFCTAIPPSKNNFRARVPVDQGLQQTRTPARGFMSPNMGKPVGDLELGRKPVSWDEPRSAADIRDLEVGLGGLLDEKEGRIAHASPDLSLPGELVEGRAGMHSRRSSWGHRSGTSESMDSIAVQMGTEANWGSISSGHGTTSSTH

SEQ ID NO: 85562 - protein, 305 aa, Miscanthus transmorrisonensis
IESVGEGVTDVAPGDHVLPVFTGECKECPHCKSAESNMCDLLRINTDRGVMIGDGKSRFSINGKPIYHFVGTSTFSEYTVMHVGCVAKINPQAPLDKVCVLSCGISTGLGASINVAKPPKGSTVAIFGLGAVGLAAAEGARIAGASRIIGVDLNPSRFEEARKFGCTEFVNPKDHKKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHSVPFAEINKAFDLMAKGEGIRCIIRMEN

SEQ ID NO: 85563 - protein, 305 aa, Miscanthus transmorrisonensis
IESVGEGVTDVAPGDHVLPVFTGECKECPHCKSAESNMCDLLRINTDRGVMIGDGKSRFSINGKPIYHFVGTSTFSEYTVMHVGCVAKINPQAPLDKVCVLSRGISTGLGASINVAKPPKGSTVAIFGLGAVGLAAAEGARIAGASRIIGVDLNPSRFEEARKFGCTGFVNPKDHKKPVQEVLAEMTNGGVDRSVECTGNINAMIQAFECVHDGWGVAVLVGVPHKDAEFKTHPMNFLNERTLKGTFFGNFKPRADLPNVVELYMKKELEVEKFITHSVPFAEINKAFDLMARGEGIRCIIRMEN

SEQ ID NO: 85564 - protein, 305 aa, Miscanthus transmorrisonensis
IESVGEGVTDVAPGDHVLPVFTGECKECPHCKSAESNMCDLLRINTDRGVMIGDGKSRFSINGKPIYHFVGTSTFSEYTVMHVGCVARINPQAPLDKVCVLSCGISTGLGASINVAKPPKGSTVAIFGLGAVGLAAAEGARIAGASRIIGVDLNPSRFEEARKFGCTEFVNPKDHKKPVQEVLAEMTNGGVDRSVECTGNINAMIQAFECVHDGWGVAVLVGAPHKDAEFKTHPMNFLNERTLKGTFFGNFKPRTDLPNVVELYMKKELEVEKFITHSVPFAEINKAFDLMAKGEGIRCIIRMEN

SEQ ID NO: 85565 - protein, 131 aa, Brassica napus
MAPKALAVTALLLTLNLLFFSFVTSTKCPPTTPKTPKSPKKDPPVKPTCPTDTLKLGVCADLLGLVNVLVGSPPKTPCCALLNGLANVEAAVCLCTALKANVLGINLNVPVDLSLLLNYCGKKLPYGFQCA

SEQ ID NO: 85566 - protein, 148 aa, Geobacillus kaustophilus HTA426
MTNNSGNKVQDIMTKNVATISPNQTVQEAAQIMSQKNIGALPVVENGQVKGMITDRDITLRVSSQGKDPSTVKVAEVMTNQVVTGTPNMSVQEAANVMAQHQVRRLPIVENNQLQGIVALGDIATNSASNEAAEQALTNISEPSQPQG

SEQ ID NO: 85567 - protein, 305 aa, Miscanthus transmorrisonensis
IESVGEGVTDVAPGDHVLPVFTGECKECPHCKSAESNMCDLLRINTDRGVMIGDGKSRFSINGKPIYHFVGTSTFSEYTVMHVGCVAKINPQAPLDKVCVLSCGISTGLGASINVAKPPKGSTGAIFGLGAVGLAAAEGARIAGASRIIGVDLNPSRFEEARKFGRTEFVNQKDHKKPVQEVLAEMTNRGVDRNVECTGNINAMIQAFECVHDGWGVAVLVGVPHKDAKFKTHPMNFLNERTLKGTFFGNFKPRTDLPNVVELYMKKELEVEKFITHSVPFAEINKAFDLMAKGEGIRCIIRMEN

SEQ ID NO: 85568 - protein, 622 aa, Saccharomyces cerevisiae
MLFYSFVWSVLAASVALAKTHKLNYTASWVTANPDGLHEKRMIGFNGEWPLPDIHVEKGDRVELYLTNGFQDNTATSLHFHGLFQNTSLGNQLQMDGPSMVTQCPIVPGQTYLYNFTVPEQVGTFWYHAHMGAQYGDGMRGAFIIHDPEEPFEYDHERVITLSDHYHENYKTVTKEFLSRYNPTGAEPIPQNILFNNTMNVTLDFTPGETYLFRFLNVGLFVSQYIILEDHEMSIVEVDGVYVKPNFTDSIYLSAGQRMSVLIKAKDKMPTRNYAMMQIMDETMLDVVPPELQLNQTIQMRYGHSLPEARALNIEDCDLDRATNDFYLEPLIERDLLAHYDHQIVMDVRMVNLGDGVKYAFFNNITYVTPKVPTLTTLLTSGKLASDPRIYGDNINAQLLKHNDIIEVVLNNYDSGRHPFHLHGHNFQIVQKSPGFHVDEAYDESEQDEMTVPYNESAPLQPFPERPMVRDTVVLEPSGHVVLRFRADNPGVWYFHCHVDWHLQQGLASVFIEAPVLLQEREKLNENYLDICKAADIPVVGNAAGHSNDWFDLKGLPRQPEPLPKGFTTEGYLALIISTIIGVWGLYSIAQYGIGEVIPNDEKVYHTLREILAENEIEVSRG

SEQ ID NO: 85569 - protein, 531 aa, Aspergillus oryzae
MSRVLAEFSVEYSGPAFICSILIMLCSYAYPCVSKDDQPFDPLGQILEIRRLLAGCAFFFHQLGKMEHPGELAGWLRYKDAEDLEEELPKDGVPGEVRGLEYLHKKYGSLPWSTIMQPAIQTARQGFPVGRDLVRYMNSAVGDGEDFLSKDPTWAIDFAPNGTRLGLGDTITRKRYADTLETIANNGPDAFYTGPIAETMIQALQAANGTMTLEDLRNYTIAIRDTSQIDYRGYRVIGTSAPSSGTVALNILKVLDTYDSFMVPDNVNLSTHRLDEAIRFGYGLRTELGDPYFLEGLDEYQKDMLEQSTIDEIRGKISDLHTQNVSAYDPKGLESLDTPGTSHIAAVDHTGLTISTITTINLLFGSKVMVPETGIIMNNEMDDFSTPGSSNAFGYVPSEANFIRPGKRPLSSITPTIVTHQNGSVFFVAGSAGGSRIITATVQNIIHAVDEGLSAAEALARPRLHDQLIPNQVRFEYTYNNETVAFMKSLGHNVTWVAPGDSTAQAIRVLPNGTFDAAGEPRQLDSGGFAV

SEQ ID NO: 85570 - protein, 316 aa, Clostridium difficile 630
MNTSGSEIKIIAGNSSKELAQKIADYIGVSVLDCEVGTFSDGEICVNMNETVRGCDVFVVQSTNSPVNDNLMELLILIDALKRASAGRITAVIPYYGYARQDRKAKARDPITAKLVANLITAAGADRVLTMDLHAAQIQGYFDIPLDHLLGGTILANYFNEKKIEDLVVVSPDLGSVTRSRKFANTLNGEVPIAIIDKRRPKANVCEVMNLIGDVKGKNVILLDDMIDTAGTIVNAANALKEFGAKDVYACCTHGVLSGPAIERIANSEISELIVLDTIQLPEEKRIDKIKIKTVAPLFGDAIRMIFSNESVSKLF

SEQ ID NO: 85571 - protein, 333 aa, Burkholderia xenovorans LB400
MSSPRIPSPRRVSVAPMMDWTDRHCRSLHRVISRHTWLYTEMVTTGALLHGDVPRHLAFTPVEAPVALQLGGSEPDDLARSAKLGEQWGYDEINLNCGCPSERVQRGAFGACLMNEPQLVADCVKAMRDAVSVPVTVKHRIGVDAVEEYGFVRDFVGTIADAGCNVFIVHARNAILKGLSPKENREIPPLKYDYAYQLKRDFPHLEIIINGGIKTLDEVETHLQHVDGVMLGREAYHNPYLLAGVDARFYGSADTPLTREQVEAKLIDYCAAEMARGTYLGAITRHALGLYRGEAGARGWRRVLSDSKRLAARDLSIFDEARQHLREPVEIFE

SEQ ID NO: 85572 - protein, 377 aa, Yarrowia lipolytica CLIB122
MSRIGSVTRVARAARAATTGVARNLSSTSYQAGFKPLVASNGFNGAIGNTPLIRINHLSDETGCEVYGKAEFMNPGGSVKDRAALYVVEDAERKGLIKPGGTVVEGTAGNTGIGLAHVCRAKGYKCVIYMPNTQSQGKIDLLRLLGAEVYPVPAVAFDNPQNYNHLAKAHAEKLGAGNAVWTNQFDNVANRQAHIETTGPEIWAQTDGKIDAFTCSTGTGGSFAGTMRYLKDVSHGRVQCILADPPGSVLHSYVQSGGKLTERAGSSITEGIGQGRVTENLAPEIAEVDGSVQIPDQATIEMVYNLLDKEGLYLGASSCLNVVAAYEVAKQIGPGHVVVTLLCDGAHRYADRLFSKKWLESKGLTIPENLQKYVVLD

SEQ ID NO: 85573 - protein, 388 aa, Sinorhizobium meliloti 1021
MTIMTSLSPRATAAPESGIVEVVNYARGREGLIPLWVGEGDLPTPDFVSRAAADALMAGETFYTWQRGIPPLREALVRYYQRRFQKALSPENFYVTGSGMQAIKLAIEAVGSPGDEVVLLTPAWPNFAAAADLSGVRPVAVPLQFEGGKWRLDPERLQAAIGERTRALFINTPSNPTGWTATHDDLKAILALAREHGLWIIADEIYALYYYPDGRAPSFLDVMEEDDRILFVNSFSKNWSMTGWRVGWIVAPPAMGQVLENLIQYSTSGVAQFMQRGAVAALDEGDGFVEENIAKAKRNRDTLCDALIATNRVETLKPDGALYAFLKIDGVTDSRAAALDIVDRTGVGLAPGTAFGEGGALFMRACFLRDPLQIAEAADRLQRYILSR

SEQ ID NO: 85574 - protein, 342 aa, Sinorhizobium meliloti 1021
MAVLVTGGAGYIGSHMVWSLLDGGEAVVVLDCLSTGFRWAVAPEARFYFGDVGDRALLQRVFAENEIDSVVHFAGSAVVPESVANPLAYYENNTANTRTLIAATVEAGIRHFVFSSTAAVYGTQDTPDPVSETAALRPQSPYGRSKLMSEMMLQDAAAAHDFRFVALRYFNVAGADPLGRAGQSTLGATHLIKVACEAALGRRRKIDVLGTDYPTADGTGVRDYIHVSDLVAAHRSALAYLRAGGEPLVANCGYGHGFSVLQVLDTVRQVSGRDFMVDYAPRRPGDPAQIVADPSVARLKLDWVPTHASLEHIVRSAFDWESHLSRKNSFDEEQDERLIANG

SEQ ID NO: 85575 - protein, 326 aa, unidentified eubacterium SCB49
MFTHTYHTKELSDYNFLITGGAGFIGSNIVGYLLKNNAKKVRVLDNLATGSMDNLAEHMEHPSFEFMKGDIRNIEDCKRAMQDIDYVSHQAALGSVPRSINDPATSNDVNVGGFLNMLIAQNESKTVKKMVYAASSSTYGDSPSLPKVEDVIGKPLSPYAVTKLVNELYADVFYKTYGTKTLGMRYFNVFGPKQSPTGAYAAVIPLFMQALVDEKSPTMNGDGEQTRDFTYVENAVQANVRGMLSGDEANNEVINIAYGNRISLNTLWSDLKDVSGKELAAVYGPPRKGDVRDSLANIDKAKKLIGYDPKFSVAEGLKVTWEYFTK

SEQ ID NO: 85576 - protein, 642 aa, Candida glabrata CBS 138
MVVRTGSKHMYEKERSSSNHESSSSLVTSLMKSWKISSSPSSSKRTSSLPSSPSTPVLSSSPTTNTAASAKAYGSRTSSDSLSNMGFYKVADGNIEAYSKKQISSRRTSSSYSPLRYVNPLSMSSSSVLESPRANSGLGLHKYNSHGNGGSTSRRASGHDVKKPAKYFRDLDEDWSAVIDDYNSPIPTMVNGGYGAKISRKASESNTLSRVSTSSSVATNTTTKVGSNSLSYPQLPQLKRSETDHLRTQKELEDTKEVQHLNAIIKRIAKFDSILKDKSIINLQELRQVSWNGIPKCHRPVVWKLLIGYLPANIKRQENLLNNKRKEYKDSLAHTFSDKHARDEPTWHQIEIDIPRTNPHIPLYQFKTVQQSLQRILYLWAIRHPASGYVQGINDLATPFYQTFLTEYLSPSKIEDVESTDPLDYMTPEQIEDVEADTFWCLTKLLEQITDNYIQGQPGILNQVKNLSQLVKRIDGDLYSHFQDEHVEFIQFSFRWMNCLLMREFQMSAVIRMWDTYLAETSSESSATYSHKAEYGPPRTPTEPRVSTFTTPVKEFNSPSASMKSAESTKLSQSSLNEFHVFVCAAFLVKWSDQLLAMDFQEIITFLQNPPTKDWDENEIEMLLSEAYIWQSLYKDATSHWL

SEQ ID NO: 85577 - protein, 198 aa, Shigella boydii
LKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIV

SEQ ID NO: 85578 - protein, 622 aa, unidentified eubacterium SCB49
MNFLSVENIAKSYGERILFNGISFGINEGQKIGFVAKNGTGKTSLLNILSGLDTPDEGNVVYRKNLKVAFLSQEPNLNPELTIEQTILDADNPILGVIARYEKAILNPDDTDAYQAAFDAMDVNNAWDFETKYKQILSKLKLDDLSQKVKNLSGGQKKRIALANALLTKPDLLVMDEPTNHLDLEMIEWLEALFAKENFTLFMVTHDRYFLERVCNEIVELDEGQLYSYKGNYSYYLEKRESRIESEKTETGKAKQLYKKELEWMRRQPKARTTKSKSRIDDFSDIKARAHKRRNENTIELELNMERLGTKIVELHKISKSFGDKELFQKFEYNFIKGERVGIIGKNGTGKSTFLNIMTGKLQADAGKVVIGDTVKFGYYTQKGIDIKPGQKVIDVVREFGDFIPLKKGRMISASQLLERFMFEGKKQYDFVEKLSGGERKRLYLCTVLIQNPNFLILDEPTNDLDIVTLNVLESFLIDFPGCLIVVSHDRYFMDKIVDHLFVFKGKGEIQDFPGNYSDYRIYEDSQPSEKAIETTPSENKKNWKDKGEKTKLSYNDQKEFNRLEKDIPKLERERQALQAKFATENWDADEINKQSIKLQEIIDKIEEKEMRWFELSEIIEG

SEQ ID NO: 85579 - protein, 656 aa, Triticum aestivum
  misc_feature (453)..(453): Xaa can be any naturally occurring amino acid
  misc_feature (624)..(624): Xaa can be any naturally occurring amino acid
GILFLASEMGLELSLSRLKALAKFAFGIGLPQVLLSTLAFAAFELPPNGAIGTRILQFLFNSRPDLVNIRSVDEAIVIGAALSLSSSAFVLQLLAEKGELATRFGSATLGILLLQDIAVVPLLVILPVLESQNVVEQSVWPMLLAESLKALGGLGILSLGGKYLIRRIFEFVAESRSSEAFVALCLLTVSGTSLLTQWLGFSDTLGAFLAGALLAETNFRTQIEADIRPFRGLLLGLFFVTTGTSIDMQLLIREWPNVLSLLAGLIAIKTLITTALATRVGLTFQESVRIGLLLSQGGEFGFVVFSLANRLGVLPLELNKLLIIVVVLSMALTPLLNDLGRKAAGIIDERSETKEVKPAEEANYGATEPIVILGFGEMGQVLAKFLAAPLSFGLERDTEGWPYVAFDLNPAVVKSARKSGFPVLYGDGSRPAVMQSAGISSPKAVMIMYTGKXEETVESVDRLRQAFPAVPVYVRAQDMSHLLDLRKAGATDVVLENAETSLQLGSMLMKGLGVMSDDVSFLSKLVRDSMELQAQEALNNVESRETTTMESLQVRVSDLVESNGNGSGMIPREQSLGLSSRPEVRVMKTTPDNPMPNLNNKNESEDGVKYCLLETADGEETVEXSSGSKEMTDQTSFCKTKAQSEAKALNLWFPHR

SEQ ID NO: 85580 - protein, 1029 aa, Oryza sativa
MPRFVGARCCEEGGARRGLDAAWGSRGRNYGLFGFTMNDYLSVGTVISFTTIINFGRVMMALAVDVSRFEGVPMAPPDPILGVSEAFKADQNDLKLNLGVGAYRTEELQPYVLNVVKKAETLMLEKGENKEYLPIEGLAAFNKATAELLFGADNPVLKQGRVATLQSLSGTGSLRLAAAFIQRYFPEAKVLISSPTWGNHKNIFNDAKVPWSEYRYYDPKTVGLDFEGMIADIQAAPDGSFVLLHGCAHNPTGIDPTPEQWEKIADVIQEKKHMPFFDVAYQGFASGSLDEDASSVRLFVQRGLEVFVAQSYSKNLGLYAERIGAINVVCSTPEVANRVKSQLKRLARPMYSNPPIHGARIVANVVGDPTMFGEWKQEMEEMAGRIKNVRQKLYDSLSAKDDSGKDWSFILRQIGMFSYTGLNKTQSDNMTDKWHIYMTKDGRISLAGLSLAKCEYLADAIIDSFHNGPSSHVYVNKDSNTEKVKLPEKIGCQKTSWYQSRPAGGRRRLNPSWPEAWRLEQGRECASAAARKSGASAARRGGRSRAAAGAELLLLLGAELAGRSGSCSVVAGSQHSEDFASLVENQGIEQVMGKLVDMLAKKFSEASTTSNAIIPHTESILKIELMQNEIKLEGVKNYLSWSRRALLILKTKGLEGYVTGEVKEPENTSSVEWKTWSTTNSLVVAWLLTSLIPAIATTVETISSAREMWKTLTKLYSGEGNVMLMVEAQEKISALRQGERSVAEYVVELKSLWSDLDHYDPLGLEHSDCIAKMKKWVERRRVIEFLKGLNPEFEGRRDAMFHQTTLPTLDEAIAAMAQEELKKKVLPSAAPCSPSPTYAIVQGKETRECFNCGEMGHLMRDCHAPRKPTYGRGRGVDRGGTRGGRGYAGRSNRGRGYGYRGDYKANAVTLEEGSSGTTPDNVANFAHSTSGSFNQAFMSMNTSHSSWILDSGASRHVTGMSGEFTSYKPYSFAHKETIQTADGTSCQERRTGKKLGISIRRDGLWYLDRRGTNEDVCALMASTSKEVTE

SEQ ID NO: 85581 - protein, 337 aa, Shewanella sp. MR-7
MAIKIGINGFGRMGRLALRAAWEWDDVEFVQINDPAGDAATLAHLLEFDSVHGRWRYPVTANVDAILIQDKAIRTTRNKAIANTDWSGCDVVIEASGVMKTKALLQAYLDQGVKRVVVTAPVKEEGVLNVVMGVNHQLYDPTIHPIVTAASCTTNCLAPVVKVIHEQIGIRHGSMTTIHDITNTQTILDAPHKDLRRARACGLSLIPTTTGSATAITHIFPELKGKLNGHAVRVPLANASLADCVFELERRVTEAEVNALLQSAAEGELKGILGYEERPLVSVDYKTDSRSSIVDALSTMVVNGTQLKLYVWYDNEWGYANRTAELARLVGQLDMPR

SEQ ID NO: 85582 - protein, 338 aa, Lactobacillus crispatus
MTVKIGINGFGRIGRLAFRRIMDLGEKSKDIEVVAINDLTTPAMLAYLLKYDTTHGTFNHEVSSTEDSIVVDGKSYHVYAEPQAQNIPWVKNDGVDFVLECTGFYTSKAKSQAHIDAGAKRVLISAPAGNDLKTIVYSVNEDTLTADDKIVSAASCTTNSLAPMANALDKEFGIEVATMTTIHAYTGTQMTLDGPSRSGKEQDARAAAENIIPHTTGSAKAIGLVLPNLNGKMNGHAQRVPVPDGSETELVSILSKKVTADEVNEAMKKYESPSFAYNGDHIVSSDVLNMTAGSIFDPTQTMVTTAGDKQLVKTVAWYDNEYSFTCQMVRTLLHFATL

SEQ ID NO: 85583 - protein, 436 aa, Magnetospirillum magneticum
MELHHPELTYAAIVALAAVLCGGLMTRLKQPAIVGYILAGVVLGPSGFGLVSNRDAVATLGEFGVLMLLFVIGMKLDIIRFLEVWKTAVFTTLLQIAGSVGTALLLRHGLGWSLGLAVVLGCAVAVSSTAVVIKVLESSGELETPVGRTTLGILIAQDMAVVPMMLVLESFETKALLPADMARVVLSVLFLVLLFWWLSKRRIDLPVTARLSRDSDLATLSTLAWCFGTAAISGVLDLSPAYGAFLGGVVLGNSAQRDMLLKRAQPIGSVLLMVFFLSIGLLLDFKFIWKNLGTVLTLLAMVTLFKTAFNVTALRLAGQDWPSAFLAGVALAQIGAFPFLLAKTGKAVGRITAQKTKLVVGVTVLSLVLPPFWLFTMRRIHRVAAVHVHSFRDLVTRLYGDEARALVRTARRARMLARRGSWRDDPNAGPGSGIST

SEQ ID NO: 85584 - protein, 308 aa, Geobacillus stearothermophilus [sequence omitted]

SEQ ID NO: 85585 - protein, 335 aa, Dechloromonas aromatica RCB
MKILVTGAAGFIGMTTSLRLLARGDEVVGLDNMNDYYEVSLKENRLKRLTALPGFRFVKLDVGDRAGMEKLFADEKFDKVIHLAAQAGVRYSIQNPHAYVDSNLVGFINILEGCRHHKVQHLVYASSSSVYGGNTKMPFSEHDSVDHPVSLYAATKKANELMAHTYSHLYGLPTTGLRFFTVYGPWGRPDMALFLFTKAILEGRPIDVFNHGNMKRDFTYVDDIVEGVIRVMDRNAAANAEYDSLSADPATSNAPYRVFNIGNNNPVQLLDFIGAIETALGQKAEKRLLPLQDGDVPATYANTDLLNDWVGFVPGTSVQEGVSKFIAWYRDYYKV

SEQ ID NO: 85586 - protein, 428 aa, Lactobacillus crispatus
MLKSVIENVHALEIFDSRGNPTVEVHVTLSNGVVGKAEVPSGASTGENEAVELRDGGSRLGGKGVSKAVNNVNTEINDALKGMDPYNQPKIDKTMIDLDGTPNKGRLGANAILGVSMAVAVAAANDARLPLYRYLGGTDLEMPQTFHNVINGGEHADNGIDIQEFMITPVAKTSFRDGFEKIVNVYHTLKKVLEDMGYETGLGDEGGFAPNMKNSEEALKALHESIIKAGYKPGEDIAIACDCAASYFYNKDDHKYHLEGKVLTDEELADYYDKLLDEFPELISMEDPYDENDVDGMVKFTKSHKDRIQIVLDDFICTNPALLTKAIKEGAGNASLIKLNQIGTVTETLETIRLSRKNGYNTMISHRSGETGDTFIADLAVAVNGGQLKTGAPARSERVEKYNRLLEIEEELGDGERLAFFPDDVDHD

SEQ ID NO: 85587 - protein, 432 aa, Magnetospirillum magnetotacticum
MELHHPELTYAAIVALAAVLCGGLMTRLKQPAIVGYILAGVVLGPSGFGLVSNRDAVATLGEFGVLMLLFVIGMKLDIIRFLEVWKTAVFTTVLQIAGSIGTALLLRHGLGWSLGLAVVLGCAVAVSSTAVVIKVLESSGELETPVGRTTLGILIAQDMAVVPMMLVLESFETKVLLPADLARVILSVLFLVLLFWWLSKRRIDLPLTSRLSRDSDLATLSSLAWCFGTAAISGVLDLSAAYGAFLGGVVLGNSAQRDMLLKRAQPIGSVLLMVFFLSIGLLLDFKFIWKNLGTVLTLLAMVTVFKTALNVAALRLARQDLASAFLAGVALAQIGEFSFLLAETGKAVKLINAKETNLVVAVTVLSLVLSPFWLFTMRRMHRVAAVHVHSFRELVSRLYGDEARNARRARTLVRRGSWRDDHNAGPGSGIST

SEQ ID NO: 85588 - protein, 305 aa, Miscanthus transmorrisonensis
IESVGEGVTDVAPGDHVLPVFTGECKECPHCKSAESNMCDLRRINTDRGVMIGDDKSRFSINGKPIYHFVGTSTFSEYTVMHVGCVAKINPQAPLDKVCVLSCGISTGLGASINVAKPPKGSTVAIFGLGAVGLAAAEGARIAGASRIIGVDLNPSRFEEARKFGCTEFVNPKDHKKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHSVPFAEINKAFDLMAKGEGIRCIIRMEN

SEQ ID NO: 85589 - protein, 472 aa, Shigella flexneri 2a str. 301
MSQNVYQFIDLQRVDPPKKPLKIRKIEFVEIYEPFSEGQAKAQADRCLSCGNPYCEWKCPVHNYIPNWLKLANEGRIFEAAELSHQTNTLPEVCGRVCPQDRLCEGSCTLNDEFGAVTIGNIERYINDKAFEMGWRPDMSGVKQTGKKVAIIGAGPAGLACADVLTRNGVKAVVFDRHPEIGGLLTFGIPAFKLEKEVMTRRREIFTGMGIEFKLNTEVGRDVQLDDLLSDYDAVFLGVGTYQSMRGGLENEDADGVYAALPFLIANTKQLMGFGETRDEPFVSMEGKRVVVLGGGDTAMDCVRTSVRQGAKHVTCAYRRDEENMPGSRREVKNAREEGVEFKFNVQPLGIEVNGNGKVSGVKMVRTEMGEPDAKGRRRAEIVAGSEHIVPADAVIMAFGFRPHNMEWLAKHSVELDSQGRIIAPEGNDNAFQTSNPKIFAGGDIVRGSDLVVTAIAEGRKAADGIMNWLEV

SEQ ID NO: 85590 - protein, 305 aa, Miscanthus transmorrisonensis
IESVGEGVTDVTPGDHVLPVFTGECKECPHCKSAESNMCDLLRVNTDRGVIIGDGKSRFSINGKPIYHFVGTSTFSEYTVMHVGCVAKINPQAPLDKVCVLSCGISTGLGASINVAKPPKGSTVAIFGLGAVGLAAAEGARIAGASRIIGVDLNPSRFEEARKFGCTEFLNPKDHKKPVQEVLAEMTNGGVDRSVECTGNINAMVQAFECVHDGWGVAVLVGVPHKDAEFKTHPMNFLNERTLKGTFFGNFKPRTDLPNVVELYMKKELEVEKFITHSIPFAEINKAFDLMAKGEGIRCIIRMEN

SEQ ID NO: 85591 - protein, 184 aa, Candidatus Phytoplasma solani
EKYPHVTFFFDGGKELKLLNANRILISSPRVKTYDLKPEMSAFEITDVAKKAVLSNKYQTMILNFANPDMVGHTGSLEATIKAVETIDTCLQDLIETILSVGGKACILADHGNAEQMTDEAGNPHTAHTTNLVPLIVTDQNITLKKGALCDVAPTLLDLLGIAQPKEMTGKSLLHKKLNSKNFK

SEQ ID NO: 85592 - protein, 870 aa, Burkholderia vietnamiensis G4
MRRAEESQLKSSAPDQIVLLAPLSGPIVALADVPDPVFAGGMFGDGIGIDPLAGRLVAPCAGVVSHLARTGHAVTITSPQGAQVLLHIGIDTVELNGQGFTARVEDGAHVAPGDLLIEFDQDVVARSAHSLVSVIAIANSDAFDVVERASGFATAGETPLLTLRANGAAAGQATQAAHATATATSAHEVRRQIVLTQPGGLHARPAARARESVRGFDATVDVQFDGRHASIASVVGLLGLGAGEGATVELIGRGAHAQQAVDAVARELLREAHGEVEETPARLRSPAPPTLRHDDGAARAGAPLDPNTLAGVCAAPGIAVGTLVRLDDADIVPPEPASGTPASESRRLDQALKAVDAELGETVRNASARGAVGEAGIFAVHRVLLEDPTLVDAARDQISLGKSAGFAWRATIRAQIDTLSRLDDALLAERAADLRDIEKRVLRALGHTSGATRALPDEAVLAAEEFTPSDLSSLDRERVTALVMARGGATSHAAIIARQLGIPALVAVGDALYAIPDGTQVVVDASAGRLEHAPSAVDVERARHERERLEGVREANRQHAREAAATADGRAIEVAANIATLDDANTALDNGADSIGLLRTELMFIHRQTAPSVVEHRQSYQSIVDALQGRTAIIRTLDVGADKEVDYLTLPPEPNPALGLRGIRLAQVRPDLLDDQLQGLLAVKPFGAVRILLPMVTDAGELVRLRARIDEFARAQGRTEPIEVGVMIEVPSAALLADQLARHADFLSIGTNDLTQYTLAMDRCQADLAAQSDGLHPAVLRLIDIAVRGAAKHGKWVGVCGALGGDPLAVPILVGLGVTELSVDPVAVPGIKARVRRLDYQLCRQRAQDLLALDSAQAVRAASREVWPLD

SEQ ID NO: 85593 - protein, 448 aa, Candidatus Phytoplasma solani
MNKTKIVCTLGPACQGKEALKQLIKNGLNVARFNFSHATYENSEKILREIKEINQELNTYVATMLDTKGPEIRTHNFVKPVQIEKNSEVRIAFTEVLGTEKKFSISYKELYNDIKVNDLIFIDDGYLTLEVIQKDEQNRELITKAHNTHIVKSRRGVNVPNIKLKIPYISPKDASDIVFACQKGYNFLALSFVRNASDVLEVRKILKEQQNEKIKIISKIENQEGIDNLEEIIKVSDGIMIARGDLGIEVAGELVPLYQTQMIQDCLYAGKPVIVATQMLESMQRNPRPTKAEISDVWNAVLEGATSTMLSGESASGLYPAQAVAFMAKINHQSEQYLDYEMIASFYNPKTRSEFLAFSVIQLALKEQIHAVVVDDVSYAFAFAKMHSKVPVFVQVKDISQATSLALNFANFPFLTQEELTIKLALLKEDIQKDLVIASIQKNTLFFI

SEQ ID NO: 85594 - protein, 305 aa, Miscanthus transmorrisonensis
IESVGEGVTDVAPGDHVLPVFTGECKECPHCKSAESNMCDLLRFNTDRGVMIGDGKSRFSINGKPIYHFVGTSTFSEYTVMHVGCVAKINPQAPLDKVCVLSCGISTGLGASINVAKPPKGSTVAIFDLGAVGLAAAEGARIAGASRIIGVDLNPSRFEEARKFGRTEFVNQKDHKKPVQEVLAEMTNRGVDRNVECTGNINAMIQAFECVHDGWGVAVLVGVPHKDAEFKTHPMNFLNERTLKGTFFGNFKPRTDLPNVVELYMKKELEVEKFITHSIPFAEINKAFDLMAKGEGIRCIIRMEN

SEQ ID NO: 85595 - protein, 398 aa, Zea mays
MGMAAVKAVAAITAIIAGGRLAGLSMALGAFLAGLLLAETEFSLQVESDIAPYRGLLLGLFFMTVGMSIDPKLLLSNFPAISVILSLLIIGKTLLVTFVGRVFGVSAIAAIRVGLLLAPGGEFAFVAFGEAVNQVSSTLDLLLMYTIVDHRNIYNCFVGISMALTPWLAAGGQFLASKFEQHDVRSLLPVESETDDLQDHIIILGFGRVGQIIAQLLSERLIPFVALDAGSDRVAAGRALDLPVYFGDSGSREVLHKIGAERACAAAITLDTPGANYRAVWALNKYFPNVKTFVRAHDVDHGVNLEKAGATAVVPETLEPSLQLAAAVLAQASFQAKLPMSEIQESINEFRNRHLSELTELCATSGNSLGYGFSRVMSKSKSISSDDESETVDSALAI

SEQ ID NO: 85596 - protein, 305 aa, Miscanthus transmorrisonensis
IESVGEGVTDVAPGDHVLPVFTGECKECPHCKSAESNMCDLLRINTDRGVMIGDGKSRFSINGRPIYHFVGTSTFSEYTVMQVGCVAKINPQAPLDKVCVLSCGISTGLGASINVAKPPKGSTVAIFGLGAVGLAAAEGARIAGASRIIGVDLNPSRFEEARKFGCTEFVNPKDHKKPVQEVLAEMTNGGVDRSVECTGNINAMIQAFECVHDGWGVAVLVGVPHKDAESKTHPMNFLNERTLKGTFFGNFKPRTGLPNVVELYMKKELEVEKFVTHSVPFAEINKAFDLMAEGEGIRCIIRMEN

SEQ ID NO: 85597 - protein, 273 aa, Triticum aestivum
  misc_feature (186)..(186): Xaa can be any naturally occurring amino acid
  misc_feature (221)..(221): Xaa can be any naturally occurring amino acid
  misc_feature (231)..(231): Xaa can be any naturally occurring amino acid
MAATSSPSTAAAAMWAFAAATCVKLLLVPTYRSTDFDVHRYWLALTHALPARQWYTDASSQWTLDYPPFFAYFSRLLSLPAPFVDASLVAIPVPAAPSSSVYILYLRLTVAFSDLLLLASVLLLARDARRRQRPFLALLLVLWSPALLIVDHIHFQYNGFLMGLLLLSLHFLEQGKDLAGGSCVWXALLCSKHLFLVAAPVYFVYLFRHYCCGRGLARGLXGRLVLMGAGXVVAVFAMAFAPFVYYGQMQQLLSRLFPFGRGLFHAYWAPNFW

SEQ ID NO: 85598 - protein, 160 aa, Helicobacter hepaticus ATCC 51449
MEAKNTELKKSICINVINEHSVLARISGLFSARGYNIESLTTAPIPNSNLSRITIVTQGSEVVIEQIIKQLHKLIPVVSVISSDDLLEKEAVLVKIPLNESLADIEALCKAYNGKIANANEKYIIVIATDKPSAINQFIAAVRIFNPKEIIRSGVIAMER

SEQ ID NO: 85599 - protein, 570 aa, Helicobacter hepaticus ATCC 51449
MKVMKGAQMLIQALHLEGVKVVFGYPGGAVLHIYDEIYKQNYFSHILARHEQGAVCAADGYARSSGEVGVAIITSGPGFTNAITGIATAYTDSIPLVVISGQVPITQIGTDAFQEIDAVGISRPCTKHNFLVRNISELPRILKEAFYIARSGRQGPVLVDIPKDITGTLGEFAYPESISLQSYKPTIKGNSRQIKKLCEAIMSAQKPLFYIGGGAILSNASEIIREIVHCTGIPCAETLLARGVLRYDDENLLGMLGMHGSYAANMAVSECDLLVCLGARFDDRVTGKLSEFAKNAKIAHIDIDPSSIGKIIAVDYPIVGDLKHIVSDMMIELSGYDTQKIMRWREHLRSYALTHPMSFEDSVDSIKPQWVIQRLGEHLGDNAIITTDVGQHQMWAAQFYPFSFPRQFLSSGGLGTMGYGLPAALGAKLACPHKTIINITGDGSILMNIQELMTCVVYGIPFVNVILNNNYLGMVRQWQSFFYEHRFSHTDLSLQPDFIKLIESFGGVGFRVEKKCEFDEAFKKALDAKKVAFIEVMIDRYEDVLPMVPSGGAIYEMILSSGEKALREGK

SEQ ID NO: 85600 - protein, 445 aa, Candidatus Kuenenia stuttgartiensis
MPYRAWFQCIAGCDEKYKLNEIIYHCKKCGNLLEVVHDLDQLRKHDAKYWKDLLDARYLRTKWPYGSSVWGKKEFVCPQVKNENVVSLYEGGSNLFWAERLGKELGIENIWIKQCGNSHTGSFKDLGMTVLVSMVKQMISEGKKIPAVACASTGDTSAALAAYCAAAGIPSIVFLPKDKVSLAQLIQPIANGALTLSIDTDFDGCMKLVREVCLKNNIYLANSMNSLRIEGQKTISVEIVQQFDWEVPDVIVVPGGNLGNTSAIGKGFLIMEAMGITNKRPRIVCAQAAKANPLYLSYLTGFKEFKPIKAQKTLASAIQIGDPVSYQKAINILKKFDGIVEQATEDELANAAAQADKTGLFSCPHTGVALAVLKKLLEKKKIKAHEKVVVISTAHGLKFTEFKINYHENKLKEVTPRFANLPVSVPPSYEAVKTAILEKFEGFSL

SEQ ID NO: 85601 - protein, 201 aa, Shigella boydii
LKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGLAAMIGVAMIVGFS

SEQ ID NO: 85602 - protein, 118 aa, Geobacillus kaustophilus HTA426
MSENIKKLPLVVEEGWRKKRTQPTLPEVYRSLRIPKTGSWMKKFLAFAGPGYLVAVGYMDPGNWATDIAGGSQFGYTLLSVILLSNLMAILLQALAGKLGIVTGRDLAKLVATITASL

SEQ ID NO: 85603 - protein, 148 aa, Picea sitchensis
MEQTFIMIKPDGVQRGLVGEIISRFEKKGFILKGLRMVGVERSFAEKHYEDLSSKPFFTGLVEYIISGPVVAMVWEGKGVVATGRKIIGATNPAASEPGTIRGDFAVEIGRNVIHGSDAVESAKKEIALWFPDGVVDWQSSLHSWIYE

SEQ ID NO: 85604 - protein, 330 aa, Brassica napus
  misc_feature (205)..(205): Xaa can be any naturally occurring amino acid
MDMETKKPYMMVTMIQLIYAIMFLISKSVLDGGMNTFVFVFYRQAFATMFLAPLAFFFERKSAPPLSFVTFIKIFILSLFGMTLSLDLNGIALSYTSATLAAATTASLPAITFFFALFLGMESLTVKSIQGTAKLLGITVCMGGVITLALYKGPLLKLPLCLHLHHHQNIPGHVSGGSTSWLKGCVLMVTSNILWGLWLVLQGRXVLKVYPSKLYFTTLHCLLSSIQSFVIAIAVERDISAWKLGWNLRLVAVIYCGFIVTGVAYYLQSWVIEKRGPVFLSMFTPLSLFFTILSSAVLLCEIISLGSILGGLLLIIGLYCVLWGKSKEEK

SEQ ID NO: 85605 - protein, 396 aa, Sinorhizobium meliloti 1021
MRYASITSRLAELGSGKWTLHTRARQLKASGAELIELTIGEPDLPPDRALLEECQRAMNAGRYRYSNGRGEPAVVAALTEKYRRRRAAVTAENILCFPGTQTALFAVMFALAEAGDGVLVGDPLYATYEGVIRSTGAHPVFVPLNPENGFHMRAEDLEKAVTPECRVLLLNTPHNPTGAVLTAEEIAAIGEVARRHDLWIVCDEVYEELVFDALFASPFDNPDLAERTVVVSSISKSHAAPGFRSGWAVGPAEFTERLLPISETMLFGQQPFIADMTAYALTHDIDTARQMRESYSRRARRIIDGLAGASGVSVLPPEAGMFALIDVSGTGLSGEAFAWALLEEEGVAVMPGSSFGDKARNFLRVSLTVPDAAIEEACRRIAALAERCTIRKERRA

SEQ ID NO: 85606 - protein, 201 aa, Shigella boydii
LKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQLAGWSNWTIGEAPFAGGFAAMIGVAMIVGFS

SEQ ID NO: 85607 - protein, 190 aa, Shigella boydii
GGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFS

SEQ ID NO: 85608 - protein, 184 aa, Shigella boydii
IAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGLAAMI

SEQ ID NO: 85609 - protein, 295 aa, Triticum aestivum
MAMASSTTASVAAASLRALAGASPAPLPKPFLVLLSPAPPRRLGLGLRAARPRGPLAPLASSDSFFETSAAVDVAEPEDEALAVAEEEPAVAEEEEDVAAEEEVEEVGEYVEPPEEAKVYVGNLPYDVDSERLAQLFEQAGVVEVSEVIYNRETDQSRGFGFVTMSTIEEAEKAVEMFHRYDVNGRLLTVNKAAPRGARVERPPRDSGSSFRIYVGNLPWQVDDSRLVELFSEHGKVVDARVVYDRDTGRSRGFGFVTMASQPELDDAIAALDGQSLEGRALRVNVAEERPPRRF

SEQ ID NO: 85610 - protein, 507 aa, Mycobacterium avium 104
MTVFARPGSAGALMSYESRYDNFIGGQWVAPARGRYFENPTPVTGQTFCEVARSDEADVDKALDAAHAAAPAWGKTAPPERAAILNKIADRIEENLESLAVAEVWDNGKPIREALAADIPLAADHFRYFAGALRAQEGSLSQIDDDTVAYHFHEPLGVVGQIIPWNFPILMGAWKLAPALAAGNAVVLKPAEQTPVSVLYLMSLIGDLLPPGVVNVVNGFGAEAGKPLASSNRIAKIAFTGETTTGRLIMQYASQNLIPVTLELGGKSPNIFFSDVMAKADDYQDKALEGFTMFALNQGEVCTCPSRSLIQADIYDEFLELAAIRTKAVRQGDPLDSETMLGSQASNDQLEKVLSYIAIGKDEGATIITGGERAELGGDLSGGFYMQPTIFAGNNKMRIFQEEIFGPVVAVTSFTDYDDAISIANDTLYGLGAGVWSRDGNTAYRAGRDIQAGRVWVNCYHAYPAHAAFGGYKQSGIGRENHKMMLDHYQQTKNMLVSYSNKAQGFF

SEQ ID NO: 85611 - protein, 573 aa, Solanum lycopersicum
IRHESTVTGGVQDVYGEDSATEDQSITPWTLSVASGFSLLRNPHYNKGLAFSERERDTHYLRGLLPPVVISHDLQVKKMMNSIRKYDVPLQRYMAMMDLQEMNERLFYKLLIDNVEELLPIVYTPTVGEACQKYGWIFKRPQGLFFSLKEKGKIHEVLKNWPEKKIQVIVVTDGERILGLGDLGCQGMGIPVGKLSLYSALGGIRPSACLPVTIDVGQTMKFVDDEFYIGLRQRRATGQEYSELLDEFMYAVKQNYGEKVLIQFEDFANHNAFNLLAKYGTSHLVFNDDIQGTASVVLAGLMAALNLVGGSLSEHTFLFLGAGEAGTGIAELIALEMSKQTGIPLEETRKKIWMVDSKGLIVKSRMEMLQHFKRPWAHDHEPVQELVNAVKSIKPTVLIGSSGAGRTFTKEVVQAMATFNEKPIIFALSNPTSQSECTAEEAYSWSEGRAIFASGSPFAPVEYNGKVYASGQANNAYIFPGFGLGLIISGAIRVHDDMLLVASEALADEVSQENFEKGTHIPPFSNIRKISAHIAKVAAKAYELGLATRLPQPKDLVAYAESCMYSPAYRSYR

SEQ ID NO: 85612 - protein, 377 aa, Mycobacterium avium 104
MQTQAAVLFERNTPWSIETIELDGPKATEVLVELHASGMCHSDDHLVTGDMPIALPCIGGHEGAGVVKAVGEHVSWLAPGDHVVFSFIPSCGRCPSCSTGHQSLCDLGAKIYSGMQIHDGTARHHLNDKDLALACGIGSFAHHTVVHEASCVKIPDHYRLDLACLLGCGFITGWGSAVYAAEVRPGDTVAIAGVGGIGAAAVQGAKLAGARTITVIDPSEHKREEAMKMGATHTAADWQEAKGVVAKATWDRGVDKFICAMGVGDGQLIGQALAMTAKRGKLVVTNIHPMLEREIRANLMDLTLTEKQIIGTLYGSGNPRADIPKILELFSAGQVDLEAMVTRTYPLDKVNDGYADMHAGANIRGVLLYPPAENANC

SEQ ID NO: 85613 - protein, 203 aa, Arabidopsis thaliana
MCLIMETDDHNGDVLAPPSNFSMVEDGIYRSGFPRPENFSFLKTLNLRSIIYLCPEPYPEENLKFLEANNIKLYQFGIEGKTDPPTPMPKDTVLDALKVLVDVRNHPILIHCKRGKHRTGCLVGCLRKVQSWCLSSVLEEYQKNAGLKWRQRDLNFIEAFDIVSLRQCLLSIMYQYHGYGFKRRRLAYEEENVKTPKPQAARV

SEQ ID NO: 85614 - protein, 758 aa, Dechloromonas aromatica RCB
MEKDLREAALEYHRWPTPGKISVRPTKGLTNQRDLALAYSPGVAAACDAIVEDPATAAWYTSRANLVGVVTNGTAVLGLGNIGPLASKPVMEGKGCLFKKFAGIDVFDIELAENDPDKLIDMIAALEPTLGGINLEDIKAPECFYIEEKLKARMNIPVFHDDQHGTAIISGAAMLNGLKVVGKKIDQVKVVVSGAGAAAISCVNLWCELGVKRENITICDSKGVIYVGRPGGMDETKARYAQNTDKRTLGEALVGADIFLGLSAAGVVKQDMVKAMADKPMVFALANPTPEIMPELVKEVRPDAIIATGRSDYVNQVNNVLCFPFIFRGALDVGATRITEEMKMASVRAIAELAEAEVTDEVAMAYPGADLSFGPEYLIPKPFDPRLIVKIAPAVAQAAMDSGVATRPITDWAAYRAKLSEFVYHTGVGMRAIFQAARQAKGKRIIFAEGEDERVLRAAQVVIEEKFARPILIGRPEVIAHRLEKAKLRIQPGVDFDVVNPESDERYRECWTAYHKAMARQGITPAIAKEAMRRKPTVIGAMLLKLGYADGMICGMTGQYSHHLGVISQIIGKRAGVSTLAAMNYLMLPGRSLFICDTHVNENPNAQEIAEMTLMAAEQVKRFGSHPKVALLSHSNFGSANSESARKMSIAAGLVSAMSAGELEVDGEMHGDSALNEDLRREANPDSPLKGEANLLVMPNIDAANISYNLIKMTGGEGVTIGPILLGAARPAHVLTSTATVRRLVNMTALAVVESMER

SEQ ID NO: 85615 - protein, 379 aa, Glycine max
MSTAGQVIKCRAAVAWEAGKPLSIETIEVAPPQKGEVRLRILFNSLCRSDVYWWDAKDQTPLFPRILGHEASGIVESVGEGVTHLKPGDHALPIFTGECGECTYCKSEESNLCELLRINTDRGVMLSDGKTRFSKNGQPIYHFVGTSTFSEYTVLHEGCVAKINPNAPLDKVAIVSCGFCTGFGATVNVAKPKPNNTVAVFGLGAVGLAACEGARVSGASRIIGVDLLPNRFEQAKKFGVTDFVNPKDHNKPVQEVIAEMTNGGVDRAIECTGSIQASISAFECTHDGWGTAVLVGVPKKDVEFKTNPMKFMEGRTLKGTFYGHYRPRTDIPGVVEKYLNKELELDKFITHSVPFSKINTAFDLMLKGEGIRCLICMEE

SEQ ID NO: 85616 - protein, 473 aa, Pseudomonas putida GB-1
MTQTSPSTPDEQHLQRNLTNRHIQLIAIGGAIGTGLFMGSGKTISLAGPSIIFVYMIIGFMLFFVMRAMGELLLSNLNYKSFIDFSADLLGPWAGYFTGWTYWFCWVVTGIADVVAIAAYTQFWFPDLPQWIPALTCVGLLLSLNLVTVKMFGELEFWFALVKIVAILGLVATGLYMVITGFTSPSGRTAQLANLWNDSGMFPHGLMGFFAGFQIAVFAFVGIELVGTTAAEAKNPERTLPRAINSIPIRIIVFYVLALIAIMAVTPWRDVVPGKSPFVELFVLAGLPAAASIINFVVLTSAASSANSGVFSTSRMLYGLSQEGDAPKAFEKLSSRSVPANGLYFSCTCLLLGAVLIYLVPDVVEAFTLVTTVSAVLFMFVWTLILLSYLKYRKNRAALHQASKYKMPGGRFMCYVCLVFFAGILVLLSLEADTRSALVVTPIWFMILAVTYQFVRSRRHPRGATPQVEQSQR

SEQ ID NO: 85617 - protein, 488 aa, Legionella pneumophila subsp. pneumophila str. Philadelphia 1
MEIYKMYIDGKFTLAKSGATRDIFDPANGDLIAKVPESAKEDAILAIKAARKAFDEGEWRKSLALDRGKLLFKLADLIRANAKMLAELETRNCGKPLLEAEFDVTDAANCFEFYGGLATKIHGETMSVPANSFSYVVREPIGVCGQIIPWNFPLLMAAWKLAPALAAGNTVVLKPSELTPITALELFKLIDECGFPAGVVNLITGPGIGVGEELASNAMVDKVAFTGGSATGRKIMQAATGNLKKISLELGGKNPNIVFADSDLEMAIDGALFGAFANQGEVCSAGSRLLVERSIHKKIVEGMLKKIPNIKLGHGLDAGVKMGPLVSSAHREKVESYVKLGMEEGAKLLCGGKRPTGNEFAKGHFFEPTIFDEVKSTMRIAREEIFGPVLVVIPFDTEEEAIRIANDTDYGLSGAVWTKSVTRAHRVTSQIRAGILWVNHYHPTYNEMPWGGYKQSGAGRELGLYGIESYLEVKQVNINLDETPIGWY

SEQ ID NO: 85618 - protein, 450 aa, Legionella pneumophila subsp. pneumophila str. Philadelphia 1
MKHQLVGTKLMKKIHIKTPIPGPKSQQLMELRRQHVARGPFHATPIFVKQAKGSFVEDVDGNVFLDFSSGFGVVNTGHCPDSVVNAIKLQAEKFIHTGFNIIPYESYIKVCEKLNDHTPGHFEKKSLLLNSGAEAVENAIKIARAYTGKQAVICFDHAFHGRTYMAMTLTSKNKPYKHGFGPFPSEIHRAPFPYEYRWKGANCVEECFDEFTDLANFRVGVENIAAVIIEPVLGEGGFIQSPALFLQKLREFCTTNDIVFIADEIQSGFGRTGNLFAMNTLGVPPDLTISAKGLGGGVVLAGVTGKAEIMDAAMEGGLGGTFGGNPLSCAAALEVFHIFEEGSLLQNVTHLAKALQSRLSGFKEKYKVVGDVRGLGVMQAIELVKDKNTKEPNKEATVQLAQFCLEHGLIILTCGTYGNVIRLHMPLSTGVKDLELGLSIIEEGLKKLSV

SEQ ID NO: 85619 - protein, 310 aa, Legionella pneumophila subsp. pneumophila str. Philadelphia 1
MSSKLLTIQLLEELVHAAELNQEGKTADYIPELANVNQELTAIAVQALGEKTLAYSNNPLHPVTLQSTGKMIPLIGLLEEFGADQLFEWVKVEPSGDDFASITRLEQFGPKPSNPMLNAGAIALCSRIPGIGEQQFRWLEHWVQKLFNQRLSINPLVFASEKRTGNRNRALAYLLKSRNNLGADVHETLDLYFALCSYEAMLDQMLYLPTLLANRGKDPDTGEQILSTETCKITLAIMATCGLYDETGTHMVKTGMPAKSGVSGYTIAVVPGKAGIVVLSPRVNAKGNSIRGEIMLEGLSKAMNWHFALP

SEQ ID NO: 85620 - protein, 168 aa, Alteromonadales bacterium TW-7
MANVEAKQQQPDLAEKLIAVNRVSKVVKGGRIFSFTALTVVGDGAGKVGFGYGKAREVPAAIQKAMEKARRNMINVDLNGNTLQHPVKGRHAGSLVFMKPASEGTGIIAGGAMRAVLEVTGVQNVLSKCYGSTNPINVVRATISALENMNSPQSIAAKRGLRVEEILG

SEQ ID NO: 85621 - protein, 364 aa, Pseudomonas putida
MNSAIGPYKGGLRFHPSVNLGVLKFLAFEQTFKNSLTSLPMGGGKGGSDFDPKGKSDAEVMRFCQAFMSELYRHIGADVDVPAGDIGVGAREIGFLFGQYKRLSNQFTSVLTGKGMTYGGSLIRPEATGFGCVYFAEEMLKRRGQSVEGKRVAISGSGNVAQYAARKVMDLGGKVISLSDSEGTLYCEAGLSEAQWLALLELKNIKRGRISELASAHGLEFRAGQHPWSLPCDIALPCATQNEVDAGAARTLLRNGCVCVAEGANMPTTLAAVDIFIEAGILFAPGKASNAGGVAVSGLEMSQNAMRLLWTAGEVDSKLHAIMQSIHHACVHYGEDNGQINYVKGANIAGFVKVADAMLAQGVV

SEQ ID NO: 85622 - protein, 464 aa, Legionella pneumophila subsp. pneumophila str. Philadelphia 1
MVLEFDTIILGGGKGGKTLAMDLAKSGQKIAMVENNQIGGTCINVACIPTKTLVQSAKVAHYCRKAKDYGLNTTLHPIDFKAIRARKDAVVKGMREANLKQFLDSGMDLMLGHGHFIGPKMIEVTLSSPRDKQKTLHITADKIIINTGALPFIPPIAGLDKVNYFTNDSLMNTDLVPQHLLIIGGGYIGLEFAQMFRRFGAEVTVIEASSEFLGREDKDIAEQVFQTLSNEGIQFAVDTKINAIRQEQTEVIIEANRQGQSEIIRGTAVLVAVGRIANTAGLHLDKTGVELDERGFIKVNEFLETTAAGIWALGDVKGGAQFTHLSLDDYRLVKHNLQNPQKKLSSQNRLIPYTVFLDPELARIGLTEAQARSQGRRIKIATIPAAAIPRAKTQGETTGILKAVIDAETDLILGVSIFCAEAGEILGVIQLAMELRVPYQKLRDMMFAHPTLVEGINLWFAQII

SEQ ID NO: 85623 - protein, 375 aa, Yarrowia lipolytica CLIB122
MSYYSRRNRDAQAAPPAAASKKVPIEKSQQLLKSLLRESDNKVCADCKTATHPRWASWNLGCFICIRCSGIHRGMGTHISRVKSVDLDAWTEEQLASMMKWGNTRCNMFWEAKLPKGHVPDDNKIENFIRTKYDMKKWAASTTVPDPDTLGGASHAAAPVQAPPKDTKIAGPPQVTKKAPATQQSSLIGLDFDEPQQHQHKPAQLQQPQQTQKNDDFLSFAQSPPQTQQQSPQQHQQSPPQQQFQAQQPFPSASAPDSSRPDLKKSILSLYANSRQAPVVQQQQQQQQFQQQQFQAQQQFQQQQPQFQQQQGGDFGGFGNMQQQTNSGFGNMQQANSGFGGFGGAPQQQNNAHNDWADAAAPKKQEDDVFANVWK

SEQ ID NO: 85624 - protein, 623 aa, Amaranthus hypochondriacus
MLVLCSRSRLTSSLIRRLKDQIANVSNHRSFATSEGHRLAIVNKRSLDILQDPWFNKGTAFSMTERDRLDLRGLLPPNVMTTEQQIERFTADLRVLELTTKDGPSDTYDLAKWRILNRLHDRNETMFFKVLIENIEEYAPIVSTPTVGLVCQKFSGLYRRPRGMYFSSDDRGEMMSMVYNWPAEQVDMIVVTDGSRILGLGDLGVHGIGVAIGKLDLYVAAAGINPQRVLPVMIDVGTNNEDLLKNPLYLGLQKKRLDGEEYLAVMDEFMEAVFTRWPNVIVQFEDIQNKWALTLLQRYRHKYRTFNVDVQGTSGVAIAGLLGAVRAQGRPMIDFPKQKIVVAGAGSSGVGVLNAARKTMARMLGNDESAFDRARSQFWVVDDKGLITEKRANLDPEVQPFAWKENEISLQGLNEGAKLVEVVRQVKPDVLLGLSAYGGLFSKEVLEALKDSTSTRPAIFAMSNPTKNAECTPEEAFSIVGDHVVYASGSPFKDVDLGNGKIGHVNQGNNMYLFPGIGLGVLLSGSRIISDSMFQAAAERLAGYMTDEEVINGVIYPSISRIRDITKEVAAAVIKEAVEEDLAEGYRDMDARELQKLNEEQILEYIEKNMWNPEYPTLVYKKR

SEQ ID NO: 85625 - protein, 346 aa, Burkholderia xenovorans LB400
MNTSIPSSTTSSDEGATLLPRIAVLATGGTIAGAAADATNTSGYQAGVVGVEQLLAVVPALSAVARVAPEQIASIDSKDMALPLWTTLAQRINALLADDDIDGVVVTHGTDTLEETAYLLHLTIKSDKPVVLTAAMRPASALSADGPLNLLNAVTVAAHVASRGQGVLVAFNNRIHSARDVVKTSTYAVDAFHSPEIGALGWVQDGRVEFQRSVVRPHTLATEFVIGAKWPHVEIVVSYAGVSRIAVDALVAAGVRGIVVAGTGNGSIHASVQQALADAASQGVAVVRASRVGSGHVMRNGAAADDALGFVSAGSLNPYKARVLLMLALAAGAAGPMVLQKIFDTY

SEQ ID NO: 85626 - protein, 310 aa, Aspergillus oryzae
MTTFTLTTGAKIPAVGFGTWKAAPGEAAAAVKTAFEVGYRHFNMSVPVSNPTRNTDGNEPEIGGVFKSTKVPRSEYFVTTKLWSSDHRRVESALDKSLQDLGLSYVDLYLMHWPVTLDPSDSVEYGKENRKVHAAGWDFNDTWREIEKLLETGKVRAIGVANFSTVNLEKLLKTAKVVPAVNQTEIQPLLPQNKLNAYCREKGIHQTAFGPLGGSGSTLHSHPVIVDIATKRGCDTGNVMLSWGIQKGWSVIPKSTNPKRIQANLRGNVELTSEEMGKMDALALPKGKRFNRPDWGTVIFHDDAEVDLEE

SEQ ID NO: 85627 - protein, 626 aa, Solanum tuberosum
MAIFSNQMRLSSTLLKRLHQRVAAAVNSSSSRNFTTTEGHRPTIVHKRSLDILHDPWFNKGTAFSFTERDRLHIRGLLPPNVMSFEQQIARFMADLKRLEVQARDGPSDPYVLAKWRILNRLHDRNETLYYKVLMENIEEYAPIVYTPTVGLVCQKYSGLFRRPRGMYFSAEDRGEMMSMVYNWPADQVDMIVVTDGSRILGLGDLGIQGIGIAIGKLDLYVAAAGINPQRVLPVMIDVGTDNENLLKDPLYLGLQDHRLDGEEYIEVIDEFMEAVFTRWPHVIVQFEDFQSKWAFKLLQRYRNNYRMFNDDIQGTAGVAIAGLLGAVRAQGRPMIDFPKMKIVVAGAGSAGIGVLNAARKTMARMLGNTEIAFESARSQFWVVDAKGLITEARENVDPDARPFARKIKEIERQGLSEGATLAEVVREVKPDVLLGLSACGGLFSKEVLEALKHSTSTRPAIFPMSNPTRNAECTPEEAFSILGENIIFASGSPFKDVDLGNGHVGHCNQANNMFLFPGIGLGTLLSGSRIVSDGMLQAAAECLAAYITEEEVLKGIIYPSISRIRDITKEVAAAVVKEAIEEDLAEGYREMDSRELRKLDEAQISEFVENNMWSPDYPTLVYKKD

SEQ ID NO: 85628 - protein, 188 aa, Shigella boydii
TMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGLAAMIGV

SEQ ID NO: 85629 - protein, 192 aa, Triticum aestivum
  misc_feature (56)..(56): Xaa can be any naturally occurring amino acid
  misc_feature (74)..(74): Xaa can be any naturally occurring amino acid
  misc_feature (98)..(98): Xaa can be any naturally occurring amino acid
  misc_feature (123)..(123): Xaa can be any naturally occurring amino acid
  misc_feature (133)..(133): Xaa can be any naturally occurring amino acid
  misc_feature (140)..(140): Xaa can be any naturally occurring amino acid
  misc_feature (149)..(149): Xaa can be any naturally occurring amino acid
  misc_feature (151)..(151): Xaa can be any naturally occurring amino acid
  misc_feature (158)..(158): Xaa can be any naturally occurring amino acid
  misc_feature (162)..(162): Xaa can be any naturally occurring amino acid
  misc_feature (164)..(164): Xaa can be any naturally occurring amino acid
  misc_feature (167)..(167): Xaa can be any naturally occurring amino acid
VVEVVVSPPYVFLPTVKGKLRPEIQVAAQNCWVKKGGAFTGEVSAEMLVNLGVPWXSSLGHSERRSLDGKNKRXVWERRLHMHSLKGLKGIACVGWNXLSKRRTGFQPWAVFPEQTKQLLTRXKDWANVVLPXEQCWAIXTGKFHNGQXQXPCNLRTXQDKXPXVAXPAVMEVVTANSRLPQPSHGLVSLTI

SEQ ID NO: 85630 - protein, 585 aa, Mesembryanthemum crystallinum
MGGSNALNEMTNGSDGITGGVADVYGEEFATQDQLVTPWSFSVACGHSLLRDPQHNKGLAFTEKERDAHFLRGLLPPVVLSQELQEKKFLTTLRQYQVPLQKYMAMMDLQERNEKLFYKLLVDHVEELLPLVYTPTVGEGCQKYGSIFRRPQGLFISLKDKGRILELLRNWPEKKIQVIVVTDGERILGLGDLGCQGMGIPVGKLSLYSALGGVCPSACLPITLDVGTNNQKLLDDEFYIGLKQKRATGEEYAEFVQEFMSAVKQNYGEKILVQFEDFANHNAFELLEKYRTTHLVFNDDIQGTASVVLAGLIASLKLLGGTLADHKFLFLGAGEAGTGIAELIALEMSKKTKAPVEQMRKKIWLVDSKGLVVSSRKETLQQFKLPWAHEHEPITTLIDAVQAIKPTVLIGTSGKGKQFTKEVVEAMANINAKPLILALSNPTSQSECTAEEAYTWSQGHAIFASGSPFDPVEYEGRTFVPGQANNAYIFPGFGLGLIMCGAIRVHDDMLLAASEALASQVTGEHFIKGLIYPPFKDIRKISAHIAAGVAAKAYELGLASRLPQPADLVKFAESCMYNPTYRSFR

SEQ ID NO: 85631 - protein, 198 aa, Shigella boydii
RELKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAM

SEQ ID NO: 85632 - protein, 319 aa, Chlamydomonas reinhardtii
MFAALGAPCVAYRLSAVYNAVDQSAIVQLWRDTQRYSPEEIDFQERVFARSGLAPCGTHLPPNLNPACVGNDAATDLDSAAAECRLAVCGAVEGLLEKTGLRPKDIDILVTTCSIYCPTPSMASMVVNAFGMRKDVQAYHLGGMGCANGVVGINLVADLLKAHPNSTALFVCTETTTPAYYRGNERHVRLRHRLVTNLLFRMGGAAVCLTNKPGLRARAKYELLHRVAPRILTWSQLAAAALHMLQQRRRRVAHQHQYRPNFQHSTCRHFLLHAGGAKVLDGLGEALQLDASRLGPSRAVLHDYGNPTSNLSPPLHPCR

SEQ ID NO: 85633 - protein, 415 aa, Hevea brasiliensis
MFGRAPKKSDNTKYYEILGVSKNASQDDLKKAYRKAAIKNHPDKGGDPEKFKELAQAYEVLSDPEKREIYDQYGEDALKEGMGSGGGAHDPFDIFQSFFGGNPFGGGGSSRGRRKEGEDVIHPLKVSLEDLYNGTSKKLSLSRNVICSKCKGKGSKSGASMKCSGCQGSGMKVSIRQLGPSMIQQMQHPCNECKGTGETINDKDRCPQCKGEKVVQEKKVLEVIVEKGMQNGQRITFPGEADEAPDTITGDIVFVLQQKEHPKFKRKGDDLIVDHTLSLTEALCASQFILTHLDGDLLIKSQPGEVVKPDQFKAINDEGMPMYQRPFMRGKLYIHFSVDFPDSLPPDQCKALEAVLPSRTSVQLSDMELDECEETTLHDVNFDEEMRRKQQQAQEAYDEDDDMHGGGQRVQCAQQ

SEQ ID NO: 85634 - protein, 193 aa, Shigella boydii
IAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFS

SEQ ID NO: 85635 - protein, 491 aa, Listeria monocytogenes str. 4b F2365
MTDELEQKALITIFGGTGDLANRKLYPSLYHLYSKGSLGDNFAVIGTARREWSNDFFRDKVKESIKDIDGSEKDADAFASHFYYQSHDVTNKESYVTLKDLSDELDAKYELGGNRLFYLAMAPNFFGTIASRIKSEGFVDTDGFHRLIIEKPFGHDLASAEELNNSLRQAFKEDEIYRIDHYLGKEMIQNISVIRFANSIIESLWNNRYIDNIQVTLTEVLGVEDRGRYYDESGALRDMVQNHILQIVSLLAMEPPINLTTREIRHEKVRALRSLRVFEGKEVHQNFIRGQYGPGEVGGKELKGYRQEDNVDPHSNTETFVAAKLEIDNFRWAGVPFYIRTGKRLAKKTTQIAIQFKDVPLNLFGQQQSLGGNVLVIHIQPDEGITLHLNVKEPGQGMVTMPVNLNYIHSSPDGMNTPEAYEKLILDCLRGDATYFSHWDEVSLSWNFIDHIADVWTNTKDHFPNYKSGSMGPKEADDLIQRDGFQWFPID

SEQ ID NO: 85636 - protein, 292 aa, Coccidioides immitis RS
MARDTELSANERSFILEALHNNVRLDGRALDQFRPLNLTFGDEYGHVKVQLGRTTVIVRISAEVTAPRPERDSDGIFTVSIELNDMALPGFETGRQSDLETQLSRTLDKIVRRSNALDTESLCIAKGLSCWNVRADVHIVDADGGLVDICCLAIMAGLLHFRIPESTVSDGKVTVYSPEEKVPVPLNLTKVPLSITFNLYDEGKITLMDATSSEEAVSEGAVIIALDKTGEIALYTKAEGTPADPLNMVACSTAALAKVRDLNALVQKRLGEDSKKRDQKGLRAESSAANER

SEQ ID NO: 85637 - protein, 376 aa, Xanthomonas campestris pv. campestris
MSKRDYYEVLGVARGASDEELKKAYRRCAMKYHPDRNPGDAAAEATFKECKEAYEVLSDGNKRRAYDAHGHAAFEHGMGGGGGGPGGPDMGDIFGDIFGNIFGGGAAGPRAARRGADVGYVLELDLEEAVAGIERRIEIPTLIECEPCHGSGSEDGKVEVCATCHGRGQVRIQRGIFAMQQSCPHCDGRGTLIQNPCKTCHGAGRVEEDKVLSIKVPAGVDTGDRIRLAGEGEAGPAGTPPGDLYVEVRVREHAIFQRDGDDLHCEVPIRISQAALGDTVRVATLGGEAEIRIPAETQTGKLFRLRGKGVRSVRSRSEGDLYCRVVVETPVNLTADQRELLKQFEATFTGEDARKHSPKSATFIDGVKGFWDRMTS

SEQ ID NO: 85638 - protein, 93 aa, Brassica napus
VISCLRKNAPELVNVLAYSEVFDRSGGGAERMCREMGVPFLGSVPLDPQLCKAAEQGKSCFEGDNKCSVSAPALKSIIEKVVALIKGEDGAHQ

SEQ ID NO: 85639 - protein, 530 aa, Caulobacter crescentus CB15
MPKLNSVIDASSDAFAKNAAHNRALVDELRAKVAQAALGGPESARERHTARGKLLPRERVERLLDPGSPFLEVGQLAACDLYNGEAPGAGMICGVGRVSGREVMIVANDPTVKGGAYFPMTVKKHLRAQEIAAQNRLPCLYLVDSGGANLPHQAEVFPDRDHFGRIFFNQARMSAASIPQIACVMGSCTAGGAYVPAMSDETVIVRNQGTIFLAGPPLVKAATGEVISAEELGGAETHGRRSGVVDHVAENDEHALEIVRSIVANLNTTKPDQLVLADPEPPAYDPEELYGIVPTDVRAPYDVREVIARIVDGSQFDEFKALYGTTLVCGFARIWGQPVAILANNGVLFSESALKGAHFIELACKRKIPLIFLQNISGFMVGGKYEAGGIAKDGAKLVTAVASAEVPKFTVLIGGSFGAGNYGMCGRAYSPRFLFTWPNSRISVMGGEQAASVLATVHRDAAKWSPEEAEAFKAPIRQRYEDEGNPYHATARLWDDGIIDPAQTRDALGLAISASLNAPIPETTFGVFRM

SEQ ID NO: 85640 - protein, 154 aa, Schizosaccharomyces pombe
MAKDKKDHKHSGSTEDEYDSYLPALMPIAKPLAPKKLNKKMMKTVKKASKQKHILRGVKEVVKAVRKGEKGLVILPGDISPMDVISHIPVLCEDNNVPYLYTVSKELLGEASNTKRPTSCVMIVPGGKKKDMSKVEEYKESYEEIIKEVPALEV

SEQ ID NO: 85641 - protein, 618 aa, Arabidopsis thaliana
MIPHQEVNEEEASLFDFLWLLLASVIFVPLFQKIPGGSPVLGYLAAGILIGPYGLSIIRNVHGTRAIAEFGVVLLLFNIGLELSVERLSSMKKYVFGLGSAQVLVTAAVVGLLAHYVAGQAGPAAIVIGNGLALSSTAVVLQVLQERGESTSRHGRASFSVLLFQDLAVVVLLILIPLISPNSSKGGIGFQAIAEALGLAAVKAAVAITAIIAGGRLLLRPIYKQIAENRNAEIFSANTLLVILGTSLLTARAGLSMALGAFLAGLLLAETEFSLQVESDIAPYRGLLLGLFFMTVGMSIDPKLLLSNFPVIVGTLGLLIVGKTMLVVIMGKLFGISIISAIRVGLLLAPGGEFAFVAFGEAVNQGIMSPQLSSLLFLVVGISMAITPWLAAGGQLIASRFELHDVRSLLPVESETDDLQGHIIICGFGRVGQIIAQLLSERLIPYVALDVSSDRVTIGRSLDLPVYFGDAGSKEVLHKIGAGRACAAVVALDAPGANYRCVWALSKFYPNVKTFVRAHDVVHGLNLEKAGATAVVPETLEPSLQLAAAVLAQAKLPTSEIANTINEFRTRHLSELTELCEASGSSLGYGYSRTSKPKPQPSDASGDNQIIEGGTVVI

SEQ ID NO: 85642 - protein, 505 aa, Arabidopsis thaliana
MAIIVVTTIFILLSFALYLTIRIFTGKSRNDKRYTPVHATIFDLFFHSHKLYDYETEIARTKPTFRFLSPGQSEIFTADPRNVEHILKTRFHNYSKGPVGTVNLADLLGHGIFAVDGEKWKQQRKLVSFEFSTRVLRNFSYSVFRTSASKLVGFIAEFALSGKSFDFQDMLMKCTLDSIFKVGFGVELGCLDGFSKEGEEFMKAFDEGNGATSSRVTDPFWKLKCFLNIGSESRLKKSIAIIDKFVYSLITTKRKELSKEQNTSVREDILSKFLLESEKDPENMNDKYLRDIILNVMVAGKDTTAASLSWFLYMLCKNPLVQEKIVQEIRDVTSSHEKTTDVNGFIESVTEEALAQMQYLHAALSETMRLYPPVPEHMRCAENDDVLPDGHRVSKGDNIYYISYAMGRMTYIWGQDAEEFKPERWLKDGVFQPESQFKFISFHAGPRICIGKDFAYRQMKIVSMALLHFFRFKMADENSKVSYKKMLTLHVDGGLHLCAIPRTST

SEQ ID NO: 85643 - protein, 244 aa, Bacillus sp. SG-1
MAIGKEGLDILKNSTVAVLGIGGVGSFAAEALARSGVGRLVLVDKDDVDITNINRQIHALLSTVGKPKADLMKERIKDINPDCEVIALKMFYTEETYEEFFSYGLDFVVDASDTISYKIHLMKECLERNIPLIASMGAANKTDPTRFKIEDISKTHTDPLAKVIRTRLRKEGIHKGVKVIFSDESPIVIREDIRQEVGKDDAKIRKAKFPPSSNAFVPSVAGLIAASHVISELLSSIEIKRVKD

SEQ ID NO: 85644 - protein, 501 aa, Glycine max
  misc_feature (202)..(202): Xaa can be any naturally occurring amino acid
MAMASLARRKGYAVVLSSRSSFCLTSWRGFASGSDENDVVVIGGGPGGYVAAIKAAQLGLKTTCIEKRGTLGGTCLNVGCIPSKALLHSSHMYHEAKHAFANHGVKFSSVEVDLPAMMAQKDKAVSNLTKGIEGLFKKNKVNYVKGYGKFVSPSEVSVDTTEGGNTVVKGKHIIIATGSDVKSLPGVTIDEKKVVSSTGALXALTEIPKRLVVIGAGYIGLEMGSVWGRLGTEITVVEFASEIVPTMDAEVRKQFQRSLEKQGLKFKLKTKVVGVDTSGDGVKLTLEPAAGGDQTTLEADVVLVSAGRTPFTAGLGLDKIGVETDKIGRILVNERFATNVSGVYAIGDVIPGPMLAHKAEEDGVACVEYIAGKVGHVDYDKVPGVVYTMPEVASVGKTEEQVKELGVEYRVGKFPFMANSRAKAIDNAEGLVKILAEKETDKILGVHIMAPNAGELIHEAAIALQYDASSEDIARVCHAHSTMSEAVKEAVMVSYDKPIHI

SEQ ID NO: 85645 - protein, 378 aa, Helicobacter hepaticus ATCC 51449
MSILKEAYLYFANGLFFKAQSFGSDGTFVGEVVFNTSMSGYQEVITDPSYSGQFIVFSMPEIGIVGVNNQDSESPRAACTGVILSSYNDFVSNFRSEQSLSTYLKEHNIMGICGVDTRNLIKMLTTQGAMMMIASTQITQESELKASLSRTPPIQDINFIKEVSTKTSYVHTDSTFDFTHFAYGTSPNFKAKVVAIDFGAKRNILNELVAVGLEVEVIPHSFSAAEILSRFKAGEIQGVFLSNGPGDPLVLHNEIEQIKQLIQSDIPIFGICLGHQLLSIAHGFPTYKLKFGHHGSNHPIKNLQSGAVEITAQNHNYCVPESIAQIATITHRNLFDNTIEGVRYKDKPIFSVQHHPEASPGPREARILFEEFAKLCCK

SEQ ID NO: 85646 - protein, 481 aa, Bacillus clausii KSM-K16
MKLDLRRQQMLLAGEWVDRTETMEVRNPENDQLVAIVPKASKTDMEQAIARAKEGAKASAALPVYKRMAILNRAADFVDAHKERFARTIATEGSKTIREARKETGRCVETLRLCAEEARRVTGETIPFDQSPGGTGRFGYYERHPLGIIGAITPFNDPLNLVAHKIGPAIAAGNAIVLKPATATPLSALLLAEAFMEADLPKGILSVMTGLGSEVGDVLITHPDVRMVSFTGGMEAGLEIAKKAGLKKKSMELGSNSPVIVLEDAQIEDAVKANVSGAFWAAGQNCIGVQRLYVHEEVYDRFKELFVKQSCAYLMGEKLSEKTDMGPLISEKEAKRVAFMVDDALRMGAALLCGGKRRGAFYEPTVLENVPDECMLAKEEIFGPVVLLYKIKSLAEGIERANQSDYGLHAGLFTESMNAVFQAIQELEAGGVMVNDSSDFRIDAMPFGGTKQSGLGREGVKFSILEMTEQKVVCFKLRDNG

SEQ ID NO: 85647 - protein, 530 aa, Aspergillus oryzae
MSDARTTLMETWFTPALVAAIVAARLLFSLYSAWRHAQRARSLNCQEAPLYPSRDPFGVATLLETLRADRDKFLPKLSQKRVDLISSQQNRYVSTFRVRQAGRENFFTVDPKNIQAMLATQFNDFFLGDMRRNAGAPVIRSGIFVSDGADWSHSRSLIRPQFTRTQINNLELEERHVQNALRAMPTQSNGWTSEVDIQTILFRLTLDSATEFLFGKSCNSQLTALEKDAGEMSDSFLNSFDRCAWYLAARLRFERLYWIVNNKEFRECTRVVHELVDGYVHAALQRAQQAEKPADPERGSHYVFVDALTATTQDPNQLRDECLNVLIAGCDTTASLLSWNILLLARHPDIFQRLRKEIIERFGTYSEPRDINFSSLKSCQYLQHFINETLRLHPVVPFNRRCANKDTTLPRGGGKDGNSPVYLQKGQPVLYSSYVLQRRKDIWGEDAEEFNPDRWYGRKAIWEHIPFSGGPRTCIGQQFAITNTSFVLVRLLQRFDSIEDVYPEREIRYGVTLTNCPADRVTVRMHQAEL

SEQ ID NO: 85648 - protein, 356 aa, Xanthomonas oryzae pv. oryzae KACC10331
MNRSFIVQQRGALSSIQPARRQCVRPVKRERYVNLAGMIETVPLAHSDVLQAAARIAPHCAPTPLLTSHSLDALSGARLFFKAEHLQRSGAFKFRGACNAVWSLPDERTAHGVVTHSSGNHGAALALAARTRGMGCHVVVPEGAVAAKLANISRHGATLWRCAPTIAAREQLCAEVQASSGATLVHPYTDVAVIAGQGTATLELLHQSGGLDVLVAPVGGGGLAAGAALALRCAPGCELVLAEPAGAADTARSLAAGQRLVDFVPDTVCDGLRGTLGAPNFALLQHAGAQVITVDDAAVVQAMRLIWQLLKQVVEPSSVITLAAVLAEPARFAGRRVGLILSGGNVDLDALPWAAA

SEQ ID NO: 85649 - protein, 280 aa, Glycine max
APPPDLTRIYSGSWDTTVRVWDRLSMKCTAVLRHSDWVWALVPHNTTVASTSGSDVYVWDTNSGALVTIVHNAHVGNTYALARSHTGDFLFTGGEDGAIHMYEIVNDGYESKTWHVAAWIPHSAAVYSLAFEFPWLVSASSDGKLALIDVRKLLRISKRALGKRVSKVKHLGGDIVEPPQRMLHGFKSNLFSVDIGAERIVSGGEEGVVRIWNFTEALEIERRARALRGIRLEHRMRRRKLQTELSNKSGRSDQCSVAAKKNSVTCIWPTKRGMSGKLKA

SEQ ID NO: 85650 - protein, 137 aa, Zea mays
NTIIAWKITEAYIIFLTSLLLSTFFFQVMNLIGDVKGKVAILIDDMIDTAGTITSAAALLKQEGAEAVYACCTHAVFSPPAIERLSGGVFEEVIVTNSILLPEDKCFPQLTVLSMANLVGETIWHVHRDGSVSSIFQ

SEQ ID NO: 85651 - protein, 350 aa, Listeria monocytogenes str. 4b F2365
MTYKITSLAGDGIGPEIMTSGLQVLEAVAKKYNHTFEIESHPFGGAGIDVAQDPIPSSTLKACRDADAILLGAIGGPKWDNAPKRPEDGLLALRKALGLFANIRPIQVPSSITHLSPLKKEIVENTDFVVVRELTGGLYFGEPKYWDNEAAVDSLTYTRAEIERIIEKAFEIAATRNKKVTSVDKANVLASSKLWRKIADEVASRHPDITLEHLYVDAAAMLMIQRPTTFDVIVTENLFGDILSDEASVITGSLGMLPSASHAENGPSLYEPIHGSAPDIANQNIANPMSMISSVSMMLRQSFSLFEEADAIDAATARTMQAGFLTADLGGNTSTTDFTNEVLKQIEGGE

SEQ ID NO: 85652 - protein, 273 aa, Candida glabrata CBS 138
MSRPEELAPPEIFYNDSESKKYTASTRVQHIQAKMTLRSLELLNIEPNSFILDIGCGSGLSGEILTEEGHVWCGLDISPSMLATGLTRELEGDLMLQDMGQGIPFRPGTFDAAISISAIQWLCNADTSYNDPKRRLMRFFNGLFAALKKGGKFVAQFYPKNDDQVDQILQAAKVAGFSGGLVIDDPESKKNKKYYLVLSSGSPSNEEKQVNLEGVTMDATDVDSKEPRHKQSKTLLGESKKNFIMRKKELMRRRGRQVAHDSKFTGRKRRTKF

SEQ ID NO: 85653 - protein, 422 aa, Listeria monocytogenes str. 4b F2365
MELVDLLVTEEDVEKAYEVLKAVVKHTPLEYDFYLSEKYHCNVYLKREDLQRVRSFKLRGAFYAISRLSAEQLEKGVVCASAGNHAQGVAYTCKRMTVPATIFMPTTTPQQKVSQVKFFGGSNVEVVLVGDTFDASATAAKEFAATHGQTFIPPFDDPDIIAGQGSLAVEMVKDLNKAHEQADYVFAGIGGGGLISGVATYLKAKSPITKIIGVEPDGAPSMTAALKQNQVVTLDKIDKFVDGAAVKEVGGLTFQHAKVLVDEVTTVSEGAVCSTILDMYTKQAIVAEPAGALSVAALEIYREEIKDKTVVCIVSGGNNDINRMQEIEERSLLHEGLKHYFIVNFSQRPGALKEFVNDVLGPHDDITKFEYTKKVNRGNGPVIIGVLLQDKNDYEGLLERVAAFDPSYIPINDNQTLYTLLV

SEQ ID NO: 85654 - protein, 393 aa, Mycobacterium avium 104
MTVSRLRPYATTVFAEMSALAARVEAVNLGQGFPDEDGPAEMLKAAQEAIADGVNQYPPGIGIAPLRHAIAAQRHRRYGIEYDPDTEVLVTVGATEAIASAVIGLVEPGSEVLLIEPFYDSYSPVIAMASAQRVAVPLVPHGRGFALDADALRRAVTPRTRALIVNSPHNPTGTVLGATELAAIAEVAVESDLLVITDEVYEHLVFDDHRHLPLAGFDGMAERTITISSAAKMFNCTGWKIGWACGPAHLIAGVRAAKQYLSYVGGAPFQPAVALALETQDAWVADLRDRLRARRDRLAAGLIDIGFEVHDSAGTYFLCADPRPLGYDDSVAFCAALPEKVGVAAIPLSPFCDPAGAHGPADVWNHLVRFTFCKRDDTLDEAIRRLAALRGTG

SEQ ID NO: 85655 - protein, 400 aa, Pyrococcus furiosus DSM 3638
MSIRLPQEGKVIEVVNGSLKIPNEPIVAYIEGDGIGREVIPAAIKVVDKAVETAYKGKRRIVWWKLLAGKEALQKVGKLLPEETVKGIAEVKVALKGPMETPIGTGHRSINVALRKMFDLYANIRPIKYYGVPTVYPYADKVDLIIFRENTEDVYAGIEWEAYSREAQKLREFLKNEFGIEIREDSGITLKPISKFATQRIVRKAIKWAIEKGRKRVTIMHKGNVMKFTEGAFRNWAFEVAEKEFSEYVSIGKPEEGKILVDDKIADNMLQQIILRPWEYDIIVTPNLNGDYLSDAAAALVGGVGMAAGINVGDYIAIAEPVHGTAPDIAGKGIANPSAAILSAALLLEYLGWVEAAELIRASLRKTIEKGKVTPDLARGEKALSTEEFIQEVIKEIEGE

SEQ ID NO: 85656 - protein, 484 aa, Synechococcus sp. CC9311
MLEVQAHQQLKQLLHLEEMPWEHHLTLSRLIGRSLRRQDRTRIRLSAGERDRWWLGLLVPLCLQSQDCVLVLDERQRQRFLQVELPRLRQGGLRLACWSGSTAPPDSQLWLLSPSELVNVHRRRGFKHSHQLIIPEAESLAHHLRQAMELSIETQDWDRLRQAYPTAGPALLDLHERLSRQLFAASSRSTCDLPMPSSALVSLRDLIGLLGPAPEPWAELLTLQSSQWASWAHLDQNLLQWTWTLQPLEPLQTLHCLLNQHPSILLQTDGVFLERKRRTDERSTESGPLVDIQLHDRIRTEPLRLFAPRRQPLPNTASYAEHLLDQCRRLILGRRGLTLVLLDDPGLRQKLTTELAGEFGSRVIHQDTAPEVNGVICCSWSWWMDHQNQLPALDQLIVALLPVSSLEDPLTAARVESLKKLGKDWFRDLLLPEALAKLVPAVAPLRQSGGRLAILDGRVRGRSWGKQVLRALEPWSPLQRLLPD

SEQ ID NO: 85657 - protein, 287 aa, Zea mays
MSSPTHARLAQQGKAGVALRLLLSAALAGFLLVFAARTLVTSPVPASPSYSYSSEPQPHPLPLPVAEALVHYATSNATPQQTAEEIGVALRVLQRRAPCNFLVFGLGLDSPMWAALNHGGRTVFLEEDAAWITSVRGRHPALESHHVAYDTALADADALLGLRAHPACVAQPDLAAAAAASCRLALRGLPPVFAGLDWDLVMVDAPTGWTPRAPGRMGAIYTAGMAARARRPGAGPTHVFVHDVDRPVEDAFSRAFLCEGYLAEQVGRIRHFVIPSHRDKDGTPFCP

SEQ ID NO: 85658 - protein, 525 aa, Streptomyces avermitilis MA-4680
MPSAPSAAAPDTVLVVDFGAQYAQLIARRVREARVYSEIVPSTMPVAEMLAKNPAAIILSGGPSSVYAEGAPRLDREIFEAGVPVFGMCYGFQLMATTLGGTVDNTGAREYGRTPLHVSKSGSTLFEGTPDEQPVWMSHGDACSAAPEGFTVTASTDVVPVAAFENDEKRLYGVQYHPEVMHSTHGQQVLEHFLYRGAGLTPSWTTGNVIDEQVELIREQVGTRRAICGLSGGVDSAVAAALVQKAIGSQLTCVYVDHGLMRQGETEQVEKDFVAATGVQLKVVDAEERFLTALKGVSDPEEKRKIIGREFIRVFEQAQAEIIADEGPEVAFLVQGTLYPDVVESGGGTGTANIKSHHNVGGLPEDLEFELIEPLRKLFKDEVRMVGQELGLPDEIVQRQPFPGPGLGIRIVGEVTKERLDLLREADAIAREELTAAGLDREIWQCPVVLLADVRSVGVQGDGRTYGHPIVLRPVSSEDAMTADWSRLPYDTLAKISTRITNEVADVNRVVLDVTSKPPGTIEWE

SEQ ID NO: 85659 - protein, 200 aa, Streptomyces sp.
AWNTGAVENNRGYKVRYKGGYFPAPPVDHFADLRAEISLELDKNGLQVERQHHEVGTAGQAEINYKFNTLLAAADDLMLFKYIVKNVAWRNGKTATFMPKPIFGDNGSGMHVHQSLWSGGEPLFYDEQGYAGLSDTARYYIGGILKHAPSLLAFTNPTVNSYHRLVPGFEAPVNLVYSQRNRSAAMRIPITGSNPKAKRV

SEQ ID NO: 85660 - protein, 114 aa, Triticum aestivum
SPSFGSLAHSKMSTVTRAYLDQRLAAAKRCSKEAAMAGAKAAAVATVAAAVPTLASVRMLPWAKAHLNPTGQALIISTVAGMAYFIVADKTILSMARKHSFEDAPEHLRNTSFH

SEQ ID NO: 85661 - protein, 338 aa, Escherichia coli
MKILITGGTGYIGSHTILMLLNEGYDIIVIDNFSNSSPKVIERIEFLSQKKVCFHEGDIRDERFLKSVFKEHVITTVIHFASLKSVSESISMPIEYYDNNISGTLTLLKVMNYFGVNNFIFSSSATVYGAPSRIPLDESCDTGDTTNPYGTSKYFLEQILIDTQRANPALNIMLLRYFNPVGAHSSGFIGEDPNGIPNNLFPYITQVAIGRLPRLSIFGDDYPTEDGTGVRDYIHVMDLASGHVAALNRQHVLTGLRCYNLGTGKGYSVKEIVETFQKITGKKIPYIVSARRPGDIAECWSSPELAQKELHWEAKRSLEDMVIDAWNWQNKNPNGYLE

SEQ ID NO: 85662 - protein, 290 aa, Streptococcus pyogenes MGAS10394
MDKLARIDEAIRRYYKTTSNGVSEELIDAILYSVDSGGKRIRPLILLEMIEGFGVSLQNAHFDLAAALEMIHTGSLIHDDLPAMDNDDYRRGRLTNHKQFGEATAILAGDSLFLDPFGLIAQAELNSEVKVALIQELSLASGTFGMVGGQMLDMKGENQALSLPQLSLIHLNKTGKLLTFPFKAAALVTEQAITVRQQLEQAGMLIGHAFQIRDDILDVTASFEDLGKTPKKDLFAKKATYPSLLGLEASYQLLTESLDQALTIFQTLESDVGFKPQIITKLIEGLRLNA

SEQ ID NO: 85663 - protein, 332 aa, Burkholderia vietnamiensis G4
MKVAVLGAGAWGTALAGHLAARHDTLLWARDAALIAGLQARHENSRYLEGIALPDALRYDADLDAALAHGAADDALCVIGAPVAGLRTLLRAMRDARCVPAHVVWVCKGFEADTHLLPHQVIAAELPEQRSNGVLSGPSFAREVGLGLPVALTVASASAACRERTLAAFHHGAMRIYTGDDVVGVEVGGAVKNVLAIATGIADGLGLGLNARAALITRGLAEMSRLGVALGGRAETFTGLTGLGDLILTATGDLSRNRTVGLQLASGRSLADILGALGHVAEGVRCAQAVLALAHAHAIEMPITEAVCGVLFDGVAPRDAVSGLLRRDARAE

SEQ ID NO: 85664 - protein, 254 aa, Triticum aestivum
  misc_feature (133)..(133): Xaa can be any naturally occurring amino acid
MAATTTATSRRAPAVLALALALLLLAAAPSASARGDGNGVYEPCADATVSRGDGFTFGVAFAGRDAFFSGGVQLSPCDSRLNLAGAGPLLALFRPTVDEISLLTVNASGPGALTSAGGYMVAFAGRKFAARSXPPVFVGNSSYTVTGFTLVFEFHKGTLQNLFWKSDGCSSCSGQANFGCVENSCAIKTSSCRGNGGGGQVDCSPGIQLAFSGTDKHEAVLNSWYEVSKLKQYSLFGLFSGLKDSLAGQFSNFF

SEQ ID NO: 85665 - protein, 486 aa, Pseudomonas sp. S-47
MKEIKHFISGAFVGSASGKLFDNVSPANGQVIGRVHEAGRAEVDAAVRAARAALKGPWGKMTVAERAEILHRVADGITARFGEFLEARMPGHRQAEVAGQPHRHSARRANFKVFADLLKNVANEAFEMATPDGAGALNYGVRRPKGVIGVISPWNLPLLLMTWKVGPALACGNCVVVKPSEETPLTATLLGEVMQAAGVPAGVYNVVHGFGGDSAGAFLTEHPDVDAYTFTGETGTGETIMRAAAKGVRQVSLELGGKNAGIVFADCDMDKAIEGTLRSAFANCGQVCLGTERVYVERPIFDAFVARLKAGAEALKIGEPNDPEANFGPLISHKPREKVPSYYQQAVDDGATVVTGGGVPEMPAHLAGGAWVQPTIWTGLADDSAVVTEEIFGPCCHIRPFDSEEEAIELANSLPYGLASAIWTENASRAHRVAGQIEAGIVWVNSWFLRDLRTAFGGSKQSGIGREGGVHSLEFYTELKNICVKL

SEQ ID NO: 85666 - protein, 317 aa, Bacillus subtilis subsp. subtilis str. 168
MSNQYGDKNLKIFSLNSNPELAKEIADIVGVQLGKCSVTRFSDGEVQINIEESIRGCDCYIIQSTSDPVNEHIMELLIMVDALKRASAKTINIVIPYYGYARQDRKARSREPITAKLFANLLETAGATRVIALDLHAPQIQGFFDIPIDHLMGVPILGEYFEGKNLEDIVIVSPDHGGVTRARKLADRLKAPIAIIDKRRPRPNVAEVMNIVGNIEGKTAILIDDIIDTAGTITLAANALVENGAKEVYACCTHPVLSGPAVERINNSTIKELVVTNSIKLPEEKKIERFKQLSVGPLLAEAIIRVHEQQSVSYLFS

SEQ ID NO: 85667 - protein, 248 aa, Burkholderia vietnamiensis G4
MYKLVLIRHGESTWNKENRFTGWVDVDLTEQGRNEAYQAGALLKEAGYTFDIAYTSVLKRAIRTLWHVQDKMDLMYLPVVHSWRLNERHYGALSGLNKAETAAKFGDDQVLVWRRSYDTPPPALEPTDERAPFSDPRYAKVPREQLPLTECLKDTVARVLPLWNESIAPAVRAGKQVLIAAHGNSLRALIKYLDGISDSDIVGLNIPNGVPLVYELDENLKPIQHYYLGDQDAIAKAQAAVAKQGKAG

SEQ ID NO: 85668 - protein, 264 aa, Thermobifida fusca YX
MIAIIGAGRMGEALLAGILHTGRDAAEVLISEAREDRAAELCQRYGVAAASPAEAAARADTLLLAVKPQDMVAALNEIAPALPPGRLVISVAAGITTAVLEKHLPAETAVVRAMPNTPALVGQGMTAIAAGTHTLEEHLDRAETLLRSVGEVVRVPEKHLDAVTALSGSGPAYFYLVAEAMIEAGVLLGLPRPTAERLVTQTAVGSAAMLRDSGDHPTLLREAVTSPGGTTAAALRELERHGLRSAFADAVEAACRRSAELAEG

SEQ ID NO: 85669 - protein, 601 aa, Haemophilus somnus 129PT
MTETTITFNDLGLPEFILNAVSEMGFSTPSPIQQACIPHLLNGHDVLGMAQTGSGKTAAFSLPLLAKIDTNEKYPQMLVMAPTRELAIQVADACEQFVKFSKGVRIVTLYGGQRYDIQLRALKQGAQVVVGTPGRILDHIRRGTLDLSNLQSIVLDEADEMLRMGFIDDVETVMAELPEQHQTALFSATMPAPIKRITKRFMHNPQEVKIQSTQRTAPDITQSCWYVRGFRKNEALLRFLEVEDFDAAIIFTRTKTATLDVTELLEKHGFRAAALNGDMTQQLREQTLDRLRNGSLDILVATDVAARGLDVERISLVVNYDIPLDAESYVHRIGRTGRAGRAGRAILFVEPKERRLLGNIERLMKKAIEEVEMPNHLALQECRRKNFVAKITKQLEHHDLEQYRSLLEDLFTADQDQEDIAAAMLMLLQGKQKLILPEDPVFEKHSRRNDRRERGERRGKENPRSERHGYGTPQPMDLYRIEVGRCDGVEVRHVVGAIANEGDIQSRYIGHIKLYDTYSTIELPQGMPKELLQVFAKTRVLNKQMRMSFVSAVNSEEEFEAGSGGKRKGRYEREFRGGRKFNEKSNRSFSEQRKERRERKR

SEQ ID NO: 85670 - protein, 202 aa, Brassica napus
MILANLPNDLESEILARVPAKSLQELKTTCKRWYTLFKDSKFVEKNKKLSSEAARETFLLSNHEVYSIAGDLHSSGDVAQPLEFTGKLSKDLDLYTISHCDGLMLCQAKNNSSVVVWNPCTGETKMIKPRTRYQIRDRFALGYDDSRRGYKILRFGYYQNEEKVWFVECEMYDLSSGSWRVVDSFTLDYRMYCSGVSLRGDT

SEQ ID NO: 85671 - protein, 198 aa, Shigella sp. K-319
TMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFSFQG

SEQ ID NO: 85672 - protein, 408 aa, Helicobacter hepaticus ATCC 51449
MKKQIYEKVIKAKQRLENVIIPSPLSYAPMLSLLAQADIYLKKENLQLTGAFKIRGAFNKIASLVEQSTHSQIQGVIAASAGNHAQGVAYAAKHFGIKAVIVMPEATPLLKVSATKALGAEVVLSGDNYDEAYAKALQVAKERDLVFIHPFADEEVIAGQGSIALEMIQECEDLNVVVVPIGGGGLISGIGSVYKQLYPNVRVIGVVASGADAMKRSFESGAIQKIESVRSIADGIAVRDVNEENFALVQECVDEIVSVDDEEIANAILFLIEKQKLVVEGAGAASVASILHKKFALTKQDKVALVLSGGNIDITLLNVIIEKGLLKSNRKMKLEVVLIDKPGSLQGLTNILSKVGANIVQIEYDRTSVMLKYGDALVTMALETKNEEHKVLIREQLQHYGYHFNEIN

SEQ ID NO: 85673 - protein, 193 aa, Bacillus clausii KSM-K16
MNIPIPYVMEQTRYGERSYDIYSRLLKDRIIFIGDEITDTLANSVTAQLLFLASTDPEKDISIYINSPGGSVSAGFAILDTMLYIKPDIQTICTGMAASFAAVLLVGGTKGKRCALPHAEVMIHQPHGGMKGQASDMDIYAQRILKQRKEINHFIAERTGQTPDKIATDSERDYFMSAAEAKDYGVIDNILPV

SEQ ID NO: 85674 - protein, 159 aa, Caulobacter crescentus CB15
MTDAATLSTAGFDLTPPTEAERERLEANLTAEEARVLLHHGTEAPFCGGLLGEKSPGVYGCRLCGLPLFKHETKFESGTGWPSFYAPFAEDHVVGVRDTSYGMVRIETRCARCDSHQGHVFPDGPAPTRLRYCINSVSLQFVKAGAPLPDPLHRGDKIT

SEQ ID NO: 85675 - protein, 231 aa, Acidobacteria bacterium Ellin345
MSIAENISGIRRRIETAAKHAARNPVEIALMAVCKTKPADAIREAYAAGQRLFGENRVQEFATKAPLLSGLSDARFHMIGHLQSNKSKAAAELFSAVDSVDSLKLAERLNAAARDLGKTLDILIEINVGGEEAKSGMPPESPEVLQILEHAKEWQNLRMRGLMTVPPFTEDPEGARPYFRTVRELRDSMALKGFALDQLSMGMSHDFEIAIEEGSTCVRVGTAIFGERPTP

SEQ ID NO: 85676 - protein, 583 aa, Oryza sativa Japonica Group
MSFGGAGSIPEEALHLVLGYVDDPRDREAVSLVCRRWHRIDALTRKHVTVPFCYAASPAHLLARFPRLESLAVKGKPRAAMYGLIPEDWGAYARPWVAELAAPLECLKALHLRRMVVTDDDLAALVRARGHMLQELKLDKCSGFSTDALRLVARSCRSLRTLFLEECSIADNGTEWLHDLAVNNPVLETLNFHMTELTVVPADLELLAKKCKSLISLKISDCDFSDLIGFFRMAASLQEFAGGAFIEQGELTKYGNVKFPSRLCSLGLTYMGTNEMPIIFPFSALLKKLDLQYTFLTTEDHCQLIAKCPNLLVLAVRNVIGDRGLGVVADTCKKLQRLRVERGDDDPGLQEEQGGVSQVGLTTVAVGCRELEYIAAYVSDITNGALESIGTFCKNLCDFRLVLLDREERITDLPLDNGVRALLRGCTKLRRFALYLRPGGLSDTGLGYIGQYSGIIQYMLLGNVGETDDGLIRFALGCENLRKLELRSCCFSEQALARAIRSMPSLRYVWVQGYKASKTGHDLMLMARPFWNIEFTPPSSENANRMREDGEPCVDSQAQILAYYSLAGKRSDCPRSVVPLYPA

SEQ ID NO: 85677 - protein, 210 aa, Brassica napus
FTNQQAPPGTFWQGSHNNNPGGVFPTTAPGLGVPEQPVYMIPPPSPTPHPGSVYHAPPQQPQGVMRPVVTGQVNQGGYYPYREQHQPAYSMTQPPVGVAKGQPQQQQQQQQAPLPFTSGPPPQPQYSAVPPPQQVVGLADTRAYTQVTYAGAMGKQVYYTEAPPPGPPQYHGIGFPVTGGMSGLRTGPDGKLVAMNMAPKVSSQNSDSAV

SEQ ID NO: 85678 - protein, 469 aa, Streptomyces avermitilis MA-4680
MSQTTTAVSGVSAPVSIGVRLDRMPITPMHRRLTAVIGIGLLFDTFENSLSGTIAKVLQGDFAFGATSLKLVLASVFVGQFIGSLVLGRVADRFGRRRAFLINLAIYSGFSLLGAFSPNAGWLIATRFLAGIGIGAEQALSDCYLADVLPAAKRGRFIAWAYTLAFCGVPAVGFAALWLVPLTPLGVDGWRWLFVIGALGSAVVWVLRRQLIESPRWLAATGRTAEADRLVSRMEAQAPAGRTAEDLPAPYEAPGAARVRLRDVFAPGLRRRTVMLWIFCALSVVGYYGFGTLAPQILAAKGFDIVAGLGFTALCFLGYPVGSALSLPVIDRVERKTLVAASAAAMVAAGMGFAFTDSPALIVAFGFGYTLCSNVFSSVSHVYLSEQYPTAIRATASGAAYSLSKLSAAALPFVLLPVLDSYGPGALFAVIAAAMAALAVTVLTLGERTTGASVDRAPVPVNIPTLKRS

SEQ ID NO: 85679 - protein, 314 aa, Picea sitchensis
MASEAQGSGNSFKPYKLKHILTGHKRAVSSVKFSADGKLLGSASADKSVRIWSAGDGSAKRELQGHAEGVSDMAWSSDSHYVCSASDDKTLRIWDVHTGDCIKTLKGHTNYVFCVNFNPQSNLIVSGSFDETVRIWDVRTGKCLKVLPAHSDPVTAVHFNRDGSLIVSSSYDGLCRIWDSATGHCLKTLIDDENPPVSFVNFSPNGKFILAGTLDNTLRLWNFATGKFLKTYTGHVNSKYCISSTFSVTNGKYIVSGSEDNCVYLWDLQARNIVQKLEGHTDTVISVSCHPTENKIASGALENDKTLRIWVQEN

SEQ ID NO: 85680 - protein, 219 aa, Clitoria ternatea
MATPWSLTAVEVDNVVFPPAVKPPSSADTFFLGGAGVRGLQIEDKFVKFTAIGIYLHDDALPFLAAKWNGKSDHELTESVEFFRDIVTGPFEKFMQVTMILPLTGQQYSEKVSENCVAIWKSLGIYTDAEAKAIDKFVSVFKDETFPPGSSILFTVSPKGSLGITFSKDGSTTTVIENKLLSEAVLESMIGKHGVSPAAKQSLASRLSGLFKAGGDTDK

SEQ ID NO: 85681 - protein, 283 aa, Mycobacterium avium 104
MNLDLSLAVDALPRPGETVLASSLRQAPGGKGGNQAVAAARAGARVQFVGAVGDDAAAGQLRAHLQANGVGLDGAVEIPGPSGTAIVVVDANAENTIVVAPGANGRFTLNDERARAVLAGCDVMLTQLEIPVATAVAAARHARSGGAVVVVNASPAGRDPDSLSELAAAADVVITNEEEASEWPWRPRHLVVTLGSHGARYVGADGEYSVPSPDVDAVDTTGAGDVFAGVLAANWPLEPGSPDQRRLALRRACAAGALATLVPGAGDCAPRAEEIERALRGKS

SEQ ID NO: 85682 - protein, 174 aa, Vitis vinifera
MTEYDPRLVAPTSLYLAAKAEESTVQARLLVFYVRKLNPDEKYRYEIKDILEMEMKILEALNYYLVVFHPYRALSQLLQDANLNDLTQLSWGIVNDTYKMDLILIYPPHLIALACIYIASVHKDKETTAWFEELRVDMNVVKNISMEILDFYDSHRTITEDRITTTFNKLALRS

SEQ ID NO: 85683 - protein, 504 aa, Mycobacterium avium 104
MSAPTDQATERVQALVGDGQLTRAQAGGKAWSIQHMLSLNIPVPPGFVLTTDVCREYHDRGRVLPAGVTRDIARAMENLESRSGRRFGHVDHPLLVSVRSGAAISMPGMMDTILNLGMNSSIEEALAAETGDARYAADTRHRFTEQFTRVVGVEPPENHWEQLDLAIRAVLESWNSKRALAYRRSHGIPDDGGTAVTVQAMVFGNLDDRSGTGVLFSRDPLSGAAQPYGEWLPRGQGEDVVSGRKDALHLDHLAATMPSVHRDLLAAAATLERHGRDMQDIEFTVQSGKLWLLQSRAAKRSPQAALRCAVQLQREGVISTKEALDRLTAEHVRALQRPTLDPAAVAASPPVASGKPASPGIATGLVVIDADEAEDLADKGRAVILARPTTDPDDVAAMSASVAVVTELGGSTSHAAVVCREMAVPCVVGCGMDSVTALAGRVVTVDADTGTVHLGELPVRPLLEADDEDLRTIERWLRDDLENYDPSYDVVALIERRQQRGATR

SEQ ID NO: 85684 - protein, 152 aa, Synechococcus sp. CC9311
MAAERSFIAIKPDGVQRGLVGEILGRFERKGFKLVGLKQLTPSRELAEQHYGVHKERPFFGGLVDFITSGPVVAMVWEGDGVITSARKMIGATKPLEAEPGTIRGDLAINIGRNVIHGSDAPETAEFEIGLWFNPSELSDWTPSDQTWRVEG

SEQ ID NO: 85685 - protein, 437 aa, Oryza sativa
  misc_feature (154)..(154): Xaa can be any naturally occurring amino acid
MGFVESIGRYRVGRTIGAGTFAKVRLAVDADTGATVAVKVIDKRMVIRNNLMYQVKREITAMKLLNHPNIVKIYEVIATKTKICLVMEYVSGGQLSDKLSYLKRLDEKEAKKYFYQLIDAVDYCHRRGVYHRDLKPENLLVDNQGNLKVSDFGXLSVLKKPGQFLSTSCGSPCYVAPEVIQHKSYDGAAADVWSCGVILFELLAGYLPFQDCSLTNLYRRISRAQFVFPQWLSVPQKKIIIRILDPSPITRAKISDIFDDKWLQDHCNPSARIENDDDCDVIEEASTDSDSSHNTEVKETEEMTAETDRFINAFQLIARCSDLDLSGLFQEQKTKLASPHPVQETFDKIKVAAKDVSMAVKRMNSSLVEIQDSKLLPRSNLDLTLSAEVIKVTPAHCVVEVSKSTGDLRSYKEFCRSLSSLLNGGQLSASSSDMECD

SEQ ID NO: 85686 - protein, 430 aa, Pyrococcus furiosus DSM 3638
MENPYEIVGVVAREILDSRGNPTVEVDVYTHVGMGRAAVPSGASTGTHEALELRDGGKRYHGKGVRRAVENVNKIIAPELIGMDVRWQREIDALLLELDGTENKSNVGANAILAVSLAVAKAAANSLELPLYQYLGGVNAYVLPVPLSNVINGGVHAGNDLDFQEFMIMPIGADSFREAIRWVSETYHVLKKVIMEKYGKNAVNVGDEGGFAPPMKEVTEPLDVLIKAIEEAGYKPGDEIALALDVASSELFNEETGKYVVGGKEYDRGELLELYKDLTSTYPIVSIEDPFHEEDWEGFVMITKELGHKVQIVGDDLFVTNPKRLRKGIELGAANALLLKVNQIGTLSEAMDAAFTAFRAGYGVIVSHRSGETEDATIADLAVALNAGQIKTGAPARSDRNAKYNQLIRIEEELEGVAVYAGKRFRKVFF

SEQ ID NO: 85687 - protein, 592 aa, Burkholderia vietnamiensis G4
MRVSFTLHGIPVSRGIAIGRAYLIAPAALDVAHYLIDTSQIDAEVERFRAAREGVHRELEALRADLTDDTPTEVGAFIDVHAMILSDAMLVQETIDLVRTRRYNVEWALTEQLELLTRHFDDIEDEYLRERKADIEQVVERVLKALAGAPSASQALDRAAAQGQNEMIVVAHDIAPADMMQFKSQSFQAFVTDLGGRTSHTAIVARSLGIPAAVGVQHASALIRQDDLIIVDGDQGIVIVDPAPIVLEEYSYRQSEKLLEQRKLQRLKFSPTQTLCGTKIDLYANIELPDDAKAAVEAGAVGVGLFRSEFLFMHQKQMPEEEEQFAAYKRAVEWMKGMPVTIRTIDVGADKPLEALDEGYETAPNPALGLRAIRWSLSEPQMFLTQLRAILRASAFGQVKILIPMLAHAQEIDQTLDLIREAKRQLDDAGLAYDPNVRVGAMIEIPAAAIALPLFLKRFDFLSIGTNDLIQYTLAIDRADNAVAHLYDPLHPAVLHLIAYTLREAKRAGVAVSVCGEMAGDPALTRLLLGMGLTEFSMHPSQLLVVKQEILRAHLKALEKPTADVLAAFEPEEVQAALQRLAVAEPRADAAA

SEQ ID NO: 85688 - protein, 470 aa, Vitis vinifera
MAEDRNGDLSEASDYTSEDEGTEDYRRGGYHAVRIGDTFKNGRYVVQAKLGWGHFSTVWLAWDTQKSKYVALKVQKSAKHYTEAAMDEITILKQIAEGDPDDKRCVVKLLDHFKHSGPNGQHVCMVFEYLGDNLLTLIKYADYRGTPLHMVKEICFHILVGLDYLHHQLSIIHTDLKPENVLLLSMIDPSKDPRKSGASLILPTSRDKIKIRRKAKRAAQDSNNDANSNGDSVEEQQNMNTDDVKDCKLVDFGNACWTYKQFTNDIQTRQYRCPEVILGSKYSTSADLWSFACICFELVTGDVLFDPHSGDNYDRDEDHLALMMELLGMMPRKIALGGRYSRDFFNRYGDLRHIRRLRFWPLNKVLTEKYEFSEQDANDIADFLVPILDFVPEKRPTAAQCLTHPWINAGPRLREPSIASLPKATDGGVSEKRERDEREAMEVGVGNIAIDGPSKSDKEPQSIQKLQKQS

SEQ ID NO: 85689 - protein, 158 aa, Candidatus Kuenenia stuttgartiensis
MLFGIGYDIHRLVENRKLILGGVSFDYHLGLLGHSDADVVIHAICDALLGAAALGDIGEYFPDTDEKWKDVSSSVILLKVVDLLKEGNFKINNIDVIILAQKPKIGLRKQEMRQYIAQLLHLNTNRVNIKATTMEGVDAIGRGEAIAAQAIAGLHENT

SEQ ID NO: 85690 - protein, 475 aa, Oryza sativa Japonica Group
MDQRGGAGGAAETHRVQLPDTATLSDVKAFLATKLSAAQPVPAESVRLTLNRSEELLTPDPSATLPALGLASGDLLYFTLSPLPSPSPPPQPQPQAQPLPRNPNPDVPSIAGAADPTKSPVESGSSSSMPQALCTNPGLPVASDPHHPPPDVVMAEAFAVIKSKSSLVVGDTKREMENVGGADGTVICRLVVALHAALLDAGFLYANPVGSCLQLPQNWASGSFVPVSMKYTLPELVEALPVVEEGMVAVLNYSLMGNFMMVYGHVPGATSGVRRLCLELPELAPLLYLDSDEVSTAEEREIHELWRVLKDEMCLPLMISLCQLNNLSLPPCLMALPGDVKAKVLEFVPGVDLARVQCTCKELRDLAADDNLWKKKCEMEFNTQGESSQVGRNWKERFGAAWKVSNNKGQKRPSPFFNYGWGNPYSPHGFPVIGGDSDMLPFIGHPNLLGRSFGNQRRNISPSCSFGGHHRNFLG

SEQ ID NO: 85691 - protein, 587 aa, Trichodesmium erythraeum IMS101
MELQNYLRRTKIVATIGPATIKPDVLRELIKAGATTLRLNFSHGTHEDHQNSIRLIRQTSFELNQTVAILQDLQGPKIRLGKFETGSISLEDGDPFILTSHLKLGTQKISSVTYEPLADEVPEGAKILLDDGKVEMLVEKVDKTEKELHCRVVVGGTLSNNKGVNFPGVYLSIKALTDKDRKDLMFGLDQGVDWVALSFVRNPQDVIEIKQLIANAGKKVPVIAKIEKHEAIEQMEEILALCNGVMVARGDLGVELPAEEVPLLQKRLISTSNRMGIPVITATQMLDSMVNNPRATRAEISDVANAIIDGTDAVMLSNETAVGKYPVEAVTTMATIAKRIEQEVITCNVSSMNDTGHSIPNAISHAVSQIAQELDAAAIMSLTKTGATARNVSKFRPKTPILAVTPHVDVARQLQLVWGVKPLLVLDLPSAGQTFQSAINVAQENELLVDGDLVVMTAGTLQGIAGSTDLIKVEVVTAVLGQGTGVGQGSVSGRARVARNSTEVRDFNHGEILVVNQTNAEFVEAMQKASGVVTEEDSVTSHAAVIGLRLGLPVIVGVKNATNVVRDGTILTLDAQRGMVYSGTNRR

SEQ ID NO: 85692 - protein, 479 aa, Pseudomonas aeruginosa UCBPP-PA14
MARIDMQTKLLINGALVAGESESHAVYNPSQGNVLVRITEASGAQVHAAVQSADAAFDAWSQTPPKDRAALLLKLAERIDAQAHVFARLEADNCGKPFNAVLLDELPAVSDVFRFFAGAVRCLQGSAAGEYVAGHTSMIRRDAVGVVASIAPWNYPLLMAAWKLGPALAGGNTVVLKPSEHTPLSTLKLGELLAEIFPAGVVNIVHGRGASVGEPLTSHAQVRMVSLTGSVRTGSRIIEGTAESVKRMHMELGGKAPVLIFDDADIDAAVEGIRAFGFYNAGQDCTAACRLYVQKGVYQEFVRKLGEAVSSIRCGLPDDPATEMGPLITKEHLERVEGFVNRARELPHIEVVTGGKRAEGAGFFFEPTVLAGATQEDEVVRREIFGPVVTVSSFEDEAQALAWANDSDYGLASSVWTADVGRAHRLAARLQYGCTWVNTHFMLVSEMPHGGVKLSGYGKDLSMYGLEDYTVVRHVMFKH

SEQ ID NO: 85693 - protein, 163 aa, Desulfovibrio vulgaris subsp. vulgaris str. Hildenborough
MEQNEFGLIEKIVYLNRVAKVVKGGRRFSFSALVVVGDGKGSVGFGLGKAQEVPEALRKATERAKKSMIEVPLIDGTLPYEILGRFGAGHVLLKPASKGTGIIAGGAVRAVMEAVGVTDVLTKAIGTNNPHNVLRATVAGLASLRSAEEVGQLRGKKLEAPRK

SEQ ID NO: 85694 - protein, 514 aa, Streptomyces avermitilis MA-4680
MRFQVAELAEIREQVHAGPGEKATAAQHAKGKLTARERIGLLLDEGSFHEVEPLRRHRATGFGLEAKRPYTDGVVTGWGTVQGRTVFVYAHDFRIFGGALGEAHAAKIHKIMDMAISAGAPLVSLNDGAGARIQEGVSALAGYGGIFQRNTKASGVIPQISVMLGPCAGGAAYSPALTDFVFMVRETSQMFITGPDVVKAVTGEEITQNGLGGADVHAETSGVCHFAYDDEETCLDEVRYLLSLLPGNNRETPPSVPSEDPPDRRCEALVDLVPVDGNRPYDMRQVIEEIVDDGEFLEVHERWATNIICALTRLGGQVVGIVANQPRSLAGVLDIEASEKAARFVQLCDAFSIPLVTLLDVPGFLPGVGQEHGGIIRHGAKLLYAYCDATVPRISLILRKAYGGAYIVMDSQSIGADLTYAWPTNEIAVMGAEGAANVIFRRQIAEADDPEAKRAELVKAYKAELMHPYYAAERGLVDDVIDPAETREVLISSLTMLRTKHADRPARKHGNPPQ

SEQ ID NO: 85695 - protein, 663 aa, Dehalococcoides sp. VS
MLNIQNLSKSFGVRSLYTGVNLNIGARDRLALLGPNGSGKTTLFEMIAGRLEADEGKIILRRGTTVGYLEQDIKPSSKQPLLKAVSSASDRLSSLSHKISLLQGELAEEKDGSENNRLLSELGELQHSFEALGGYNAEQEAKLILAGLGFKPADFDRPLHEFSGGWLMRAELAKLLFLSPDILILDEPTNHLDLESTRWFESYLKQYSGSVLFTSHDRAFLNSIATKILSLEDQKARLYSGNYDSYLRERELRLNQLESQARRQQELIDKETKFIERFRYKATKASQVQSRIKKLDKLSAVAIPRQTKKIHFNFPEPERSGHDVIKLRNLTKSYGDLVIYQGLELVLARGDKAALVGPNGAGKTTLLKILAGVMPFDSGYRNLGANVNTAYFAQYYVESLIPANNLIEELETVLPDAPEQQLRGMLGAFLFSGDDVKKRISVLSGGEKTRLAIAKMLLKPANLVLMDEPTNHLDIPAREILADALQAYKGTLCFITHDRTLIREVANKIIEVRNGKIRVFEGDYDAYLKFAAANPFEGEAPKSPAPVISHRPAPVPAALSQKQRKTLEGQIRNQHYKETGALKKEISDTEAEITNLEQRKQELETLLADPDLYRSGQKAADTSAEYKNCKEQLVTLGDKWLKLCQQNDALKQKLEDTLKALYN

SEQ ID NO: 85696 - protein, 259 aa, Desulfovibrio vulgaris subsp. vulgaris str. Hildenborough
MKKYRGIFIKNENEIGLLREANRIVASILDVLGEHVRPGVRTMHFEELAQKLCQEHGVKPAFQGYYGYPFALCCSVNEEVVHGFPSERILNEGDIVSFDMGVVYEGFYGDSARTFPVGKVSDEATRLMDVTRESLMKGIAQAKPGNSLYDISVAVQRHVESNGFQVVRRFVGHGIGRALHEKPEVPNFVPPGITGVPLKPGMVLAIEPMVTVGTYEVEILDDNWTAVTRDRKLSAHFEHSVAITNDGCEILSLSPGAVR

SEQ ID NO: 85697 - protein, 498 aa, Bacillus clausii KSM-K16
MSQVPTGENSLKTRLVSFLNGGSKKLLINGEWVDAVSGQTFETMNPATGDTLAIVAEAGQEDIDSAVKAARKAFDEGPWSKMSAAERSRLIYKLADLIEEHKEELAQLETLDNGKPIRETANADVPLAIEHFRYFAGWATKIVGQTIPVQGNYFNYTRHEAIGVVGQIIPWNFPLLMAAWKLGAALATGCTVVLKPAEQTPLSALYLGELINEAGFPKGVVNIVPGFGHSAGTAIVNHPAVDKVAFTGSTNVGKLIMKQASESLKRVTLELGGKSPNIILPDADLSKAVPGSLMGIMFNQGQVCCAGSRLYVQKKQYDHVVADLVSLTKKINQGDGLLEHTTMGPLISTQQQKRVKNYIDRGVEEGAELLAGGTIPYDQGYFVSPTIFADVDHSMTIAKEEIFGPVVAAMPFESVDDLIGKANDSDYGLAAGVWTQDIKKAHYIAHRIKAGTIWVNCYNVFDAASPFGGYKQSGIGREMGSYALDNYTEVKSVWVNMD

SEQ ID NO: 85698 - protein, 477 aa, Methylocystis sp. SC2
MSVQATHSGSARIDPRYDHAALAAARESDRFSLHTKHLNEMWVRVLKTIGYDVGFTRGLGPYLWDRKGDRYLDLLSGWGVFALGRNHPAVRDALVSVLDGELANLVQLDVSVLAGVLAEKLLGYAPWLEKVFFANSGAEAVEAAIKFARAATGRPGILHCAHSFHGLTYGSLSMNGDDIFKKGFGPLLPNAREVAFDDLDALERALAGRDVAAYFVEPIQGKGVNIPQEGYLLGAQALCRKYGTLFVADEIQTGIGRTGRFFAIDHYPGVEPDMIVVAKALSGGHVPVGAVLTRKWIFDKVFDRMDRAVVHGSTFSKNDLAMAAGVATLDVLKNERVIENAAKTGDRLLASFQRMAGGYELVADVRGKGLMIGVEFGPPKSFKLKAAWNLLETVNSGLFCQLISIPLFRDHKVLTQVAGHGNHTIKLLPPLTISDEDCDWIEQSFDAVIADAHKAPSAVWSLGKTLAEHAIKARMSG

SEQ ID NO: 85699 - protein, 127 aa, Zea mays
MESAVNPKAYPLADAQLTMGILDIIQQAANYKQLKKGANEATKTLNRGISEFVVMAADTEPLEILLHLPLLAEDKNVPYVFVPSKQALGRACGVTRPVIACSVTSNEGSQLKQQIQGLKDSIEKLLI

SEQ ID NO: 85700 - protein, 498 aa, Mycobacterium avium 104
MPKAQDWEETLADLQRRRQHAFDMGGPERLDKHRNKGKLDARARIEYLLDPGTFRELGTLVGGEIAADGLVVGSGEINGTPVMLGAEDFTTLAGSIGPGGNSKRYRIAELALRDKIPLVMLLEGAGFRPTGGHYGRTPTDLLAQAQCSGRVPTVAAVLGPSAGHGALVAPVCDFRIMSRQGAIFTAGPPVVKESTGEDISKEDLGGPDVALPSGVIHNVAENDEAVLDDVRRYLSYFPPSAWSYPPSLPAGDAAMPRPTPELLDIVSRDNRRVYDMRAVLDVVFDSPDWFEVQPQFGKAIICALAHLGGHPVAVVANQPQVLAGSIDADAADKAAHFIMVADSFHLPIVFLADNPGMLPGSRSERSGVLRAGARMFAAQTAATTLKLHVTLRKAYGFGSMVMSLLGFDHQVATFAYPGATMGAMSAAALSRASHAGEDLSTKLRNAELQASYRSAEHMGFDELIDPRETRDALLASLRRGLSSRQAAAEPVSRTVIMP

SEQ ID NO: 85701 - protein, 150 aa, Clarkia delicata
KGEVVNNHDELMSNFFAQPDALAYGKTPEQLKKENVSEHLIPHKTFTGNRPSLSILLPTLDAYRIGQLLGIYEHRVAVQGFVWGINSFDQWGVELGKSLATQVRKQLHASRVKGEPVEEGFNFSTKTLLTRYLQATSDVPADPSTLLPNI

SEQ ID NO: 85702 - protein, 474 aa, Rhodopirellula baltica SH 1
MKTARHELVILGGGPAGYVAAIRAAQLGIDVACIDDNPRFGGTCVRVGCIPSKALLESSHLYEEAQHKFADHGLNVSNVEVDLDVMMKRKEKIVESLTGGIDMLFDRRGVTAYHGRGRLRDVDSIEITPSEGAAEDQPTLVTADQIMLCPGSVPAQLPFVEEDGDRIGNSTTALSFPEVPEELVVIGGGYIGLELGSVWNRLGSNVIVLEAFDRIMPGLDKEMATLAHRSFKKQGMDIRTGTFVASAKVDPKPGDKKPCVIKIKNGETIRCDRVLLATGRAPATKSMGLEEAGVKLDERGFIQVNHQFETSVTGIYAIGDCIGGAMLAHKAMEEGIVCVEQMAGIASEMNYEVIPAIVFTHPEIAMVGKTEEELKEAGIEYNKGVCPLGANGRARTLGDIDGRVKILADAATDRVLGVHIIGPRAGDMIAEAAAAMEFGASSEDIARTCHAHPTLSEAVHEAALAIDDRAIHTA

SEQ ID NO: 85703 - protein, 429 aa, Clarkia delicata
AAHLKQKIDRMNNGDHINSTENRSVLHVALRAPRNSVICSDGKNVVPDVWNVLDKIKDFSERVRNGSWVGATGKELKDVIAVGIGGSFLGPLFVHTALQTDPEASKNARGRELRFLANVDPIDAARNISGLNPETTLVVVVSKTFTTAETMLNARTLREWISSALGVSAVAKHMVAVSTNLPLVEKFGIDPNNAFAFWDWVGGRYSVCSAVGVLPLSLQYSFAVVEKFLQGAHSIDQHFSSAPFEKNIPVLLGLLSVWNVSFLGYPARAILPYSQALEKLAPHIQQVSMESNGKGVSIDGLPLPFESGEIDFGEPGTNGQHSFYQLIHQGRVIPCDFIGVVKSQQPVYLKGEVVNNHDELMSNFFAQPDALAYGKTPEQLKKENVSEHLIPHKTFTGNRPSLSILLPTLDAYRIGQLLGIYEHRVAVQG

SEQ ID NO: 85704 - protein, 527 aa, Arabidopsis thaliana
MHSSHLLLEEPIRMASILEPSKSSFFPALTKIVGTLGPKSRSVEALSGCLKAGMSVARFDFSWGDADYHQETLDNLKVAVRSTKKLCAVMLDTVGPELQVINKSEKAITLKADGLVTLTPNQDQEASSEVLPINFNGLAKAVKKGDTIFVGQYLFTGSETTSVWLEVDEVKGDDVICLSRNAATLAGSLFTLHSSQVHIDLPTLTEKDKEVISTWGVQNKIDFLSLSYCRHAEDVRQTREMLKKLGDLSQTQIFAKIENVEGLTHFDEILQEADGIILSRGNLGIDLPPEKVFLFQKAALYKCNMAGKPAVLTRVVDSMTDNLRPTRAEATDVANAVLDGSDAILLGAETLRGLYPVETISTVGRICAEAEKVFNQDLYFKKTVKYVGEPMTHLESIASSAVRAAIKVKASVIICFTSSGRAARLIAKYRPTMPVISVVIPRVKTNQLKWSFSGAFEARQSLIVRGLFPMLADPRHPAESTSATNESVLKVALDHGKHAGVIKSHDRVVVCQKVGDASVVKIIELED

SEQ ID NO: 85705 - protein, 80 aa, Clarkia delicata
KGEVVNNHDELMSNFFAQPDALAYGKTPEELKKENVSEHLIPHKTFTGNRPSLSILLPTLDAYRIGQLLAIYEHRVAVQG

SEQ ID NO: 85706 - protein, 172 aa, Ralstonia eutropha JMP134
MADKAKRKDSDKEKKAVKSASDRIEVRQSGVHGKGVYAIAPIAEGERVIEYKGEHISWKKALDRHPHDPNDPNHTFYFSLDDGSVIDAKFGGNRARWINHACTPNCEAREKKGRVFIHALRDIATGEELFYDYGLVIDARYTKKLKKEFECRCGSPDCRGTMLAPKGKTSSK

SEQ ID NO: 85707 - protein, 249 aa, Pseudomonas fluorescens PfO-1
MSNRLEGKIALITGGTTGIGLASAQEFVAQGATVFITGRRQAELDKAVAAIGPRAIGIQGDVAKLEDLDRIYSEISAKAGHLDILFANAGGGDMLPLGSITEEHFDRIFDANVKGTLFTVQKALPLLRDGASILLTSSTTSVQGTENFSVYSASKAAVRNFARSWLLDLKPRRIRVNAISPGPVRTPGLAGLVPAEHTQGLFDQLASIVPIGRLGEPSEIAKAALFLASDDSSFVNGIELFVDGGTAQI

SEQ ID NO: 85708 - protein, 420 aa, Oryza sativa Japonica Group
MGGRKRALLVGINYPGTKAELKGCHNDVARMRRALVDRFGFDEADIRVLADADRSAPQPTGANIRRELARLVGDARPGDFLFFHYSGHGTRLPAETGQDDDTGYDECIVPSDMNLITDQDFTELVQKVPDDCLFTIVSDSCHSGGLLDKTKEQIGHSTKQNQAQQIKREERSDSGTGGFRSFLKETLKETVRDAFESRGVHIPHQSSRRNDDEDEEPHMGSSSHGGDRIKNRSLPLSTLIEMLKEKTGKDDIDVGSIRMTLFSLFGDDASPKIKKFMKVMLTKLQEGQHGGVMGLVGALAQEFMKAKLEGNQEADALEPAMKQEVHSVHEAYAGTTARVSNGVLISGCQTDQTSADATTPKGVSYGALSNAIQTILSEKSGRVTNKELVLRARELLSKQGYTQQPGLYCSDKHTSVAFIC

SEQ ID NO: 85709 - protein, 141 aa, Sulfurospirillum multivorans
HSECLTGDALGSLKCDCGEQLEFALQNISLLGGMIIYLRQEGRNIGLFNKVNAYALQDQGFDTIEANHQLGFKSDERSYEVVETILEHFKIDKIRLLTNNPKKMSCLKNIMIIERWPIIIPSNNHNVDYLKTKKEMMGHLL

SEQ ID NO: 85710 - protein, 107 aa, Candidatus Phytoplasma solani
MSTNKIINYQGQDFKDFINQKGLVLVDFFANWCGPCRKLAPILNELSQSEQGVVIVKVDIDEFRQLAIDHQVTHFPTLVLYKNQQEVARQVGFLEKPALLSFLKAHK

SEQ ID NO: 85711 - protein, 234 aa, Glycine max
MLTVYAPRAVLKCHLHQDSASSQQPYSYPCKINNNVHLVNCNPKPFGTPCTNISFHSSSFSGKCDKLQKSLHLFHHVATHKWLCGLQDSISSDDEYRSSRNIAISLFRRYRNFIDRGGGDNLKEFITAGVNAYALGCTDEGLRKELVDMKNSGIEIDVMQSYGGSTSLKSKIISEEVDECILWLSIIFITILCTPQPTIVRWSSTTPVSDEVRLQWKGFCALIANAYFMKGMAW

SEQ ID NO: 85712 - protein, 711 aa, Burkholderia vietnamiensis G4
MNSTASPAPARAGCVTHERRDALLVVTIDHPPVNALSADVRRGLADALDAAQADHAVRAVLIVGAGRNFIAGADIREFGKPPVPPSLPDVCERIESSAKPVVVALHGATLGGGLEVALAAHYRLALPGAKLGLPEVTLGLLPGAGGTQRTPRLIGAKAALDLMLTGRHASAEEARALGLVDRVARSDDTLAEGLAYAQELVSLGAPVRRTRDAQGLAERTAAQAALAAARAELPKKSRGLFSPAKIVDAVEAALTLSFDAGMKLERSLFLQCLDSPQRAGLVHAFFAEREAAKAPEARRASARAVERVGVVGGGTMGAGIAVAALDAGLPVTMIERDDASLARGRAHVEKVYDALVAKGRMTPDARAARVARLDGSTRYDALAQADVVIEAVFEDMAVKQAVFAELARVCKPGAVLATNTSYLDIDALAAGIDRPTDVIGLHFFSPANVMKLLEIVVPKRVSAEVVATAFALARQLKKTPVRAGVCDGFIGNRILAVYRTAADYLMEDGASPYQIDRAVRGFGFPMGPFQVVDLAGGDIGWATRKRRAATRDPRARYVEISDRLCERGWFGQKSGRGYYLYPDGARVGTPDPEVDAIVAAERAKKGIVPRSFSDDEILRRYLAAMINEGANVVHERIALRPLDVDAVFLYGYGFPRHRGGPMHYADTVGLANVLADIRAFANEDPLFWRPSPLLVELVERGADFASLNRID

SEQ ID NO: 85713 - protein, 358 aa, Oryza sativa Japonica Group
MSAYCGKYKDELIKNAAYIGTPGKGILAADESTGTIGKRFASINVENVEDNRRAFRELLFCTPGALQYISGVILFDETLYQKTKDGKPFVDVLKEAGALPGIKVDKGTIEVAGTDKETTTQGHDDLGKQCAKYYEAGARFAKWRAVLKIGPNQPSQLAIDLNAQGLACYAIICQENGLVPIVEPEILVDGPHDIDRCAYVSEVVLAACYKALNEHHVLLEGTLLKPNMVTPGSDAKKVAPEVIAEYTVRTLQRTVPPAVPAIVFLSGGQSEEEATLNLNAMNKLSAKKPWSLSFSFGRALQQSTLKAWAGKTENVEKARAAFLVRCKANSEATLGTYKGDAVLGEGAAESLHVKDYKY

SEQ ID NO: 85714 - protein, 630 aa, Burkholderia vietnamiensis G4
MSDPIRPPSRPRTPVAALAGLAFVALVAFSAGCTSPSASSGAVVPVAAASGGAVPLPGVQAPEPSSGWTDKPGWTAQHFMIAAANPLAAQAGYDMLKAGGTAIDAAIATQMVLGLVEPQSSGLGGGAFMLYFDGNATQAYDGRETAPAAATERLFYGPTGQPLSFYDGVVGGRSVGTPGVLRMLDAAHRAHGKLPWRRLFQPAIRLAERGFTISPRLAMLIANDKYLMNDPVARAYFYNPDGTPKAAGTVLKNPALAAVLRQIAERGANAFYTGPIARDIVAKVRRHPTNPGLLTLQDLARYKAKVRAPLCTDYRRSVVCGMPPPSSGGLAIAQMLGILEAMPDWQQIGAQKPVRNDVGYEPTPFAAHLFSEAGRLAYADRARYVADPDFAPLPGGSWASLTDKAYLAQRARLVGETSMGVAQPGTPQGAMLALADDRSAELPSTSDIAIIDRYGHALSMTTSVEDAFGSRLMVRGFMLNNQLTDFSFVPSEHGRPVANRVQPGKRPRSAMSPELVFDQKTRQVTMIVGSAGGPAIINHVAKTLIGVMDWGMTMQQAIALPNFGSMNGPTQLERGRVSDALVDGLKGRGHDVRVVEMNSGLQGIQRLNVQGQTVWFGGADPRREGVALGE

SEQ ID NO: 85715 - protein, 646 aa, Zea mays
MEAALSFSKDSPPISIICAAKIVGLPLTINHSLAAGSAPTLQFASGESLHGVNPIILYIARGASIASLSGKNDIEFGHVVEWLEYAPTFLSGSEFENACLFVDGFLASRTFLVGHGLTIADIAVWSNLAGIGQRWESLRKSKKYQNLVRWFNSIDSEYKEALNEVVAAFVGKRGIGKSPAPSLKEKVHDSKDPSAPEVDLPGAKVGKVCVRFAPEPSGYLHIGHAKAALLNKYFAERYQGRLIVRFDDTNPSKESNEFVENLLKDIETLGIKYDAVTYTSDYFPKLMEMAESLIKQGKAYIDDTPKEQMRKERMDGIESRCRNNTVEENLSLWKEMVNGTERGMQCCVRGKLDMQDPNKSLRDPVYYRCNTDPHHRVGSKYKVYPTYDFACPFVDALEGGASKNLNLMEWDKLWTINKKIIDPVCARHTAVLKDQRVIFTLTNGPEEPFVRILPRHKKFEGAGKKATTFANRIWLDYADAAAISKGEEVTLMDWGNAIVKEIKVESGVITELVGELHLEGSVKTTKLKITWLADIEELVPLSLVEFDYLISKKKKDSLFLGKLMLNYSVGGIWQLEEDEDFLDNLNPCTRREIPALGDANMRNIKRGEVIQLERKGYYRCDAPFIRSSKPVVLFAIPDGRQQASLS

SEQ ID NO: 85716 - protein, 289 aa, Oceanicola granulosus HTCC2516
MPADFDAALAAARDAVAARLAARPRGVSGPLEAASDYALEGGKGLRAFLVLEGARLCGLAPGAALGAAAAIECVHAYSLVHDDLPAMDDDDIRRGRPTVHKAWDEATAILVGDALQALAFEEVLACDAPPERLVALARGLAEAAGARGMVAGQMLDIAAESAVAPMTLADVERIQSHKTGALIVWSATAGAHLAGADPAPFARYGAALGLAFQIADDLLDATGDAAEVGKAVDKDAAAGKATFVSLQGVAAAKGRAEELVEVACNVLSPFGEQAATLREAARFVIARRK

SEQ ID NO: 85717 - protein, 637 aa, Oceanicola granulosus HTCC2516
MTDRPPTPTLDKVHLPADLRRLSDGELHKLAHELRAETISAVSETGGHLGAGLGVIELTVALHAVFETPRDKLIWDVSHQSYPHKILTGRRDRIRTLRQKDGLSGFCKRSESPYDPFGAAHSSTSISAALGFAAARDLGGDAGDAIAVIGDGAMSAGMAYEAMNNAGHLGKRLIVILNDNEMSIAPPVGAMSSYLSRLYAGAPFQELKAAAKGAVSFLPPPFQQGAKRAKEMLKHLAVGGTLFEELGFSYVGPIDGHDLEQLLAVLRTVKARADGPILIHAITRKGKGYAPAEGAADKGHGVSKFDVITGEQKKAKSNAPSYTSVFAKALIAEAARDDKVVAVTAAMPDGTGLKSFMERYASRCFDVGIAEQHAVTFAAGMAAGGMKPFCAIYSTFLQRGYDQVVHDVAIQRLPVRFAIDRAGLVGADGATHAGAFDVAYLANLPGFTVMAAADEAELVRMVATAAAHDDGPIAFRFPRGEGVGVEMPADPQPLEIGKGRIVREGSRVAILSFGTRLQEAETACERLAGRGITPTLADARFAKPLDEELILRLAREHDALITLEEGAIGGFGSHVAQLLAEKGVFDGGLAYRSMVLPDIFIDQASPRDMYDVAGLNAEHIEQKVLEALGVNLLSRRA

SEQ ID NO: 85718 - protein, 295 aa, Alteromonadales bacterium TW-7
MSIKDYIERAQIDVATTLNSYFEQPLDSDKTIKEATHYSLFNGGKRLRPFLVYAVGEMLGAKKSDLDVLAAAIECIHSYSLVHDDLPAMDDDDLRRGYPTCHIVYGEAQAILAGDALQTLAFELIATHNFNCSAQSQVKMIAALAHASGIEGMVAGQGLDIAATDKVVSVQELERIHKLKTGALINCAITLGALCSEKADEQTLENLSVFGYAIGLAFQVHDDILDVEGDTFILGKPQGSDIEANKATYPALLGMLGAKEKAQNLITQAHEALALIDADTTLLASLANYLIERDH

SEQ ID NO: 85719 - protein, 245 aa, Triticum monococcum
ELCVSAGPCGGTAVRHGTANGGGVGTPRPPSMVPGRVPPPPMYRPKPMQPPPGRRRSGRGWCCACCLWLTLVLVGLVFLGAIALGVFYVIYHPELPTFVVTSLRLAALNVSDSDSVTSRIEFTVTARNPNEKIVFVYGDIGAAFAADGTDIGDGTVSGFLHPSRNTTVIKGSASAAAATVDPVQAASLRSKKSHAMSVEMDSKVGFQIGQFKSKRISVRVLCGGFSAGLAKPAPSPAPISLGRRE

SEQ ID NO: 85720 - protein, 620 aa, Alteromonadales bacterium TW-7
MTLDSSKYPLLNLVDKPAQLRDLAQDKLPEFSNELREYLLNSVSQSSGHLASGLGTVELTVALHYVYNTPEDRVVWDVGHQAYPHKILTGRRDQMHTIRQKDGLHPFPFRDESDYDTFSVGHSSTSISAALGMSIAAQKEGTGRKTVAVIGDGAITAGMAFEAMNHLGDVKSDMLIILNDNEMSISENVGALTNHFARILSGSFYTNIREGSKKLLSGVPPVKELASRMEEHLKGMVIPGTFFEELGLNYIGPIDGHDVNMLVDTLRNMRNLKGPQLLHIKTQKGKGYKPAEADPIGYHGVPKFDPNTSSLPKSKPGAPTFSKVFGDWLCDMAQQDDKLMAITPAMREGSGMVRFSKEHADKYFDVAIAEQHAVTLAAGFACEGLKPVVAIYSSFLQRAYDQLIHDVALQNLPVLFAIDRAGIVGADGETHQGAYDLSFMRCIPNMVIMAPSDTNECRQMLYTGYKANCPVAVRYPRGSAGTADIQSDMQLFEIGKANTIKEGSKIAILSFGTLLENAQLAANELNATLVNMRFIKPLDTSLLNDIIKNHDVIVTLEDNAIAGGAGSAVNEYLASQQANVKILNLGIPDEFIKHGTQDEMHDEMGLGEQGILSSIRSFTA

SEQ ID NO: 85721 - protein, 138 aa, Arabidopsis thaliana
  misc_feature (2)..(3): Xaa can be any naturally occurring amino acid
  misc_feature (12)..(13): Xaa can be any naturally occurring amino acid
  misc_feature (51)..(51): Xaa can be any naturally occurring amino acid
  misc_feature (63)..(63): Xaa can be any naturally occurring amino acid
  misc_feature (67)..(67): Xaa can be any naturally occurring amino acid
  misc_feature (78)..(80): Xaa can be any naturally occurring amino acid
  misc_feature (82)..(83): Xaa can be any naturally occurring amino acid
  misc_feature (85)..(85): Xaa can be any naturally occurring amino acid
  misc_feature (90)..(91): Xaa can be any naturally occurring amino acid
  misc_feature (93)..(94): Xaa can be any naturally occurring amino acid
  misc_feature (100)..(101): Xaa can be any naturally occurring amino acid
  misc_feature (104)..(105): Xaa can be any naturally occurring amino acid
MXXSMVSSAAVXXSPAQATMVAPFTGLKSSAAFPVTRKTNKDITSIASNGXRVSCMKVWPPIXKKKXETLSYLPDLSXXXLXXEXDYLLXXKXXPCVEFXXQHXXALLTPPYCPLMIPFLCPSFVITLPQCISSPPSP

SEQ ID NO: 85722 - protein, 434 aa, Candidatus Kuenenia stuttgartiensis
MELIEKIKSKKSHIGIIGLGYVGLPLVIEFCKAGFQVTGFDIDPEKVTLLHQGKSYIKHISSSLLTPHFSQFTPTTDFSQLLAMDCIIICVPTPLNKYREPDMSYVFNTTKTIAGNLRKGQLIVLESTTYPGTTDEDMRPMLEESGLKTGEDFYLAFSPEREDPNNKDFSTRTIPKVVGGYTKNCLTVAQALYDSVVVKTVPVSSTRVAEATKLLENIYRSVNIALVNELKMLFDRMGIDVWEVIEAAKTKPFGFQAFYPGPGLGGHCIPIDPFYLTWKAREYEFSTRFIELAGEINTNMPYYVVQKTVEALNENGKSIKGAKILILGLSYKKDIDDTRESPSLKIMDLLGEKDAHVDYNDPYIPVIPKTRKYSFNNCSVPLHAETLAKYDAVVIATEHADYDPDFILKNSQLIVDTRNLIKNHTNHSDKVKRA

SEQ ID NO: 85723 - protein, 425 aa, Coccidioides immitis RS
MAYQRYGTSNIRACDSYFVESYDNDYQPSRVCPKEHAKIIARERQYAMGDEMTKAVREEYQEDIIAHMHLMDSATLPDVDSIDIQTEIQWFMRPYLLDFLIEAHAAFQLLPGTLFLTVNLLDRYCSKRVVYKRHYQLVGCAALLIAAKYSDKKERVPTIKELKSMCCSLYDDDMFVQMEWHVLQTLGWSIGHPTVDGFLQVAVMDTPYDPEVEHLALYILEIALFHREFVSKLSADLSRAALALSRCILNRPQASHNDWASNYDSLTLVNLSQHLFQPSHVLARKYSSAHYSRVSKILEQFLARQSTVTKSYNPPTPPTDRAEDSKPYEGEIGLATPQKSHCPRTMTNGYITPPITPENDAFAPTSNANPSKDASGLLYVCPTSPTPQQAMHYGQTHHYKLQETDPYSQHQRFPQQPSVPYNSVF

SEQ ID NO: 85724 - protein, 153 aa, Magnaporthe grisea 70-15
MSTEQTFIAIKPDGVQRGLVGPIISRFEQRGYKLVAIKLVTPGKAHLEQHYADLKDKPFFAGLVEYMNSGPIAAMVWEGRDAVKTGRTLLGATNPLASAPGTIRGDYAIDVGRNVCHGSDSVENAKKEIALWFKEGEVVSYQASQASWIYEKP

SEQ ID NO: 85725 - protein, 201 aa, Desulfovibrio vulgaris subsp. vulgaris str. Hildenborough
MPVPIVIESTGRAERAYDIYSRLLKDRIVLLGTPIDDQVASLICAQLLFLESENPEKEIHMYINSPGGSVTAGMAIYDTMQYINSPVSTLCMGQAASMGALLLAAGAPGLRFSLPHSRIMIHQPSGGFQGQATDIDIQAREVLRLKQSLNAIMSQHTGKPLEQVALDTERDYFMGPEEAQAYGLIDRVLTSRSEATDTISK

SEQ ID NO: 85726 - protein, 333 aa, unidentified eubacterium SCB49
MILKVGLLGGGSWGTTVASLTAKNTDTLLWARNEETVNEINEHHTNSQYLPGAQLNKNLKASTSIQEVVENADVLIMGVPSQHFRNVLREAKPFIRPWIPIVSLAKGLELGTKMRMTQIIEEELPGHPAGVLTGPNLAKEIHNGQAAAAVISMVDKTIGKKLQGVFNSGLFRVYTNTDVIGCELGGALKNIMAIATGMGDGANAGDNTRAALITRGLSELTRLGTAMGGKRRTFAGLAGMGDLVATCSSSQSRNHHVGFQLGRGKSLDQIIEEMNEVAEGVKTAKAVMELAADYNVDMPISREVYKVLYEGNTVNDAFIGLIKLESGSEQEPG

SEQ ID NO: 85727 - protein, 696 aa, Silicibacter sp. TM1040
MSDPVLLEITDDIAVIAIANPPVNALSHSVRQGLDAAFDEIARRDDVKAAVIYGTDRTFIAGADIREFGKPPQEPFLPDLINRIEACAVPVVAALHGTALGGGLEVALGAHYRIAVPSARFGLPEVTLGILPGAGGTQRLPRLAGVEFALEAITSGRQIGAEEALAAGVIDRISDTADIREMGLSYARELIASGAQPRRTSDIAPEPVSPDVFEQARAKLAKKARGQLAPQNCVKAVEGALSLPFAEGLANERALFQELMESDQRAALIHAFFAERQVAKVPEINGVEPRAISRIGVIGGGTMGAGIAVSALLAGLQVTLIERDAEAVSRAETNVAKILQGSVKRGKLTQEKFDAIMREAFEASAEYATLATADVVIEAVFESMEVKKEVFTKLDAICKPGAVLASNTSYLDVNEIAAMTTRPQDVIGLHFFSPAHVMRLLEIVVADETAPDVTATGFALAKRLKKVAVRAGVCDGFIGNRILSHYRKAGDGAVLAGASPFEVDRALVNFGLAMGPYAVSDLAGLDIGWATRKRLAPTRDPREVYAEFVDRLCEAGHLGRKTGKGFYVYDDGGQTPNAEVLDHIAEERAAKGIAAREIPEQEIVDRYMAAMINEAARVVEEGIALRPLDVDVTLLNGYGFPRWRGGPMQYADTVGLEKVLADIERFAQEDDFLWQPAPLLKRLVAEGKTFADLNNA

SEQ ID NO: 85728 - protein, 527 aa, Clarkia delicata
VEFDNIFLDYSRQQASPDTISKLYKLADAAHLKQKIDRMYNGDHINTTENRSVLHVALRAPRNSSICSDGKNVVPDVWNVLDKIKDFSDRVRNGSWIGATGKELKDVIAVGIGGSFLGPLFVHTALQTDPEASKNARGRELRFLANVDPIDVARNISGLNPETTLVVVVSKTFTTAETMLNARTLREWISSALGPSAVAKHMVAVSTNLPLVEKFGIDPNNAFAFWDWVGGRYSVCSAVGVLPLSLQYGFAVVEKFLQGAHSIDQHFSSAPFEKNIPVLLGLLSVWNVSFLGYPARAILPYSQALEKLAPHIQQVSMESNGKGVSIDGLPLPFESGEIDFGEPGTNGQHSFYQLIHQGRVIPCDFIGVVKSQQPVYLKGEVVNNHDELMSNFFAQPDALAYGKTPEELKKENVSEHLIPHKTFTGNRPSLSILLPTLDAYRIGQLLAIYEHRVAVQGFVWGINSFDQWGVELGKSLATQVRKQLHASRVKGEPVEEGFNFSTKTLLTRYLQATSDVPADPSTLLPNI

SEQ ID NO: 85729 - protein, 551 aa, Mycobacterium avium 104
MSSGGENTRRAEPVEPRGTAVLDSAHLGDIEGAFGRIRVGETEHARTWKTRLLTLLAIVGPGIIVMVGDNDAGGVATYAQAGQNYGYSLLWVLLLLVPVLIVNQEMVVRLGAVTGVGHARLINERFGRGWGWFSVGDLFLLNFLTIVTEFIGISLAAEYIGVSKYVVVPVSAVALVAIMASGSFRRWERAMFIFIAITLLQIPMLLMSHPQWGRAAKSFVVPSISGGVSSDAVLLIIAIVGTTVAPWQLFFQQSNVVDKRITPRFMGYERADTVLGAFVVVIGAAALVMTGDWAARSTDTVGGFTDAGATAHLLGQHRQVLGSIFAIVLMDASIIGAAAVTLATSYAFGDVFGLKHSLHRGFADAKQFYLSYTAMVVVAAAIVLIPGAPLGLITTAVQALAGLLLPSASVFLLLLCNDREVLGPWVNRAWLNWVAGLIVGTLLLLSGILMATTLFPDLNVVAVAGYLTLALIILAAGAAPVLRWLARRQPARPGPRLPARGVDRSTWRMPPLTLLEPVTWSPGTRLAMIALRGYLVVGALLLVVKAIQLSR

SEQ ID NO: 85730 - protein, 455 aa, Photorhabdus luminescens subsp. laumondii TTO1
MTTSRSVLDMIGNTPLLELTHLNTGPCQLFIKLENQNPGGSIKDRVALSMIEQAEEQGLLQSGGTIIEATAGNTGIGLALVAALKGYKLILVVPDKMSREKVFHLRALGTDVRLTRSDVSKGHPEYYQDYALRLAQEIPGAYYIDQFNNPANSAAHTTTTGPEIWQQMDHNVDAVVIGVGSGGTLGGLSHYFAQVSPETEFVLADPTGSILVDYIEHGKYGEAGSWQVEGIGEDFVPPLGNFSRVHHAYRVSDAEAFSSARDLLLKEGVLAGSSSGTLLAAALRYCRAQTTPKRVVTLACDSGNKYLSKMFNDYWMLEQGFQSRVQQHDLSDYITYRYQDGATVFISPEDTLKTAHTRMRLYEISQLPVLKEEQVVGIIDEWDLMHTVQADPRNFSLPVSHAMTHQVRTLDKNDSLQQLMATFDAGHVALIVDNGRFLGLVTRTDVLNAWRQQLN

SEQ ID NO: 85731 - protein, 484 aa, Rhodopirellula baltica SH 1
MSHTIVIFGASGDLTSRKLVPALFRLFSRGRLPDSTRIVGVSRSPYEHSEWRKSLRETTAKFVGKSFSEEAWESFAPNIYYQPGDIKDAESFQSLATFLDEIEEGKSTGRVYYLSTMPQLYEEAIQQLGAAGLACDKTGPRRVIIEKPFGTDLKTAQRLNESIHNVFREDQIYRIDHYLGKETVQNIFALRFANSIFEPLWNRNYIDHVQITVAEEVVIGRRAGYYDNSGILRDMFQNHILQLMMITAMEPPAKFDAALVRDEKVKVLHSVRKMTGGDFASQTVRGQYDGYLQEEGVPANSQTETFAALKLYCDNWRWQGVPFFLRSGKGMSCRTTQIVIQFKNVPHQLFGGSKKENKLGNRLVIQVQPAEGIQLHFETKVADAGMKTRTNHLDFNFQDSIGGQEMPDAYQRLLLDAVQGDASLFARGDEVELAWSIIDPIIEAWRSPAAPPLHTYQTGLWGPEECSQWLFDQKREWFDVCPVI

SEQ ID NO: 85732 - protein, 80 aa, Clarkia delicata
KGEVVNNHDELMSNFFAQPDALAYGKTPEQLKKENVSEHLIPHKTFTGNRPSISILLPTLDAYRIGQLLAIYEHRVAVQG

SEQ ID NO: 85733 - protein, 464 aa, Streptomyces avermitilis MA-4680
MQFHDSMISLVGNTPLVRLNSVTAGIQATVLAKVEYFNPGGSVKDRIALRMIEAAEESGALQPGGTIVEPTSGNTGVGLAIVAQQKGYKCIFVCPDKVSTDKINVLRAYGAEVVVCPTAVDPEHPDSYYNVSDRLVRETPGAWKPDQYSNPNNPLSHYHSTGPELWEQTEGKITHFVAGVGTGGTISGTGRYLKDASEGRVQVVGADPEGSVYSGGSGRPYLVEGVGEDFWPTAYDRTVADEIVAVSDKDSFQMTRRLAKEEGLLVGGSCGMAVVAALRVAERLGPDDVVVVLLPDSGRGYLSKIFNDEWMADYGFLEDSGPSARVADVLSDKAGGSIPSLVHMHPDETVGEAIEVLREYGVSQMPIVKPGAGHPDVMAAEVVGSVVERELLDALFTQRASLQDPLEKHMSAPLPQVGSGEPVGDLMSVLGTADAAIVLVEGKPTGVVSRQDLLSFLAKGGGKQ

SEQ ID NO: 85734 - protein, 113 aa, Zea mays
MATAPRRLLPALLKALAPAGARGLSTEKAVGAAAAAAVAVVGSHTAKWMQDTSKKSPMELINEVPPIKVDGRIAVCEGVAEGVGHPIEYICLDLEAPNVCKYCGLRYVQIHHH

SEQ ID NO: 85735 - protein, 308 aa, Bacillus subtilis subsp. subtilis str. 168
MVRVANSITELIGNTPIVKLNRLADENSADVYLKLEYMNPGSSVKDRIGLAMIEAAEKEGKLKAGNTIIEPTSGNTGIGLAMVAAAKGLKAILVMPDTMSMERRNLLRAYGAELVLTPGAEGMKGAIKKAEELAEKHGYFVPQQFNNPSNPEIHRQTTGKEIVEQFGDDQLDAFVAGIGTGGTITGAGEVLKEAYPSIKIYAVEPSDSPVLSGGKPGPHKIQGIGAGFVPDILNTEVYDEIFPVKNEEAFEYARRAAREEGILGGISSGAAIYAALQVAKKLGKGKKVLAIIPSNGERYLSTPLYQFD

SEQ ID NO: 85736 - protein, 526 aa, Clarkia delicata
VEFDNIFLDYSRQQASPDTISKLYKLADAAHLKQKIDCMYNGDHINSTENRSVLHVALRAPRNSAICSDGKNVVPDVWNVLDKIKDFSDRVRNGSWIGATGKELKDVIAVGIGGSFLGPLFVHTALQTDPEASKNARGRELRFLANVDPIDVARNISGLNPETTLVVVVSKTFTTAETMLNARTLREWISSALGPSAVAKHMVAVSTNLPLVEKFGIDPNNAFAFWDWVGGRYSVCSAVGVLPLSLQYGFAVVEKFLQGAHSIDQHFSSAPFEKNIPVLLGLLSVWNVSFLGYPARAILPYSQALEKLAPHIQQVSMESNGKGVSIDGLPLPFESGEIDFGEPGTNGQHSFYQLIHQGRVIPCDFIGVMKSQQPVYLKGEVVNNHDELMSNFFAQPDALAYGKTPEQLKKENVSEHLIPHKTFTGNRPSISILLPTLDAYRIGQLLAIYEHRVAVQGFVWGINSFDQWGVELGKSLATQVRKQLHGSRVKAKPVEGFNFSTKTLLIRYLEATSDVPADPSTLLPNI

SEQ ID NO: 85737 - protein, 164 aa, Alkalilimnicola ehrlichei MLHE-1
MRHIISILVENEFGALSRIAGLFTARGYNIECLTVAPTDDPTLSRMTLVTIGDDRIIEQIIKQLNKLLDVVKVMDMTEGRHIEREMMLIKVAAAGADQREEFKRLTDIFRGRILDVTDRIYTIELTGPGEKLDAFLDVLGQSAILEVVRSGVIGIARGEKHLRV

SEQ ID NO: 85738 - protein, 675 aa, Vitis vinifera
MDSVDRMPISSSVEESMATTVSFADAPGSTLSVYKDSNGPVDESRNDGSEASSSGSPWYQLRKDAIAFVSQTLQRGRKNLWQLTTSRVSVLLSSAAACSTSIHQFLRNYEDLNVFILAGEAFCGVEAVEFRMKLKTGCENYFVAFHRQSLYALKMVLEKENWQNIPPDTIQVISFAGLVGDGAALIISSDGNSASARVHQSNKSADSFETGAKKSGFSWWLKNGNPFLQKLTCTSKEWPNSPLANGSTSEEPDGKITENFHGDKFSPRYGVANGNNSVSEDENEDLWADFIDEDSQLPSRLSKPNLPRNHSSYWNDEESAGQTGSSLCLLRFMDKYARLMQKLEIANVEFFKGICHLFEVFFHFVFETFGQQNTHPSGKGATDFLNHRLKTALSRITQDYDQWIKPQLVPFSSSSTSLNVPFSHMDVTLTGPHSTNFVHSSNTSFGLKERCAGVDTISLVARILHRSKAHLQSMLLQNNAAIVEDFYAHLVDAVPDLTEHIHRTTARLLLHINGYVDRIANAKWEVKELGLEHNGYVDLLLGEFKHYRTRLAHGGIHKEVQDLLLEYGLENVAETLIEGLSRVKKCTDEGRALMSLDLQVLINGLQHFVSANVKPKLQIVEIFIKAYYLPETEYVHWARAHPEYSKNQIVGLINLVATVRGWKRKTRLEVLEKIE

SEQ ID NO: 85739 - protein, 194 aa, Bacillus subtilis subsp. subtilis str. 168
MILMIDNYDSFTYNLVQYLGELGEELVVKRNDSITIDEIEELSPDFLMISPGPCSPDEAGISLEAIKHFAGKIPIFGVCLGHQSIAQVFGGDVVRAERLMHGKTSDIEHDGKTIFEGLKNPLVATRYHSLIVKPETLPSCFTVTAQTKEGEIMAIRHNDLPIEGVQFHPESIMTSFGKEMLRNFIETYRKEVIA

SEQ ID NO: 85740 - protein, 477 aa, Thermobifida fusca YX
MSVLALGLSHRSAPVTLLERVALSGEVRLKLMTEMVNTSAVNEAMVVSTCNRTEVYADVDQFHPGVAAICELLSQYTGVSQEELTQHCYVHYEERAVQHLFSVACGLDSMVVGEGQILGQVRNALKDAQHVGTLGRVLNDLGQRALRVGKRAHTETHLDKAGASMVSFGLTVAGRFLTPDREPQPSAAAAVCPVDGDTGVEVSAALPDPQLLTGRRIMVLGAGSMSALAANTVARHGASTILIANRTFDRAQRLAECLTEGYESVRSSAVPFEDAARHLADIDLVISCTGAQGIVLTAEQVAAGGDRATRPLVFLDLALPHDIDKAVRKLPGVHLVDIEELRDAAEDGTATGQVADLTAVRDIVAEEVAEYQAVRSAERVAPTVVALRSKAQKVVESELERLNGRLPGIDDRTRAEITRTVRRVVDKLLHQPTVRVKQLATGPEGAVYAEALRELFDLDPAIPSAVVKPGTALGEER

SEQ ID NO: 85741 - protein, 187 aa, Triticum aestivum
PRGRDWSTRTLTWTERSRKSLPRRQNRIINLKLGTATVAEQTFIMIKPDGVQRGLIGEVISRFEKKGFYLKGLKLQNVEKSSAEQYYSDLSSKPFFAGLVEYIVSGPVVAMVWEGKSVVATGRKIIGATNPLASEPGTIRGDFAVDIGRNVIHGSDSVESARKEIALWFPEGIADWRSSQHNWIYEA

SEQ ID NO: 85742 - protein, 120 aa, Bacillus subtilis subsp. subtilis str. 168
MDKVYVEGMEFYGYHGVFTEENKLGQRFKVDLTAELDLSKAGQTDDLEQTINYAELYHVCKDIVEGEPVKLVETLAERIAGTVLGKFQPVQQCTVKVIKPDPPIPGHYKSVAIEITRKKS

SEQ ID NO: 85743 - protein, 158 aa, Triticum aestivum
  misc_feature (99)..(100): Xaa can be any naturally occurring amino acid
  misc_feature (106)..(106): Xaa can be any naturally occurring amino acid
  misc_feature (112)..(112): Xaa can be any naturally occurring amino acid
  misc_feature (120)..(120): Xaa can be any naturally occurring amino acid
  misc_feature (123)..(123): Xaa can be any naturally occurring amino acid
  misc_feature (135)..(135): Xaa can be any naturally occurring amino acid
ETEPSGPLAVLKGFKNLPTGMPSVLLVTGLTWLSWFPFILYDTDWMGREIYHGDPKGSNAQISAFRRKASRVGSVPGCCSTRFVLGFSPFLDRAMCRKXXPKVVWXTNNFMXCVAMAATXADXFWPSKDYNGYVXDPSPPDIKASARLFASWVSSRIL

SEQ ID NO: 85744 - protein, 527 aa, Avicennia marina
MAIRQLITLARRTRKPVQACASLRPFSTAVATAPDASLPSPPPPTGMIYDRLSESVKQKLKKLEEPDSRFLRYNSPHPTVDSHTEILSAPLTRVTTLPNGLRIATESTLVSTTATVGVFIDAGSRFESEESNGTAHFLEHMIFKGTERRNARELEEEIENMGGHLNAYTSREQTTYYAKVMDKDVPRALDILSDILQNSRFDEQRIIRERDVILREMEEVEGQTEEVIFDHLHASAFQYTPLGRTILGPAENIKKIGKEHLRTYISTHYTAPRTVVVASGAVKHEDFVEEVKKLFTRLSSDPTTASELVAKEPAIFFTGSEVRMLDDDIPLAQFAVAFEGASWTDPDSIALMVMQSMLGSWNKNAVGGKHMGSELAQRVGINEIAESMMAFNTNYKDTGLFGVYAIAKPDCLDDLAYAIMYEITKLCYRVSEADVIRARNQLKSSLLLHMDGTSPVAEDIGRQLLTYGRRIPYAELFARIDAVDPSTIKRVANRFIFDRDVAISAVGPIQGLPDYNWFRRRTYWLRY

SEQ ID NO: 85745 - protein, 506 aa, Oceanicola granulosus HTCC2516
MTAPKPVVLCILDGWGLREEREANAPALAETPNFDRIWRDCPHATLTTHGRDAGLPEGQMGNSEVGHTNIGAGRVVAMDLGQIDLALEEGTYAEQPPLKDFIATLKDSGGRAHLLAVVSDGGVHGHIAHLLETARILDAEGVPVVVHAMTDGRDVAPTSGKGFVERLVEELPGSATVGTVIGRYYAMDRDERWERIETAYRAIAEGKGESEAADPVAAVEAAYDADMTDEFIPATVIEGYDGLREADGLFCLNFRADRAREILRALADPEFDGFARETPALAARLGMVDYSSDHNAWYESVFPKKAIRNTLGAWVAAQGLRQFRLAETEKYPHVTFFLNGGKEEPEAGEDRKMPKSPKVATYDLQPVMSAGEVSDAFVGAIEAGYDLIVVNYANPDMVGHTGDLDAAIKACEAVDAGLGRALEALEAAGGAIVVTADHGNCETMVDPETGGPHTAHTLNPVPVIVVGGPEEATLREGRLADLAPTVLDLMGLDQPPEMTGKSLIQR

SEQ ID NO: 85746 - protein, 457 aa, Oryza sativa Japonica Group
MSRIHRNPTLLAPTPSPSSIPPLLEPSRSSPPPPMAATIVSVKARQIFDSRGNPTVEVDVCCSDGTFARAAVPSGASTGVYEALELRDGGSDYLGKGVSKAVDNVNSVIAPALIGKDPTSQAELDNFMVQQLDGTKNEWGWCKQKLGANAILAVSLAICKAGAIIKKIPLYQHIANLAGNKQLVLPVPAFNVINGGSHAGNKLAMQEFMILPTGAASFKEAMKMGVEVYHNLKSVIKKKYGQDATNVGDEGGFAPNIQENKEGLELLKTAIEKAGYTGKVVIGMDVAASEFYNDKDKTYDLNFKEENNDGSQKISGDSLKNVYKSFVSEYPIVSIEDPFDQDDWEHYAKMTAEIGEQVQIVGDDLLVTNPTRVAKAIQEKSCNALLLKVNQIGSVTESIEAVKMSKRAGWGVMTSHRSGETEDTFIADLAVGLATGQIKTGAPCRSERLAKYNQATS

SEQ ID NO: 85747 - protein, 480 aa, Oryza sativa Japonica Group
MSRIHRNPTLLAPTPSPSSIPPLLEPSRSSPPPPMAATIVSVKARQIFDSRGNPTVEVDVCCSDGTFARAAVPSGASTGVYEALELRDGGSDYLGKGVSKAVDNVNSVIAPALIGKDPTSQAELDNFMVQQLDGTKNEWGWCKQKLGANAILAVSLAICKAGAIIKKIPLYQHIANLAGNKQLVLPVPAFNVINGGSHAGNKLAMQAFMILPTGAASFKEAMKMGVEVYHNLKSVIKKKYGQDATNVGDEGGFAPNIQENKEGLELLKTAIEKAGYTGKVVIGMDVAASEFYNDKDKTYDLNFKEENNDGSQKISGDSLKNVYKSFVSEYPIVSIEDPFDQDDWEHYAKMTAEIGEQVQIVGDDLLVTNPTRVAKAIQEKSCNALLLKVNQIGSVTESIEAVKMSKRAGWGVMTSHRSGETEDTFIADLAVGLATGQIKTGAPCRSERLAKYNQLLRIEEELGAAAVYAGAKFRAPVEPY

SEQ ID NO: 85748 - protein, 335 aa, Streptomyces avermitilis MA-4680
MATVPTALAGRHFLKELDFTAEEFRGLLELAAELKAAKKARTETLYLRGRNIALVFEKTSTRTRCAFEVAAADQGASTTYLDPAGSQIGHKESVKDTARVLGRMFDGIEYRGHGQGVVEELAAHAGVPVYNGLTDEWHPTQMLADALTMTEHSDKPLTEIAYAYLGDARYNMGNSYLVTGALLGMDVRIVAPRLLWPDETIVEVAQQLAVASGARITLTEDVKEGVRGADFVATDVWVSMGEPKEVWDERIGLLGPYAVTMDVLRATGNDDVKFLHCLPAFHDLGTDIGREIHARHGLTSLEVTDEVFESAHSVVFDEAENRMHTIKAVLVATLA

SEQ ID NO: 85749 - protein, 450 aa, Frankia sp. CcI3
MCMTSKKLVVVGQGYVGLPLAMRAVDVGWRVVGVDVDESRVARLAAARSYVEDIPDRQLVAALGSGRYEPTSDYARAAAFDVAVITVPTPLREGAPDLSYIVGAARSLAPLVRPGVTVILESTTYPGTTEELFAPLLTEGSGLHPGIDFHLGYSPERIDPGNRVWNLVNTPKVVSGVHEDSLAAVSAFYDTVVERTVPVGSTRTAELTKLLENTFRHVNIALVNELAMFAHELGVDVWEAIDAASTKPFGYLRFTPGPGVGGHCLPIDPSYLSWRVRRSLGRSFRFVELANDINDHMPDHVVRRVTEMLNTRRRSVAGSRILLLGLAYKKNTGDARESPATRVATLLADLGAHVRAADPHVDAARLPPRVTLVEVDAGELAAADLVVLLVDHDAFDRDQVARHACAVLDTRHWLPTHDRGRRPVAAGGGHPLIPAQVARHDELAFAVEPL

SEQ ID NO: 85750 - protein, 543 aa, Bacillus clausii KSM-K16
MILCYANQVSQSYGATQVFANLSMEIKSGARIGLVGRNGEGKTTLARILAGVEPPATGEVGWRKGLAKGMLAQAPTYSPDRRVYTILETVFSDIKKVKEHMTRLEEVLATEQKPAKLERVLEEYGSLQQQFADVGGFEYEANIRRIAAGLGITGLLEKRWGALSGGERTKVGLACLLLQKPELLILDEPTNHLDLYAFDWLADWVRHYAGAVLIISHDRAFLDAAVTEIWEMENGVLHQYAANYSGYLKEREERLMREFQQYADQQKKMKKMREAIKRLKEWANRANPPNAGMHRQAKSMEKALARMEELKKPPQTKKVELSFEQQGRSGEDVVELKSVSKTFGERQVLGQVDLAVRHQERVALVGANGEGKSTLLKLILGEIEPDTGQCKIGASVSLGYLSQHGTELDPKQTVLEAFRASALLADGEARGQLARFLFYGQDVFKRVADLSGGEKMRLRLAQLIFEKHNVLVLDEPTNHLDIDSKEVLEEALAEFTGTIIAVSHDRYFLNKLFPVTYWLENGAATRYEGSFSYAWAKRKKHEQ

SEQ ID NO: 85751 - protein, 364 aa, Picea sitchensis
MGSASENSEMNTKVVNEDEWLLGMELGNFSCLPMGMKAAIELDVLQIIANAGNGVQLSPRQIVAHIPTTNPDAAITLDRILRVLASHSVLSCSVTTDENGKAERLYGLTPLCKYLVMNQDGVSLAPLVLMNQDKVLMDSWYYLKDAVLEGSQPFTKAHGMNAFEYPAKDQRFNRVFNRGMSEHSTMLMNKILDTYQGFKEVQELVDVGGGVGSTLNLIVSRYPHISGINFDMPHVVTDAPHYPAVKHVGGDMFDSVPTGQAIFMKWILHDWSDDHCRKLLKNCHKALPEKGKVIVVDTILPVAAETSPYARQGFHIDLLMLAYNPGGKERTEQEFQDLAKEAGFAGGVKPVCCANGMWVMEFHK

SEQ ID NO: 85752 - protein, 268 aa, Frankia sp. CcI3
MSDLPDPDELLAIALTIARAAGDLLARGREGTVAAETTKSSPTDVVTALDRASEALVARRLAELRPGDGLLGEEGSDSAGTTGVRWIVDPLDGTVNFLYRLPNWAVSIAAEVDGEVVAGVVHAPALGATYTATRGGGSYRDGEPLTGSTVTTLAGALVATGFGYTASRRAAQAAVASRVVPRVRDLRRMGAASLDLCAAAGGLVDAYYERGLKPWDQAAGGLVAVEAGLRVGGLHGRPAGEDLTVAAPPALFPALTALLAEDPPADRD

SEQ ID NO: 85753 - protein, 381 aa, Acidobacteria bacterium Ellin345
MGWVAGTQIGAYEIVGPIGNGGMGEVYKVRHTISQRTEAMKVLLSGAARRPEVTDRFVREIRVLANLNHPNIAALHTAFHHEDQLIMVMEFIEGKNLSEMLSTGMVLRDSVAYIRQAVTALAYAHSQGVIHRDIKPSNIMINSAGQVKLLDFGLALMSTPDPRLTSSGSLLGSVHYISPEQIRGETMDARSDLYAVGVTLFEVITGRLPIQGHSFSEIINGHLQVIPPSPAVLNACIPANLAAITLKALAKNPSERFQNASEFLQALDTVQIESGLHFAVTMETPFVSSAVAAAAASNTPNPSVSQPSQVKGYDPAVINEITSQLANYVGPIAKVIVKRASSSSNNLRELCDKVAREIDSENQRKNFLQSVRKHLGSSDAI

SEQ ID NO: 85754 - protein, 183 aa, Glycine max
  misc_feature (111)..(111): Xaa can be any naturally occurring amino acid
SSYANFLSKGDVALGILLTSYTTIASVIVTPLLTGLLIGSVVPVDAVAMSKSILQVVLVPVTLGLLLNTYAKSVVSVLQPVMPFVAMICTSLCIGSPLALNRSQILTGEGXEEQVSRTISLCTGMQSSTLAGLLATQFLDSSQAVPPACSVIAMAIMGLCLASFWGSGFVIRNLLPLPPLRTN

SEQ ID NO: 85755 - protein, 80 aa, Clarkia delicata
KGEVVNNHDELMSNFFAQPDALAYGKTPEQLRKENVSEHLIPHKTFTGNRPSLSILLPTLDAYRIGQLLAIYEHRVAVQG

SEQ ID NO: 85756 - protein, 641 aa, Flavobacteria bacterium BBFL7
MLNIHDLHVSFGGEPLFEEITFRLNGGNRVGLIGKNGAGKSTLLKVIAGDIEYDQGQLAMEKGTSIGFLRQDIDFEKGRTVLEEAYTAFAKAREIEAELDQINIQLAERTDYESDSYSKLIEDMSTLTHEYEIIGGYQYKGETEKILKGLAFKPEQFGMLTDELSGGWRMRIELAKLLLENHDILLLDEPTNHLDIDSILWLEQFLQTYPGAVVIVSHDKMFLDNVTNRTIEISLGRIYDYPKPYTQFLALRAEMREQQEATFKNQQKEIERTEKLIQKFKAKASKATMAQSLVKKLNRMDVVEIEQTDNAAMNINFAKSIQPGKVVLEIDKVSKSYGEKKVLSEVDLMIERGSRVAFVGQNGMGKSTLAKIIVGDINDSTGTVNLGHNVQLGYFAQNQAEYLDGEKTVLDIMIDAADDSNRVKVRDMLGSFLFRGDEAEKKVKVLSGGERNRLALCKLLLQPFNVLIMDEPTNHLDIQSKNVLKAALLKFDGTLIVVSHDREFLQGLTDVVYEFRDHKLNLHLGDIDYYLQQRKAQDMREIEKVTEAKVDPLSRKQETEKKQLSYEDQKKQKSLNNRLSKAEAEINNLEREIKKLDQELAANYDELAAKPGFFDAYQAKKKALDEWMTKWEDVSEQLDKF

SEQ ID NO: 85757 - protein, 527 aa, Clarkia delicata
VEFDNIFLDYSRQQASPDTINKLYKLADEAHLKQKIDRMYNGDHINITENRSVLHVALRAPRNSAICSDGKNVVPDVWNVLDKIKDFSERVRNGSWVGATGKELKDVIAVGIGGSFLGPLFVHTALQTDPEASKNARGRELRFLANVDPIDAARNISGLNPETTLVVVVSKTFTTAETMLNARTLREWISSALGVSAVAKHMVAVSTNLPLVEKFGIDPNNAFAFWDWVGGRNSVCSAVGVLPLSLQYGFAVVEKFLQGAHSIDQHFSSAPFEKNIPVLLGLLSVWNVSFLGYPARAILPYSQALEKLAPHIQQVSMESNGKGVSIDGLPLPFESGEIDFGEPGTNGQHSFYQLIHQGRVIPCDFIGVVKSQQPVYLKGEVVNNHDELMSNFFAQPDALAYGKTPEQLRKENVSEHLIPHKTFTGNRPSLSILLPTLDAYRIGQLLAIYEHRVAVQGFVWGINSFDQWGVELGKSLATQVRKQLHASRVNGEPVEEGFNFSTKTLLTRYLKATSDVPADPSTLLPKI

SEQ ID NO: 85758 - protein, 483 aa, Silicibacter sp. TM1040
MVSRVIPVDSFDFVLFGATGDLARRKILPSLFHRFQIGQFDDNSRIIGASRSKMDQGEFQTLVGDALKEFGDIPADAEPDVERFLSLLDYASVDAKGDGGWSDLGSKLRDGVVRAFYLSVAPSLFGDIAGRLKSTGIADDQSRIVVEKPFGHDLASAQALNAALREHFEESQIYRIDHYLGKETVQNLMALRFANSLFEPQWNSHHIDHVQITVSESISVAGRGEYYDKSGAMRDMVQNHLMQLLCLTAMEPPSTFEPNAVRNEKLKVIESLVPVAADDIVRGQYRAKSGNDSYLDHAGDPQSRTESFVAMKVEVANWRWAGTPFYLRTGKCLRERVSEIAVYFRKPPHNIFGEDNAIDGNMLVIRLQPDEGITLKTTIKDPGPGGMRLTSADLDMTFADSLPEAGRPQDAYERLIMDVIRGNQTLFMRGDEVEAAWTWADPIINAWDTSTRAPQPYDQGGSGPEDALLLLHRDGRRWRSIGA

SEQ ID NO: 85759 - protein, 342 aa, Physcomitrella patens subsp. patens
MGAQLASQGWVPRPDWEKESYPEAKDLVLIPLFAVLFPTVRYLFDSFFLEKVGRKAILGAKTPAIVTLTEDVDEYQRKKFIKFKESAWKGLYYLTAEVFALAVTYNEPWFTESKQFWIGPGDQQWPNQMMRLKLKVLYGFAGGFYTYSIFALIFWETRRKDFGVSMTHHVAAVVLIIFSYLARFARVGSVVLAIHDASDVILESAKLSKYLGSEIFASIFFLVFALSWVILRLIYFPAFVIWSTSYEVLQLLDRETNPQGPVLYYIFNTLLISLFILHIYWWVLMWRMILKQIQDWGRISDDIRSGMFMFSVFFVVFVHCCSDVRCIIIQCQLKDRRTGTQR

SEQ ID NO: 85760 - protein, 536 aa, Silicibacter sp. TM1040
MSDIWQQLSAHRAATEATPLTDYFAQDADRFARYSASAGEMLLDYSKTALDDTARDLLVQLAESVDLKSRIAAMMSGAKINSTENRAVLHTALRAPKDAVIEVDGENVVPGIQKVLAQMGAFATALREGSYQTKTGTAFTDVVNIGIGGSDLGPVMATLALAPYHDGPACHFVSNVDGAHIHDVLAGLNPETTLVVIASKTFTTIETMTNAETAIQWLKGALGEDVSTHLAAVSTALDKTAAMGIPDARVFGFADWVGGRYSMWGPIGLPIMIAVGPESFGEFLAGAAAMDQHFRDAPLMENLPALLGLIGVWHNNICGYGSRAVLPYDQRLSRLPAYLQQLDMESNGKSVALDGSPLPRASGPVVWGEPGTNGQHAFYQLLHQGTQVIPTEFLIAATGHEPELAHQHNLLKANCLAQSEALMLGRSWDEAREIAIARGFDGVDADRMAGHLSFPGNRPSVTLAYPKLTPFVFGQIVALYEHRVFTEGVIWGINSFDQWGVELGKELATRLLPMVEGADASQKDASTRGLLAKLST

SEQ ID NO: 85761 - protein, 307 aa, Clarkia epilobioides
  misc_feature (77)..(87): Xaa can be any naturally occurring amino acid
AAHLKQKIDRMNNGDHINSTENRSVLHVALRAPRNSVICSDGKNVVPDVWNVLDKIKDFSERVRNGSWVGATGKELXXXXXXXXXXXFLGPLFVHTALQTDPEASKNARGRELRFLANVDPIDAARNISGLNPETTLVVVVSKTFTTAETMLNARTLREWISSALGVSAVAKHMVAVSTNLPLVEKFGIDPNNAFAFWDWVGGRYSVCSAVGVLPLSLQYSFAVVEKFLQGAHSIDQHFSSAPFEKNIPVLLGLLSVWNVSFLGYPARAILPYSQALEKLAPHIQQVSMESNGKGVSIDGLPLPFES

SEQ ID NO: 85762 - protein, 109 aa, Physcomitrella patens subsp. patens
MSSSDRGGIQALLAAEQDAQHIVSNARAAKTARLRQAKEEAEREVAQYRAQREAEFKKKLSDTSGDSGANLKRLEGETDEKIKRLSGEAAKVAPEVTALLMKYVITVRN

SEQ ID NO: 85763 - protein, 382 aa, Triticum aestivum
MVSKMKRLPTLAKVALLLLVLLLLLAATLLLIFLVPRRRTAPLPPAAAPPAPADNCSSDRAVAFDFSPFLAQYRGGCVHRMDGTARVPAGVDAATGVVSKDVVIDHATGLGARMYLPPAEGKGGGRKEKQKDLPVVVFFHGGAFVIMTPFEPKYHDYLNALVARARVVAVSVDYRLAPEHPLPTAYDDSWAALNWAVKNADAGPEPWLRDRGNLSRLFLAGDSAGANIAHNMAMRAGDVNGSGLEGGAGVLGVLLLDPYFWGKRPVGAETTDPATRRRYEATWSFVCGGRYGIDDPLINPLAAPAWALRRLACGRVAVTTSGLDDFEARGEAYAAALNGSGWRGEVVRYETAGERHVYFLDQPGSPKSARELAFAAAYLSRG

SEQ ID NO: 85764 - protein, 251 aa, Vitis vinifera
MPFLRIAIGQPQETYQPDALKAALAEFFGTLIFVFAGEGSGMAFSKLTDDGSTTPAGLIAEALGHGLGLFVAVSGACNISGGHINPAVTFGAFVGGNITLLRGILYWIAQLLGSAVACLLLKFCTHGMTTSAFAISSGVTVWNAFVLEIVMTFGLVYTVYATAIDPRKGNVGIIAPLAIGLIVAANILAGGAFDGASMNPAMSFGPALVSWDWTNHWVYWAGPLIGGGIAGLVYETVFIHHTHEPLPGSEF

SEQ ID NO: 85765 - protein, 587 aa, Oryza sativa
MDPIATASWPSTSASSWPRSVRRRVPEAEEERELGRRVEEMEEAVERLRAEKEAAEAEERDLRAELDAERAAAETAASEAMLMIERLQREKAAALLEARHFRRLADGRADRDGELQDELASLSALAASYLSLLHAHGIDPDDDDGSNQQEQLQPPVEHLDAEADRESRSVVASPPPSEKVFAYAAATAPAADCGAEVTENLYARVEALEVDWSAMRREVAALRAERAQAVLAREVARRLCREAAVAGERGAVAVAAERPRFSVLAVCKEKEMSYCQEKESDSCRLRFSACFYSSTNPSRCIDDDGHKCDMMWWWPAFLYPPPAPAFVAAASVAQFALLANAGLGELRGEHMAYSKFWQVVAGKKKNGGGGGGGALLPSRQGMLVAYVPAFVAAAASFAVPGAVVGVRAQVLSAALTVHFLKRILEVLFIHQYSGSMPLNTAATISSSYLVITATMIYAQHLAAGLPDPPVDLLYPGVAAFAVGIAGNFYHHYLLSQLRNAAGGSGGGERQYRIPTGGLFGLAACPHYLFEIVGFFGFAMIAQTAHALAVASGTVAYLAGRSCATRRWYESKFEDFPDSIKALVPYIL

SEQ ID NO: 85766 - protein, 158 aa, Bacillus subtilis subsp. subtilis str. 168
MFRIGQGFDVHQLVEGRPLIIGGIEIPYEKGLLGHSDADVLLHTVADACLGAVGEGDIGKHFPDTDPEFKDADSFKLLQHVWGIVKQKGYVLGNIDCTIIAQKPKMLPYIEDMRKRIAEGLEADVSQVNVKATTTEKLGFTGRAEGIAAQATVLIQKG

SEQ ID NO: 85767 - protein, 187 aa, Frankia sp. CcI3
MRRPDRRRRDQREARMAVYALGDAVPTIDPTAYVHPDATVIGTVTIGPESTVWPGAVLRGDYGTIEIGARTSIQDGTVIHATEELTTVVGDDCTVGHLAHLEGCVVEDGALVGSGSVVLHRVRIGRGALVGAGAVVVGGTVVPPGARALGVPAKILPDSVAPGALAAGAAIYVANGKHYREQLRRID

SEQ ID NO: 85768 - protein, 421 aa, Bordetella petrii
MQNRDLNTRRSLATPRGVGVMCDLYAVRAENATLWDSTGKEYIDFAGGIAVLNTGHRHPKVKAAVAEQLEAFTHTAYQIVPYESYVALAERINALAPIDGLKKTAFFTTGVEAVENAVKIARAYTGRSGVVAFTGSFHGRTMLGMALTGKVAPYKLAFGPMPGDIYHVPFPNGTQDISVADSLKALDLLFKSDIDPQRVAAIIIEPVQGEGGFNITPPELMTALRKVCDEHGIMLIADEVQTGFARTGKLFAMQHHGVQADLITMAKSLGGGFPISGVVGRAEVMDGPAPGGLGGTYAGNPLAVAAAHAVLDVIEEEQLCARAEQLGRRLQDHLNKLRPRCPAIADVRGLGSMVALELNDPATGKPDAAAVKRVQDEAIQRGLILLSCGVYGNVLRFLYPLTIPDAQFAQALDILADVLTA

SEQ ID NO: 85769 - protein, 818 aa, Arabidopsis thaliana
MKSLASPPCLRLIPTAHRQLNSRQSSSACYIHGGSSVNKSNNLSFSSSTSGFASPLAVEKELRSSFVQTAAVRHVTGSLIRGEGLRFAIVVARFNEVVTKLLLEGAIETFKKYSVREEDIEVIWVPGSFEIGVVAQNLGKSGKFHAVLCIGAVIRGDTTHYDAVANSAASGVLSASINSGVPCIFGVLTCEDMDQALNRSGGKAGNKGAETALTAVDLVLSCVDRTFGSVFPTNPLDSRGMSTSEDKPEIISRVVHQEGDVEIVDRSQKDKDEEKEEGKGGFLDKVKDFIHDIGEKLEGTIGFGKPTADVSAIHIPKINLERADIVVDVLVKNPNPVPIPLIDVNYLVESDGRKLVSGLIPDAGTLKAHGEETVKIPLTLIYDDIKSTYNDINPGMIIPYRIKVDLIVDVPVLGRLTLPLEKCGEIPIPKKPDVDIEKIKFQKFSLEETVAILHVRLQNMNDFDLGLNDLDCEVWLCDVSIGKAEIADSIKLDKNGSGLINVPMTFRPKDFGSALWDMIRGKGTGYTIKGNIDVDTPFGAMKLPIIKEGGETRLKKEDDDDDDEVVGAVVLKNPTFILFRAAVPPCQVLWRYAELELLLRLLYSTALFVQHFAISLQEHGCTVSFIIIVKAIFLRQSFADTQNKSLVAQMKEEMLHMDINSMIGSSMPLGMMRIGTIIHNIEMNPGQGAKMVRAAGTNAKILKEPAKGKCLIKLPSGDTKWINAKCRATIGTVSNPSHGTKKLYKAGQSRWLGIRPKVRGVAMNPCDHPHGGGEGKSKSSGSRGRTSVSPWGKPCKGGYKSASVKKKKKRLAEAAAKM

SEQ ID NO: 85770 - protein, 489 aa, Bordetella petrii
MSQLPQPLKRAELLRDACYIDGKWVGASGGATIPVDNPSTGKTIVSVPKLGRKETEQAIASAEAALPAWAAKTGKERAAILLKWAQLMMANQQDLAIIMTSEQGKPVTEAAGEIAYAASFLEWFSEEAKRIDGDVLQSPKAGQRLMVLKQPIGVTAAITPWNFPAAMITRKAGPALAAGCTMVVKPAQQTPLTALALAVLAEEAGVPPGVFHVITGSSREIGAALCESDAVRKLSFTGSTEVGRTLMEQCAPTIKKLSLELGGNAPFIVFNDADLDRAVDGILASKYRNAGQTCVCANRIYIQSGVYEDVLKRLTAKVEAMKVGDGFADGVTQGPLIDSNAVAKVQEHIADATQHGAKVVTGGKPHALGGTFFQPTIVRDVTPSMRFATEETFGPVAPLFKFETEEEVLKQANNTIFGLAAYFYTRDYARVWRVSEALEYGIVGINTGIISNEVGPFGGVKQSGLGREGSKYGIEEYLELKYLCLDLGA

SEQ ID NO: 85771 - protein, 246 aa, Oceanicola granulosus HTCC2516
MRAAGKLAAELLDRIAPHVRPGQSTGELDRLITEWIDAAGATSATIGYKGYQHASCISVNHVVCHGIPGPKVLKDGDILNIDITVIVDGWYGDSSRMYVAGKLSRKAARLIDVTHESLMKGIEAARPGNTFGDIGHAIQTYAEANRMSVVRDFCGHGLGQVFHAPPNVLHYGRAGTGPRLEEGMFFTIEPMVNLGRAETKVLADDWTAVTRDKSLSAQFEHSIGITADGAEIFTGSPGGLFHPTWS

SEQ ID NO: 85772 - protein, 292 aa, Trichodesmium erythraeum IMS101
MWKKIAEHITQVTVENFEVTDHCLVGGGCINTAYKLTDGTRSYFVKINQASLVEMFRAEALGLEEMWETQTIRVPKPFCYGTEGNNCYIVLEWLELGDRGNDKSWENMGQNLAALHRHQGKSEFGWAHNNTIGSTPQINSWCGDWAEFWVQHRIGYQLKLAKGRGVSFSGGDRLLKIIPELLAGHQPQPSLVHGDLWGGNASFTVDGEPIIFDPATYWGDREVDLAMTELFGGFPTAFYRGYNEAWPLDNGYKHRKALYNLYHILNHFNLFGGGYASQAEIMIQQLLAKNWV

SEQ ID NO: 85773 - protein, 287 aa, Desulfovibrio vulgaris subsp. vulgaris str. Hildenborough
MQAARVEGYLATCLAGRGIPPRLQSAMEYSLLAGGKRLRPVLCLSTAGMTGLDPMSVMPFAAAIELIHTYSLIHDDLPAMDDDDLRRGRPSNHRQFDEATAILAGDGLLTDAFDLMASVGGGIPAGHVLAALREVSSAAGSSGMVGGQALDMDYTGRDDIDLAALRTMHAMKTGALIRCSCVAGALLGGAPASAVEQVAGYGAAIGAAFQIVDDILDETGDEAQLGKPVGSDVEQGKVTYPSLLGIERSRALAQEQADIAVTCLADFEGEDADFLRALAQYIVDRVS

SEQ ID NO: 85774 - protein, 641 aa, Desulfovibrio vulgaris subsp. vulgaris str. Hildenborough
MTDSTIPGLLARIQRPTDVAGLSADDLRTLAADLRTAIIDTVSKNGGHLAPSLGVVELTLAMLSTFDPGKDKVVWDVGHQAYAWKLLTGRAADFHTLRRRHGISGFPKPCESEYDHFGVGHSSTSISAALGMALARDLAGDDHHVVAVIGDGSLTAGLAFEGLNQAGDMGRRLIVILNDNEMSISRNVGALSLFLSRNLSKGWARRVKRDVETALKSIPGIGDEMVAYAKRSEHSLKSFFTPGMLFEAFQFNYIGPVDGHDVKALVRNLELAKTNDRPVLLHVLTRKGKGYTPAEANPAFFHGVGRFEPETGRARKPGDTPVLPTYTDVFGETLCRLADMDERIVAITAAMPEGTGTNCFRERHPDRFVDVGICEQHAVTFAAGLAIQGYRPFVAIYSTFLQRSYDQIVHDVCIQKLPVVLCLDRAGLVGEDGPTHHGAFDLSFLRHIPHMSIIAPRDEADLQAAMYTALHLDAPLAIRYPRGVGFGIPLAESPSPLPVGVGEVLKEGEGVAVIAVGSRVHPSLEAAERLAEETGRHATVFDARWVKPLPEAQLLDIVARHDALLFVEENALAGGFSSAVLELLADRNALSGKHIRRIGLPDEFVEQGTQKELRVSLGLCMDGVGKALKELFAAVGNATAS

SEQ ID NO: 85775 - protein, 266 aa, Zea mays
MSAYCGKYKDELIKNAAYIGTPGKGILAADESTGTIGKRFASINVENVEDNRRALRELLFCTPGALQYLSGVILFEETLYQSTKGGKPFVDILKEGNVLPGIKVDKGTVELAGTNGETTTQGFDDLGKRCAKYYEAGARFAKWRAVLKIGPTEPSQLSIDQNAQGLARYAIICQENGLVPIVEPEILVDGPHDIDRCAYVTEMVLAACYKALNDQHVLLEGTLLKPNMVTPGSDAKKVAPEVIAEYTVRTLQRTVPAAVPAIVFLS

SEQ ID NO: 85776 - protein, 345 aa, Trichodesmium erythraeum IMS101
MLGKASESKKKIYQIIYGYWQSQCVYTATNLGIPNLLHYGPQTVEIIAEKTGTKSEKLYVVLRALAHLGIFVEKPGRVFAATELSELLMTDDSPSIGHFLMHITEPNMWDSWRELESGLKTGEVPFKIAKGQDFYTSYMTENPQSKNLFNNAMSFLTAEAVDPLFEVYNFSRFKTVMDIGGNQGTLIANIVKKFGCQGILFDLPHEVETAPNNISKYGVLDSVKIIGGSALESLPKGADAIIMKYFLSVFNQEDSIKVLTNCREALPQDGRVILLQTLVPSLGAPVEYPDGTIPALAAVQMMITNPGGYWRTEEEYKNLFAASGFKLEQVVYTGTSLTVMEFSPC

SEQ ID NO: 85777 - protein, 285 aa, Brassica napus
MAKDVEGAEGFAARDYEDPPPTPFFDAEELTKWSLYRAVIAEFVATLLFLYVTVLTVIGYKISSDTKAGGDECGGVGILGISWAFGGMIFILVYCTAGISGGHINPAVTFGLFLARKVSLIRAVLYMVAQCLGAICGVGFVKAFQSAYYVRYGGGANSLADGYSTGTGLAAEIIGTFVLVYTVFSATDPKRNARDSHVPVLAPLPIGFAVFMVHLATIPITGTGINPARSFGAAVIYNESKPWDDHWIFWVGPFIGAAIAAFYHQFVLRASGSKSLGSFRSAANV

SEQ ID NO: 85778 - protein, 317 aa, Rhodopirellula baltica SH 1
MSRRCQIATLALNRCPFPLVVFLSCRMSVPNVDPSHQSNASANEATRPSPAAEGLDKSGERVREMFRQIAPRYDVMNHLLSLNIDKWWRRKAVQTLKIKGDDPILDLCCGTGDLAIAIADSAGSDVQVIGSDFCHAMLEIARVKESKRTRDTAGGSGRHTIPFLEADSMALPFDDDAFQCVTVAFGLRNIADTDQGLSEMARVCKPGGQVLVLEFSQPTLPVLKQAYNFYFRHVLPRIGQWMARNDKSAYEYLPESVGKFPCGDALAGRMRDVGLQHVTFRPLTLGVATIYVGEKPGGKTDHAEMAAHREREALVAT

SEQ ID NO: 85779 - protein, 586 aa, Oceanicola granulosus HTCC2516
MRPLSSFFPVLDWGRRYDRHALTGDLVAAVIVTIMLIPQSLAYALLAGMPPEAGIYASIAPIILYALFGTSRALAVGPVAVVSLMTAAAVGEIAAQGTAGYVAAALTLAMLSGLMLLALGLFRLGAFANFLSHPVIAGFITASGILIAASQLRHVLGIPGGGHTLPQIAASLWRNLPEINLPTLVIGGGSIAFLFWVRSGLKPLLRRAGLGPRAADIGARTGPVLAIAASILAVVLFDLDAHGVAIVGDVPRSLPPLTLPSFSPDLISQLFVPALLISIIGFVESISVARTLAAKKRQRIDPDQELIGLGAANLGAAFTGGFPVTGGFARSVVNRDAGAETPAAGAYTAVGLALAALFLTPLIHDLPKATLAATIIVAVLSLVDLSILRRAWSFSRADFGAVVTTIALTLLIGVEAGVMAGVLVSILIHLYKTSRPHMAVVGRVPGTEHYRNVLRHEVETQPHVLALRVDESLYFPNTHFLEDRLAELIAERPALTDVVLMFPAVNDIDLSALESLEAINARLRDADLRLHLSEVKGPVMDRLERSHFLDELTGGVFLSHHAATRALARPGNGGNDGVEEHGLYVI

SEQ ID NO: 85780 - protein, 164 aa, Brassica napus
  misc_feature (142)..(142): Xaa can be any naturally occurring amino acid
MLYVFELWIVIVSLLVLNLCHWIYQWRNPKCNGKLLPGSMGFPIIGETFEFMKPHDVLQFPSFVKKRVIRHGPVFRTSLFGSKVIISMDNELNMEIAKTNRTIGVPKSITRLFGDNNLFVQSIESHKHVRSLTFQLLGPQGXLKLRVIEDIDLLARKHMEEGAR

SEQ ID NO: 85781 - protein, 223 aa, Brassica napus
MAPSSSSGLTFKLHPLVIVNISDHYTRVKTQLNPPPSVCATENASSNNGEAMLQPNPRVYGCVIGVQRGRTVEIFNSFELLFDPSTETLDRSFLEKKQELYKKVFPDFYVLGWYSTGSDAEESDMLIHKALMDINESPVYVLLNPAIHHAQKDLPVTIYESELHVIDGIPQLIFAHTSYTIETVEAERISVDHVAHLKPSDGGSAATQLAAHLTGIHSAIKNA

SEQ ID NO: 85782 - protein, 229 aa, Listeria monocytogenes str. 4b F2365
MTKQANLQKVTAQIERACEESNRQPEDVTLVAVTKTIDVAGITEFYDLGIRHFGENRADVFQEKTVALADKEDICWHYIGSLQTRKVKDVLPKIDYLHSLDRSSLAKEIEKRATKPVKCFLQVNISGEESKHGFSKEEALSFLQEANFTFIEIVGLMTMAPITNSDIELHHVFHELKQLQQEIHALQLNNIPCTELSMGMTNDYGVAITEGATFIRVGRALVSDDNMEV

SEQ ID NO: 85783 - protein, 393 aa, Phytophthora porri
LTTEIGEYRAAVPSGASTGEFEALEMRDGGADYMGKGVLNAVRNVNEIIAPALVGKDVTKQADLDRYMVETLDGTQNEWGWCKKKLGANAILGVSLALCRAGAAAKKQPLWQYIADLAGNPSPCLPVPSFNIINGGSHAGNKLAMQEFMILPVGATSFTEAMKIGSEVYHNLKKVIKGRYGLDATAVGDEGGFAPNIQANAEAIDLIEEAIKDAGYTKQVRLGMDVAASEFYTGAKDARYNLDFKNADGAETEKISADKLLEMYEGFISKCADSSKIVSIEDPFDQDDWESWVKITGRIGKDVQIVGDDLTVTNPTRVKKAIEQKACNALLLKVNQIGSITESIEAVTMAKKAGWAIMASHRSGETEDTFIADLAVGLSAGQIKTGAPCRSER

SEQ ID NO: 85784 - protein, 160 aa, Xanthomonas axonopodis pv. citri str. 306
MTIHVGDRIPEVVLKRLRDGIEAVDTHSLFAGRKVLLFAVPGAFTPTCSAKHLPGYVEHFEQFRKRGIEVLCTAVNDPFVMQAWGRSQLIPDGLHLLPDGNAELARALGLEIDASGSGMGLRSRRYALYADDAVVKALFVEEPGEFKVSAADYVLQHLPD

SEQ ID NO: 85785 - protein, 385 aa, Phytophthora uliginosa
EIGEYRAAVPSGASTGEFEALEMRDGGKAYMGKGVLNAVKNVNDIIAPALIGKDVTKQAELDRYMVEELDGTQNEWGWCKKKLGANAILGVSLALCRAGAAAKKQPLWQYIADLAGNPTPCLPVPSFNIINGGSHAGNKLAMQEFMILPVGATSFTEAMKIGSEVYHNLKKVIKNRYGLDATAVGDEGGFAPNIQSNGEAINLIEEAIKAAGYTNQVRLGMDVAASEFYTGAEDARYNLDFKNENAPESEKISADKLQEVYEGFIAKCADSSKIVSIEDPFDQDDWASWVKFTGKVGKDVQIVGDDLTVTNPTRVKKAIELKACNALLLKVNQIGSITESIEAVTMAKKAGWAIMASHRSGETEDTFIASLAVGLSAGQIKTGAP

SEQ ID NO: 85786 - protein, 217 aa, Bacillus subtilis subsp. subtilis str. 168
MFFRMLKEDIDTVFDQDPAARSYFEVILTYSGLHAIWAHRIAHALYKRKFYFLARLISQVSRFFTGIEIHPGATIGRRFFIDHGMGVVIGETCEIGNNVTVFQGVTLGGTGKEKGKRHPTIKDDALIATGAKVLGSITVGEGSKIGAGSVVLHDVPDFSTVVGIPGRVVVQNGKKVRRDLNHQDLPDPVADRFKSLEQQILELKAELEDRKERINQK

SEQ ID NO: 85787 - protein, 428 aa, Streptomyces avermitilis MA-4680
MPSIDVVVAREILDSRGNPTVEVEVGLDDGSTGRAAVPSGASTGAFEAIELRDGDPNRYQGKGVEKAVLAVIEQIGPELVGYDATEQRLIDQAMFDLDATDNKGSLGANAILGVSLAVAHAASEASDLPLFRYLGGPNAHLLPVPMMNILNGGSHADSNVDIQEFMIAPIGAESFSEALRWGAEVYHTLKKVLKTKGLSTGLGDEGGFAPNLESNRAALDLIIEAIKQAGYIPGEQIALALDVAASEFYKDGKYEFEGKSRSAAEMTEYYEELVSAYPLVSIEDPLYEDDWAGWKVITDKLGDKVQIVGDDLFVTNPERLARGIEEGSANALLVKVNQIGSLTETLDAVELAQRNGFKCMMSHRSGETEDVTIADLAVAVNCGQIKTGAPARSDRVAKYNQLLRIEEILDDAAEYAGRSAFPRFRSAN

SEQ ID NO: 85788 - protein, 652 aa, Mycoplasma mycoides subsp. mycoides SC str. PG1
MEGKMNTNKESLYRTYRPKDFNSVAGHNNIKEILEKQIKDNRINHALLFSGQRGTGKTSVARIFAKTINCLNLTNSTACEQCNNCKLANQNQLIDIIEIDAASNNGVDEIREIKNSVSTLPLNSKYKVYIIDEVHMLTKQAFNALLKTLEEPPVYAIFILATTEFNKIPQTILSRCQIFNFTKIDKNSLKNRLQYIANQENYQIEKEVLDEIFYLSEGSLRDAINILEQLMLATDDLITIKSLKSIFLIATKQEQLQVIHQSLNNNTSFIISYFQKANDQGMNWDVFALGLIEILKEIIEYKLTNNTEFLNILEKNEVEQFNSINVNNLFILADNLAEAYFKTKAANISFNYLLLSLLKTINSNNNNLQAVSKTINTKQIEQNQEILKPNDITPKILDKPIIDEPVIQQPIIDDLLLTKDLDDQTLIKNTIENDKPLDSTNLDDQINEFDFYNQKEQAIDEICKTLSELKIKFNIHISQAIDSKVKMLFNEDLISILIETKNYKNQIHNIEQLLEDLFLQNDDQLVNAQIASELFMLLDSKIISLTNDVIVLKTQTKAQANLINDSMLDNHVLQQIYNWFKKPYLIFAIDKMKWDEIKTIFIDLKNKNKLSEYSEINLKQLKEKYLTINDEIDQDLINKAKDLFNDDFMIGD

SEQ ID NO: 85789 - protein, 507 aa, Pneumocystis carinii
MQKVSGSGKKTTAFQQRKSDSVYNNNEMNKGTSSISYDPVYFVRDASSFTKTTHERAASVKLKLEHLYKVTVEQTVERNQRRMDFEAKLAQDRGSEERKKRQLNSLGQKESQFLRLRRTKLSLNDFHTVKVIGKGAFGEVRLVQKIDTGKIYAMKTLLKSEMFKKDQLAHVKAERDVLAESDSPWVVSLYYSFQDSQYLYLIMEFLPGGDLMTMLIKYDTFSEDVTRFYIAECILAIEAVHKLGFIHRDIKPDNILIDKTGHIKLSDFGLSMGFHKTHDNAYYQRLFESKINTSTSSTQNSLMVDTISLTMSSKDKIATWKKNRRIMAYSTVGTPDYIAPEIFTQHGYGQECDWWSLGAIMFECLIGWPPFCSENAHETYRKIINWRENLYFPEDLHLSAEAEDLIRKLLTSADQRLGRYGANDIKLHPFFRGVNWDTIREINAPFIPQLKSITDTSYFEEIDTIPNITMNSPPVLQNKIPSDVDQNLAFVGYTYKRFDMMTQKGIL

SEQ ID NO: 85790 - protein, 318 aa, Bordetella petrii
MNDSSHSPSAHWNLDNIVSGLRAARVDWRGPRGRLRDDAGDREFPSQESLRVIVRQLCGALFPMRLGPIDLREEVEDFYVGHTIGAALDALLHQVCLELHHMGRNAPEPEPEASLRARAVQIVRQFGAALPQVRRALDLDVTAAYQGDPAAHSVDEVLLCYPGVSAMIHHRLASVMYKLGVPMLARIVAEIAHADTGIDIHPGATIGKSFFIDHGTGVVIGETAIIGDRVRLYQMVTLGAKRFPPGENGELKKGLPRHPIIEDDVVIYAGATILGRVTIGHGSTIGGNVWLTRSVPPGSNVTQASLVSDMPDCGLGGA

SEQ ID NO: 85791 - protein, 659 aa, Bordetella petrii
MNTPMPHGWRHWRLERRTDGLAWLTFDRAGAAVNALSAEVMAELAAVLDALQADPPAGLVIHSGKAAGFIAGADIDEFAELNSPQQAQALVERGWRLFDRLAAVPYPTLALIHGHCLGGGLELALACRYRIAVDQPGTSLALPEVMLGIFPGWGGMRRLPAVIGAPAALDMMLTGRPADARRAAALGLVDARVPARLAEAAAAQQVRSGKPPRRARGMAGWLGRWPLKLLVARRAHRQIAARDPQGHYPAAPAIVTLWSRHDGNALRAPDVVQRILTSDTARNLLRVFRLQERLKANGKPAAGARPASHVHVVGAGTMGGDIAAWCALKGLTVTLQDQDAARIAPAIGRAAELHARKLKDPHAARAASDRLIPDPDGAGVARADVVIEAITEQAEAKQALYRALQPRMKPDALLATNTSSLSLAALRDGLAQPGQLVGIHFFNPVAKMPLVEVVQAGPDELGAQARACAFVGQIGKLPLPVRDAPGFLVNAVLAPYMLEAMRCVDAGLAPETVDLAMTDFGMPMGPLELADTVGLDIAMAAGRQLAGQDEPPRCLAERLARGELGRKTGRGFYAWHDGKARKNNASAPPPGLAQRLVQPLVERAAQLVPDGVVADADLADAGVIFGTGFAPFTGGPLHYRATAGPTSAAGHAAPAPSNP

SEQ ID NO: 85792 - protein, 316 aa, Bacillus clausii KSM-K16
MANYSDPSLKVFTLNSNKGLAEEIARHIGVSLGKNSVMRFSDGEVQINIEESIRGCDVYLIQSTSAPANEHLMELLIMIDAVKRASARTINVVIPYYGYARQDRKARAREPITAKLVANLLETAGATRVLTIDLHATQIQGFFDIPVDQLMGVPLLSDYFESKKLDDIVVVSPDHGGVVRARKMADRLKAPIAIIDKRRPKPNVSEVMNIVGNIEGKTAIIIDDIIDTAGTITLAANALVEQGATEVYACCTHPVLSGPAIERISNSKIKELVVTNTIALTEKQRGENITQLSVAGLMAEAIIRVHEDASVSTLFD

SEQ ID NO: 85793 - protein, 136 aa, Brassica napus
MIGSFLTRGLVMVFGYAYPAYECYKAIEKNKPEIQQLRFWCQYWILVAALTIFERVGDTFASWVPLYCEAKLAFFIYLWFPKTRGTTYVYDSFFRPYVAKHENEIDRNLVELRTKAGDMTVLFCRKAVCYGQTRFT

SEQ ID NO: 85794 - protein, 655 aa, Frankia sp. CcI3
MSLLSTISSPQDVKRLDHEELATLAAEIRDFLIHAVARTGGHLGPNLGAVELTLAIHRVFDSPFDRILWDTGHQSYVHKILTGRADDFSGLRQRGGLSGYPSRAESEHDIIENSHASTALSYADGLSRAYALRGEDRAVVAVVGDGALTGGMCWEALNNIAADDRPVVIVVNDNGRSYAPTIGGLADHLAALRLAPEYEQVLDVVKQVLGRTPLVGPPLFDALHGIKKGIKDVVQPQGMFEDLGLKYVGPVDGHDVVAVESALRRARDFGGPVIVHCVTRKGFGYPPAEQDDADNFHGVGIIDPATGKPVSTSKTISWTSIFSDEIVQIGSERPDVVTLTAAMLQPVGLGAFAKAYPDRVFDVGIAEQHAVTSAAGLAMGGLKPVVCLYATFLNRAFDQVLMDVALHRQPVTFVLDRAGITGEDGASHNGMWDLSFLQVVPGLAIAAPRDAPTLRAELREAVGDTDGPTVVRFPKGKVAVDVPAIDTVGGVDVLYRSPKVAQRREVLLVSIGAMAATCLEVAERVASQGIGITVVDPRWVKPLDPALIDLARAHDLVVTVEDNGRVGGVGAALAQLLRDADVDVPLRDFGIAQRFLDHGKRDEVMAEVGLAPQDLARKVVEAVAKRQPAIEDDPTSPGEAAPAGERAGEAIGDQR

SEQ ID NO: 85795 - protein, 215 aa, Oryza sativa Japonica Group
MASKPADVTATGGGGVAVVRDNNNNAGGGEAEVYRSELTPLQKHVAFFDRNKDGIIYPSETYQGFRAIGAGVVLSAVGAVFINGGLGPKTIPENTKTGLKLPIYVKNIHKGKHGSDSGVYDANGRFVPEKFEEIFKKHAHTRPDALTDKELKELLQSNREPKDFKGWLGGFTEWKVLYYLCKDKDGFLHKDTVRAVYDGSLFAKMEQEKQSAKKK

SEQ ID NO: 85796 - protein, 309 aa, Magnaporthe grisea 70-15
MYINGGHTYTVTVPCTVTVTKTVTVTKKKPTKTKPPHPPPSSSSTVKTYTPTTLTSVTKPPKPTKSHPPPPPPETTPCETESSTTHKPTKTKPPHSTSTIVPPPPPPPETTPCTTSSSHKPPPPPPETTPCTTSTVPQAASATSGDHSVHYVYEPSASATASRDHSVHDIYHPTQPPPPPPSHTPKPPPSHSPKPPPPPPISHSAAASLPRRTLPSRLPPPSHTPSPPPPPPPSHTPAPPPPSHTPAPPPPPPPPSSSLPPPPPPPPPSSTRPPPPPPAQTTPPPIQTAAAAHFGAGLGGVLAIAALVM

SEQ ID NO: 85797 - protein, 715 aa, Frankia sp. CcI3
MTIDEVTLSFPGEVVTAAHVRYARLPEVAGPVALITLDNGHDHTRPNTFGPAGLRSLLAAVDEIEAHDPPVAAIAVTGKPFIFSVGADLSFRSSLTDPERIRPSLAALGRLGHEAFARVGEGRLGDRKVPTFALVNGAALGGGLELALHCDYRALSAGIPALAFPEVFLGLVPGWGGTQLLPNLIGAERAVSVVIGNALSQNRMLRGRQAFELGLGDVLLEPADFLAEALRWVGQVLRGDVDPVAARAPVERGAGWAEAIARGRTLADAKLHGAAPAAYRALDLLALAETADRATGYAAETEALADLSVSDELAASLYSFDLVQKRAKRPVGGPDPALARPVTKVGVVGAGLMASQLALVFAHRLEVPVVLTDIDQARLDAGVAGVHQEVDNLLLRHRITPDQANRYKANVTGSLTKDAFADADLVIEAVFENLAVKRTVLAELEAVVAPTAVLLTNTSALSVTEMAAGLDHPERVAGLHFFNPVSVLPLVEVVRAARSDDATIATTLAVAKNLKKNAVLVADAPAFVVNRLLTRFLGEVLGATEGGTPLEEADHALDPLGLPMSPMTLLALVGPPVALHVAETLHAAFPDRFRRPTALARLVEAGRSGVYTTGPDGVQTVDPDAAALIFTPSPAATPLTGDEVREAALRALAEEIHLMLTEKIVAEAADIDLCMILGAGWPFHLGGITPYLDRSGISEAVTGQRFAPPGVATLR

SEQ ID NO: 85798 - protein, 328 aa, Dehalococcoides sp. VS
MSIEPEIREALGKIYVAAAGRILADLNLLRNVEVEPDKIKLSLAGAGLSEDSRKVLQQEIGLALKPLLNKQKLEIEHITVPLNELNRVKKVVAVMSGKGGVGKSLITGLCAVALNRQGYRVGILDADITGSSIPKMFGANEHLSGNEEAILPAKSPAGISLVSTSLLLSNQSDAVIWRGPLISKMINQFWDDVLWGELDYMIVDLPPGTSDAALTVLQSLPISGIVVVFTPQGLVEMVARKAVSMAGKMGKSIIGLVENMAYLKVPELDKKIEVFGAGHGEELAKSIGVPFIGQMPLDPALAALCDNGDIEKYSHPLLDELEKAISRS

SEQ ID NO: 85799 - protein, 331 aa, Desulfovibrio vulgaris subsp. vulgaris str. Hildenborough
MTVSGCCSNVLVCGGAGYIGSHMVRALVEHGYVPIIFDNLSTGHAESVGDVDLVRGDLLDRQALRRLFAEHSFDAVMHFSAKSLVGESMTDPGIYFVNNVVGTINLLEAMREAGVSRLVFSSSAAVFGNPLTARIAEDHPRQPVNPYGRSKLMIEQALRDYANAYGMRSVSLRYFNAAGADEAGDIGESHKPETHLIPNVLRAALGTGPELKIFGDDYDTPDGTCVRDYIHVADLCDAHLRALSYMQLKPGAHAFNLGNGNGFSVKQVVEAAWRVTGRDVPHSMAPRRPGDPAWLVADSTLAERELGWKPSFTDIDAIIDSAWRWHQKPRY

SEQ ID NO: 85800 - protein, 365 aa, Coccidioides immitis RS
MDSLLTLASRQEQPSEPAPACDTGNEFDGHLGLRVSAVFVILAGSLLGALLPVLVRQDPHSRHNSRKPRVPSWVFFIAKFFGSGVIVATSFIHLLAPAHEALSNPCLTGPITEYPWVEGIMLITVILLFFLELMVIRYAHFGHGHHDESPGGRQTEAGVVSRAEKNPRAHRPGPDHLDHSNDHPSDAGSDPFDGAHTALFEDYSAQLTSVFILEFGIIFHSIFIGLTLAVAGEEFKTLYVVLLFHQTFEGLGLGSRLATIPWPHSKRFTPYLLALAFGLSTPIAIAIGLGVRNSYPPEGRTTLIVNGVFDSISAGILVYTSLVELMAHEFMFSTSMRRAPIRTVLAAFGLLCLGAALMALLGKWA

SEQ ID NO: 85801 - protein, 489 aa, Listeria monocytogenes str. 1/2a F6854
MGKATGFMEYDRIPSPGRDPKSRTRDWNEYSLPMPVADLTIQAARCMDCGVPFCSVGMEIKNGVSGCPLHNLIPEWNDAVYRGDWYEALQLLLKTNNFPEFTGRICPAPCEGGCTVAISEPAVGIKSIEKAIIDRGFEEGWIKPAPPKKRTGKRIAVIGSGPAGLACADQLNKAGHSVTVIEKSDRIGGLLMYGIPTMKLEKEQVTRRVNLMAEEGIEFVTGVAAGTDVTFAELREEYDSIVLATGAGNARDIPLAGRDAAGIHFAVPYLSQSTRDNLDNGGVQTLSAKGKNVVIIGGGDTGADCVATALRQGAKSIYQFGIQDKLPELRDGENPWPQYPRVFKMDYAHEEAEAVYGRDPREYLINTTSFEKDEAGNLIGLHTVEVEENKAERKYTPVEGSEKYFEVDMVLIAIGFAGTTEDIFTNFGVGKTDRHTIDAAKGFYRTSEEGVFACGDARHGQSLVVTAIAEGREAAREVDFYLMGETFLP

SEQ ID NO: 85802 - protein, 144 aa, Oceanicola granulosus HTCC2516
MLVHQILRSKANEGVLTLAPGKSVAEAVAFLSDKKVGAVVISEDGRVPLGILSERDIVRELGRRGAECLQDGVHDMMTDKLTTCTPHDSADQVLEMMTTGRFRHLPVMENDEMVGLISIGDVVKARLSELAMEKDALEGMIMGH

SEQ ID NO: 85803 - protein, 499 aa, Oceanicola granulosus HTCC2516
MQDLSHYVNGARVAGTSGRFADVFNPATGEVQARVPLASRAEVDDAIAKAAAAQPAWGATNPQRRARVMMRVVELLNRDMDKLAEALSREHGKTLPDAKGDIQRGLEVIEFCIGAPHLLKGEYTDGAGPGIDMYSMRQPLGVVAGITPFNFPAMIPLWKMGPALACGNAFILKPSERDPSVPLMLAEIFLEAGLPEGVLQVVNGDKEAVDAILENETVQAVGFVGSTPIAAYIYAKGCEHGKRVQCFGGAKNHMIVMPDADMDKAADALVGAGYGAAGERCMAISVAVPVGEETADRLVEKLVPRIEALKVGPYTAGDDVDYGPVVTAAAKANIEKLVQSGVDAGAELAVDGRDFKLQGYEDGFFVGPHLFDRVTPDMEIYRKEIFGPVLSTVRAGSYEEALKLAMDHEYGNGTAIFTRDGDAARDFASRVNVGMVGINVPIPVPLAYHTFGGWKKSGFGDLNQHGPDSFKFYTRTKTVTARWPSGIKEGGEFNFKAMD

SEQ ID NO: 85804 - protein, 152 aa, Populus x canadensis
MDLLNQLQRQYTDFTTLLYQEGFVDDQFTQLQKLQDESSPDFVVEVVSLFFEDCEKLVNNMAKALEQQDVDFKRVDSHVHQLKGSSSSIGAARIKNVCIAFKTFCEAQNREGCLRCLQQVNHEHTQLKTNLQSLFTLERQIVANGGSIPVMQ

SEQ ID NO: 85805 - protein, 392 aa, Phytophthora melonis
  misc_feature (60)..(60): Xaa can be any naturally occurring amino acid
LVTELGEYRAAVPSGASTGEFEALEMRDGGKAYMGKGVLNAVKNVNEIIAPALIGKDVTXQAELDRFMVEELDGTQNEWGWCKKKLGANAILGVSLALCRAGAAAKKQPLWQYIADLAGNPTPCLPVPSFNIINGGSHAGNKLAMQEFMILPVGATSFTEAMKIGSEVYHNLKKVIKGRYGLDATAVGDEGGFAPNIQSNGEAIDLIEEAIKAAGYTNQVRLGMDVAASEFYTGAEDARYNLDFKNENAPESEKISADKLQEVYEGFIAKCAGSSKIVSIEDPFDQDDWASWVKFTAKVGEDVQIVGDDLTVTNPTRVKKAIEQKACNALLLKVNQIGSITESIEAVTMAKKAGWAIMASHRSGETEDTFIADLAVGLSAGQIKTGAPCRSE

SEQ ID NO: 85806 - protein, 391 aa, Phytophthora arecae
VTELGEYRAAVPSGASTGEFEALEMRDGGKAYMGKGVLNAVKNVNEIIAPALVGKDVTQQAELDRFMVETLDGTQNEWGWCKKKLGANAILGVSLALCRGGAAAKKQPLWQYIADLAGNPTPCLPVPSFNIINGGSHAGNKLAMQEFMILPVGATSFTEAMQIGSEVYHNLKKVIKGRYGLDATAVGDEGGFAPNIQSNGEAIDLIEEAIKAAGYTNQVRLGMDVAASEFYTGAADARYNLDFKNENAPDSEKIPADKLQEVYEGFIAKCAGSSKIVSIEDPFDQDDWESWIKFTGKVGKDVQIVGDDLTVTNPTRVKKAIEQKACNALLLKVNQIGSITESIEAVTMAKKAGWAIMASHRSGETEDTFIADLAVGLSAGQIKTGAPCRSE

SEQ ID NO: 85807 - protein, 442 aa, Xanthomonas oryzae pv. oryzae KACC10331
MLAETPLLETTLERELATLAFGRRYGKVVEVVGTMLKVAGVQVSLGEVCELRQRDGTLLQRAEVVGFSRDLALLAPFGELIGLSRETRVIGLGRPLAVPVGAALLGRVLDGLGEPSDGQGAIACDTWVPIQAQAPDPMRRRLIEHPMPTGVRIVDGLMTLGEGQRMGIFAAAGVGKSTLMGMFARGTQCDVNVIVLIGERGREVREFIELILGADGLARSVVVCATSDRSSIERAKAAYVGTAIAEYFRDRGLRVLLMMDSLTRFARAQREIGLAAGEPPTRRGFPPSVFAELPRLLERAGMGESGSITAFYTVLAEDDTGSDPIAEEVRGILDGHLILSREIAAKNQYPAIDVLASLSRVMSQIVPSDHSQAAGRLRRLLAKYNEVETLVQVGEYRQGSDAVADEAINRIDAIRDFLSQPTDQLSDYESTLEQLANVTDDA

SEQ ID NO: 85808 - protein, 342 aa, Flavobacteria bacterium BBFL7
MKILVTGGLGFIGSHVVIELLDKDYEVVVVDNLSNSAISVLEGIQAISNKMPEFEKLDLRNKQALSDFFGKHQDINGVIHFAASKAVGESVENPLLYYENNINTLVYLLQELQQLPSSNLIFSSSCTVYGQADTLPITETAPVKPAESPYGNTKQIGEEIIKDVCNVDDTLNAIALRYFNPIGAHHSGLIGELPIGAPQNLVPYITQTAMGIREQLSVFGDDYPTIDGTAVRDYIHVMDLAKAHVVALERLINNEMVSNYETFNIGTGKGSTVLEVVQAFEKVTGKALNYKIVPRRDGDVTAAYADTTLANSVLGWKSQFTLQEALASAWKWQQNIEVVTES

SEQ ID NO: 85809 - protein, 152 aa, Populus x canadensis
MDVVSQLQRQLADFLAPLYREGFVDDQFTQLQKLQDESSPDFVIEVVSLFFEDCEKLVSNMAKALEQQVVDFKQVDSHVHQLKGSSSSIGAARIKNVCVAFKTFCEAQNREGCLRCLQQVNHEYTQLKANLQTLFTLERQIVAAGGSVPAMQ

SEQ ID NO: 85810 - protein, 393 aa, Phytophthora arecae
LVTELGEYRAAVPSGASTGEFEALEMRDGGKAYMGKGVLNAVKNVNEIIAPALVGKDVTQQAELDRFMVETLDGTQNEWGWCKKKLGANAILGVSLALCRGGAAAKKQPLWQYIADLAGNPTPCLPVPSFNIINGGSHAGNKLAMQEFMILPVGATSFTEAMQIGSEVYHNLKKVIKGRYGLDATAVGDEGGFAPNIQSNGEAIDLIEEAIKAAGYTNQVRLGMDVAASEFYTGAADARYNLDFKNENAPDSEKIPADKLQEVYEGFIAKCAGSSKIVSIEDPFDQDDWESWIKFTGKVGKDVQIVGDDLTVTNPTRVKKAIEQKACNALLLKVNQIGSITESIEAVTMAKKAGWAIMASHRSGETEDTFIADLAVGLSAGQIKTGAPCRSER

SEQ ID NO: 85811 - protein, 392 aa, Phytophthora heveae
LVTEMGEYRAAVPSGASTGEFEALEMRDGGAAYMGKGVLNAVKNVNEIIAPALVGKDVTQQAELDRYMVETLDGTQNEWGWCKKKLGANAILGVSLALCRGGAAAKKQPLWQYIADLAGNPTPCLPVPSFNIINGGSHAGNKLAMQEFMILPVGASSFTEAMKIGSEVYHNLKKVIKGRYGLDATAVGDEGGFAPNIQSNGEAIDLIEEAIKAAGYTNQVRLGMDVAASEFYTGAEDARYNLDFKNENAPESEKISADKLQEVYEGFIEKCAGTSKIVSIEDPFDQDDWASWIKFTGKVGKDVQIVGDDLTVTNPTRVKKAIEQKACNALLLKVNQIGSITESIEAVTMAKKAGWAIMASHRSGETEDTFIADLAVGLSAGQIKTGAPCRSE

SEQ ID NO: 85812 - protein, 408 aa, Flavobacteria bacterium BBFL7
MKELLKRYENAEPEIVFHWNDPETEAQGWTVINSLRGGAAGGGTRMRAGLDKNEVLSLAKTMEIKFTVSGPAIGGAKSGINFDPRDPRKKGVLERWYKAVSPLLKSYYGTGGDLNVDEIHEVIPITEDCGVWHPQEGVFAGHFSPTEADKINRIGQLRQGVIKVIENPIYSPDVSRKYTVADMITGYGVAEAVKHFYDIYGGDVKGKRAVVQGFGNVGSAAAYYLSQMGAKVVGIIDRVGGLINEDGFSFEEIKEMFLNKDGNALRSSELIPFEEVNEKIWSLKTEIFAPCAASKLVSQDQIDQMIASGLEVISCGANVPFADKEIFFGSIMEHTDEKVSLIPDFISNCGMARVFAYFMERRVQMTDEAIFNDTSMTIRNAIQNTYNNNSSRTQISSTAFEIALKQLV

SEQ ID NO: 85813 - protein, 565 aa, Thermobifida fusca YX
MEPDRGCSPAAGEQTLTGVAASPGKATGPVAVLAAPPTLPPRRPAVTDPDAEIARATAALHQVADQFRRQAATVDGEAREILEAQALMASDPQLAAGIAERVRNGLAAEWALDEAVASYQELLRGAGEYVAGRAADLGDIRNRALAVLLDVPMPRPPVPGHPFVLVADDLAPADVARLDADTVLAIVTRVGGATDHTAILARSLGIPAVVGCAEAHQLCEGTPVTVDGDQGTVVVHSSAQQCTTQRHSRPQAARGLATGPGRTKDGQRVELLLNLGGEDPERAARHDCEGVGLLRTEFLFMDRVAEPTGAEQSAAYARVFRAFGGRVVTVRTLDVGADKPLAFLAQENEPNPALGVRGFRMVRTSPEVLRRQLAAVARAAQETRTRVRVMAPLVATPQEAADFVALAREAGIAEVGVMVEVPSAALLADRVVREVDFVSIGTNDLAQYTLAADRTRPALSDLLDPWQPAVLHLVGRVGAAGREAGRPVGVCGEAAADPLLALVFVGLGVTSLSMAAAALPVVRGALARHTVADCRKLAALAMDAAGPCEARETVRAAVDPAVLDA

SEQ ID NO: 85814 - protein, 348 aa, Oryza sativa Japonica Group
MMGDFLSRVLLLAFGYAYPAYECYKTVELNKPEIEKLIFWCQYWILVALLTVLERFGDFAISWLPLYSEAKLMFFIYLWCPRTKGTSYVYETFFRPYISQYENDIDCSILDLRVRAGDMLVVYWQKVAIIGQTTFFNILKYASAQSPAHSSRSRSTQQQSYPQKQQQAQPQQPKQSLPQQQQKQSLPQQQQQQMPHEKPTTLRRAASAAARTAGIMQQSEDTKIAYSNPKTRRLLPTKSAPTASTRSTVAATKPVEDLKSSGMKLATEEAPSPSSNAAMPGSEPSAPPLPKSAEDDMSIDEVDIPIEDMDEPVATPEETPMEEAIRVTRGRLRKRIAAVSTADGGAAN

SEQ ID NO: 85815 - protein, 347 aa, Oryza sativa Japonica Group
MMGDFLSRVLLLAFGYAYPAYECYKTVELNKPEIEKLIFWCQYWILVALLTVLERFGDFAISWLPLYSEAKLMFFIYLWCPRTKGTSYVYETFFRPYISQYENDIDCSILDLRVRAGDMLVVYWQKVAIIGQTTFFNILKYASAQSPAHSSRSRSTQQSYPQKQQQAQPQQPKQSLPQQQQKQSLPQQQQQQMPHEKPTTLRRAASAAARTAGIMQQSEDTKIAYSNPKTRRLLPTKSAPTASTRSTVAATKPVEDLKSSGMKLATEEAPSPSSNAAMPGSEPSAPPLPKSAEDDMSIDEVDIPIEDMDEPVATPEETPMEEAIRVTRGRLRKRIAAVSTADGGAAN

SEQ ID NO: 85816 - protein, 218 aa, Glycine max
  misc_feature (101)..(101): Xaa can be any naturally occurring amino acid
MATISAVQVEFLEFPAVVTSPASGKTYFLGGAGERGLTIEGKFIKFTGIGVYLEDKAVPSLAAKWKGKTSEELVHTLHFYRDIISGPFEKLIRGSKILPLXGAEYSKKVMENCVAHMKSVGTYGDAEAAAIEKFAEAFKNVNFAPGASVFYRQSPDGILGLSFSEDATIPEKEAAVIENKAVSAAVLETMIGEHAVSPDLKRSLASRLPAVLSHGIIV

SEQ ID NO: 85817 - protein, 158 aa, Mycobacterium sp. JLS
MSLPRVGLGTDVHPIEPGRPCRLLGLHFDGADGCAGHSDGDVAAHALCDALLSAAGLGDLGGVFGTGRPEWEGVSGADMLRHVRGLLQEAGFRVGNATVQVIGNRPKIGPRRAEAQELLSELIGAPVSVSATTTDGLGLTGRGEGLAAIATALVVDEG

SEQ ID NO: 85818 - protein, 127 aa, Zea mays
MELLRAFRLSRSGAQTWSGAGLHRYLAFQVQIQGGDFVPGDGKHKKDFLASCCSPVGGIITDPCEHEWMQTVETTSRRLADRKTAKFQKNITRRGSVPETTVKKGNDYPVGPLVLGFFIFVVIGSLC

SEQ ID NO: 85819 - protein, 227 aa, Zea mays
MGQQRTLVYSFVARGTIVLADHAEVSGNFASVAAQCLQKLPANNNRFNYNCDGHTFNYHIYDGFILLDDTTYCVVATESAGRQLPVGFIERVKEDFSKKYSGGKAKNASANGLKREYGPKLKEHMRYCDQHPEEIDKLAKVKAQVTEVKGVMMQNIEKVLDRGEKIELLVDKTEDLRSQAQDFRQQGTKIRRKMWWENMKMKLIVFGIVVALILLIVLTVCKDLNCW

SEQ ID NO: 85820 - protein, 492 aa, Oryza sativa Japonica Group
MVLSKAVSESDMSVHSTFASRYVRASLPRYRMPENSIPKEAAYQIINDELMLDGNPRLNLASFVTTWMEPECDKLIMAAINKNYVDMDEYPVTTELQNRCVNMIAHLFHAPLGEDETAVGVGTVGSSEAIMLAGLAFKRRWQNKRKAEGKPFDKPNIITGANVQVCWEKFARYFEVELKEVKLRDGYYVMDPEKAVDMVNENTICVAAILGSTLNGEFEDVKLLNDLLDKKNKETGWETPIHVDAASGGFIAPFLYPELEWDFRLPWVKSINVSGHKYGLVYAGIGWCIWRNKEDLPEELIFHINYLGTDQPTFTLNFSKGSSQVIAQYYQLIRHGFEGYRNIMENCHENAMVLKEGLVKTGRFDIVSKDEGVPLVAFSLKDRSRHDEFEISDMLRRFGWIVPAYTMPPDAQHVTVLRVVIREEFSRTLAERLVLDIEKVMYQLDALPSRLMPPVPPAPLLVVAKKSELETQRSVTEAWKKFVLAKRTNGVC

SEQ ID NO: 85821 - protein, 112 aa, Rhizobium etli
MTMEKQVPIVTFRTRVRDESISGPNPYRWEDKTTDDYFSGKRVILFSLPGAFTPICSTFQLPDFESLYVEFKKNGIDDIYCLSVNDAFVMNAWGKSQGLKNVKLIPDGSGEF

SEQ ID NO: 85822 - protein, 569 aa, Arabidopsis thaliana
  misc_feature (510)..(510): Xaa can be any naturally occurring amino acid
MEHYEVLEQIGKGSFGSALLVRHKHEKKLYVLKKIRLARQTGRTRRSAHQEMELISKIRNPFIVEYKDSWVEKGCYVCIVIGYCKGGDMAEAIKKANGVEFSEEKLCKWLVQLLMALEYLHASHILHRDVKCSNIFLTKDQDIRLGDFGLAKILTSDDLASSVVGTPSYMCPELLADIPYGSKSDIWSLGCCMYEMTALKPAFKAFDMQGLINRINRSIVAPLPAQYSTAFRSLVKSMLRKNPELRPSASDLLRQPLLQPYVQKVLLKLSFREHDTLPSESERRSSYPQQRKRTSGKSVSFGPSRFGVDQEDSVSSVKPVHTYLHRHRPVDLSANDTSRVVVRRPAVSSVVSNSSKYVPVRSNQPKSGGLLKPAVVTRRASLPISQKPAKGTKDSLYHPNIGILHQLNSPDVSVNSPRIDRIKFPLASYEEMPFIPVVRKKKGSSRGSYSPPPEPPLDCSITKDKFTLEPERETKSDLSDQNATAGASSRASSGASRRQRFDPSSYRQRXAEALEGLLEFSARLLIDERYDELNVLLKPFGPGKVSPRETAIWLSKSFKESSPSNLEED

SEQ ID NO: 85823 - protein, 376 aa, Streptomyces avermitilis MA-4680
MTKTERDQPAEEASGADRLREELSNFLGAQVEKLAEKAGDKLSDVTGQLTDVAEGGGGLPAIGSRILQGDSPLKAFVSEKAKGLKDNVLGKAKEALGGGKGKRKASGGKVMNIIEVLDVGVPLRAAYDHWTQYDKFSSFAKGVRDVSKTDEVGSNWKVKVGPSSRSYKATVQEQIPDDRIVWTSEGAKGTTRGAVSFHELAPTLTRIVLVVEYYPSGFFEKTGNLWRAQGRRLRLDFKHFQRYVSLTQEEPEGWRGEIRDGEVVVSHEDAVEEEEAAEQEESEGEEPEEEGEGEAEGEAEDDADYEYEDEDEDEGEGAAEEADEYEDEDEEGAEDEEGAYEDEDEDAVEDEEGEEDEEDEDVAPSRKQRRQRRGRG

SEQ ID NO: 85824 - protein, 418 aa, Bartonella henselae str. Houston-1
MARIVMKFGGTSVANIERIYNVAQHVKREVDAGNEVAVVVSAMAGKTNELVQWTCDASPIHKDAYEYDVVVASGEQVTAGLLALTLQEMGVNARSWLGWQIPIHTDSAHGSARITDIDGSFLIQRFQEGQVAVIAGFQGLAPDNRISTLGRGGSDTSAVAMAAAIQADRCDIYTDVDGVYTTDPRVEPKARRLPKVAFEEMLEMASLGAKVLQVRSVELAMVHNVRTFVRSSFEDPNALGMGDPMNSSGTLICDEDEIVEQQNVTGIAFAKDEAQISLRRLADRPGISAAIFGPLAEARINVDMIVQNISEDGSKTDMTFTVPSADVDKAVALLEKNRKEIGFDVIQSESGLAKISVIGVGMRSHAGVAATAFRALAEKGINIQAITTSEIKISILIDSVYTELAVRTLHAVYGLDKG

SEQ ID NO: 85825 - protein, 311 aa, Caulobacter crescentus CB15
MTQPRHFIDLWKLDGATLRLLLDDAHARKAARKGWPQGKVDADAPAKDRVLSMIFQKNSTRTRFSFDAAMRQLGGSAIISTASDMQLGRGETIEDTAKVLSRMVDAVMIRANSHADVERFAQVSTVPIINGLTDKSHPCQIMADILTIEEHRGPIAGKTIAWVGDGNNVCSSFIHAAPLLGFELKIACPAVYHADLHDLARAEGLQGKVSMTTDPKAAVSGADVVVADTWVSMGDTDHDERLAALEPYQVDDRLMDLAAGNGVFLHCLPAHRGEEVTDAVLDGPRSLVWDEAENRIHAQKSVLAWCFGAIG

SEQ ID NO: 85826 - protein, 376 aa, Streptomyces avermitilis MA-4680
MDDTAKVTLAAAVVGGYVLGRTKKGRMALSIATYLAGRRFGLEPRQLATEGMRRLGEMPQFAQLQEQLRGEVLDAGRKAVTAAADRGMSSLADALSDRTARLGKKGEEEEGEEEEGEEEYAPDEEGAEGEEEEEEEEEEPEEEEPEEEEEEPEAAYEEEEEEEEEEEQPEGEYEEEEEEEEEEEEPEGEEEEEEEEEEEEEEEEPEPEETRPRRPRSARQSARSRKARGPEAREKAAPAGEEKPRTAKKAAARKAAPAKKTPAKKAAAKKTAPAKKSAPGKTAAKKAAAKKSAPAKKSAPGKTAAKKAAAKKSAPAKKSAPGKTAAKKAAAKKTAPAKKSAAKKSAAKKTAPAKKSAARKTTSSKRAASKRADRRR

SEQ ID NO: 85827 - protein, 405 aa, Caulobacter crescentus CB15
MSTATSSTTSQHHIMGVYNRAPLAFERGRGARLISTEGEEYLDCVAGIATNGLGHAHPALVEVLKAQAEKLWHVSNIYRIPEQEELADALCANSFADVVFFTNSGTEAVECALKTARKYHSANGQPERIDIYGFDGSFHGRTYAAVNASGNPSYVDGFGPRLPGYSQLTFGDHDAIKAAIASPTTAAIIVEPVQGEGGARSIPTQCLVGLRQLCDEHGVLLIYDEVQCGMGRTGKLFAYEWAEGGEPHIMAVAKALGGGFPIGACLATTEAAKGMTVAAHGSTFGGNPLAMAVGKAALEIIKSPETLDNVKTVSGFFTQQLNGLKDRFPDVIVDVRGKGMLIGVKLIPNNRDFMVLARDEKLLIAGGGDNCVRLLPPLNLTIEEASEAIAKLEKACEAARAKAAA

SEQ ID NO: 85828 - protein, 152 aa, Populus x canadensis
MDVLSQLQRQLADFLAPLYREGFVDDQFTQLQKLQDESSPDFVMEVVSLFFEDCEKLVNNMAKALEQQVVDFKQVDSHVHQLKGSSSSIGAARIKNVCIAFKTFCEAQNREGCLRCLQQVNHEYTQLKANLQTLFTLERQIVAAGGSVPAMQ

SEQ ID NO: 85829 - protein, 393 aa, Oceanicola granulosus HTCC2516
MTLAAGRHYLAIPGPSVMPDPVLAAMHRPAPNIYEGELVDMTATIAADLKRIAVTEHQVAIYIANGHGAWEAALANVCAPGETVLCCVTGRFGEGWAEMARGLGLVAEEIDFGLSSALDAGRIEAALREDRAGRIRAVLVNHVDTATTVRNDIAAVRAAIDAAGHPALLMVDCIASLGCDPFEMDALGADVVVAASQKGLMTPPGLGFLFFNERADAVQRANKVSGYWSWTVRARPEMFYQFFGGTAPTHHLYGLRTALDMLLAEGLEAIWHRHEVLSGAIWAAVDAWGQGGAMRLNVPRPEERSFAVTSVHLPEGKAEELRRFCSERLGVTLGIGLGRDPGVDYLRVGHMGHVNAHMVLGVVGVMEAGMAALSIPFGPGAGSAAAEVVARGC

SEQ ID NO: 85830 - protein, 431 aa, Euglena gracilis
MPVIKTVKARQILDSRGNPTVEVDVILDNGLLGRGAVPSGASTGEYEAVELRDGDKAVYLGKGVLKSVEAVNTIVAPKLVGLDPTEQLKIDNLMRELDGTPNKGKIGANGILGVSMAVCRAAALVKGVPLYRHIGDLHGNKTFQMPVPMCNIINGGKHADNKIDFQEFMVMPVGAANFSEGLRWCAEIFHHLKSILKKAGHVTSVGDEGGFAPNLDNDEALDFVIAAIKAAGFEPGKQIAIALDCASSELFDEGDRKGYKYWKSNPDRLFSAAEMIEKYAGWVAKYPIVSIEDPLDQNDWDGYVNMTKQLGGKIQIVGDDFFVTNPTRFKKGIELAACNSILIKVNQIGTVSETLECIKMAQAAGYTAVASHRSGETEDAFIADLAVGTAAGQIKTGSLSRTDRMAKYNQLIRIEEELGGEAKWTTAMLRK

SEQ ID NO: 85831 - protein, 162 aa, Desulfovibrio vulgaris subsp. vulgaris str. Hildenborough
MRHVLSVLVENEPGVLSRVAGLFSGRGFNIESLNVAPTLDRGVSLMTISTRGDEQVKEQIVKQLRKLVTVIKVVDFEGLATVEREMVIVKVQAEDTRRAEVLRIADIFRCKVVDVSLNDLTLEATGDHGKIEAIISLLQKFGIKEVARTGTVALRRSMQPEI

SEQ ID NO: 85832 - protein, 485 aa, Euglena gracilis
FFSILPIMANNTADIQYLRQHNIPELVNDLIQQLVTTKPAQPVAFLRDVLSKRKAVIKVVKARQILDSRGNPTVEVDVILDNGVVGRGAVPSGASTGEYEAVELRDGDKKVYLGKGVLKSVNAVNTLVAPKLIGLDPANQREIDELMKQIDGTPNKGKIGANGILGVSMACCRAAALTQGIPLWKHIANLHGNKDNFQLPVPMCNIINGGKHADNKIDFQEFMIMPIGAKSFSEGLRWVTEIFHTLKALLKKAGHVTSVGDEGGFAPDLSNDEALEFVMKAIKAAGYTPGTQIGVALDCASSELFDEGGRKGYKFWKSNPSKLFSAQEMIDIFCRWCDEYPIVSIEDPLDQNDWDGYVNMTKKMGRRTQIVGDDFFVTNPARFSKGIGMNACNAILIKVNQIGTVSETLECIKMAQAHGYGSIASHRSGETEDAFIADLAVGTGCGQIKTGSLSRTDRMAKYNQLIRIEEELGAQAKWTTKHLVR

SEQ ID NO: 85833 - protein, 392 aa, Phytophthora capsici
LVTEIGEYRAAVPSGASTGEFEALEMRDGGKDYMGKGVLNAVKNVNEIIAPALVGKDVTKQAELDRFMVEELDGTQNEWGWCKKKLGANAILGVSLALCRGGAAAKKQPLWQYIADLAGNPSPCLPVPSFNIINGGSHAGNKLAMQEFMILPVGATSFTESMKIGSEVYHNLKKVIKGRYGLDATAVGDEGGFAPNIQSNGEAIDLIEEAIKAAGYTNQVRLGMDVAASEFYTGASDARYNLDFKNENAPESEKIPADKLQEVYEGFIAKCADSSKIVSIEDPFDQDDWASWVKFTAKVGKDVQIVGDDLTVTNPTRVKKAIEQKACNALLLKVNQIGSITESIEAVTMAKKAGWAIMASHRSGETEDTFIADLAVGLSAGQIKTGAPCRSE

SEQ ID NO: 85834 - protein, 492 aa, Rhodopirellula baltica SH 1
MSGDCDFGLIGLAVMGENLALNVESRGYKVAVYNRTTSKVDALMEGRAKGKNFVGCHSIEEFVKSVKRPRRLMMLVKAGPAVDALIEQLLPHCEPGDIIIDGGNEYYVHTERRTKQVEEAGMLYVGCGVSGGEEGALKGPSLMPGGSAEAWPHIKEMFQSIAAKVGPNNDIPCCEWLGAGGAGNYVKMVHNGIEYGDMQLICEAYQLLKELGGLSNDELYDVFDEWNRGDLQSYLIEISRDIFSVKDDQGGDGYLVDKIMDVAGAKGTGKWMSQLALDLGVPSTLVTTAVFARGLSAQKEARTRASKTLNGPAESSNPEMRAIAQSLVGDRAEFVEAVRQALYASKIVSYAQGFVQLQAASAEHNWGLDYGAAALLWRGGCIIRAQFLDRIKEAFDADPNLENLLLAKYFEDAVENAQEKWRKVVAIASIMGIPVPAFSTALCYYDGYRMERLPANMLQAQRDYFGAHTYQRVDKEGTFHSEWIQLRKEPKA

SEQ ID NO: 85835 - protein, 391 aa, Phytophthora fragariae
VTEIGEYRAAVPSGASTGEFEALEMRDGGKAYMGKGVLNAVKNVNDIIAPALIGKDVTKQAELDRYMVEELDGTQNEWGWCKKKLGANAILGVSLALCRGGAAAKKQPLWQYIADLAGNPTPCLPVPSFNIINGGSHAGNKLAMQEFMILPVGATTFTEAMKIGSEVYHNLKKVIKNRYGLDATAVGDEGGFAPNIQSNGEAINLIEEAIKAAGYTDQVRLGMDVAASEFYTGAEDARYNLDFKNENAAESEKISADKLQEVYEGFIAKCADSSKIVSIEDPFDQDDWASWVKITSKVGKDVQIVGDDLTVTNPTRVKKAIELKACNALLLKVNQIGSITESIEAVTMAKKAGWAIMASHRSGETEDTFIADLAVGLSAGQIKTGAPCRSE

SEQ ID NO: 85836 - protein, 354 aa, Glycine max
  misc_feature (144)..(144): Xaa can be any naturally occurring amino acid
PEVTHSEDGMETLRRFLFDVCGVGAGWKMEDVMEEEIKVIKETVGPDEHVICALSGGVDSTVAATLVHKAIGDRLHCVFVDNGLLRYKERERVMETFEKDLHLPVVCVDAVGQFLTKLKGVVDPETKRKIIGKEFICIFDAFAXELEGKLGKKPSYLVQGTLYPDVIESCPPPGTGRTHSHTIKSHHNVGGLPKDMKLKLIEPLKLLFKDEVRQLGRILDVPVAFLRRHPFPGPGLAVRVLGDVTEGNALDILRQVDEIFIQSIKDAGLYDSIWQAFAVFLPVRSVGVQGDQRTHSHVVALRAVTSQDGMTADWYYFEHKFLDDVSRKICNGVRGVNRVVQDITSKPPSTIEWE

SEQ ID NO: 85837 - protein, 259 aa, Solanum lycopersicum
MANKLRLEGKVAIITGAASGIGEASARLFVEHGARVVVADIQDELGQKVVDSIGSDKASYRHCDVTDEKQVEETVAYAVEKYGTLDIMFSNVGTLNFCSVLDMDVLAFDETMAINVRGSALAVKHAAKVMVDKKIRGSIICNASLEGILAGAASLAYIASKHAVVGIIKAAARELGPHGIRVNGVSPYGIATPLVTKAYGLDAALLEEAIYGNGHLKGVKLSTMHVAQSALFLASDESAYTSGQNLAVDGGLSSILKLQ

SEQ ID NO: 85838 - protein, 393 aa, Phytophthora sinensis
LVTELGEYRAAVPSGASTGEFEALEMRDGGKAYMGKGVLNAVKNVNEIIAPALIGKDVTKQAELDRFMVEELDGTQNEWGWCKKKLGANAILGVSLALCRAGAAAKKQPLWQYIADLAGNPTPCLPVPSFNIINGGSHAGNKLAMQEFMILPVGATSFTEAMKIGSEVYHNLKKVIKGRYGLDATAVGDEGGFAPNIQSNGEAIDLIEEAIKAAGYTNQVRLGMDVAASEFYTGAEDARYNLDFKNENAPESEKISADKLQEVYEGFIAKCAGSSKIVSIEDPFDQDDWASWVKFTAKVGEDVQIVGDDLTVTNPTRVKKAIEQKACNALLLKVNQIGSITESIEAVTMAKKAGWAIMASHRSGETEDTFIADLAVGLSAGQIKTGAPCRSER

SEQ ID NO: 85839 - protein, 390 aa, Phytophthora cinnamomi
TELGEYRAAVPSGASTGEFEALEMRDGGKAYMGKGVLNAVKNVNEIIAPALIGKDVTKQAELDRYMVEQLDGTQNEWGWCKKKLGANAILGVSLALCRAGAAAKKQPLWQYIADLAGNPTPCLPVPSFNIINGGSHAGNKLAMQEFMILPVGATSFTEAMKIGSEVYHNLKKVIKGRYGLDATAVGDEGGFAPNIQSNGEAIDLIEEAIKAAGYTNQVRLGMDVAASEFYTGAEDARYNLDFKNENAPESEKISADKLQEVYEGFIAKCAGSSKIVSIEDPFDQDDWASWVKFTGKVGEDVQIVGDDLTVTNPTRVKKAIEQKACNALLLKVNQIGSITESIEAVTMAKKAGWAIMASHRSGETEDTFIADLAVGLSAGQIKTGAPCRSE

SEQ ID NO: 85840 - protein, 75 aa, Arabidopsis thaliana
  misc_feature (51)..(51): Xaa can be any naturally occurring amino acid
  misc_feature (53)..(53): Xaa can be any naturally occurring amino acid
  misc_feature (60)..(61): Xaa can be any naturally occurring amino acid
  misc_feature (64)..(64): Xaa can be any naturally occurring amino acid
  misc_feature (69)..(69): Xaa can be any naturally occurring amino acid
MASSMLSSTAVVTSPAQATMVAPFTGLKSSASFPVTRKANNDITSITSNGXKXVAAMKVXXPNXKEEVXTLSYLP

SEQ ID NO: 85841 - protein, 385 aa, Phytophthora cinnamomi
  misc_feature (45)..(45): Xaa can be any naturally occurring amino acid
GEYRAAVPSGASTGEFEALEMRDGGKAYMGKGVLNAVKNVNEIIXPALIGKDVTKQAELDRYMVEQLDGTQNEWGWCKKKLGANAILGVSLALCRAGAAAKKQPLWQYIADLAGNPTPCLPVPSFNIINGGSHAGNKLAMQEFMILPVGATSFTEAMKIGSEVYHNLKKVIKGRYGLDATAVGDEGGFAPNIQSNGEAIDLIEEAIKAAGYTNQVRLGMDVAASEFYTGAEDARYNLDFKNENAPESEKISADKLQEVYEGFIAKCAGSSKIVSIEDPFDQDDWASWVKFTGKVGEDVQIVGDDLTVTNPTRVKKAIEQKACNALLLKVNQIGSITESIEAVTMAKKAGWAIMASHRSGETEDTFIADLAVGLSAGQIKTGAPCR

SEQ ID NO: 85842 - protein, 348 aa, Thermobifida fusca YX
MHAVQYREVGQPPRVVDVDVPTPGPGQILLRVTAAGICHSDLTVMHWDAKTLPYQLPLTLGHEGAGVVEAVGENVNAVSVGDSVVVYGPWGCGTCHACSQGRENYCPRAARLGIMPPGLGRPGALAEYLLVDSERHVVPIGDLDPVKTVPLTDAGLTPYHAIKRSMSKLEPGSVAVVIGAGGLGHVGIQLLRLMSAATVVALDIREESRELALRSGAHHALPSDSKAVGLVRELTDGAGADVVFDFVGAQVTLDLAAQMAGLDSHINIIGIGGGSLPVSFDSLPYGTRVSTSYWGTRSELIELVELAKQGAIDVHVERYELEEGPEVYKRMEAGKIQGRAVLVPAQRS

SEQ ID NO: 85843 - protein, 69 aa, Zea mays
LPLKLTCSKRYHRNCLKSWGEHRDLFHWSSWVCPSCRSCEVCRRPGDPNKLMFCKRCDGAYHCYCQQPS

SEQ ID NO: 85844 - protein, 404 aa, Azoarcus sp. EbN1
MIAGKSVLAFVMAGGEGSRLHPLTAERSKPSVPFNGRHRIVDFVLSNLVNSEIYSIYLLVQYKSQSLIEHTRRAWVMSPLLPHHFVTVVPPQMQHGPEWFQGTADSVYQNLHLVELVKPDLVVVFGADHVYRMDLRQMIEFHIATQADATVAALPVPLEHTSSFGIIRTDSAGRIRDFREKPESAEPMPGRPGHALASMGNYVFSADLLVDALRRAHSRGGHDFGKNLLPAMAERNRVMAYDFTTNRMRGIRDYEEPAYWRDVGTIDAYYDANFDTLGEFPKFCMSNPHWPIYANPDQTEAAQVHDGHIRTASLGAGVVIRRAVIERSLLRREVVVEEGAEVVDSIIMDRSVIGKGARVRRAIIDQYNFVPPGMKIGYDPEADRQRFHISESGVVVVGKGQLKP

SEQ ID NO: 85845 - protein, 374 aa, Oceanicola granulosus HTCC2516
MSRAALIVAAGRGTRYGGPLPKQWLPLAGRRVIDHAIAAFRAAGFERIVAVLHPDDLGLLEGVETVAGGASRAESVRAGLELLAADPPATVWIHDGARPLLRPDLLARLAEAGAGADGAAPALAVTDALWTGADGRVSGVRDRTGLWRAQTPQMFGFAAILAAHRAHAGEAADDVAVALAAGLDIAIVPGDESNLKITTPGDLERAAAHLESKGAAMDIRTGNGFDVHRFGAGDHVILCGVRVPHGRGLQGHSDADVGMHALTDALYGALAAGDIGRHFPPSDPQWKGAASEIFLAHARDLARTRGYTISNVDVTLICERPKIGPHVPEMQREMARILEIDPDRVGIKATTSERLGFTGREEGIAALATATLLA

SEQ ID NO: 85846 - protein, 177 aa, Trichodesmium erythraeum IMS101
MAEQQQRRKKSSRTKEKEIEWQERVVQIRRVTKVVKGGKNLSFRAIVVIGNERGQVGVGVGKAADVIGAVRKGVADGKKHIIEVPLTKSNSIPHPVNGFGGGAKVMMRPAAPGTGVIAGGAVRTVLELAGVQNILAKQLGSNNPLNNARAAVNALDALRTLADVAQEREVPIENLYV

SEQ ID NO: 85847 - protein, 382 aa, Glycine max
MPDFLATNPLTISAAESPRFPFLHSCPTLTPRPQLNPNFRIPFSPKPSKNKSVSLALSSRSNEGSSRGYGFYNELEFEDRKDKTFGLEMNPVVGEDSQSETGSIPFDGVEGGDDKGEDDLVRAQGDADGDGDGLKKGYDDEEGENEKFGGKLRVRRGKEVIRRSNLLAKQVISIHSALSLGFVSQLWVDTSSWMVLFVEVRPNLLSGDSEKFLLDDISQVGDVVLVQDESVTDNEFKMVGLETLVGYKVVTPSRRNIGKVRGYTFGINSGAVEELELDSFGLSIIPSSLVSTYSLLVEDVLEVVSDAVVVHEAAALRIQRLSKGFLGNQNVRVSVDDFEDFDSEQSDTYGPISRRRKSFGRKKPSHRDWDDEDNWELPMDYL

SEQ ID NO: 85848 - protein, 188 aa, Bifidobacterium longum DJO10A
MMTLLQHELTDFKVNAFQNNEFHEVTKDDVLGHWSLFFFYPADFTFVCPTELEDLAKNYAKFKEIGCEIYSVSCDTHFVHKAWHDANEKIAKIEYPMLADPTALLAKDLDTYNEADGMAERGDFIVSPEGKVVAYEVISSNVGRNAEELLRRVQASQFVYEHGDQVCPANWTPGEETIEPSLDLVGQL

SEQ ID NO: 85849 - protein, 567 aa, Oryza sativa Japonica Group
MASSALICDTEQWKGLQAHVGAIQKTHLRDLMDDAERCKAMTAEYEGIFLDYSRQRATGETMEKLFKLAEAAKLKEKIEKMFSGDKINSTENRSVLHVALRAPRDEVIKSDGVNVVPEVWGVKDKIKQFSETFRSGSWVGATGKALTNVVSVGIGGSFLGPLFVHAALQTDPEAAESAKGRQLRFLANVDPVDVARSIKDLDPETTLVVVVSKTFTTAETMLNARTLKEWIVSSLGPDAVAKHMIAVSTNLELVEKFGIDPKNAFAFWDWVGGRYSVCSAVGVLPLSLQYGFPIVQKFLEGAASIDKHFRSSSFEKNIPVLLGLLSVWNVSFLGYPARAILPYSQALEKFAPHIQQLSMESNGKGVSIDGVQLSFETGEIDFGEPGTNGQHSFYQLIHQGRVIPCDFIGVVKSQQPVYLKGEIVSNHDELMSNFFAQPDALAYGKTPEQLHSEKVPEHLISHKTFQGNRPSLSLLLPSLSAYEIGQLLSIYEHRIAVQGFLWGINSFDQWGVELGKSLASQVRKSLHASRMEGKPVQGFNSSTASLLTRYLAVEPSTPYNTTTMPKV

SEQ ID NO: 85850 - protein, 290 aa, Oceanicola granulosus HTCC2516
MLLGTAAQADLTATANVRLGGDALVDADVDVDKNNHNIAEADANVLNRNGTTNARARLGGSSDNGGSGGGSGGSGGGSGGGSGGSGGGSGGSGGSGGGSGGSGGSGGSGSGGSGGGSGGSGGGGSSSGGGSGSGGGSGSGGGGGGSSAGSGGGNDSAGNNGNRNRNRNNGNRNRSAVRSESDRGSDRHDAQRRAQTRAFLESGGQAATGADQGVNLQAILGQRVYSADSYFVGEVARIDGSRGDTVALRVHLNGALGVNRSQAVVEVWPSQIRPDGVWLHMSADALRSYF

SEQ ID NO: 85851 - protein, 396 aa, Photorhabdus luminescens subsp. laumondii TTO1
MADTIFESNVMKTLINRVENVFDLVFHYMPTHIIQAPGRVNLIGEHTDYNDGFVLPCAINYQIVVAAAKREGNIIRVVSVDYGNQLDEFDISQPITFHESKMWANYIRGVVKCLLSRGYIFNGADIVVAGNVPQGAGLSSSAALETVIGQTIKNLYHLVISQTEIALNGQQAENEFVGCHCGIMDQLISAQGKKEHALLIDCRHLTAQAVSMPKDIAVMIINSNKKRELVGSEYNIRRAQCEQAAALFGVKALRDVALDEFEKRNVELDSIVARRARHVITENERTLLAAKALAESDMPLIAELMAQSHQSMRDDFEITVPEIDTLVDIVQQAIGKQGGVRMTGGGFGGCVVALVPQTLVDVVKAAVEQHYFALTGLKETIYVCQASEGADLVETW

SEQ ID NO: 85852 - protein, 391 aa, Phytophthora vignae
VTELGEYRAAVPSGASTGEFEALEMRDGGKAYMGKGVLNAVKNVNEIIAPALIGKDVTKQAELDRFMVEELDGTQNEWGWCKKKLGANAILGVSLALCRAGAAAKKQPLWQYIADLAGNPTPCLPVPSFNIINGGSHAGNKLAMQEFMILPVGATSFTEAMKIGSEVYHNLKKVIKGRYGLDATAVGDEGGFAPNIQSNGEAIDLIEEAIKAAGYTNQVRLGMDVAASEFYTGAEDARYNLDFKNENAPESEKISADKLQEVYEGFIAKCAGSSKIVSIEDPFDQDDWASWVKFTAKVGEDVQIVGDDLTVTNPTRVKKAIEQKACNALLLKVNQIGSITESIEAVTMAKKAGWAIMASHRSGETEDTFIADLAVGLSAGQIKTGAPCRSE

SEQ ID NO: 85853 - protein, 250 aa, Frankia sp. EAN1pec
MTATGDLEGKVAIVTGAANGIGVAIATRFVTEGAKVVIADIDAGGQGVAAELGERATFFSTDVSDPVQTQALVDFTIRHFGGLHVLCNNAGVSGGLRRFLDDDLRDFERVVAVDLYGVMACSRSAARHMVDHGGGAIVNIASGAGITPGIGMLPYRAAKAGVVQFTRCLAVEVGEHGIRANCIAPANISTDINAAFDKATVIRLQPLPHQGRTGDIAEAALYLASDRAAHVTGLVLAVDGGMSLGTPPRR

SEQ ID NO: 85854 - protein, 102 aa, Mycoplasma mycoides subsp. mycoides SC str. PG1
MADIIKITSKEQFDKEIKEGKVLVDFNATWCGPCKMLAPILHDFAKKVDGVKFLDVDVDLNRQVAEKFRIMSIPTLITFENGNQVNKHIGFATPDQLKKLID

SEQ ID NO: 85855 - protein, 391 aa, Phytophthora sojae
DTELGQYRAAVPSGASTGEFEALEMRDGGKAYMGKGVLNAVKNVNEIIAPALIGKDVTKQGELDRYMVEELDGTQNEWGWCKKKLGANAILGVSLALCRAGAAAKKQPLWQYIADLAGNPTPCLPVPSFNIINGGSHAGNKLAMQEFMILPVGATSFTEAMKIGSEVYHNLKKVIKGRYGLDATAVGDEGGFAPNIQSNGEAIDLIEEAIKAAGYTNQVRLGMDVAASEFYTGAEDARYNLDFKNENAPESEKISADKLQEVYEGFIAKCAGSSKIVSIEDPFDQDDWASWVKFTAKVGEDVQIVGDDLTVTNPTRVKKAIEQKACNALLLKVNQIGSITESIEAVTMAKKAGWAIMASHRSGETEDTFIADLAVGLSAGQIKTGAPCRSE

SEQ ID NO: 85856 - protein, 391 aa, Phytophthora cinnamomi
VTELGEYRAAVPSGASTGEFEALEMRDGGKAYMGKGVLNAVKNVNEIIAPALIGKDVTKQAELDRYMVEQLDGTQNEWGWCKKKLGANAILGVSLALCRAGAAAKKQPLWQYIADLAGNPTPCLPVPSFNIINGGSHAGNKLAMQEFMILPVGATSFTEAMKIGSEVYHNLKKVIKGRYGLDATAVGDEGGFAPNIQSNGEAIDLIEEAIKAAGYTNQVRLGMDVAASEFYTGAEDARYNLDFKNENAPESEKISADKLQEVYEGFIAKCAGSSKIVSIEDPFDQDDWASWVKFTGKVGEDVQIVGDDLTVTNPTRVKKAIEQKACNALLLKVNQIGSITESIEAVTMAKKAGWAIMASHRSGETEDTFIADLAVGLSAGQIKTGAPCRSE

SEQ ID NO: 85857 - protein, 334 aa, Silicibacter sp. TM1040
MTLKIAINGFGRIGRNVLRALLENDTTDVEVVAINDLAPPATQVHLLKFDSVHGRLDAEVTVEGDTMKVGRHEIRLTAIRNPEELPWSDVDIAYECTGLFTTRDKAAAHLKNGSKRVLISAPGTEVDRTVVFGVNDRDLTAEDIVVSNASCTTNCLAPVAKVLDDAFGIKTGYMTTIHAYTGDQPTHDTTHKDLYRARAAALSMIPTSTGAARAISLVLPHLKGRLEGSAIRVPTPNVSVVDLTFQPERVASVEEINAAIAAAAKEGPLQGILGYEEAPLVSIDFNHDKRSSIFAAPQTAVTSEGLVRVVSWYDNEWGFSNRMIDTGRAMGKFL

SEQ ID NO: 85858 - protein, 390 aa, Phytophthora brassicae
TEIGEYRAAVPSGASTGEFEALEMRDGGADYMGKGVLNAVRNVNEIIAPALVGKDVTKQAELDRYMVETLDGTQNEWGWCKKKLGANAILGVSLALCRAGAAAKKQPLWQYIADLAGNPSPCLPVPSFNIINGGSHAGNKLAMQEFMILPVGATSFTEAMKIGSEVYHNLKKVIKGRYGLDATAVGDEGGFAPNIQANAEAIDLIQEAIKDAGYTNQVRLGMDVAASEFYTGVKDARYNLDFKNADGAESEKISADKLLEMYEGFISKCTDSSKIVSIEDPFDQDDWESWVKITGRIGKDVQIVGDDLTVTNPTRVKKAIEQKACNALLLKVNQIGSITESIEAVTMAKKAGWAIMASHRSGETEDTFIADLAVGLSAGQIKTGAPCRSE

SEQ ID NO: 85859 - protein, 432 aa, Synechocystis sp. PCC 6803 [sequence omitted]

SEQ ID NO: 85860 - protein, 530 aa, Lactobacillus acidophilus NCFM
MEKIKRHKIGLFSAVMLALNSLIGSGWLFGSGSAAKIAGPAAIISWILGAVIIIAIALTYVELGSMFPESGGMSRYAQYSHGPLLGFIAAWANWISLVTLVPMEAVAAVQYMSSWPWSWANWTKQFIKNGDITFEGIGVVFIFMIIFTMINFWSVKIMTHFTNLISIFKILLPTLTIVVLICSGFHAQNFGSNIHEFMPYGTRSIFEATSVSGIIMSYDAFQTVINMGGELKNPRKNIVRGVLISMLITAAIYIMLQVTFIGAIEPSILAKVGWHGINFTSPFADIAIILGINWLVILLYLDAFVSPFGTGVAFVATASRALAAMTHTRHLPKWLGRLNQKYLIPRYAMVVDLILAAILVSLFRNWNLLATVITAATLIAYLTGPVTVMTLRKISPNIDRPFKPRYMPWLAPIAFVLTSLAIYWSMWPTTIQVILVIAVGLPVYIYYEIHYQHSNLKEQLKHCWWMIGYLIFISIMSYIGSTGFGGQDWIKYPFDFGIIIIASLVFYYWGIKTGMQRLDPYAEKIARNKK

SEQ ID NO: 85861 - protein, 312 aa, Bacillus clausii KSM-K16
MTVVNNITELIGNTPLVKLNRLATAEHADVYLKLEYQNPGSSVKDRIALAMVNAAEESGELKPGATIVEPTSGNTGIGLAMVAAAKGYKTKLVMPETMSMERRNLLRAYGAELVLTPGPEGMGGAIRKATELAKQDGHFMPQQFENSANPKIHRETTGKELLKQVDGQLDGFVAGIGTGGTITGAGGLLKEHFPELKIVAIEPKDSPVLSGGKPGPHKLQGIGPGFVPGILNTNVYDSVLQVSTEQAFEYARRAAREEGILGGISSGAAIYGALELAKELGPGKKVVAIIPSNGERYLSTPLYQFEEETTHS

SEQ ID NO: 85862 - protein, 197 aa, Bacillus clausii KSM-K16
MILMIDNYDSFTYNLVQYLGEMGQELVVKRNDAITITEIADLNPDCIMISPGPCSPNEAGISLEAIRAFAGKVPIFGVCLGHQAIAQAFGGHVVQAERLMHGKTSNVQHDGKTIFAGLPSPLVVTRYHSLIVKRETLPGCFEISAETTEGEVMAIRHKELAIEGVQFHPESIMTKEGKTLLRQFIDSYQGGTACSSV

SEQ ID NO: 85863 - protein, 121 aa, Bacillus clausii KSM-K16
MDKIFLNQLSFYGYHGVYPEETKLGQHFIVDLVLELDLRHAARHDDLQASIDYGDVHERVKTIVEGKPYKLVEAVAERISAELLQAYDQLQTCTVKVIKPNPPIAGHYDSVAVELTRSRHA

SEQ ID NO: 85864 - protein, 395 aa, Methanosarcina mazei Go1
MTDKIINSGNLEAGYDSVIDKDSKYVMQTYGRQPLVLSKGKGAVVQDIYGKEYIDCVAGIAVNNVGHCHPTVVKAIQAQAEKLIHVSNLYYTEIQAEFAETLASITGMECVFFCNSGAEAVEAAMKLARVATGKSAFVAAEHSFHGRTIGALSVTHKSMYRDPFMPPVSSKTSFVPYSDADAIRKAISEDTAAVVLEPIQGEGGVNVPDPGYLKEVREICDETGTLLIFDEVQTGFGRTGTWFCKEQFGVEPDIMSMAKAIGGGFPMGAIAARSGLSFGRGQHASTFGGGPLACAAALASIQAIKEEKLLERSKEMGAYFTKKLSGMARDDIVEVRGKGLMIGVEIKYPCGKFVDFAREHGVLVNCTSDSVLRLVPPLVITKEQIDSVVDVLEQA

SEQ ID NO: 85865 - protein, 392 aa, Phytophthora katsurae
LVTELGEYRAAVPSGASTGEFEALEMRDGGAAYMGKGVLNAVKNVNEIIAPALVGKDVTQQAELDRYMVETLDGTQNEWGWCKKKLGANAILGVSLALCRGGAAAKKQPLWQYIADLAGNPTPCLPVPSFNIINGGSHAGNKLAMQEFMILPVGASSFTEAMKIGSEVYHNLKKVIKGRYGLDATAVGDEGGFAPNIQSNGEAIDLIEEAIKAAGYTNQVRLGMDVAASEFYTGAEDARYNLDFKNENAPESEKISADKLQEVYEGFIEKCAGTSKIVSIEDPFDQDDWASWIKFTGKVGQDVQIVGDDLTVTNPTRVKKAIEQKACNALLLKVNQIGSITESIEAVTMAKKAGWAIMASHRSGETEDTFIADLAVGLSAGQIKTGAPCRSE

SEQ ID NO: 85866 - protein, 510 aa, Oceanicola granulosus HTCC2516
MTDILQELEARRAVARAGGGAARIEAQHGKGKLTARERIELLLDEGSFEEFDMFVAHRCTEFGMEQNRPAGDGVVTGWGTINGRMVYLYSQDFTVFGGSLSETHAQKICKIQDMALQNGAPLIGLNDSGGARIQEGVASLAGYAEVFQRNILASGVVPQISVIMGPCAGGAVYSPAITDFIFMVKDSSYMFVTGPDVVKTVTNEVVTAEELGGATTHTRRSSVADGAFDNDVEALAEVRRLVDFLPLNNRDRPPVRPFFDEVERIEESLDTLIPDNANTPYDIKELILKVADEGDFYEIQEDFAKNIVTGFIRLEGSTVGVVANQPMVLAGCLDIDASRKAARFVRFCDAFEIPLLTFVDVPGFLPGTGQEYGGVIKHGAKLLFAYGEATVPKVTVITRKAYGGAYDVMASKHLRGDVNYAWPTAEIAVMGARGATEILYRSELGEPEKIAARTKQYEDRFANPFVAAERGFVDEVIQPRSTRRRVCRAFAMLRGKRLSNPWKKHDNIPL

SEQ ID NO: 85867 - protein, 389 aa, Phytophthora cambivora
EIGEYRAAVPSGASTGEFEALEMRDGGKAYMGKGVLNAVKNVNDIIAPALIGKDVTKQAELDRYMVEELDGTQNEWGWCKKKLGANAILGVSLALCRGGAAAKKQPLWQYIADLAGNPTPCLPVPSFNIINGGSHAGNKLAMQEFMILPVGATSFTEAMKIGSEVYHNLKKVIKNRYGLDATAVGDEGGFAPNIQSNGEAINLIEEAIKAAGYTNQVRLGMDVAASEFYTGADDARYNLDFKNENAAESEKISADKLQEVYEGFIAKCADSSKIVSIEDPFDQDDWASWVKITGKVGKDVQIVGDDLTVTNPTRVKKAIELKACNALLLKVNQIGSITESIEAVTMAKKAGWAIMASHRSGETEDTFIADLAVGLSAGQIKTGAPCRSE

SEQ ID NO: 85868 - protein, 390 aa, Phytophthora erythroseptica
EIGEYRAAVPSGASTGEFEALEMRDGGKDYMGKGVLNAVKNVNEIIAPALVGKDVTKQVELDRYMVETLDGTQNEWGWCKKKLGANAILGVSLALCRAGAAAKKQPLWQYIADLAGNPSPCLPVPSFNIINGGSHAGNKLAMQEFMILPVGATSFTEAMKIGSEVYHNLKKVIKGRYGLDATAVGDEGGFAPNIQANAEAIDLIEEAIKAAGYTNQVRLGMDVAASEFYTGAKDARYNLDFKNANAPESEKIPADKLQEMYESFISKCADSSKIVSIEDPFDQDDWESWVKFTGKVGKDVQIVGDDLTVTNPTRVKKAIELKACNALLLKVNQIGSITESIEAVTMAKKAGWAIMASHRSGETEDTFIASLAVGLSAGQIKTGAPCRSER

SEQ ID NO: 85869 - protein, 394 aa, Phytophthora fragariae
LVTEIGEYRAAVPSGASTGEFEALEMRDGGKAYMGKGVLNAVKNVNDIIAPALIGKDVTKQAELDRYMVEELDGTQNEWGWCKKKLGANAILGVSLALCRGGAAAKKQPLWQYIADLAGNPTPCLPVPSFNIINGGSHAGNKLAMQEFMILPVGATTFTEAMKIGSEVYHNLKKVIKNRYGLDATAVGDEGGFAPNIQSNGEAINLIEEAIKAAGYTDQVRLGMDVAASEFYTGAEDARYNLDFKNENAAESEKISADKLQEVYEGFIAKCADSSKIVSIEDPFDQDDWASWVKITSKVGKDVQIVGDDLTVTNPTRVKKAIELKACNALLLKVNQIGSITESIEAVTMAKKAGWAIMASHRSGETEDTFIADLAVGLSAGQIKTGAPCRSERR

SEQ ID NO: 85870 - protein, 631 aa, Oryza sativa
MVQWWEEWQLRVLALTSLFLQLFLLVSATFRKYRVPALLRSCIWLAYLGGDALAIYALATVFNRHRQTASTDHGSVLEVMWVPVFLVHLGGQDSITAYNIEDNELWARHAVAMSSEAAVAVYVFWRSWSGGQVPESSPALLLFAAGFLKLGERLWALRRASFTRLAAVRSSAAGRRTPAREEEEDAGDDHIPLESYVHLASGYVQSQATGDHVPRPKDNYVFHVHPLIEPELQDVLMELFVDFPAPYPRRLAYLRSFLALEDDDAYEELCALLNQAFQFFYTKKEAAYTVVGIYLRTLHHAPGHRGHCKLQRQSQGRICALLWLADWRFVTSRIQPEMQRTVAQFNLIGFATRRRWPTMVVMRIAALFRCKKYVNQHWYLGHLSSTPIIIEFIGKDLKSRWVDDLTNAAAYRRFNDRRGQWTLRRERCYQELGWSVTELPFDEAVLVWHIATDIYLDCNNGIENPPATADERAAVKCSREISNYMMYLLLFQPDMLMPGTRQSLFAVACREIKHALRDQRQRLDERGVARWISENPNAAQPGDHLAAARRLAEAMMQMNDAGRMLKVISGVWVEMICYSASRCRGFLHAKSLGAGGEFLTVVWLLLHRMGMEVLADKLQKPEIPRHVQILP

SEQ ID NO: 85871 - protein, 173 aa, Flavobacteria bacterium BBFL7
MNNEFIESHIHDIPDFPKEGIVFKDISPLLASAKARSITTELLVRDFRGQTIDVVVGIESRGFLFGMLLADALNAKFVMLRKPGKLPGAIISQKYELEYGTDTLELQENAISPGDCVLIHDDVLATGGTAIAAAQIIQKAGGKVEGFNFVIELDFINGREKIKDYKIASVLHY

SEQ ID NO: 85872 - protein, 408 aa, Methylobacillus flagellatus KT
MALIVQKYGGTSVANPERIGNVARRVARHKALGQQVVVVVSAMSGETNRLISLAKEVMPNPDPRELDVLVSTGEQVTIALLSMALMELGVKAKSYTGGQVSIVTDSAHTKARILKIDEERIRKDLDAGYVVVVAGFQGVDEQGNITTLGRGGSDTTGVALAAALKADECQIYTDVDGVYTTDPRIVPEARRLRSVTFEEMLEMASLGSKVLQIRSVEFAGKYKVKLRVLSSFEEEGEGTLITFEDDKDMEQPVISGIAFNRDEAKITVLGVPDRPGIAYQILGPVADANIDVDIIIQNVGADGTTDFTFTVHKNDLQKALNILREKVQPHTGAREIIGDDKTAKVSVVGVGMRSHVGIASQMFRTLAEEGINIQMISTSEIKISVVIDEKYMELAVRVLHKAFGLEEV

SEQ ID NO: 85873 - protein, 175 aa, Alkalilimnicola ehrlichei MLHE-1
MILERVGPGEKAPEEINVIIEIPLRGEPVKYEVDKDSGAMFVDRFMGTAMHYPCNYGYIPNTVCDDGDPADVLVITPFPVITGSVIKCRPIGVLKMTDEAGEDAKVLAVPVGKLTAMYDDIKGPDDLPKLVLDQISHFFEHYKDLEPGKWVKIDGWEGAESAREEIRASIENYQG

SEQ ID NO: 85874 - protein, 116 aa, Synechococcus sp. PCC 7002
MDLKSLIRDIPDFPKPGILFRDITTLLNHPEGMRYTMDALVQLCLEANLKPDHVVGMESRGFIFGPTLAYNLNAGFVPVRKPGKLPAAVHTVEYELEYGTDTLEIHQDAVGSGDKI

SEQ ID NO: 85875 - protein, 172 aa, Medicago truncatula
MESHDEMGCQAPERPILCVNNCGFFGREATMNMCSKCYKDTLLKQEQEKLVATSVENIVNGNSSSNGKLAVTASAVDVRVESVELNTVSPEVPENPISNESVEMKAKTGPSRCATCRKRVGLTGFSCKCGNLFCSMHRYSDKHDCPFDYRTAGQKAIAESNPVIKADKLDKI

SEQ ID NO: 85876 - protein, 360 aa, Zea mays
  misc_feature (224)..(224): Xaa can be any naturally occurring amino acid
  misc_feature (300)..(300): Xaa can be any naturally occurring amino acid
  misc_feature (333)..(333): Xaa can be any naturally occurring amino acid
MKRKENSAHSAPPLNRPRGKRKALAELPKSNGLNMNHDSAPRPSKPRTRSAARAEAEAEAAMKRRKAGDAARWPMDTRQPDAEAAVAPYVGDIDRYLRSLEVEPLRRPSHSYFQDIQKNICPKMRAILVDWLVEVAEEFKLHAETLHLAVSYVDRFLTMNVVARNKLQLLGVTALLVAAKYEEIESSKMKVKRYTDITDNTYTKQQVVKMETDLLKSLSFQIGXPTVTTFLRQFIASCRGGNSASRGKLEFVCSYLADLSLLDYDCISYLPSVVAAACLFVARFTIQPKTRPWNLTLEQXRGRVFDLQKSIYVIHELQLTIRCSDQEVTRKKXKDPKFGCVSTMVSPREIPTSFLEDCHK

SEQ ID NO: 85877 - protein, 222 aa, Brassica napus
PNLVYLDLRFNGFTGSIPESLFNKQLDAILLNNNGFTGEIPENLGSSSASLVNLANNKLSGEIPTSFGISGSKLKEVLFLNNQLTGCIPESVGLFSDIEVLDVSFNSLMGHVPDTISCLSEIQVLNLGHNKFSGDLPDLVCSLRNLLNLTVAYNFFSGFSSECSRISFGFDFAGNCIPGKGYQRPQPDCSVIPGGSLSCLRIPAQPLTCAAILGLKATSSSP

SEQ ID NO: 85878 - protein, 421 aa, Bordetella petrii
MSLIVHKYGGTSMGSVERIRNVARRVAKWHAAGHQVVVVPSAMAGETNRLLGLAREISPQPDPRELDMIAATGEQASSGLLAVALQAEGVPARSYTGWQVPVRTDSSFTKARITSIDDARVRADLDAGRVVIVTGFQGIDPDGHITTLGRGGSDTSAVAVAAALGAHECLIYTDVDGVYTTDPRVVPEARRMSVVSFEEMLEMASLGSKVLQIRSVEFAGKYRVPTRVLSSLTDPLIPLEEEMTSGTLITFEEDEKMEAAVVSGIAFSRDEAKITLLAVPDKPGIAFSILGPVAAANIDVDMIVQNQSVAGTTDFSFTVNRNEFQRTIDLLKREVVPAVQARELVTDDKVAKVSIVGIGMRSHVGVASLMFQTLSQEGINIQMISTSEIKTSVIIDDKYMELAVRALHKAFGLDQAPAEKA

SEQ ID NO: 85879 - protein, 386 aa, Aspergillus oryzae
MTGLGMETIFAKIKEEYARTDDVGKRKIQGHIRELQVGFYSDWDVVMRLSSGPLQVALAKVGIDLGIFRSLKESDTPITLAEFVKKTGASPRLLGRILRTQAAFGLIKETGPQEYTSSAFTDVFANPAAAGAVVQLFDISGPCTQILPDFLAERHYQDITSNKDCVFQKAFDSDLTMFEWMPQHPKHMESLGHLMALERPVSWVDHFPVLEELGDFPAPDKVLMVDIGGGFGQQSKALRAKFPNIPGRVIVQDIPQTLANAQPAAGVEFMEHNFFEPQPIRNAKFYYLRHVFHDWPDEQCVLILKQIIPVMGPESEILIDEMVIPSTGVPWQAAFTDLLMMNSLGGVERTRAEWDYLMKQAGLEIIQSKVYDSKEQTILVAVPRRT

SEQ ID NO: 85880 - protein, 526 aa, Oryza sativa Indica Group
MDVPSVSSVVIPILVVLVSRLLTSALVHLLWKPYAITKLFRGQGITGPKYRLFVGSLPEIKRMKAAAAADEVAAGAHSHDFIPIVLPQHSKWATDHGKTFLYWLGAVPAVSLGRVEQVKQVLLERTGSFTKNYMNANLEALLGKGLILANGEDWERHRKVVHPAFNHNKLKFMSVVMAESVESMVQRWQSQIQQAGNNQVELDLSRELSELTSDVITRSAFGSSHEEGKEVYQAQKELQELAFSSSLDVPALVFLRKLPIIRGNTRAHQLVKKSRTMLMEIIEGRLAKVEAAEAGYGSDLLGLMLEARALEREGNGLVLTTQEIIDECKTFFFAGQDTTSNHLVWTMFLLSSNAQWQDKLREEVLTVCGDAIPTPDMANRLKLVNMVLMESLRLYSPVVIIRRIAGSDIDLGNLKIPKGTVLSIPIAKIHRDRDVWGPDADEFNPARFKNGVSRAASYPNALLSFSQGPRGCIGQTFAMLESQIAIAMILQRFEFRLSPSYVHAPMEAITLRPRFGLPVVLRNLQG

SEQ ID NO: 85881 - protein, 518 aa, Cryptococcus neoformans var. neoformans JEC21
MANESVEGSNWGRVLICGGTDWATNGRKERSSGKVPTDLMEPHILRSLCNVKASKIITGPSANYAIILDIHGAAYLFGRPPAMVQSNGVISENTPLKISPSSVGSPKGTKWVNGAAGRSHFLLVDSNGDVWGCGNNVVGQIGVPVAMVVEKLTKVAGPWVRDPEAKVVQVTAGHTFSLFLTFTGQVYASGSSEFGQLGNGKTGERLVKAGKIAYDIELSQGLVQGLENVKITEIASGNQHSLALDDNGYVYSWGFAGYSRLGLQDQKDRLIFALTGSTGQPYTRFKHIQDVMACKVIKTSSGGCTHFITTPDPEGGVMTVGFGQGVLYGELGLGSDSAKSATKPQKIIPLSGVDMIDVVGGAFFTLFLARPNSALSDLDRYPLHINSASLCLVCNTDHEQDAPLECERCDQPYHIGCLSPPLSAVPEGEWFCPECALEADAGPDEPFKPALGITIPKLANGKKGAKQDVVESRGNPEAAVSATNGALTPSKSVKGGKRSWDEERSAQGSGKKARNSKN

SEQ ID NO: 85882 - protein, 368 aa, Bartonella henselae str. Houston-1
MTYDQKKIVSALRAFERGEIVVVTDDDDRENEGDLIVAAVHCTEEKMAFIIRHTTGIVCAPMPKEEAQRFNLTPMVLDNNSVHRTQFTVTVDFKHGTTTGISAHDRTLAVRNLANSNAGANDFIRPGHIFPLIAHEGGVLMRSGHTEAAVDLCKLAGLPPVGVIGELVNDDGSVKHGDEVTRFAQENQFHIITVADLIAYRQRKEMLIQHVGEMHIETLVGPAVVQSYQLPWEAVQHVAIIFGDIRDGEDIPVRLHRENIVNDVFGQTSDILEIMRRMMKKEKRGVFVYLREGSVGVKSAVSIQALAMRGGESHTQAIEREEEWRQIGLGSQILKHLGISSVILYASKERHYVGLEGFGIRISRTDIL

SEQ ID NO: 85883 - protein, 302 aa, Trichodesmium erythraeum IMS101
MFNTLLADFRIIFERDPAARNWLEVLTCYPGFQALVFHRIAHSLYFHKVPFLPRLISHIARFLTGIEIHPGAVIGQGVFIDHGMGVVIGETAIIGDSCLIYQGVTLGGTGKETGKRHPTLGENVVVGGGAKILGNINIGSNVRIGASSVVLKDVPPNCTVVGIPGRVVDRSGVKVNPLEHGSLPDSEAKVMRALFNRINSLEEQVQLIKILQFQEPELESVVAKPHLKSFANHSNYRLTDLALFNRINYLEEQVKLIKSLQSQLLELDSTVAKPPLKSSANNYSNYDFQDLEIQDFFDGSGI

SEQ ID NO: 85884 - protein, 454 aa, Vibrio vulnificus YJ016
MQRLCCRPLNLTFIFEREETLMSKIVKVLGREIIDSRGNPTVEAEVHLEGGFVGMAAAPSGASTGSREALELRDGDKARFLGKGVLKAIEAVNGAIADALVGKDAKDQAAIDAIMIELDGTENKSKFGANAILAVSLANAKAAAASKGMPLYEHIAELNGTAGQFSMPLPMMNIINGGEHADNNVDIQEFMIQPVGAKTLKEAVRMGAEVFHNLAKVLKSKGYNTAVGDEGGFAPNLKSNAEALEVIAEAVAAAGYVLGKDVTLAMDCAASEFFDKEAGIYNMKGEGKTFTSEEFNHYLAGLVEQFPIVSIEDGLDESDWAGFAHQTQLLGDKIQLVGDDLFVTNTKILAEGIEKGIANSILIKFNQIGSLTETLAAIKMAKDAGYTAVISHRSGETEDATIADLAVGTAAGQIKTGSMSRSDRVAKYNQLIRIEEALGERAPFNGLKEVKGQA

SEQ ID NO: 85885 - protein, 640 aa, Bartonella henselae str. Houston-1
MSRTLTPLLDRVCEPQDLRAFPESDLARLADELRAETIDVVSVTGGHLGAGLGVIELTVALHYVFNTPEDRIIWDVGHQAYPHKILTGRREKIRTLRQEGGLSGFTKRSESVYDPFGAGHSSTSISAGLGMAVASALKAEKRRNIVAVIGDGAMSAGMAYEAMNNAGALNARLIVVLNDNDMSIAPPTGAMSAHLARLVSRPAYRSLRERVKVLGEKLPKFFLDKARRSEEFARGFLVGGTLFEELGFYYVGPIDGHNLKHLLPVLKNVREYPTGPVLIHVVTHKGKGYAPAEASLDKYHGVNRFDIITGKQVKASSNVLPYTKVFSKALREEASYDDKIVAITAAMPTGTGLDFFAEKFPERMFDVGIAEQHAVTFAAGMACEGYKPFVAIYSTFLQRAYDQIIHDVSIQKLPVRFAIDRAGFVGADGATHAGSFDIVFLTTLPEFVVMAPSDEVELMHMVRTAAAYDQGPISFRYPRGEGIGMDLPQRGEILEIGKGRILHEGNRIALVCFGTRISEVLVAADELSAEGLSTTVADARFAKPLDKDLMRRLAREHEVLVTIEEGAIGGFGAHLLQFLAQEGLLEHGLKVRTLKLPDEYLNHGSQEKVLSRIGLDAVGIVNTVFSALGRKIRTVQRVRV

SEQ ID NO: 85886 - protein, 267 aa, Fagus sylvatica
NQRPSLVTGHSHFVEDVALLTDGQFVLSGSWNGEPRLWNLQAGSRLSFVGHTKDVLSVVFSIDNRQIVSASRDRTIKFWNTLGECKFTIQEQDAHTDWVSCVRFSPNTTQPTIVSASWDKTIKVWHLTNCKIKNTLAGHSGYVNTVAVSPDGSLCASGGKDGVILLWDLAEGKRLYSLDAGAIIHALCFSPNRYWLCAATEQSIKIWDLESKSIVEDLKVDLKTEAADKDDATTINSTKKKVIYCTSLNWSADGSTLFSGYTDGVGQ

SEQ ID NO: 85887 - protein, 480 aa, Fagus sylvatica
MGEEGNSWIRRTKFSHTVCHRLDASRLASFPIIIRPERNSGLKSRPGATSSSEKFGTIYNKQRSLSPLPESRLSDVFKEARSETKRFMTPLPRRREQAKGVMGKFVHKDFHEVKASDSKSLANSSALRHLSSMKVNDKSKYRKESSWAKYFDHGGGRVNAVETSDEWTVDLSKLFLGLKFAHGAHSRLYHGIYNDEPVAVKIIRVPEDDENGALGARLEKQFNREVTLLSRLHFHNIIKFVAACRKPPVYCVVTEYLSEGSLRAYLHKLERKSLPLQKLIAFALDIARGMEYIHSQGVIHRDLKPENVLIDQEFHLKIADFGIACEEAYCDSLADDPGTYRWMAPEMIKHKSYGRKVDVYSFGLILWEMVAGTIPYEDMNPVQAAFAVVNKNLRPVIPRYCPPAMRALIEQCWSLQSEKRPEFWQVVKVLEQFESSLARDGTLNLVQSLTCQDHKKGLLHWIHKLGPVHPNGSMPKPKLT

SEQ ID NO: 85888 - protein, 332 aa, Zea mays
MSTANRYQHIKSTKPVVGKARKLKDLMIKSDNRICADCGAPDPKWASANIGVFLCLKCGDVHRALGPDISKVLSVTLDDWSDSDIDSMVEVGGNSYANSIYEAFLPKDHPKPKPDSTMEYRTKFIRAKYETQDFLKPSLRISSRSSFKSTTSVKSVDSNFSSTSRKDVFEDTREFVGELNITLVKGTNLAVRDMLTSDPYVVLTLGGQKVQSTVKKSDLNPVWNEVLKISVPRNYGPLKLEVYDHDMFSADDIMGEAEIDLQPMITAAMAFGDTSRLGDMQIGRWFMTKDNALMKDSTVNVVAGKVKQEVHLKLQNVESGELELELEWVPIL

SEQ ID NO: 85889 - protein, 391 aa, Phytophthora richardiae
VTKIGEYRAAVPSGASTGEFEALEMRDGGKDYMGKGVLNAVKNVNEIIAPALVGKDVTKQVELDRYMVETLDGTQNEWGWCKKKLGANAILGVSLALCRAGAAAKKQPLWQYIADLAGNPSPCLPVPSFNIINGGSHAGNKLAMQEFMILPVGATSFTEAMKIGSEVYHNLKKVIKGRYGLDATAVGDEGGFAPNIQANAEAIDLIEEAIKAAGYTNQVRLGMDVAASEFYTGAKDARYNLDFKNANAPESEKIPADKLQEMYEGFISKCADSSKIVSIEDPFDQDDWESWVKFTGKVGKDVQIVGDDLTVTNPTRVKKAIELKACNALLLKVNQIGSITESIEAVTMAKKAGWAIMASHRSGETEDTFIADLAVGLSAGQIKTGAPCRSE

SEQ ID NO: 85890 - protein, 153 aa, Streptococcus pneumoniae
EHFIRGQYRSGKIDGIKYISYRSEPNVNPESTTETFTSGAFFVDSDRFRGVPFFFRTGKRLTEKGTHVNIVFKQMDSIFGEPLAPNILTIYIQPTEGFSLSLNGKQVGEEFNLAPNSLDYRTDATATGASPEPYEKLIYDVLNNNSTNFSHWD

SEQ ID NO: 85891 - protein, 393 aa, Methanosarcina barkeri str. Fusaro
MYDVYAVREDFPVLKEVVYLDSTATTQTPIPAVEAMVEYFYRYAGNHGRGAHRLAREATNRYEDARETVAHFLNAEPSKTVLTKNTTEGINLIANSYPWEAGDHIVTTVLEHHSNLLPWLRLQKKGVKVTIVSPDSKGKIDISSIEKAFTEKTRLVAINQVSNVFGSVQDVKNITKLAHRYGIKVLVDGAQSAGHMPVSLKDLNCDFFATAGHKGLLGPQGTGVLYIKEPDVLDSASVGGGTVSDVEGYTYVLEPSPACFEAGTPNIPGVIGLGRAVEYVEKIGVPKIEAHEIKLSRETAKRLSELEHVEVYGPDDRAGIVPFNVKGLHAHDVALILDQTRKICVRSGHHCAIPTIRFLNVDSTVRASFALYNTEEEVDILVNAVAGLKALVS

SEQ ID NO: 85892 - protein, 390 aa, Phytophthora lateralis
TELGEYRAAVPSGASTGEFEALEMRDGGSDYMGKGVLNAVKNVNEIIAPALVGKDVTQQVELDRYMVETLDGTQNEWGWCKKKLGANAILGVSLALCRGGAAAKKQPLWQYIADLAGNPSPCLPVPSFNIINGGSHAGNKLAMQEFMILPVGATSFTEAMKIGSEVYHNLKKVIKGRYGLDATAVGDEGGFAPNIQANAEAIDLIEEAIKAAGYTDKVRLGMDVAASEFYTGAKDARYNLDFKNANAPESEKISADKLQEMYEGFISKCASSSKIVSIEDPFDQDDWESWVKITGKVGKDVQIVGDDLTVTNPTRVKKAIELKACNALLLKVNQIGSITESIEAVTMAKKAGWAIMASHRSGETEDTFIADLAVGLSAGQIKTGAPCRSE

SEQ ID NO: 85893 - protein, 153 aa, Streptococcus pneumoniae
EHFIRGQYRSGKIDGMKYISYRSEPNVNPESTTETFTSGAFFVDSDRFRSVPFFFRTGKRLTEKGTHVNIVFKQMDSIFGEPLAPNILTIYIQPTEGFSLSLNGKQVGEEFNLAPNSLDYRTAATATGASPEPYEKLIYDVLNNNSTNFSHWD

SEQ ID NO: 85894 - protein, 518 aa, Brassica napus
  misc_feature (73)..(73): Xaa can be any naturally occurring amino acid
NDKKRKREREREKAEAAAAAAASPQASGGTVTPAPKKRGRKPKSKDESQTQQEQEESGGKMKESGKKTKRRSXSVDEKYTQWKGLVPILYDWLANHNLVWPSLSCRWGPQLDQATYKNRQRLYLSEQTDGSVPNTLVIANCEVVKPRVAAAEHISQFNEEARSPFVKKYKTIIHPGEVNRIRELPQNSKIVATHTDSPDVLIWDVETQPNRHAVLGAASSRPDLILTGHQDNAEFALAMCPTEPFVLSGGKDKMVVLWSIQDHITTVGTDSKSSGSIIKQTGEGGDKTESPSVGPRGVYQGHDDTVEDVAFSPTSAQEFCSVGDDSCLILWDARTGTSPVTKVEKAHDADLHCVDWNPLDDNLILTGSADNTVRLYDRRNLTSNGVGTPIYKFEGHRAAVLCVQWSPDKASVFGSSAEDGLLNIWDYDRVSKKSDRAAKSPAGLFFQHAGHRDKVVDFHWNAADPWTIVSVSDDCETTGGGGTLQIWRMSDLIYRPEEEVLTELEKFKSHVMTCASKP

SEQ ID NO: 85895 - protein, 268 aa, Frankia sp. EAN1pec
MESDSSNIDMAVSVYNSAMWGREAGNGAHLGGQLATYRTSRPSLRRNGPALILDLGADGNPLDTDTLSQLNLLLDEIEQTPSPCFLVTIGSGGHWCIGVNVAWVFKVDEDEIASFVVEVHRLYARFLTLPMVSIAAIQGNAVASGLMLALSHDFRVMRPGQGFLSLLNVDLGYPLAVEDTLLLRAKLPHPTIMEMVATGKRYDAATAKAAGLVDIVTSGETVLDAATAFGLPLARKNRNVIENFKKVLFDEVLRAPSGPWPGAYSRLP

SEQ ID NO: 85896 - protein, 392 aa, Phytophthora ilicis
LVTELGEYRAAVPSGASTGEFEALEMRDGGKAYMGKGVLNAVKNVNEIIAPALVGKDVTKQTELDRYMIEQLDGTQNEWGWCKKKLGANAILGVSLALCRAGAAAKKQPLWQYIADLAGNPSPCLPVPSFNIINGGSHAGNKLAMQEFMILPVGATSFTEAMQIGSEVYHNLKKVIKGRYGLDATAVGDEGGFAPNIQSNGEAIDLIEEAIKTAGYTNQVRLGMDVAASEFFTGAKDARYNLDFKNENAPESEKISAEKLQEVYEGFIAKCADSSKIVSIEDPFDQDDWESWVKFTGKVGKDVQIVGDDLTVTNPTRVKKAIELKACNALLLKVNQIGSITESIEAVTMAKKAGWAIMASHRSGETEDTFIADLAVGLSAGQIKTGAPCRSE

SEQ ID NO: 85897 - protein, 153 aa, Streptococcus pneumoniae
EHFIRGQYRSGKIDGMKYISYRSEPNVNPESTTETFASGAFFVDSDRFRSVPFFFRTGKRLTEKGTHVNIVFKQMDSIFGEPLAPNILTIYIQPTEGFSLSLNGKQVGEEFNLAPNSLDYRTDATATGASPEPYEKLIYDVLNNNSTNFSHWD

SEQ ID NO: 85898 - protein, 392 aa, Phytophthora clandestina
LVTELGEYRAAVPSGASTGEFEALEMRDGGKDYMGKGVLNAVKNVNEIIAPALIGKDVTKQAEIDRFMVEQLDGTQNEWGWCKKKLGANAILGVSLALCRAGAAAKKQPLWQHIADLAGNPTPCLPVPSFNIINGGSHAGNKLAMQEFMILPVGATSFTEAMKIGSEVYHNLKKVIKGRYGLDATAVGDEGGFAPNIQSNGEAIDLIEEAIKAAGYTNQVRLGMDVAASEFYTGAKDARYNLDFKNENAEDSEKIPADKLQEVYEGFIAKCAGSSKIVSIEDPFDQDDWESWVKFTGKVGKDVQIVGDDLTVTNPTRVQKAIEQKACNALLLKVNQIGSITESIEAVTMAKKAGWGIMASHRSGETEDTFIADLAVGLSAGQIKTGAPCRSE

SEQ ID NO: 85899 - protein, 126 aa, Aspergillus nidulans FGSC A4
MADDTNAAWPIADEALSQQLLDLVQSATHYRQLKKGANETTKTLNRGTSELVILAADTTPLPIILHLPLLCEDKNVPYVYVPSKLALGRATGVSRPVIAASITTNEASDLMPQIRAIKVQVERLMI

SEQ ID NO: 85900 - protein, 121 aa, Agrobacterium tumefaciens str. C58
MSRYTIILKNCSFFARHGLLEQEEVLGQRFFVDAEMEVEAGDALETDDIENTVDYGVAFAVIEKSVVGQRRYLIEALANDIAKALRARYPQIVWLKITVRKPSAPVPGILDYAQVSVEHRA

SEQ ID NO: 85901 - protein, 391 aa, Phytophthora meadii
VTEIGEYRAAVPSGASTGEFEALEMRDGGKDYMGKGVLNAVKNVNEIIAPALVGKDVTKQAELDRYMVEQLDGTQNEWGWCKKKLGANAILGVSLALCRGGAAAKKQPLWQYIADLAGNPSPCLPVPSFNIINGGSHAGNKLAMQEFMILPVGATSFTESMKIGSEVYHNLKKVIKGRYGLDATAVGDEGGFAPNIQSNGEAIDLIEEAIKAAGYTNQVRLGMDVAASEFYTGASDARYNLDFKNENAPDSEKIPADKLQEVYEGFIAKCADSSKIVSIEDPFDQDDWESWVKFTAKVGKDVQIVGDDLTVTNPTRVQKAIEQKACNALLLKVNQIGSITESIEAVTMAKKAGWAIMASHRSGETEDTFIADLAVGLSAGQIKTGAPCRSE

SEQ ID NO: 85902 - protein, 153 aa, Streptococcus pneumoniae
EHFIRGQYRSGKIDGMKYISYRSEPNVNPESTTETFTSGAFFVDSDRFRGVPFFFRTGKRLTEKGTHVNIVFKQMDSIFGEPLAPNILTIYIQPTEGFSLSLNGKQVGEEFNLAPNSLDYRTDATATGASPEPYEKLIYDVLNNNSINFSHWD

SEQ ID NO: 85903 - protein, 175 aa, Triticum aestivum
MAPTVMASSATSVAPFQGLKSTAGLPVSRRSNGASLGSVSNGGRIRCMQLWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 85904 - protein, 334 aa, Hyphomonas neptunium ATCC 15444
MKILVTGAAGFIGSEMALRLLKEGHSVTGVDCFTPYYDPQLKEDRAARLTAFDDFRLERIRIEDSEAMEAVFQRDTPEMVLHFAAQAGVRYSLDHPRDFIDANIVGSFNIIDLSRRHGTQHLVMASTSSAYGANQKFPFEERDSAPYPLTIYAATKLASELIAHSHAHLYGVPTTVLRFFSVYGPWGRPDMAFFLFTDKIFKGQPIDVFNHGDLLRDFTYIDDLVEAIRRLMDTPPVVGNHIIRGDSLSPVAPYRLVNIGNASPVRLMDYIEAIEGAIGRKAEKNMIDMQPGDVKQTFADVRLLDALTGYTPDTDYRTGIARFVDWYRDYFKPA

SEQ ID NO: 85905 - protein, 247 aa, Rhodopseudomonas palustris CGA009
MREAGALALSMFRTELRTWTKGASSPVSEADIAVDELIRRRLQDATPHYGWLSEESADDLVRLDKDWVWIVDPIDGTRAYLAGREDWCVSVALIANAKPMLAAVFAPVSGEFFFATRGAGASLNGASLHASVGTTLEGAKVAGPKPLIERLALPPTAHILPRIGSLALRLCRVADRQVDVAFAGGQSRDWDLAAADLIVHEADGTMTTLAGEDIVYNRPEVTHGVLVAAGRERHAHIVEHFRVSPRG

SEQ ID NO: 85906 - protein, 188 aa, Frankia sp. CcI3
MTSIDDAPQRSAAHDAVAEVLRGHIRDIPDWPQPGVVFKDITPLLATPTAFGVVIGALADAARALGATTIAGIEARGFLLAAPVADRLGTGLVPIRKQGKLPGPTRSASYDLEYGAATIEIHADAVHDGDRVLLVDDVLATGGTAAAAHSLLAAGGGEVVGLAVLMELSFLPGRDRVAPLDVVSLLTI

SEQ ID NO: 85907 - protein, 197 aa, Triticum aestivum
MLMLHETVPFVRPSSCRDLKLSEKSASAFHCKLGCSAVCSSAEGHHVQKPHIVHSHKVNFTRTSHLLCKSLNKRTTRHWLHRFHVNASPDDEFRSSRNIAISLFKRYKKIIDRGGGGENLKEFVSAGVTAYALGCTDEGLRKELMDLEDSGLEIEGLGSLGGTSSKFKVHSFEVTSENLAAGTDGCHRKFRGTISSC

SEQ ID NO: 85908 - protein, 344 aa, Oryza sativa Indica Group
MESLPVPSVQSMVAADGGAHVPPRYIRPRDEAVATDGETEIPVIDFQRLQLGHDEEMARLDKACQDWGFFQLINHSVPEDVVDGMKANARGFFELPAETKKQFAQERGQLDGYGQLFVVSEDQKLDWADILFLNTLPVQNRNFRFWPNQLAKFRSALDKYSAAVKSIVDFLLVTVANNLGVDPEVIANKCGTDGIQAVRMNYYPPCVQADKVIGFSPHSDSDLLTLVLQVNEVDGLQIKRNETWFPVRPLEGAFIVNVGDILQIFTNGRYKSAEHRAVVDMKKERLSIAAFHSPSVHAVIGPLKEMVAHEHEAVYRSIGHDEFMKLFFSSKLEGKSFLDRMKKL

SEQ ID NO: 85909 - protein, 326 aa, Staphylococcus aureus subsp. aureus N315
MIEKSQACHDSLLDSVGQTPMVQLHQLFPKHEVFAKLEYMNPGGSMKDRPAKYIIEHGIKHGLITENTHLIESTSGNLGIALAMIAKIKGLKLTCVVDPKISPTNLKIIKSYGANVEMVEEPDAHGGYLMTRIAKVQELLATIDDAYWINQYANELNWQSHYHGAGTEIVETIKQPIDYFVAPVSTTGSIMGMSRKIKEGHPNAQIVAVDAKGSVIFGDKPINRELPGIGASRVPEILNRSEINQVIHVDDYQSALGCRKLIDYEGIFAGGSTGSIIAAIEQLITSIEEGATIVTILPDRGDRYLDLVYSDTWLEKMKSRQGVKSE

SEQ ID NO: 85910 - protein, 162 aa, Triticum aestivum
  misc_feature (58)..(58): Xaa can be any naturally occurring amino acid
  misc_feature (73)..(73): Xaa can be any naturally occurring amino acid
  misc_feature (78)..(78): Xaa can be any naturally occurring amino acid
  misc_feature (105)..(105): Xaa can be any naturally occurring amino acid
  misc_feature (126)..(126): Xaa can be any naturally occurring amino acid
  misc_feature (129)..(129): Xaa can be any naturally occurring amino acid
MAPSVMASSATTVAPFQGLKSTAGMPVARRSGNSSFGNVSNGGRIRCMQVWPIEGIKXFETLSYLPPLTVEDXLKAVXVPAPSNWVPCPDSSKGPVCPTVENHRXPGYYQRKYWTIWNCQGSVDRXTQXLKDPRRQKGSPILTVKLKLFNPKTPGSGEKPQK

SEQ ID NO: 85911 - protein, 418 aa, Brassica napus
MEDKRGVVLYSIFPLVLLIIFLKFLKPNKQNLPPSPPGWLPVIGHLRLLKPPIHRTLRFLTESLHGGGGGVMSLRLGSRLVYVVSSHRIAAEECFGKNDVVLANRPQVIIGKHVGYNNTNIIAAPYGDHWRNLRRLCTIEIFSTHRLNCFLYVRTDEVRRLISRLFRRAGSEKTVVEMKPMLTALTFNNIMRMMTGKRYYGEETTDEEEAKRVRQLVADVGANTSSGNAVDYVPILRLFSSYEKRVKELGKKTDKFLQGLIDEKREQQETGNTMIDHLLVLQKSDTEYYTDQIIKGIILVMVIAGTNTSAVTLEWALSNLLNHPDVIRKARTEIDKQVGLDRLIEESDLSELPYLKNIVLETLRLHPATPLLVPHMASEDCKVGSYDMPRNTTLLVNAWAIHRDPNLWYDPDCFKPER

SEQ ID NO: 85912 - protein, 426 aa, Bartonella henselae str. Houston-1
MGVDISRLRNGLTIATHTMQQIDSVALGIWVKVGSRNETFTQHGIAHLLEHMAFKGTENRTAFQIASDIEDVGGEINATTSTETTAYFARVLKNDIPLAIDILADILMHSKFDEDELEREKQVVFQEIGAARDVPDDVVFDYFTETAFRHQSLGRSILGTPKTVQSFTSADLHSFMNKHYSADRMIVVAAGAVQHENFLQEVESRLSTFRPHSTEPLTNLANYVGGDFREYRDLMDTQVVLGFEGRPYHARDFYAAQILSIILGGGMSSRLFQEVREKRGLCYSIYAFHWGFSDIGLFGLHAATGQEKLKELLPVILDELSKVSKNIHTNELQRARAQYRATLTMAQENPSSQANFIARQILLYGREIPLSETIERLELITPARLTDLAGRLFINATPTLAAVGPVGSLMNFDNLTSTLSSNIKQV

SEQ ID NO: 85913 - protein, 358 aa, Oryza sativa Japonica Group
MSAYCGKYKDELIKNAAYIGTPGKGILAADESTGTIGKRFASINVENVEENRRSLRELLFCTPGALQYLSGVILFEETLYQKTKDGKPFVDVLKEGGVLPGIKVDKGTIEVAGTEKETTTQGHDDLGKRCAKYYEAGARFAKWRAVLKIGPNEPSQLAIDLNAQGLARYAIICQENGLVPIVEPEILVDGPHDIDRCAYVSEVVLAACYKALNEHHVLLEGTLLKPNMVTPGSDAKKVSPEVIAEYTVRTLQRTVPAAVPAIVFLSGGQSEEEATLNLNAMNKLSTKKPWSLSFSFGRALQQSTLKAWSGKAENIEKARAAFLTRCKANSEATLGTYKGDAVLGEGASESLHVKDYKY

SEQ ID NO: 85914 - protein, 487 aa, Glycine max
MSFRSENVNPNPSPTPPLKKRWSDIWTKSKPLNQMVMAMKLHSLSSSPRISTTDKTNPILSPFPITDRTLLLSDALLLKIIALVSDSSTQRNSNSLVCKRWLNLQGRLVRSLRISDWNFLLSGRLIHRFPNLNHVDLLSAALISPKNSGILLSNRVISMHLDSNSSPNWCFFEDNMLPVEVIDNGLTSLASGCPNLRRLHVIGTTEIGLLTVAEECSTLQELELQRCSDNVLRGIAACGNLQILKLVGHVDGFYDSVVSDIGLTILAQGCKRLVKLELSGCEGSFDGIKAIGKCCQMLEELTFSDHRMDDGWLAAISYCENLKTLRFQSCKKIDPNPGMEEYLGCCPALERLHLQKCQLRDRKSVVALFSVCRAVREIVIQDCWGLDNSMFSLAMICWRVKLLYLEGCSLLTTEGLESVIHSWKDLQSLRVVSCKNIKDNEISPALATLFTTLKELRWSPDTKSLLPSSVKGITMGKKGGKFFKRAR

SEQ ID NO: 85915 - protein, 436 aa, Oryza sativa Japonica Group
MKNTSSLCLLLLVVLCSLTCNSGQAQVLFQGFNWESWKQQGGWYNMLKGQVDDIAKAGVTHVWLPPPSHSVAPQGYMPGRLYDLDASKYGTAAELKSLIAAFHGKGVQCVADVVINHRCAEKKDARGVYCVFEGGTPDDRLDWGPGMICSDDTQYSDGTGHRDTGEGFGAAPDIDHLNPRVQRELTDWLNWLKSDVGFDGWRLDFAKGYSTDIAKMYVESCKPGFVVAEIWNSLSYNGDGKPAANQDQGRQELVNWVNAVGGPAMTFDFTTKGLLQAGVQGELWRLRDGNGKAAGMIGWLPEKAVTFVDNHDTGSTQKLWPFPSDKVMQGYAYILTHPGVPCIFYDHMFDWNLKQEITALAAIRERNGINAGSKLRIVVADADAYVAVVDEKVMVKIGTRYDVGNAVPSDFHQTVHGKDYSVWEKGSLRVPAGRHL

SEQ ID NO: 85916 - protein, 393 aa, Phytophthora porri
LTTEIGEYRAAVPSGASTGEFEALEMRDGGADYMGKGVLNAVRNVNEIIGPALVGKDVTKQAELDRYMVETLDGTQNEWGWCKKKLGANAILGVSLALCRAGAAAKKQPLWQYIADLAGNPSPCLPVPSFNIINGGSHAGNKLAMQEFMILPVGATSFTEAMKIGSEVYHNLKKVIKGRYGLDATAVGDEGGFAPNIQANAEAIDLIEEAIKDAGYTTQVRLGMDVAASEFYTGVKDARYNLDFKNADGAESEKISADKLLEMYEGFISKCADSSKIVSIEDPFDQDDWESWVKITARIGKDVQIVGDDLTVTNPTRVKKAIEQKACNALLLKVNQIGSITESIEAVTMAKKAGWAIMASHRSGETEDTFIADLAVGLSAGQIKTGAPCRSER

SEQ ID NO: 85917 - protein, 505 aa, Kineococcus radiotolerans SRS30216
MAVRWTSRSWRAPPAGPGAGPNRLGVMRRAKIVCTLGPAVAGHDGLRSLVDAGMDVARLNLSHGSHDDHRANFEGVRAAAAATGRSVAILADLQGPKIRLGRFADGPHDLAVGDVFTITTEDVVGTREICSTTYAGLPGDVSVGDAILIDDGKVGLVVTAVEGPRVTTLVTVPGPVSNNKGINLPGVAVSVPALSEKDVEDLRFALRLGVDMVALSFVRSAADADDVHKVMDEEGITVPVIAKVEKPQAVQNLREVVAAFDGIMVARGDLGVELPLEEVPLVQKLAIELARRQAKPVIVATQMLESMITAPRPTRAEASDCANAVLDGADALMLSGETSVGAFPYEAVRTMARIIENTETHGAERIAALGTVPHTKGGAITLAAAEVGKQLDAKLLVTFTQSGDSARRLSRLRSGIPLLAFTPDEATRRRLALSWGIEPEFAAFISTTDEMVKEVDRRLQEMGRCAVGDLVVIVAGAPPGIVGSTNALRVHRIGDATSGMSAAYA

SEQ ID NO: 85918 - protein, 355 aa, Phytophthora meadii
  misc_feature (10)..(10): Xaa can be any naturally occurring amino acid
VLNAVKNVNXIIAPALVGKDVTKQAELDRYMVEQLDGTQNEWGWCKKKLGANAILGVSLALCRGGAAAKKQPLWQYIADLAGNPSPCLPVPSFNIINGGSHAGNKLAMQEFMILPVGATSFTESMKIGSEVYHNLKKVIKGRYGLDATAVGDEGGFAPNIQSNGEAIDLIEEAIKAAGYTNQVRLGMDVAASEFYTGASDARYNLDFKNENAPDSEKIPADKLQEVYEGFIAKCAGSSKIVSIEDPFDQDDWESWVKFTAKVGKDVQIVGDDLTVTNPTRVQKAIEQKACNALLLKVNQIGSITESIEAVTMAKKAGWAIMASHRSGETEDTFIADLAVGLSAGQIKTGAPCRSE

SEQ ID NO: 85919 - protein, 284 aa, Xanthomonas axonopodis pv. citri str. 306
MSESSSPSCAQVRLRNGRRVPALGLGSWNLGQGRHAPEQEIQALQLGQQLGMQLIDTAEMYGNGRSEQLISQAIGRTQPPYVVSKVLPSNASARGIARACEASLQRLGVRTLDLYLLHWRGGSDLAEVVDAFEALRDAGKIRDWGVSNFDVDDMEELWAIDGGPHCLVNQVLYHAGSRGIEFDLLPWCAAHEVAVMAYSPLGSRALLDHPVLHAIGQRRGVAATAVALAWAIRSGNVIAIPESGTPAHVRANAAACTLQLHADDLAEIDRAFAPPTRKQPLDLL

SEQ ID NO: 85920 - protein, 485 aa, Kineococcus radiotolerans SRS30216
MVDPRGFLKVRDRELPPRRPVPLRLMDWREVYEKQDLDQLKRQAGRCMDCGIPFCHNACPLGNLIPEWNDLVSRGDMREAIERLHATNNFPEFTGKLCPAPCESACVLGINQPPVTIKQVEVMIAENAAEHGWLEPRVPERLTGKTVAVIGSGPAGLAAAQQLTRAGHTVAVYERDDKIGGLMRYGIPEFKMERAVLDRRLAQMEAEGTRFRAGVDIGTDITGEQLRERYDAVVVATGATQWRDVDLPGRELAGVHQAMEYLPPTNRVAVGEERPADYVDAAGLDVVVIGGGDTGSDCYGTALRQGARSVTQLDIYPAAPGERTEDEPWPTMPKVFSVSSSHEEGGERKFSASTRALIGEDGRVTALRVVEVRKVDGTWTPVEGTEQDLPAQLVLLAIGFSGPEHGGLVEQLGLQADARTRFTRTPGYATSTPGVFVAGDAGRGQSLIVWAIAEGRACASAVDEFLMGDTALPSPIRADAVPLTA

SEQ ID NO: 85921 - protein, 455 aa, Geobacillus stearothermophilus
AIETETLVVGAGPGGYVAAIRAAQLGQKVTIVEKGNLGGVCLNVGCIPSKALISASHRYEQAKHSEEMGIKAENVTIDFAKVQEWKASVVKKLTGGVEGLLKGNKVEIVKGEAYFVDANTVRVVNGDSAQTYTFKNAIIATGSRPIELPNFKFSNRILDSTGALNLGEVPKSLVVIGGGYIGIELGTAYANFGTKVTILEGAGEILSGFEKQMAAIIKKRLKKKGVEVVTNALAKGAEEREDGVTVTYEANGETKTIDADYVLVTVGRRPNTDELGLEQIGIKMTNRGLIEVDQQCRTSVPNIFAIGDIVPGPALAHKASYEGKVAAEAIAGHPSAVDYVAIPAVVFSDPECASVGYFEQQAKDEGIDVIAAKFPFAANGRALALNDTDGFLKLVVRKEDGVIIGAQIIGPNASDMIAELGLAIEAGMTAEDIALTIHAHPTLGEIAMEAAEVAL

SEQ ID NO: 85922 - protein, 472 aa, Oryza sativa Indica Group
MEFHESKTFETRDPRTGDVIARVAEGDKEDVDLAVKAAREAFDHGEWPRMSGSERERVMAKYAEVVERHADELAALESLDAGKPLAAARAVDVGECVGILRYFAGAADKIHGETLKMSRQLQGYTLREPLGVAGLIVPWNFPAIMFFSKVSPALAAGCTVVVKPAEQTPLSALFLAHLSKQAGVPDGVINVVTGFGPTAGAAISSHMDVDVVAFTGSTEVGRLIMEASAKSNLKPVALELGGKSPFIVFDDADLDKAVELAIGGNFFNKGEACVAGSRVFVQEGIYDRFEQKLADTMKSWVVGDPFDPRVNQGPQVDKAQYERVLGYIEQGKAEGATVLTGGKPCGKKGYYIEPTIFTNVKDDMVIAREEIFGPVMCLMKFKTVEEAIERANGTRYGLAAGLVTRDIDVANRMARSIRAGVVWVNCYFAMDRSCPFGGRKMSGFGKDDSMHALDKFLAVKSVVTPVHGSPWF

SEQ ID NO: 85923 - protein, 167 aa, Triticum aestivum
GSAALKMVEEVRRQFSTIPGLMEGRATPDYASCVRISTDASLREMMPPGALVLLAPLVVGTFFGVHTLAGLLAGALVSGVQVAISASNSGGAWDNAKKYIEAGASEHAKSLGPKGSEAHKAAVIGDTIGDPLKDTSGPSLNILIKLMAVESLVFAPFFAAHGGLIIK

SEQ ID NO: 85924 - protein, 390 aa, Phytophthora cinnamomi
TELGEYRAAVPSGASTGEFEALEMRDGGKAYMGKGVLNAVKNVNEIIAPALIGKDVTKQAELDRYMVEQLDGTQNEWGWCKKKLGANAILGVSLALCRAGAAAKKQPLWQYIADLAGNPTPCLPVPSFNIINGGSHAGNKLAMQEFMILPVGATSFTEAMKIGSEVYHNLKKVIKGRYGLDATAVGDEGGFAPNIQSNGEAIDLIEEAIKAADYTNQVRLGMDVAASEFYTGAEDARYNLDFKNENAPESEKISADKLQEVYEGFIAKCAGSSKIVSIEDPFDQDDWASWVKFTGKVGEDVQIVGDDLTVTNPTRVKKAIEQKACNALLLKVNQIGSITESIEAVTMAKKAGWAIMASHRSGETEDTFIADLAVGLSAGQIKTGAPCRSE

SEQ ID NO: 85925 - protein, 400 aa, Vibrio angustum S14
MKAFTLPDLGEGLAESEIVQWHINIGDTVKTDQVVVTVETAKATVDVPAPYSGKIVHRYGNEGDVINIGQCLLEIDELLANTSSVQPEKISESSENNTSPSTTVVGNISQLDKHVDVDPSYDDANQTVNLHSIANQHHPLIATPSARLLAQKLGVNIKEITGSGANHLILDNDVYLAYQQQIPGTELLKGSRRNMAKNMTRSHHDVASVTITEEARLYHWQKNDDITVNLVKAINNACHIEPALNAWFDAETMTRCLHKTVNIGIAVDSSHGLYVPVLHHAEQYHQEGIRRWIDRTAASIRSRKIDRHQLQKATITLSNYGAIAGIYATPVVTPPQVAIIGAGRIMDKVVMEGERVKTIKVLPVSITFDHRACTGGEAARFIKALLNSLESPPCDNIESS

SEQ ID NO: 85926 - protein, 521 aa, Lactococcus lactis
MKERQELGLIGLLPPTVQTIEEQAEQTYEQYLTKPSDLEKRHFLMEIFNTNRTLFYYLFNKHIVEFNPVVYDPTIADTIENYSHLFVDPQYAAYLDINHPENITETLKNAAGDREIRLIVVTDAEGILGIGDWGTQGVDISVGKLMIYTAAAGIDPASVLPVVIDAGTNRKELLEDHLYLGNHQERIYGDQYYSFVDQFVETAESIFPKLYLHWEDFGRSNAATILNNYKTKIPTFNDDIQGTGIVVLGGIFGSLDITGEKLTDQVYLCYGGGSAGAGIAGRVHAEMVSEGLSEEEAYKHFFMIDQQGLLFDDMEDLTPAQKPFAKKRADYKDAGDMTDLLNVVKTVKPTILVGTSTNPGAFTKEVVEAMCANTERPVIFPISNPTKKMETTAEQVIEWSDGKAFVATGVPSGTISYKGVDYQIGQANNSLIYPGLGLGMLASEAKLLTDEMIGAAAHSLSGLVDPGKPGAPVLPPFEFVADVSIKVAEAVAKKAQEQGLTESKETDMAKAVRDLKWYPEY

SEQ ID NO: 85927 - protein, 390 aa, Phytophthora medicaginis
EIGEYRAAVPSGASTGEFEALEMRDGGKDYMGKGVLNAVKNVNEIIAPALVGKDVTKQAELDRYMVETLDGTQNEWGWCKKKLGANAILGVSLALCRAGAAAKKQPLWQYIADLAGNPSPCLPVPSFNIINGGSHAGNKLAMQEFMILPVGATSFTEAMKIGSEVYHNLKKVIKGRYGLDATAVGDEGGFAPNIQANAEAIDLIEEAIKAAGYTNQVRLGMDVAASEFYTGAKDARYNLDFKNANAPESEKIPADKLQEMYEGFISKCADSSKIVSIEDPFDQDDWESWVKFTGKVGKDVQIVGDDLTVTNPTRVKKAIEQKACNALLLKVNQIGSITESIEAVTMAKKAGWAIMASHRSGETEDTFIARLAVGLSAGQIKTGAPCRSER

SEQ ID NO: 85928 - protein, 344 aa, Oryza sativa Japonica Group
MGTRAAFVVAFLIRSLYGGMQIVTKFAFNEGMSTSVFVFYRHVIAILFLVPVAFVLERKTAPPLTFKVSLKLFLHALYGISGAINIYSLGLSYASATSSSAIFNLLPAVAFILALLMKMESLNLKRINGIAKVSGVVLCIVGVIILAFYQGPELKSFNHHHLFRTSTVYAAATSHPATTWILGIFLTTLSTTCWALWTVLQGPMLEVYPSKLLNTTIQIVFATIQCFFIALAIERDFSRWKLHLDMGLIAVIYSGVLVSGVAYYMQVWVIDKSGPVFLAMTMPITLLVTIMLSSFVLGEAVTLGSIISGVVMVGGLYCVLWAKKSEQAAISKQQMVVPVQTTRV

SEQ ID NO: 85929 - protein, 393 aa, Phytophthora colocasiae
LVTEIGEYRAAVPSGASTGEFEALEMRDGGKDYMGKGVLNAVKNVNEIIAPALVGKDVTKQAELDRYMVEQLDGTQNEWGWCKKKLGANAILGVSLALCRGGAAAKKQPLWQYIADLAGNPSPCLPVPSFNIINGGSHAGNKLAMQEFMILPVGATSFTESMKIGSEVYHNLKKVIKGRYGLDATAVGDEGGFAPNIQSNGEAIDLIEEAIKAAGYTNQVRLGMDVAASEFYTGASDARYNLDFKNENAPDSEKIPADKLQEVYEGFIAKCAGSSKIVSIEDPFDQDDWESWVKFTAKVGKDVQIVGDDLTVTNPTRVQKAIEQKACNALLLKVNQIGSITESIEAVTMAKKAGWAIMASHRSGETEDTFIADLAVGLSAGQIKTGAPCRSER

SEQ ID NO: 85930 - protein, 331 aa, Methylobacillus flagellatus KT
MLKLSEFLVQQERQHAVADNVLTLIQDIAATCQAVAREIRYGALRGNMGSAGRENVQGEEQKALDVISNDIFTAMASKQPHVAAVASEEMAQAQVFAGKQGKYLLVFDPLDGSSNVNLNLSVGSIFSILPAPEGSVDEASFLQAGSRQLAAGYALYGTSTMLVLTMGHGVHGFTLDPDQGEFYLTHPGLTIAASTEEFAINMSNQRFWQPPVQRYIAECIAGSSGPRGKDFNMRWVATMVAEVHRLLVRGGVFLYPLDSRAVGRGGRLRLLYEANPMSLLVEQAGGLATTGHRRILDVEPAGLHQRVAVMMGAREEVERLQDYHSFTDPTA

SEQ ID NO: 85931 - protein, 333 aa, Zea mays
MAASLLHASAAAASLLSSTQHARAGAAAFHPLACAPSLRLTRSSFSTNRHLEISLRAISASRRFAGRGAPRDRRVVAALAGEQTSLECWCWMQEGSEVGDDRNGEIKPEEAQEIWKVMLEQFKAEALRMQALSMQAYDVYSERTREVLLEASEKLKIQADKAQKDLSVVATEIGQEGQEYLMMAARNSPDSIKDITTTFRALGKLNWPSEYEDYHVGIPFGTFLTVGGFLNFMLAGSTSALRFGIILGLALLALGISSLRSQRDGGRRPRLLVKGQAAIASVIFFREFSVLLQNGWFPKIFMVLLSGVVAGFYFYRIAAGSPKELSSNSDSVN

SEQ ID NO: 85932 - protein, 290 aa, Mycoplasma mycoides subsp. mycoides SC str. PG1
MAIRKAVIPCAGFGTRFLPFTKSQAKEMLPIIDTPTIEYIVKEAVDSGIKEILIILNDKKSEIMNYFSRNIQLEGFLYNKGKIAELEQIKTKYDASIHYIIQDEPLGLGHAISLCKGFINNESFAVLLGDDLFKCQTPAIKQLMDLYEEKQSTILGTILIDKKDCKKYGICKIESSDDNVYKVCSVIEKPDEQNAPSNVAIAGRYILTPEIFNYLDLQLKGETGEIELTDSILKTISDVDCYAKVIDGKRYDIGNKLGYLEAFVDFALNRDDTKNEFIKLVKKINEEETL

SEQ ID NO: 85933 - protein, 247 aa, Methylobacillus flagellatus KT
MSSTPSGTAKVIVLTGASSGIGEATARHLARLGHHLFIGARRLDRLTALQDELRAEGCHVEVMQLDVTRLEDLQGIASQTHATHGRIDVLINNAGVMPLSPLAALKIDEWNRMLDVNVRGVLHGIAAALPIMQAQGHGHIINIASIGAYQVWPSSAVYCASKFAVRAISDGLRQETDAIRVTLVSPGVVESELADHITDETARAAMREFRRIALPPQAVAQAIAYAIAQPDGVDVNELIVRPTASPY

SEQ ID NO: 85934 - protein, 498 aa, Candidatus Blochmannia floridanus
MRSKTTTTQACNFIIFGAKGDLARRKLIPALYQLEKIGSIHPRTFILGVGRAEWDLLTYIKIVRSSLERFMKESINENIWCRFSKRFDFCNLDVNQTEQFVHVLNKLKNLDLLTINYFAMPPHTFGSICKGLSLVGLNKERNRIVIEKPLGMNFDSARVINSQVSKYFHETQIYRVDHYLGKEAILNLLVLRFANSVFFSNWDNNTIDHVQITVSEEVGIEGRWGYFDAMGQMRDMVQSHLLQILTIIAMSPPFDLSADCIRDEKVKVLRSLRMINTNTIHEIAVRGQYTAGFINGQPVPGYLEEIGSNKDSKTETFVSIKVNIDNWRWFGVPFYLRTGKRLAMKYSEVVIYFKKPILNLFKDSYSILPNNKLIIRLQPYEGIDMQILSKIPGLGNKNRLKITNLNLNLRKIFSGEYILDAYERLLLEVMRGIQVLFVRYDEIEDSWRWVDSVIEAWSLVDGVPKLYKAGTWGPSESTEMIRKGNHHWNKCTLKYTNI

SEQ ID NO: 85935 - protein, 488 aa, Candidatus Blochmannia floridanus
MPQLLRRTKIIATLGPATDQKNTLEKIIISGVNIVRLNFSHGNSSEHFFRANKVRKLANQLHKYIAILGDLQGPKIRISTFQTNNIYLQSGDDFLIDSTLKNSHNNQKYVGVNYKELPQDVSPGDYLLLDDGKIQLKVIKIQNTQIFTKVVIGGLLSNNKGINKLGGGLSAKVLTNKDKLDIITAAKIGVDYLAISFPRNSMDLNFARKLITDAGSNAKIISKIERAEVVKSDDTIDDIIKASDAVMIARGDLGIEIGEPQLVGIQKKIIQRAHLLNRAVITATQMMESMIINSVPTRAEIMDVANAVLDGTDAVMLSAETATGQYPSETVSSMADVCLGAEKTLNNTNNQLIFINQLQKKINNTKEAIAASTMHIANCLSKIRAIISITDWEHIVLLLSRFNSQLPIFALSKHIHILNIVTLYKGVIPIYFNRTGNNIIDARQASNLLRDQGFLTPGELVIIIQDNIVNQSNINNVTHILTIEEQCK

SEQ ID NO: 85936 - protein, 377 aa, Wolinella succinogenes DSM 1740
MAGSSNTPKRKLPKESYKIMKKYEIAIIKGDGIGPEIVDEAKKVLDAISYSHGFELSYHDYLMGGIAVDRAGVPLPDETIEGCLRADAVLFGAIGGEKWDSLPRELRPESGLLKLRKSLEIFANLRPTVVYDELIEASTLKESVIKGVDILVVRELIGGIYFGEPKGREGDKAFNTMVYSVPEIERIAHVAFKAAMRRQKRVCSVDKANVLDVSQLWRETVTRIAKEYPEVELSHMYIDNAAMQLIRNPKQFDVILTGNLFGDILSDEASMLSGSIGLLPSASIGGKAALYEPIHGSAPDIAGQGIANPIATIASASMMLRHSLGEVEAADAIDKAIVKTLKEGYRTKDIAAFGAKEICTTDEMGSIIANYAAKKGE

SEQ ID NO: 85937 - protein, 539 aa, Oryza sativa Indica Group
MASLPVPSVQAMVAAIGIDHVPPRYLRPTDADEPVASDGGEAEIPVVDFWRLQLGDGDELARLHIACQDWGFFQLVNHNVPEDVVEGMKASIKGFFELPAETKKQVVQEPGQLEGYGQLFVVSEDQKLDWADILYVKTQPLQDRNLRFWPDQPAGFRMALDRYCAAVKITADGLLAAMATNLGVESEVIAERWVGGVQSAMVAAIGIDHVPPRYLRPTDADEPVASDGGEAEIPVVDFWRLQLGDGDELARLHIACQDWGFFQLVNHNVPEDVVEGMKASIKGFFELPAETKKQVVQEPGQLEGYGQLFVVSEDQKLDWADILYVKTQPLQDRNLRFWPDQPAGFRMALDRYCAAVKITADGLLAAMATNLGVEPEVIAERCVGGVQSVRVQYYPPCGQADKVVGISPHSDADLVTILLQANEVDGLQIRRGGAWLPVRPLEGALIVNVGDILQVFTNGRYKSVEHRVVVDGKKERLSMATFHSPSKNAIVGPLSEMVEHEDDAAYTSMNHDELLKLFFAKKLEGKNFLNPIKKLKNSG

SEQ ID NO: 85938 - protein, 534 aa, Nicotiana plumbaginifolia
MGNCCSRGQPDDNEHTSNNDQKSNTKNDQSISNNSQQQQNNGSITPSKSPDPSSKPSKNSPIGPVLGRPMEDVRKTYSIGKELGRGQFGITHLCTHKQSGEQFACKTIAKRKLVNKEDIEDVKREVQIMHHLTGQQNIVELKGAYEDKHSVHLVMELCAGGELFDRIIAKGHYTERAAATLLRTIVQIVHTCHSMGVIHRDLKPENFLLLNKDEDSPLKATDFGLSVFYKQGDVFKDIVGSAYYIAPEVLKRRYGPEVDIWSVGVMLYILLSGVPPFWAETEHGIFNAILRGHVDFSSDPWPAISHGAKDIVKKMLTIDPKQRLTAIQVLNHPWIKEDGEAPDTPLDNAVLSRLKQFRAMNNFKKVALRVIAGCLSEEEIMGLKQMFKSMDTDNSGAITLEELKQGLAKQGTKLSDHEIEQLMEAADADGNGTIDYEEFITATMHMNRMDKEEHLYTAFQYFDKDNSGFITIEELEQALREFGMTDGKDIKEIVAEVDSNNDGRINYEEFVAMMRKGTPETAANLKKRRESFVA

SEQ ID NO: 85939 - protein, 430 aa, Agrobacterium tumefaciens str. C58
MSPSPVWHPFTQHGLEPPMKRVVSADGAFLVDEDGNRLFDAISSWWVITHGHRHPAIMAAIRAATETLDQVIFAEFSHEPAETLARGLIELAPAGLSHVFYSDSGSTAVEVALKMALGYFHNCGEKRDRIVVMEHGYHGDTIGTMSTGERGVFNAAYEPLLFGVDRLAFPEVGSEQCTLDMFEAYCRSGRVAALLVEPLVLGAGGMKVYAANVLAGLKQIAESHGCLVIADEVMTGWGRTGTVFACEQAAISPDILCTSKGLTGGSLPLAATLCSAQIFDAHFSTDRRKTFFHSSSYTANPIACAAAVANLQVWRDEPILQRIGQVQQTLGDHIRRFADDGRFANIRQAGTIAALDLVVPAGGYLSEAGPRMRQLFRRRGFLIRPLGNVLYLMPPYCSTADDLTRAFDVIDEVAGIVTDVASAKSYGVGK

SEQ ID NO: 85940 - protein, 334 aa, Geobacillus stearothermophilus
AVKVGINGFGRIGRNVFRAALKNPDIEVVAVNGLTDANTLAHLLKYDSVHGRLDAEVSVNGNNLVVNGKEIIVKAERDPENLAWGEIGVDIVVESTGRFTKREDAAKHLEAGAKKVIISAPAKNEDITIVMGVNQDKYDPKAHHVISNASCTTNCLAPFAKVLHEQFGIVRGMMTTVHSYTNDQRILDASHKDLRRARAAAESIIPTTTGAAKAVALVLPELKGKLNGMAMRVPTPNVSVVDLVAELEKEVTVEEVNAALKAAAEGELKGILAYSEEPLVSRDYNGSTVSSTIDALSTMVIDGKMVKVVSWYDNETGYSHRVVDLAAYIASKGL

SEQ ID NO: 85941 - protein, 132 aa, Triticum aestivum
  misc_feature (7)..(7): Xaa can be any naturally occurring amino acid
  misc_feature (9)..(9): Xaa can be any naturally occurring amino acid
  misc_feature (19)..(19): Xaa can be any naturally occurring amino acid
  misc_feature (26)..(26): Xaa can be any naturally occurring amino acid
ESWGKLXGXTNIQIVGDDXTVTNPKXIATAVEKKSCNCLLLKVNQIGTVTESIEAHNLAKSDGWGTMISHRSGETEDTFIADLTVGLSTGQIKTGAPCRSERLAKYNQILRIEEELGAGAKFAGKNFRHPLQ

SEQ ID NO: 85942 - protein, 219 aa, Xerophyta viscosa
MPGLTIGDTIPNLELDTTQGRIKIHDYVGNGYVILFSHPGDFTPVCTTELGKMAAYADEFSKRGVKLLGLSCDDVQSHKEWIKDIEAYTPGCHVKYPIAADPTREIIQQLNMVDPDETESSKCAVPSRALHIIGPDKRIKLSFLYPASTGRNMDEVLRAVESLQQAAKHKVATPANWKPGEPVVIKPDVSSEEAKKLFPQGYKSVDLPSKKDYLRFTNV

SEQ ID NO: 85943 - protein, 208 aa, Rhodopseudomonas palustris CGA009
MNNVSTRAPVRGTKTSLTLPNILTYARIAAIPVVVGCIFAQSILGGPLALRWVALAVFIAAAITDFLDGHFARIWDQQSAFGRMLDPIADKLLVASCLLMLAADSIIHGWTLWAAIVILCREILVSGLREYLAALRVSVPVTRLAKWKTTAQLVAIGFLLAGEAGDEVLPFTTEIGVSLLWLSALLTMYTGYDYFRAGIHHLIEEDQA

SEQ ID NO: 85944 - protein, 140 aa, Hyphomonas neptunium ATCC 15444
MAVQRTFSIIKPDATERNLTGAINAVIEKAGLRIVGQRRIQMTRAQAERFYSVHSARPFFGELVDFMISGPVVVQVLEAEDAITKYREVMGATNPADAADGTIRKLFAKSIGENSVHGSDSAENAALEIAQFFSEADLTN

SEQ ID NO: 85945 - protein, 157 aa, Glycine max
  misc_feature (5)..(6): Xaa can be any naturally occurring amino acid
  misc_feature (9)..(9): Xaa can be any naturally occurring amino acid
  misc_feature (11)..(12): Xaa can be any naturally occurring amino acid
  misc_feature (15)..(16): Xaa can be any naturally occurring amino acid
  misc_feature (24)..(24): Xaa can be any naturally occurring amino acid
  misc_feature (33)..(33): Xaa can be any naturally occurring amino acid
GYAAXXAVXSXXKNXXKTFLKKYXAKWKADHTXRCRAMPHIKTFARYKNQSLAWFLLTSANLSKAAWGALQKNNTQLMIRSYEDKCPARESSEMKKTKLVTLTGIKKESMHSSSEVIIPLPLPYELPPLPYSSQDIPWSWDRQYNKKDVYGHVWPRM

SEQ ID NO: 85946 - protein, 891 aa, Bartonella henselae str. Houston-1
MTKWVYSFGDGSAEGSASERNLLGGKGANLAEMSNLGLPVPPGFTLTTEVCNFYYAYGKSYPKELREAVEQALKHIGEKTGREFCNEKRPLLLSVRSGARASMPGMMDTVLNLGMNDETVKAIALQTKNERFAYDSYRRFIQMYSNVVLGLEHSYFEEILDDSKMRKGYTIDTEMTAVDWQDVIVSYKAYIEEKLGKPFPQDPEQQLWGAIGAVFSSWMTARAVTYRRLHNIPESWGTAVNVQAMVFGNMGEDSATGVAFTRNPSTGEKELYGEFLVNAQGEDVVAGIRTPQNITENARIVAGSNKPSLEKIMPEAFGKLYHIGQKLEKHYRDMQDLEFTIEKGKLWMLQTRSGKRTARAALKMAIEMVEEGLISREEAVMRIDAKSLDQLLHPTLDPKAGRFVVARGLPASPGAATGEIVFTSEEAETASVEGRKVILVRIETSPEDIHGMHAAEGILTTRGGMTSHAAVVARGMGKPCISGAGSVRIDYSTNTMFASGQSFKKGDVITIDGGSGEIFKGKVAMLQPELCGDFAKLMEWADGMRRIKVRANAETPSDARMGHSFGAEGIGLCRTEHMFFSGERIVAMREMILSDDENGRRKALDKLLPMQRSDFVQLFEIMCGLPVTIRLLDPPLHEFLPKTDAEILDIATVMGVSKEALAERAQQLHEFNPMLGLRGCRLAITYPEIVEMQARAIFEAAAEAAQKSGSPVMLEIMVPLVALKSELDFVKTHIDQVACEVMKEKKSTIQYMVGTMIELPRAALRADEIAETAEFFSFGTNDLTQTTFGISRDDAAPFLATYFQKGLLEQDPFVSIDRDGVGELIAIAAKRGRSQRAKIKLGICGEHGGDPASIALCEENDLDYVSCSPFRVPIARLAAAQSAIAKKRERF

SEQ ID NO: 85947 - protein, 468 aa, Methanosarcina mazei Go1
MSEHNEAANLVKTLRPFHIWALGVGIVLVGEYMGWNFTVAKGGILGSLLAMLVAGTMYVIIALCASELGSATKLAGGPYDWARLFVGPGAAASVGLAVYMEYIALEAADAIVVAFIAQSIFPELQVFPVTLLVIALLTFINYRGVVAALTLNFVLTMIAFIAIVVFFFATAFGGVNIHPEYLFQGALPNGMIGLFAALQFGPWFYLGIEGAAMCAEECKHPSRAVPLGQQAGMITLLVGAAMTLYLCSVLIPTDLLGVSVYPLFEAAQNSGIFIFIALLGLGTFLTCVASANGCVCDSSRSWFALSRDKYVSSWFSAVHPRYNTPYRAVIFTMPVAIGFAFSGFLDQVITFSIVSGLLCYVLIPFSLIRFRNLFPQTTSKVRPFAGPLQPYIAYFAIAIAITILSTLFWGYKYNLIFAFVFYGIAYFYFSHRHKNSNIENNWAEMGWPLPNGSENGRIGKEAVGFGDE

SEQ ID NO: 85948 - protein, 505 aa, Arabidopsis thaliana
MDIISGQPLFLLFCFILSCLLFFTAARSRRSPSQVLSKSPPGPPRLPIIGNIHLVGKNPHHSFTDLSKTYGPVMSLKLGCLNSVVIASRDAAREVLKAHDQILSGRYITQATKSNNHHEFSVGWIHPSSPRFRNVEEMTFTQLFSPQRIEATKALRMKKVQELVNFLSESSERGEAVDISRASFVTALNIISNILFSVNLGSYDSKNSSAFQEMVIGYMESIGNPDVSNFFPFMRLLDLQGNSKKMKEYSGKLLQVFREFYDARILENSSRIDEKDVSSRDFLDALIDLQQGDESEINIDEIEHLLLDMFLAGTDTNSSTVEWAMTELLGNPKTMTKVQDEINRVIRQNGDVQESHISKLPYLQAVIKETFRLHPAAPFLLPRKAERDVDILGFHVPKDSHVLVNVWAIGRDPNVWENPTQFEPERFLGKDIDVKGTNYELTPFGAGRRICPGLPLALKTVHLMLASLLYTFEWKLPNGVGSEDLDMGETFGLTVHKTNPLLACL

SEQ ID NO: 85949 - protein, 392 aa, Phytophthora phaseoli
  misc_feature (111)..(111): Xaa can be any naturally occurring amino acid
  misc_feature (292)..(292): Xaa can be any naturally occurring amino acid
LVTELGEYRAAVPSGASTGEFEALEMRDGGKDYMGKGVLNAVKNVNEIIAPALIGKDVTKQAEIDRFMVEELDGTQNEWGWCKKKLGANAILGVSLALCRAGAAAKKQPLXQHIADLAGNPTPCLPVPSFNIINGGSHAGNKLAMQEFMILPVGAKNFTEAMKIGSEVYHNLKKVIKGRYGLDATAVGDEGGFAPNIQSNGEAIDLIEEAIKAAGYTNQVRLGMDVAASEFYTGAEDARYNLDFKNENAAESEKIPADKLLEVYEGFIAKCADSSKIVSIEDPFDQDDWESXVKITGKVGKDVQIVGDDLTVTNPTRVKKAIEQKACNALLLKVNQIGSITESIEAVTMAKKAGWGIMASHRSGETEDTFIADLAVGLSAGQIKTGAPCRSE

SEQ ID NO: 85950 - protein, 390 aa, Phytophthora humicola
TELGEYRAAVPSGASTGEFEALEMRDGGADYMGKGVLNAVKNVNDIIAPALIGKDVTKQAELDRYMVEQLDGTQNEWGWCKKKLGANAILGVSLALCRAGAAAKKQPLWQYIADLAGNPTPCLPVPSFNIINGGSHAGNKLAMQEFMILPVGATSFTQAMKIGSEVYHNLKKVIKGRYGLDATAVGDEGGFAPNIQSNGEAIDLIEEAIKAAGYTNQVRLGMDVAASEFYTGAKDARYNLDFKNENAPESEKIPAEKLQSVYEGFISKCAGSSKIVSIEDPFDQDDWESWVKFTGKVGKDVQIVGDDLTVTNPTRVKKAIELKACNALLLKVNQIGSITESIEAVTMAKKAGWAIMASHRSGETEDTFIADLAVGLSAGQIKTGAPCRSE

SEQ ID NO: 85951 - protein, 105 aa, Glomerella lindemuthiana
GKHGSDTGAYDTEGRFVPSKFEAIFSKHAHTNPNYLTYDELKEMIKANREPKDLAGRIGSFVEWSVLYKVAKDKNGLLQKDAIRAVYDGTLFEQLKKQRSSTKNN

SEQ ID NO: 85952 - protein, 376 aa, Flavobacteria bacterium BBFL7
MTDFYDILGISKGATAAEIKKAYRKKAIEFHPDKNPGDATAEENFKKAAEAYETLSDPQKKARYDQLGHQAYTSGGAGGFGGGGFGGMDMDDIFSQFGDIFGGGGFSGFGGGGGFGGGGRRRVKGKDLRIRVSLTLEEAAVGVEKKVKVKRKKQAPGVTYKTCTTCGGSGQVTRIQNTILGRMQTSAPCNVCGGAGQTMDKKPAGADAQGLIIDEETVSIKIPAGVETDMRLKVSGKGNEAPGNGVSGDLLVDIEVKEHAELQREGNNLHYDLYVSVPEAVLGTTKEIQTVTGKVRIPIEAGIQSGKILRLRGKGMPSVNGYATGDLLVHVNVWTPRNLSRDQKEFFESMMADSHFEPAPEKGDKSFFEKVKDMFS

SEQ ID NO: 85953 - protein, 393 aa, Phytophthora hibernalis
LVTELGEYRAAVPSGASTGEFEALEMRDGGADYMGKGVLNAVKNVNEIIAPALVGKDVTQQVELDRYMVETLDGTQNEWGWCKKKLGANAILGVSLALCRGGAAAKKQPLWQYIADLAGNPSPCLPVPSFNIINGGSHAGNKLAMQEFMILPVGATSFTEAMKIGSEVYHNLKSVIKGRYGLDATAVGDEGGFAPNIQANAEAIDLIEEAIKKAGYTDKVRLGMDVAASEFFTGAKDARYNLDFKNDNAPESEKISADKLLEVYEGFISKCAASSKIVSIEDPFDQDDWESWVKITGKVGKDVQIVGDDLTVTNPTRVKKAIELKACNALLLKVNQIGSITESIEAVTMAKKAGWAIMASHRSGETEDTFIADLAVGLSAGQIKTGAPCRSER

SEQ ID NO: 85954 - protein, 393 aa, Vibrio angustum S14
MFKSLSPVQLDPILSLSIAYREDPRDNKIDLGVGVYRNSLGETPIMQAVQLAEKRLIKTQTTKSYVALAGSEVFNQSMMDLLLSGTSAHSRASAVQTPGASGALRMLADLINVAQPDTTVWLTNPSYVNHKPVMEAAGLKVKYYPYFDPETKQVNSEAMLSELAKAGPKDVVLLHGCCHNPTGADITFADWQAITALANKNGFMPFVDMAYLGFGDGLEQDGAGLKYMADNTEEMVVATSCSKNFGLYRERTGAAIIISNSQQEAQKAKGRILTLARSSYTMPPDHGAALVADILNDQKLTNIWKDELDTMHSRILTLRQELTQAIRQRGSEQFDFIEQHKGMFSVTGLTSEQILTLREQYGIYAVGDGRINIAGLQEKHIDHLAEALVSVSR

SEQ ID NO: 85955 - protein, 512 aa, Mycoplasma mycoides subsp. mycoides SC str. PG1
MSLIVLENITHQNGEKILYKNSEMRINKGEHVALIGPNGAGKSTLLNIIAQKITPDHGTIQWHPKAKIGYLDQHQEVDPNITSEEYLKDAFKNLFEIEAKIHKIYENMAIEYKESDLIKALELQDYLTSHNFDTIDKTIGNLVSGLGINPNNMKKKLSELSGGQRGKILLAKLLLKNDDFILLDEPTNFLDIEQVEWLINFLNNYENAFLMISHDVEFINRVAKIIYAIENQKINRYVGDYNKYLELSALKADQYDKARESQQQQIAKLKDYIARNAARFSTAKSAQSRQKQLDKMDVLDERKKLVKPKMSFKYKRPNSAVVVKSQNLEIGYNFSLTAPLTFELREGQKCIVKGYNGIGKTTFLKTISNQLKPISGWCKLGDGVEVRYFEQVEKFHEYETPISYLSSRHKEVLDPEIRATLSRFGIKSELMLNPMSDLSGGEQTKVRLASLSLEPASLLILDEPTNHIDVLAKESLLEAIKEFQGTVLITTHDINFETNWADKVLNFEDLVE

SEQ ID NO: 85956 - protein, 569 aa, Colwellia psychrerythraea 34H
MNIFSPHLFRQQFPLIESHDQSLIEKDDLMPSLIYFDNAATTQKPRQVIDCQQHYYRNFNANVHRASHQLSSKATFAFEKARSLVQGFIGAKSVKEVIWTKGATESINVVVQSLARNILIPGDEIAICVSEHHANIVPWQIVAEQTGAVIKVIPITESGYIDVDEIDNIISDKTKFVACAHISNVLGRINPIEQVIVKAKSVGAITVIDGTQAVAHFSVNVQSLDCDFYVFSAHKMYGPTGIGVLYGKKKHLESMAPYQGGGEMIKTVSFTQGTTFNSLPFKFEAGTPNIAGVIAFAESIKFLGPLLTDVSNSYGLFEQKLVNYCYQALDKIAQVNFIVEGTPDIGVIAFTLTGHHNHDIAMSLDTHGIAIRSGHHCAMPLMAYLKIDGCLRVSLAPYNTVTEIDYFIDCLKNILLEETIEQSNSRVKEDVLLDSPVKEIDEIITLFSRTKGWDTRHREIMLLGKNLPRLDKASRDDNTLIAGCESLAWIKAEHSAQGLYSFTADSDAKIIRGLLVIVLAAFNHQTAQEIHQFNINDYFEKLGLMQHLSPSRGNGVLAIVEKIKAMAQQ

SEQ ID NO: 85957 - protein, 408 aa, Mycoplasma mycoides subsp. mycoides SC str. PG1
MSHPFSVDEIKQIHQEISKIIHYTPLHYADKLSALTGNNIYLKLENLQKTGSFKLRGATNKINKLTNEEKEHGIIAASAGNHAQGVAYAATNLGLKSTIVMPENAPMAKIQATEKYGGKVVLSGRFFDDALAKAIELKEKENLTLIHAFDDIEIIKGQATITYEIDQQIKNIDYCLVPIGGGGLMSGIATYLKQVNPNIKMIGVEAANVNSYQQAKALSRPVMVDSKPSIADGIAVKKVSDLTFSILNQYVDDVVVVSEEEIAEAMLFLMENCKFVTEGSGAVTAAALMFDKLNIKNQNKTIVGLVSGGNIDIAMVGNIINKALIKTNRRLVLSVNITSDNKEILKIINIINSCGAKIFKIKTNRDIMYLELSEIHATFIIDLSNTDQQQQIIDKIIQANYKITSITD

SEQ ID NO: 85958 - protein, 393 aa, Phytophthora inundata
LVTELGEYRAAVPSGASTGEFEALEMRDGGADYMGKGVLNAVKNVNDIIAPALIGKDVTKQAELDRYMVEQLDGTQNEWGWCKKKLGANAILGVSLALCRAGAAAKKQPLWQYIADLAGNPTPCLPVPSFNIINGGSHAGNKLAMQEFMILPVGATSFTQAMKIGSEVYHNLKKVIKGRYGLDATAVGDEGGFAPNIQSNGEAIDLIEEAIKAAGYTNQVRLGMDVAASEFYTGAKDARYNLDFKNENAPESEKIPAEKLQSVYEGFISKCAGSSKIVSIEDPFDQDDWESWVKFTGKVGKDVQIVGDDLTVTNPTRVKKAIELKACNALLLKVNQIGSITESIEAVTMAKKAGWAIMASHRSGETEDTFIADLAVGLSAGQIKTGAPCRSER

SEQ ID NO: 85959 - protein, 470 aa, Aspergillus nidulans FGSC A4
MRLTWLLTLLAASRVLSQNTDSDSDSDSDSSTTTDSNEEAISQSLAEIASAITTTVDDATVPSGDYITYSTTVYLTGTHGTVIGSTAVQVTGTPNANATTSANATITSTSDTVTVLIGGQTTISGNSTGNSTHSATPSPSQTPVVNTQPCNGWPEFCDRKYSNITQVAAHNSPFVAQGNVAANQALDVHYQLDDGVRMLQFQTHIMNGTMYLCHTSCDLLNVGPLEDYLSNITEWLRQHPYDVVTILIGNYDYVDPGNFTTPMENSGLMDFVFTPPMIPMGLDDWPTLGSIILSGKRAIVFMDYQANQTAYPWLMDEFSQMWETPFSPTDRDFPCTVQRPPDLAAEDARKRMYMANHNLNIDFSIASLNLLIPNTALLNETNADHGYGSVGRMAENCTTLWNRPPNFLLVDYYNEGNFNGSVFQVAADMNGVSYDRDSCCGTLSAASSLGPGAMMSAVLFFVGLQVLAWL

SEQ ID NO: 85960 - protein, 118 aa, Panax ginseng
LCAGGELFGRIIAKGHYTERAAASLLRTIVQIVHTCHQMGVIHRDLKPENFLLLNKDENSPLKATDFGLSVFYKQGDQFKDIVGSAYYIAPEVLKRKYGPEVDIWSIGVMLYILLCGV

SEQ ID NO: 85961 - protein, 338 aa, Pantoea agglomerans
QITAKRFLIATGASSTAPNIPGLDEVDYLTSTSLLELKKVPNRLTVIGSGYIGMELGQLFHNLGSEVTLIQRSERLLKEYDPEISEAITKALTEQGINLVTGATYERVEQDGDIKKVHVEINGKKRIIEAEQLLIATGRKPNTESLNLHAAGVEVGSRGEIVIDDYLKTTNSRIYSAGDVTLGPQFVYVAAYEGGLAARNAIGGLNQKVNLEVVPGVTFTSPSIATVGLTEQQAKEKGYEVKTSVLPLDAVPRALVNRETTGVFKLVADAKTLKVLGAHVVAENAGDVIYAATLAVKFGLTVGDLRETMAPYLTMAEGLKLAVLTFDKDVSKLSCCAG

SEQ ID NO: 85962 - protein, 59 aa, Rosa blanda
ETLEQREAGSTVEVVAAQTKAIAEKVKDWTNIVLAYEPVWAIGTGKVASPAQAQEVHCE

SEQ ID NO: 85963 - protein, 504 aa, Coprinopsis cinerea okayama7#130
MMKDFKTSYVLDVYLQLFKEYQCTTLNLRILWRDCIISMDQDHTKYVLATGFGRFWRGHAQKERLETFLGSGIFNRDDDDWKEHRAIARPFFARDRIEDFDNFETHTARTLSILTSLASTQEAFDAQDLYSRFTLDSASEFLFGKNLDTLSQSRPIPGQTVMGPKGSAVEGDWGSFAKAFETAQINATTRARIGHWWPLLELFKDKNAEHADVIHRWLDPLVQRALNERTQRIGRKRADSKASLGTSFLKHIAECVDDPVTIRDQLLNMLLASRDTTATVLTFLTYLLATHPDVTDRLRAEILEHVGPTSHPFPDTLKQLKYLRAVLNETMRLYPPVPLNIRETRSASCTLPPSDPTYASSDTRPFYMPAKTIIMYFPLLTQRNPALWGEDAEEFVPERWIDPDRASKIVNNPAMYAPFSAGPRICLGQNYAYNQMSYFVVRLLQQFDRFTLAPEFQPPGSLPPKEWKHRQGRQKDEKIWPAAALTLFVKGGLWVKCHLAKTHS

SEQ ID NO: 85964 - protein, 307 aa, Escherichia coli
MNAKVWVLGDAVVDLLPESEGRLLQCPGGAPANVAVGVARLGGNSGFIGRVGGDPFGRYMRHTLQQEQVDVSHMYLDDQHRTSTVVVDLDDQGERTFTFMVRPSADLFLVEEDLPQFAAGQWLHVCSIALSAEPSRSTTFAAMESIRSAGGRVSFDPNIRPDLWQDQALLLACLDRALHMANVVKLSEEELVFISSSNDLAYGIASVTERYQPELLLVTRGKAGVLAAFQQKFTHFNARPVASVDTTGAGDAFVAGLLASLAANGMPTDMTALEPTLTLAQTCGALATTAKGAMTALPYQRDLNRQF

SEQ ID NO: 85965 - protein, 59 aa, Rosa blanda
ETLEQRGAGSTVEVVAAQTKAIAEKVKDWTNIVLAYEPVWAIGTGKVASPAQAQEVHCE

SEQ ID NO: 85966 - protein, 484 aa, Rhodopseudomonas palustris CGA009
MDAPRKFAGSRRSRRGVKLIPCRAFHPPAAQCMRSAMLDKIKPTSAVNAPNDLNAFWMPFTANRAFKRAPKMVVGAEGMHYITADGRKIIDAASGMWCTNAGHGRKEIAEAIKAQADELDFSPPFQFGQPKAFELASRIADLAPEGLDHVFFCNSGSEAGDTALKIAVAYQQIKGQGSRTRLIGRERGYHGVGFGGTAVGGIGNNRKMFGPLLNGVDHLPATYDRDKQAFTIGEPEYGAHFAEALEGLVNLHGANTIAAVIVEPMAGSTGVLPAPKGYLKKLREITKKHGILLIFDEVITGYGRLGYAFASERYGVTPDMITFAKGVTNGAVPMGGVITSAEIHDAFMTGPEHAVELAHGYTYSAHPLACAAGIATLDIYRDEKLFERAKALEPKFAEAVMSLKSAPNVVDIRTVGLTAGIDLASIADAVGKRGFEAMNAGFHDHELMLRIAGDTLALTPPLILSEDHIGEIVDKVGKVIRAVA

SEQ ID NO: 85967 - protein, 587 aa, Bacillus subtilis subsp. natto
MKRTWNVCLTALLSVLLVAGSVPFHAEAKKPPKSYDEYKQVDVGKDGMVATAHALASEIGADVLKKGGNAIDAAVAIQFALNVTEPMMSGIGGGGFMMVYDGKTKDTTIIDSRERAPAGATPDMFLDENGKAIPFSERVTKGTAVGVPGTLKGLEEALDKWGTRSMKLLITLTIKLAEKGFPIDSVLADAISDYQEKLSRTAAKDVFLPNGEPLKEGDTLIQKDLAKTFKLIRSKGTDAFYKGKFAKTLSDTVQDFGGSMTEKDLENYDITIDEPIWGDYQGYQIATTPPPSSGGIFLLQMLKILDDFNLSQYDVRSWEKYQLLAETMHLSYADRASYAGDPEFVNVPLKGLLHPDYIKERQQLINLDQVNKKPKAGDPWKYQEGSANYKQVEQPKDKVEGQTTHFTVADRWGNVVSYTTTIEQLFGTGIMVPDYGVILNNELTDFDAIPGGANEVQPNKRPLSSMTPTILFKDDKPVLTVGSPGGATIISSVLQTILYHIEYGMGLKAAVEEPRIYTTSMSSYRYEDGVPKDVLSKLNGMGHRFGTSPVDIGNVQSISIDHENGTFKGVVISGSNDAAIGINLKRK

SEQ ID NO: 85968 - protein, 220 aa, Vibrio vulnificus YJ016
MSMTQDEMKKAAGWAALKYVEKGSIVGVGTGSTVNHFIDALGTMSEEIKGAVSSSVASTEKLEALGIKIFDCNEVASLDIYVDGADEINADREMIKGGGAALTREKIVAAIADKFICIVDGTKAVDVLGTFPLPVEVIPMARSYVARQLVKLGGDPCYREGVITDNGNVILDVYGMKITNPKQLEDQINAIPGVVTVGLFAHRGADVVITGTPEGAKIEE

SEQ ID NO: 85969 - protein, 354 aa, Burkholderia pseudomallei K96243
MSRTRLLSELVPGLDTLVRPLDLLARPTPVTEEPELARRWGQAGLWIKRDDLANPLYGGSKVRTLEFFLGRARAQRADGIVTMGPYGSHQLLATAVFGRRTGFLTRGVATPQPDVPEIALNRRLLPAYGMEVMRCASFAAVPAALLRARLKPLGAGRPFWIPPGANHPLGVMGVVEGALEVAQAIRAGSLPVPDDVVVPTGTCATAAGVYLGFALAGLDVRVVAVRMVPMIVTGPAKLLRMARQTERLLRRYGLTAPARWGELLWTNDHAGPSYGRAGLVAERARADVAQFGAFRTETTYTAKTLALLAGGGLQRRRVLFWNTYSAIDPDPSRDAGGACAWPDGESSAHSATAP

SEQ ID NO: 85970 - protein, 161 aa, Kineococcus radiotolerans SRS30216
MSGDGSPEIEVDGSGLRVAVVAARWHAETMDGLLAGARRALEASGVTEVTEVRVPGAFELPVAAARLARAGHDAVVALGVVIRGGTPHFDYVCDAATQGLTQVAVTTGVPIGFGVLTVDNEAQALHRAGLRGSREDKGAEAVLAALETVVALRGVAPLPQG

SEQ ID NO: 85971 - protein, 393 aa, Phytophthora cinnamomi
  misc_feature (256)..(256): Xaa can be any naturally occurring amino acid
  misc_feature (258)..(258): Xaa can be any naturally occurring amino acid
  misc_feature (324)..(324): Xaa can be any naturally occurring amino acid
LVTELGEYRAAVPSGASTGEFEALEMRDGGKAYMGKGVLNAVKNVNEIIAPALIGKDVTKQAELDRYMVEQLDGTQNEWGWCKKKLGANAILGVSLALCRAGAAAKKQPLWQYIADLAGNPTPCLPVPSFNIINGGSHAGNKLAMQEFMILPVGATSFTEAMKIGSEVYHNLKKVIKGRYGLDATAVGDEGGFAPNIQSNGEAIDLIEEAIKAAGYTNQVRLGMDVAASEFYTGAKDARYNLDFKNENAPESEKIXAXKLQEVYEGFIAKCAGSSKIVSIEDPFDQDDWESWVKFTGKVGQDVQIVGDDLTVTNPTRVKKAIEXKACNALLLKVNQIGSITESIEAVTMAKKAGWAIMASHRSGETEDTFIADLAVGLSAGQIKTGAPCRSER

SEQ ID NO: 85972 - protein, 210 aa, Kineococcus radiotolerans SRS30216
MSAPAVPAGTAVAAALDALRAGRPVLVSDAADRENEGDVVLSAQLATAEWVGWAVRHTSGMLCAPMPAERADALGLPRMVERNEDSYRTDYTVSCDAASGVTTGISAADRARTARVLAEPSSGPGDLIRPGHVFPLRARPGGVLERPGHTEAAVDLCRLAGLAPVGLISELVEDDGSMSRWDQIVALGEQYDLPVLTIADLRTHLSAAAD

SEQ ID NO: 85973 - protein, 389 aa, Oryza sativa Indica Group
MEEHRLGGGGGGGGGGGRPPIPGAAGRKLPGLSRHASFEQAGPRYFASRSKTSTILILEGVRSPANSTKSGTEKTFENMDAVAYMPVVRSGGWADIGSRHTMEDVFICSDNLMKEFGVESFEDGPSAFYGVFDGHGGKHAADFVCSNLARFIVEDEDFPREIEKALSSAFLQTDAAFADACSVNSSLASGTTALAALVVGRSLLVANAGDCRAVLCCRGKAIEMSRDHKPSCNREKVRIEASGGYVYDGYLNGQLNVARAIGDWHMEGMKACDGLGPLSAEPEVMIRNLTEEDEFLIIGCDGIWDVFRSQNAVDFARRKLQEHNDPVTCCKELVDEAIKRKSGDNLSVVVICFNSRPPPVLTTPRPRVQRSISAEGLRELQSFLDSLAD

SEQ ID NO: 85974 - protein, 392 aa, Phytophthora tentaculata
  misc_feature (56)..(56): Xaa can be any naturally occurring amino acid
LVTELGEYRAAVPSGASTGEFEALEMRDGGKDYMGKGVLNAVKNVNEIIAPALIGXDVTKQAEIDRFMVEELDGTQNEWGWCKKKLGANAILGVSLALCRAGAAAKKQPLWQHIADLAGNPTPCLPVPSFNIINGGSHAGNKLAMQEFMILPVGATSFTEAMKIGSEVYHNLKKVIKGRYGLDATAVGDEGGFAPNIQSNGEAIDLIEEAIKAAGYTNQVRLGMDVAASEFYTGAEDARYNLDFKNENAADSEKISADKLQEVYEGFIAKCAGSSKIVSIEDPFDQDDWDSWVKFTGKVGNDVQIVGDDLTVTNPTRVKKAIEQKACNALLLKVNQIGSITESIEAVTMAKKAGWGIMASHRSGETEDTFIADLAVGLSAGQIKTGAPCRSE

SEQ ID NO: 85975 - protein, 221 aa, Kineococcus radiotolerans SRS30216
MSRSVQVNPSILSADFANLEAELRRISTADAAHVDVMDGHFVPNLTLGLPIVEALQRVSPIPLDCHLMIEAPDRWAPAYAEAGAAGVTFHAEAAMAPVKLAREIRAAGGRAGIALRPATPLEPFVDLLAEFDMLLVMTVEPGFGGQSFLDVTLPKIARARAAIGDLDVRLQVDGGVSASTIERAAEAGADVFVAGSAVYGAEDAAAAIGTLRELAAGACRH

SEQ ID NO: 85976 - protein, 392 aa, Phytophthora nicotianae
LVTELGEYRAAVPSGASTGEFEALEMRDGGKDYMGKGVLNAVRNVNEIIAPALVGKDVTKQAEIDRFMVEELDGTQNEWGWCKKKLGANAILGVSLALCRAGAAAKKQPLWQHIADLAGNPTPCLPVPSFNIINGGSHAGNKLAMQEFMILPVGATSFTEAMKIGSEVYHNLKKVIKGRYGLDATAVGDEGGFAPNIQSNGEAIDLIEEAIKAAGYTNQVRLGMDVAASEFYTGAEDARYNLDFKNENAAESEKISADKLQEVYEGFIAKCANSSKIVSIEDPFDQDDWASWVKFTGKVGKDVQIVGDDLTVTNPTRVKKAIEQKACNALLLKVNQIGSITESIEAVTMAKKAGWGIMASHRSGETEDTFIADLAVGLSAGQIKTGAPCRSE

SEQ ID NO: 85977 - protein, 311 aa, Bradyrhizobium japonicum USDA 110
MLIASGDALIDFVPTRNADGREAVMPAVGGSCLNVAIGMARLGAPTGFVGGISTDLFGQMIADHATASHVELGLATRSDHQTTLAFVRIVAGESHYAFYDAETATRNWTYRRGSVAFDTVEVLHVGSTTLVNDEGAAETKALIADARMSSTISFDPNCRPNLVRDKPAYLARMAEFAQSADLIKMSDVDFAYLFGDEPYQQRASTLLGQGTSLVVVTRGNNGAIAWHAGAGRIEVQAPRVEVADTIGAGDSFQAALLFALHKQGRLARQQLKVINADELRRALSFAANCAGLTCTRPGADPPWSHEITWSP

SEQ ID NO: 85978 - protein, 221 aa, Oryza sativa Indica Group
MVDIRRAYPELGNCLYFDLAHKTHAVLYELPKNRLNWLWYINGDEPELTGSSVTMKVSEATVSEMKEEAERVWCPELARLISETAEPFVNVIYDAEPLPRLSWCGGRVALVGDAAHPTTPHGLRSTNMSIVDARVLGCCLARRGDAETTPRRALAEYEAARRPVVAAQVLHARRLGRLKQGLGMGSAGDGEGFDARTATEEEISQLRQSSMPYFSGAPTTE

SEQ ID NO: 85979 - protein, 636 aa, Cytophaga hutchinsonii ATCC 33406
MIQPGELLRTIHSPEELRKLDETQLIQVSEELRQFIVDNVSVYGGHFAASLGVVELTVALHYVFNTPVDQLVWDVGHQAYGHKILTGRMENFHTNRTYNGLSGFPKRSESPYDTFGVGHSSTSISAALGMAVASQYQKDNRQHIAVIGDGALTGGMAFEAMNHAGVTNSNLLIVLNDNCMAIDPNVGALKDYLVDITTSRTYNRVRDEVWNMLGKISKFGPNAQAIASKVESGLKASLLKQSNLFESLHIRYFGPVDGHDLNHLVQVLNDLKDIPGPKILHTLTVKGKGYALAEKDQVKWHAPGKFDKVTGQIHVKTYDTPQAPKYQDVFGNTIIELAEKNDKIMGITPAMPSGCSLNLMMEKMPDRAFDVGIAEQHAVTFSAGLATQGLIPFCNIYSTFMQRAYDQVIHDVCIQNLHVIFCLDRAGFAGVDGPTHHGAYDLAFFRCIPNLVVSAPMNEQELRNLMYTAQLQKNKGPFSIRYPRGQGVMPNWKTPFEEITIGKGRKVSDGDDVAILSIGHIGNYVIEAKALLREEELSPAHFDMRFVKPIDEEMLHLVFKKFKKIITVEDGCLMGGFGSAVLEFMADNNYAAQVIRLGIPDRIVEHGEQAELHKECGFDPQSIARTVRNLSGVVLK

SEQ ID NO: 85980 - protein, 392 aa, Phytophthora megakarya
LVTELGEYRAAVPSGASTGEFEALEMRDGGKAYMGKGVLNAVKNVNDIIAPALVGKDVTQQAELDRYMVETLDGTQNEWGWCKKKLGANAILGVSLALCRGGAAAKKQPLWKYIADLAGNPTPCLPVPSFNIINGGSHAGNKLAMQEFMILPVGATSFTEAMQIGSEVYHNLKKVIKGRYGLDATAVGDEGGFAPNIQSNAEAIDLIEEAIKAAGYTDKVRLGMDVAASEFFTGAEDARYNLDFKNENAPESEKISADKLQEVYESFIAKCANTSKIVSIEDPFDQDDWASWIKFTGKVGKDVQIVGDDLTVTNPTRVKKAIDEKACNALLLKVNQIGSITESIEAVTMAKKAGWAIMASHRSGETEDTFIADLAVGLSAGQIKTGAPCRSE

SEQ ID NO: 85981 - protein, 800 aa, Magnaporthe grisea 70-15
MSSGDNNSPGGSSRPQAVSRNSTNNASGRNNHAPANPSGLRNVVDPSEDASATNNNGDAGPSEPRSPTRNAASETTSLLRGVHDDHHPHEGQCNHGTFSPRPSSPTSILSSEPSFATSESSTSRLFENFLGTITGNSNDPDWRRKLARRIRSKKMHTSQELAREHGIRDSPLMYLSYYIPCLNWMSQYKRSYLKGDLIAAVTIAGMYLPMALSLADNLAHVPPINGLYGFVFQPFVYALLGSSPQMMVGPEAAGSLLVGSVVKSTLDRTSGTPSSMGGGAENDAELQAKVCGIVGGIAAATVFIAGLTRLGFLDSVLSRPFLRGFISAIGVVIGVDQLIPELGLNKLAAATPAVGHGSSMDKLRFMFDNLDQVHKMTALVAGVSFTVIMVARETKRRLQPRYPGVAYVPDRFIVVVLSAWLAYYFEWEKHGVQILGTVKAASGRPFTFRWPFQPSHVVQIRDAMGTSFLLAMLGFFESSVAAKSLGDQTIFPDIQLSPNRELIALGAANLLGSCFMSLPAFGGYGRSKVNRQTGGKTPMSSLFVSFIALMVILFGLRLFYYLPKPVLSSLISVVAWSLIEECPHDIYFFLRIRAWQELSLMFLIVLTTIFFSLNMGIAIGIGISLLLVIRNSTRPHIQILGRIPGTNRFENAEAHPERLEFVEGCLIVKIPEPLTFANTGQLKNRLRRLELYGTNKAHPALPRLRAQVQNKNVVFDVHGVTSMDGSGTQVLEEIVRGYRDRGVRVFFSRLPSRDSSPVWKLMENSGIVEMVGGIDHFVDDVHEALRLTEGPDSGDLPAAS

SEQ ID NO: 85982 - protein, 474 aa, Candidatus Blochmannia floridanus
MFKQQEVGVIGMGIMGQNLALNIENKGYRVSIYNRSPDKTNIIIKNNPTKNLIPYFSIEQFIFSLKKPRVIFLMITAGVHVDHIIQVLSNYLEIGDILIDGGNSFYQDTVRRDLYLSEKKINFIGLGISGGEEGALKGPSLMPGGSQDAFKIVESLLKKIAARFNDNEICMEYIGPNGSGHYVKMMHNGMEYGDMQIISEIYFFLKMVLHLTAKQLGKIFSDWNMGELSSYLIEITSHILMKSDNNQYCVLDYILDVADNKGTGLWSSKDALDLGVPSTMITESVFARYLSTLKNQRIQASKVFSNVFEGKVNFDLENIDIFVEKARKALYLSKIILYAQGFYQLKISSMTYHWNLNYQKIAKIFRAGCIIRSNFLQEIINIYSKTPKIENLLLDSYCVNIINNYQQDLRDIVTIGIDHGIPMPALSAAISYYDGFRSLMLPANLIQAQRDCFGSHTYKRIDKSGVFHTRWLSK

SEQ ID NO: 85983 - protein, 239 aa, Triticum aestivum
MKLNISYPANGSQKLIDIEDERKVRVFMDKRMGAEVPGDSVGDEFKGYIFRITGGNDKQGFPMKQGVMHPTRVRLLLSEGHSCYRPRRTGERKRKSVRGCIVAMDLSVLALSIVKQGDADIPGLTDVVHPKRLGPKRATKIRKFFGLTKDDDVRKYVIRREVQPKGEGKSPYTKAPRIQRLVTPQRLQHKRHRAALKRRQAEKVKDEANEYAQVLAKRIAEAKVNKADARKRRASSMRK

SEQ ID NO: 85984 - protein, 324 aa, Medicago truncatula
MGVGLLLVCHGLVTALVVISFLCGRWPIFEGTFIQRIHYFLTFGAYDYFLRFVGAVFGSKCTNAVLSVEYYCCDRPNPLLQIIYLVIISFTYYFAVNSSFAYIPGYYLSATHKYTSFFAAAVGILLFLLTSFTDPGTIKAENVSQYLAAYPYDNIIFSKKECSTCKIPKPARSKHCSICDRCVARFDHHCGWMNNCIGERNTRYFMAFLLWHFLLCMYGTVLIGLILAGRLKELKVVYILTVYYGIENSFWDLAPHVVQWLLGSYNTQILLIVFVAIVGMLLGGFFGYHAKLCLSNTTTNEVLSTSGLEMTVSVNSSKLGGSRK

SEQ ID NO: 85985 - protein, 292 aa, Vibrio mytili
GRFVFRAAQERADIEVVGINDLIDVDYMAYMLKYDSTHGRFNGTVEVEGGNLIVNGKTVRVTAERNPEDLKWDAIDVDVVAEATGLFLTDETARKHITAGAKKVVLTGPSKDATPMFVNGVNFDTYAGQDIVSNASCTTNCLAPIAKVLNDKFGIESGLMTTVHATTATQKTVDGPSAKDWRGGRGASQNIIPSSTGAAKAVGVVLPEVNGKLTGMAFRVPTANVSVVDLTVNLVNGASYEAICAAMKEASEGELKGVLGYTEDAVVSQDFIGETCTSVFDAKAGIALTDKF

SEQ ID NO: 85986 - protein, 639 aa, Vibrio vulnificus YJ016
MALLTIHNGQLAFGDNPLLDKADFVLQEHERVCLVGRNGAGKSTLMKVLAGEVILDDGKLQITQDVVVSRLEQDPPRNEPGTVYDYVASGLAEVGEQLKIYHDLLDLVAQEPTEKNINRLARVQEQLDHANAWRFEDRVKHVLAALKLDAETKLTDLSGGWQRKAALAKALVCDPDVLLLDEPTNHLDVTTIEWLETFLKDFRGSIIFISHDRAFIKAMATRIVDLDRGKLASFPGDYDNYLVEKEEMLRVEEMQNAEFDKKLAQEEVWIRQGIKARRTRNEGRVRALKKLREERQNRVDVQGKAKIQIDDAARSGKIVFEAEKLQFSFDGKKIVDDFSFNIMRGDRIALIGPNGCGKSTVLKLLLDQLKPESGRLHCGTKLEVAYFDQYREILDPEKTVIDNLADGKQEVTVGGRERHALSYLQDFLFSPKRARTPVKALSGGEKNRLLLARIFLKPNNLLILDEPTNDLDIETLELLEELLANYQGTLLLVSHDRQFVDNTVTTSWIFEGEGKIEEFVGGYHDAQQQRKQAIEAREVMEKSAPKAKVVEETPKTAPAKNTSKKLSYKLQRELEALPAKLEQLEADIEALQEQVNSAEFFAQPVETTQPVLEQLAALEQELEIAFERWEELEAMQQDS

SEQ ID NO: 85987 - protein, 139 aa, Medicago truncatula
MSSTGTTKGGRGKPKAAKSVSRSSKAGLQFPVGRIARFLKAGKYAERVGAGAPVYLSAVLEYLAAEVLELAGNAARDNKKNRIVPRHIQLAVRNDEELSKLLGTVTIANGGVLPNIHQTLLPKKVGKGKGEIGSASQEF

SEQ ID NO: 85988 - protein, 292 aa, Vibrio natriegens
GRFVFRAAQERNDIEVVGINDLIDVDYMAYMLKYDSTHGRFNGTVEVEGGNLIVNGKTVRVTAERNPEDLKWDEIGVDVVAEATGLFLTDETARKHITAGAKKVVLTGPSKDATPMFVNGVNFDTYAGQDIVSNASCTTNCLAPIAKVLNDKFGIESGLMTTVHATTATQKTVDGPSAKDWRGGRGASQNIIPSSTGAAKAVGVVLPEVNGKLTGMAFRVPTANVSVVDLTVNLVNGASYEAICAAMKEASEGELKGVLGYTEDAVVSQDFIGEVCTSVFDAKAGIALTDKF

SEQ ID NO: 85989 - protein, 292 aa, Vibrio navarrensis
GRFVFRAAQERADIEVVGINDLIDVDYMAYMLKYDSTHGRFNGTVAVEGGNLIVNGKTVRVTAERNPADLKWDEIGVDVVAEATGLFLTDETARKHIEAGAKKVVLTGPSKDATPMFVMGVNHASYAGQDIVSNASCTTNCLAPIAKVLNDNFGIESGLMTTVHATTATQKTVDGPSAKDWRGGRGASQNIIPSSTGAAKAVGVVLPELNGKLTGMAFRVPTANVSVVDLTVNLQKAASYADICKAMKAASEGELKGVLGYTEDEVVSQDFIGEVQTSVFDAKAGIALTDKF

SEQ ID NO: 85990 - protein, 289 aa, Cytophaga hutchinsonii ATCC 33406
MRNNYTNTRTMLLNLDKTFKPFSGTELPFESFIFSGGEPHIKIRPDVDTNQPITVTHRLNSFNDVGLLLVAVDALRRMHVDKINLFIPYFPAARQDRVMVKGEPLTVKVYAELINALQLSKVTVFDAHSEVTPALLNNCEAVSNHRFIQQVLKITGNDCLLISPDGGALKKIYKVSEYLGGIQVVECSKSRDVTTGKLKGFKVYADDLQGKDCLIVDDICDGGGTFIGLAEELKKKNCGAIYLAVSHGIFSQGFEKFSPAFKRIFTTDSFQNIENEYVTQLKIADGLLS

SEQ ID NO: 85991 - protein, 289 aa, Vibrio nigripulchritudo
FVFRAAQERADIEVVGINDLIDVEYMAYMLKYDSTHGRFNGTVEVEGGNLIVNGKTVRVTAERNPTELQWDQIGVDVVAEATGIFLTDETARQHITAGAKKVVLTGPSKDATPMFVMGVNDSTYAGQDIVSNASCTTNCLAPIAKVLNDKFGIESGLMTTVHATTATQKTVDGPSAKDWRGGRGASQNIIPSSTGAAKAVGVVLPELNGKLTGMAFRVPTANVSVVDLTVNLKEGASYEAICAAMKEASEGDLKGVLGYTEDQVVSQDFIGEVQTSVFDAKAGIALTDN

SEQ ID NO: 85992 - protein, 240 aa, Triticum aestivum
MNIIEAVFGRYKSPAERMREHQRSLQKATRELDRERTKLESQEKQLIIDIKSNAKKGQMNSCKVMARDLVRTRRYVAKFYSMRTQLQAVSLRLQTMRSNQQMAEAMRGATRAMGMMSRTMNLPQIQKILMDFEKESSVMDMKEEMMNDAVDHAMEDNEDETEEEESDKILQEVLDDIGINLSHQLGDTPVRLEAPSAVQESRQAVAIGDSSAGPSGNTGGATNVPDIDDFSARLASLRKD

SEQ ID NO: 85993 - protein, 514 aa, Triticum aestivum
MGLVWMVAAAVAAVLASWAFDALVYLVWRPRAITRQLRAQGVGGPGYRFFAGNLAEIKQLRADSAGAALDIGDHDFVPRVQPHFRKWIPIHGRTFLYWFGAKPTLCIADVNVVKQVLSDRGGLYPKSIGNPHIARLLGKGLVLTDGDDWKRHRKVVHPAFNMDKLKMMTVTMSDCAGSMMSEWKAKMDKGGSVEIDLSSQFEELTADVISHTAFGSSYEQGKKVFLAQRELQFLAFSTVFNVQIPSFRYLPTEKNLKIWKLDKEVRTMLMNIIKGRLATKDTMGYGNDLLGLMLEACAPEDGQNPLLSMDEIIDECKTFFFAGHDTSSHLLTWTMFLLSTHPEWQEKLREEVLRECGNGIPTGDMLNKLQLVNMFLLETLRLYAPVSAIQRKAGSDLEVGGIKVTEGTFLTIPIATIHRDKEVWGEDANKFKPMRFENGVTRAGKHPNALLSFSSGPRSCIGQNFAMIEAKAVIAVILQRFSFSLSPKYVHAPMDVITLRPKFGLPMILKSLEM

SEQ ID NO: 85994 - protein, 391 aa, Vibrio vulnificus YJ016
MRGHIMSVIKMTDLDLAGKRVFIRADLNVPVKDGKVTSDARIIASLPTIKLCLEAGAKVMVTSHLGRPTEGEYAEEFSLQPVVNYLNDALDCEVKLAKDYLDGLELNAGELVVLENVRFNKGEKKNDEELSKKYAALCDVFVMDAFGTAHRAQASTHGVGMFAEVACAGPLLAAELEALGKAMSNPERPLVAIVGGSKVSTKLTVLESLSKIADQLVVGGGIANTFIAAEGHNVGKSLYEADLVETAQKLMKECAIPVATDVACAKAFDENAEAEIKHVSEVQDDDMIFDLGPDSTAALAEIIANAKTILWNGPVGVFEFKNFEAGTKGISEAIAQSPAFSVAGGGDTLAAIDKFGIKADVSYISTGGGAFLEFVEGKVLPAVEMLEARAK

SEQ ID NO: 85995 - protein, 346 aa, Vibrio vulnificus YJ016
MLKVAINGFGRIGRNVLRAVYESGKHQQIKVVAVNELAQPEAMAHLLQYDTSHGRFGKRISHDQEHLYVHHDACPQGKGEFDSIRILHLSEINLLPWRDLEVDLVLDCTGVFGCQADGLEHIKAGAKKVLFSHPGASDLDNTIIYGVNHETLKAEHNVVSNGSCTTNCIVPIIKVLDEAFGIESGTITTIHSSMNDQQVIDAYHSDLRRTRAASQSIIPVDTKLHKGIERIFPKFSNKFEAISVRVPTVNVTAMDLSVTINTNVKVNDVNQTIVNASQCTLRGIVDYTEAPLVSIDFNHDPHSAIVDGSQTRVSNGHLVKMLVWCDNEWGFANRMLDTALAMQAAK

SEQ ID NO: 85996 - protein, 183 aa, Triticum aestivum
LHKTSLYKKDCRTGPEFPGYRRPTQAPLSAPEELAQGKTDMSAKGGKALVQSDAGAYVAWSGVDQPELTAEGLGCGLLVLRPLSFALPHYADSHKFGYVLRGSGVAGVLPVATGNASSAARERVVRLEVGDVIAVRTGDVSWWYNDSDGDADDLSILFMGDTERAVSPGDISYFFSRRRQQGP

SEQ ID NO: 85997 - protein, 142 aa, Picea sitchensis
MNILADGIQDDVGNVTRFVMLAREPVIPRTDRPFKTSIVFAHEEGTGVLFKVLSAFAFRNINLTKIESRPQRSKPVRVVDDLNGGTAKHFFEYIFYVDFEASMADPRAQNALAEVQEFTTFLRVLGSYPMDISPLNRACSNH

SEQ ID NO: 85998 - protein, 226 aa, Triticum aestivum
MDSEHWISRLAAAKRFYAAQLGHADRAGMDELDMDGDENAGRPDFACPYCYEDHDVASLVAHLEEDHPFEPHAAPCPICSEKVSKDMLNHITMQHGYLFKNRRRLRRFAVPGSQSLSLLSRDLREAHLQVLLGGGGHRSSNNNATNISADPLLSSFGLSFPTLDAEETSKLSTPAQSDVPVLKETAARPWRSSIDSSLTREEREQGQRESDGFVQDLLLSTLFRDH

SEQ ID NO: 85999 - protein, 139 aa, Cytophaga hutchinsonii ATCC 33406
MGGNRTFSMIKPDAVKDGHSGSILKMIEGAGFRIVAIKLTYLSAERAGEFYAVHTGKPFYDSLKSIMSESPIIALILEKENAVEDFRKLIGATNPANADAGTIRKLFAKSLERNAVHGSDSDENAQIEGSFFFSALEKF

SEQ ID NO: 86000 - protein, 390 aa, Phytophthora tropicalis
TEIGEYRAAVPSGASTGEFEALEMRDGGKDYMGKGVLNAVKNVNEIIAPALVGKDVTKQAELDRFMVEQLDGTQNEWGWCKKKLGANAILGVSLALCRGGAAAKKQPLWQYIADLAGNPSPCLPVPSFNIINGGSHAGNKLAMQEFMILPVGATSFTESMKIGSEVYHNLKKVIKGRYGLDATAVGDEGGFAPNIQSNGEAIDLIEEAIKAAGYTDQVRLGMDVAASEFYTGASDARYNLDFKNENAPESEKISADKLQEVYEGFIAKCAGSSKIVSIEDPFDQDDWASWVKFTAKVGKDVQIVGDDLTVTNPTRVKKAIEQKACNALLLKVNQIGSITESIEAVTMAKKAGWAIMASHRSGETEDTFIADLAVGLSAGQIKTGAPCRSE

SEQ ID NO: 86001 - protein, 395 aa, Agrobacterium tumefaciens str. C58
MKFGIVIVAAGRGERAGSPEEGPKQYRPIGGRAVIEHTLATFLRWNDACPIVVVSHADDAALLSPILARLDAGERITTVTGGATRQQSVLAGLEALSSHGLTHVMIHDAVRPFVAADMLERIAALHRAGAGGVLPALPVTDTLKRGLEDRVVETVSRQGLYAAQTPQSFSYSDILDAHRAAAASGKTDFTDDASIAEWTGLTVTLTEGSVDNVKLTLKRDIAMADEKLSHALPDVRTGNGYDVHQLEAGDGVTLCGIFIEHDQRLKGHSDADVALHALTDALLATCGAGDIGDHFPPSDPQWKGAASRIFLEHAAKVVRDNGGTIMNADVSLIAEAPRIGPHRQAMREALSDMLGIALERCSVKATTNETIGFVGRREGIAAIATATVVYQGRPL

SEQ ID NO: 86002 - protein, 385 aa, Phytophthora macrochlamydospora
YRAAVPSGASTGEFEALEMRDGGKDYMGKGVLNAVRNVNEIIAPALVGKDVTKQAEIDRFMVEELDGTQNEWGWCKKKLGANAILGVSLALCRAGAAAKKQPLWQHIADLAGNPTPCLPVPSFNIINGGSHAGNKLAMQEFMILPVGATSFTEAMKIGSEVYHNLKKVIKGRYGLDATAVGDEGGFAPNIQSNGEAIDLIEEAIKAAGYTNQVRLGMDVAASEFYTGAEDARYNLDFKNENAAESEKISADKLQEVYEGFIAKCANSSKIVSIEDPFDQDDWASWVKFTGKVGKDVQIVGDDLTVTNPTRVKKAIEQKACNALLLKVNQIGSITESIEAVTMAKKAGWGIMASHRSGETEDTFIADLAVGLSAGQIKTGAPCRSE

SEQ ID NO: 86003 - protein, 256 aa, Xanthomonas axonopodis pv. citri str. 306
MSIQILDHGRLREIRLARPPVNALDSAVCQALSVAVQQAGEEVDGIVLSGSERIFSGGMDVPHLLAHGADRAALLASWTAFFDAAQALANSRVPVVAAIGGHAPAGGCVLALCCDYRVMARSADTARPYTIGLNEVQVGLAAPEGIQRLLRRVVGAHRAERLLISGQLLPAEQAVAIGLVDELVDGELVTARAVAWLQELQQLPRQPMLTTRAIARADLRAALAPELIQLERFIDGWYAPDAQTALHGLVARLQKA

SEQ ID NO: 86004 - protein, 357 aa, Zea mays
MASESRISQVATTIPVRNVQDLAAYDAGELTADALERYIRPDIDKDAVLYEHSGELPVVDLGRLNPQHWEEEAAAKLRYACEEWGFFQVLSHGVPEEVMVNIKRDIQEFFELPLDVKNAYAQTPGDLQGYGQAYVVSNDQKLDWADMFCIISQPPPARDMKHWPTQPLTFRKSLEDYSVELEKVAHSIVTAIGKILNIDPELMSDKYAVQVLRMNYYPPCTSMPEKVLGFSPHSDASFLTILSQVNSVEGLQIRRHGAWVPVKPHPEALLVNVGDLLEIMTNGKFKSIEHRVMINARKERLSVSAFHNPKFDGVVAPVTVTPTEKLLYRTVKVEDYIKHHLSNKLDGKRALDHVKTF

SEQ ID NO: 86005 - protein, 448 aa, Brevibacillus agri
MSVPNDLQKNFSEVVSALKPKEAIDEANRCLYCYDAPCIKACPTSIDIPSFIRKIATGNLLGSARTIMESNPVGASCARVCPTEELCEGACVLNHASKPIMIGLLQRHATDWAIRNNAALFQKGDPNGKRVAIIGAGPAGLSAARELARLGYEVTIYEAKERAGGLNTYGIVSFRLPQEISLWEVEQVEALGVTIKTNTRIGVDIMPDELVANYDSVLLAVGMSSVPSLHIPGEELEGVLDAIALVEDTKTKPLTTDMVGKKVVVIGAGNTAIDAATCSKRLGADNVQILYRRTVQEMSCYQFEYEFAKQDGVEFRWLVAPTRVLGNKGRVTGLELIRMELGEPDAKGRKRPVPIPGSEFFIEVDFVVKAIGQNRHLSLIDQLGLQHQNGIVTVEDGTYRTSHPKVFAAGDVIFGGGKTDAMVVDAANHGKRAAYAIDKAIRDQKQLV

SEQ ID NO: 86006 - protein, 147 aa, Medicago truncatula
MYSVAQLVEYTSSLFQQGFLDDQFNQLQLLQDESNPNFVVEVVTLFFEDAEKLLNQLEKEIGQENNIDFKRVDALVHQLKGSSSSIGAQRVQRVCIAFKNYCEEKNIEGCFKSLQDIKQEYTLVKTKFETLFKMEQQIFAAGGSAPR

SEQ ID NO: 86007 - protein, 317 aa, Methylobacillus flagellatus KT
MSQLRNNAELGDELGISQIVTSLREVRLTALEHRNRLNRPPKLPARKALAGVVEGLGAALFPNRLGLPDLREEGIDYFVGHTLDVALRELVAQVRLELSFIAELDQVEDLKVRATALVREFASQLPAIRHLLDSDIRAAYEGDPAARSVDEVLVCYPGINAITHYRIAHVLHQLGVPLIARMITEIAHSATGIDIHPGAQIGEGFFIDHGTGVVIGETSIIGRHVRLYQAVTLGAKRFPVDADGTLVKGNARHPIVEDDVVIYAGATILGRITIGRGSVIGGNVWLTYSVPPNSNITQAQMGEGAPAGPRNGTVTHQ

SEQ ID NO: 86008 - protein, 253 aa, Zizania aquatica
GARGIGEAIVRQFVKHGANVVIADIDDAAGEALAAALGPHVSFVRCDVSVEEDVERAVERAVARHGRLDVLCNNAGVLGRQTRAAKSILSFDAGEFDRVLRVNALGAALGMKHAARAMTARRTGSIVSIASVAGVLGGLGPHAYTASKHAIVGLTKNAACELGAHGIRVNCISPFGVATPMLINAWRQGHDASTADDADADIDLDIAMPSDEEVEKMEVVVGGLATLKGPTLRPRDIAEAALFLASDDSRYIS

SEQ ID NO: 86009 - protein, 194 aa, Medicago truncatula
MAKHNRVNGKGGSNKNKLDWTRRYRIIVGIADGLLYLHENCQRRIIHRDIKAENVLLTENFEPQICDFGLAKWLPEQCSHHNVSKSEGTFGYFAPEYLMHGIVDEKTDVYSFGVLLLEIITGRRALDHLHQSLVLSAKPLLDANNIKDLVDPSLGDDYDQEQMDRVVLTASLCVEISPILRPRMSQASFNTTKR

SEQ ID NO: 86010 - protein, 621 aa, Methylobacillus flagellatus KT
MTTSNIHDLSSFEPEAILAAFPGEHPRMAAAIVVGREAQASGHLDIDELTRIANEIYAEGFPHGAPELPSTASLTDSAVPYAAGSPGIGAPVPPVPSAVSALPAGAPAAANVVPGIELAQVTPPSLGVSPSRLPPEFSQERVEAVGPAPAFPGLDISSLLGGVDIPYPVDLQGLLTLPVNSLYPHGSGNPGAGNASPYYFVAERPGIPDVAASAHPPFDVSLVRKDFPILSELVNGRPLIWLDNAATTQKPQAVIDRLSYFYQHENSNIHRAAHELAARATDAYEGARETVRRFINAPAVENIVFVRGTTEAINLVAKTWGRKHLGEGDEVVVTHLEHHANIVPWQQLCQETGAKLKVVPVDDTGQVLLDEYQKLLTSRTKLVSFTQVSNALGTVTPAREMIAMAHAVGAKVLLDGAQSVSHMRTDVQSLDCDFLVFSGHKIFGPTGIGALYGKAEVLDDMPAWQGGGNMIQDVTFEKTVYHGAPAKFEAGTGNIADAVGMGAALEYVERLGIENIARYEHELLVYATAALNKVPGLRLIGTAQHKASVLSFNLQGYKSEEVGAALNQEGIAVRSGHHCAQPILRRFGVEATVRPSLAFYNTYAEVDVLQGVLSKLASAKR

SEQ ID NO: 86011 - protein, 253 aa, Ehrharta erecta
GARGIGEAIVRLFVKHGAKVVVADIDDAAGEALAAALGPHVSFVRCDVSVEEDVERAVERAVARCGRLDVLCNNAGVLGRQTRAAKSILSFDAGEFDRVLRINALGAALGMKHAARAMMPRRAGSIVSVASVAGVLGGLSPHAYTASKHAIVGLTKNASCELGAHGIRVNCISPFGVATPMLINAWRQGHDASTADDADADIDTDISVPSDEEVEKMEEVVRGLATLKGPTLRPRDIAEAVLFLASDESRYVS

SEQ ID NO: 86012 - protein, 238 aa, Vibrio ordalii
GNLVVNGKTVRVTAERNPEDLKWDAIGVDVVAEATGLFLDDATARKHITAGAKKVVLTGPSKDATPMFVMGVNHASYAGQDIVSNASCTTNCLAPIAKVLNDKWGIESGLMTTVHATTATQKTVDGPSAKDWRGGRGASQNIIPSSTGAAKAVGVVIPELNGKLTGMAFRVPTANVSVVDLTVNLQNPASYAEICAEMKRASENEFAGVLGYTEDAVVSQDFIGEINTSVFDAKAGIA

SEQ ID NO: 86013 - protein, 502 aa, Medicago truncatula
MDSKRIIESSSSSSSSPLLFRGNAESQSQQYDSSDDVASNDEQHKQKITSSSSSSSIPPPTLTFTTLVAVFGSYVFGTAIGYSSPTQARIMIDLNLTVAQFSIFGSILTIGAMIGAIVSGTIADYAGRRLAMGFSQLFCISGWLAITIAKDAWWLYIGRLLVGCGIGLLSYVVPVYIAEITPKNLRGGFTAVHQLMICCGMSLTYLIGAFVNWRILAIIGIVPCLVQLLSVPFIPDSPRWLAKMGRLKESDSSLQRLRGKNADVYKEANEIRDYTEALQQQTEANIIGLFQLQYLKSLTVGLGLMILQQFGGINGIVFYANSIFISAGLSESIGTIAMVAVKIPMTTLGVFLMDKSGRRPLLLLSAVGTCLGCFLAALSFFLQDIHKWKEVSPILALVGVLVYVGSYSLGMGAIPWVIMSEIFPINVKGSAGSLVTLVNWLCSWIISYAFNFLMTWSSTGTFFGFAAICGFTVLFVAKLVPETKGRTLEEIQVSLNSNSMKK

SEQ ID NO: 86014 - protein, 253 aa, Ehrharta erecta
GARGIGEAIVRLFVKHGAKVVVADIDDAAGEALAAALGPHVSFVRCDVSVEEDVERAVERAVARYGRLDVLCNNAGVLGRQTRAAKSILSFDAGEFDRVLRINALGAALGMKHAARAMMPRRAGSIVSVASVAGVLGGLGPHAYTASKHAIVGLTKNASCELGAHGIRVNCISPFGVATPMLINAWRQGQDASTADDADADIDTVISVPSDEEVEKMEEVVRGLATLKGPTLRPRDIAEAVLFLASDESRYVS

SEQ ID NO: 86015 - protein, 290 aa, Vibrio orientalis
FVFRAAQERNDIEVVGINDLIDVEYMAYMLKYDSTHGRFNGTVEVEGGNLIVNGKTVRVTAERNPEDLKWDAIGVDVVAEATGLFLTDETARKHITAGAKKVVLTGPSKDATPMFVMGVNDSTYAGQDIVSNASCTTNCLAPVAKVLNDKFGIESGLMTTVHATTATQKTVDGPSAKDWRGGRGASQNIIPSSTGAAKAVGVVLPELNGLLTGMAFRVPTANVSVVDLTVNLKEAASYEAICAAMKEASEGELKGVLGYTEDQVVSQDFIGEVQTSVFDAKAGVALTDKF

SEQ ID NO: 86016 - protein, 254 aa, Avena sativa
GARGIGEAIVRLFVKHGAKVVTADIDEAAGEALAASLVPHVAFVRCDVSVEEDVERAVDRAVSRHGRLDVFCNNAGILGRQTCAAKSILSFDAGEFDRVLRVNALGTALGMKHAGRAMMARRYGSIVSVASVAGVLGGLGPHAYTASKHAIVGLTRNAACELGAHGIRVNCVSPFGVATPMLINAWRQGHDASAADDADADIDLDKIAVPSDQEVEKMEEVVRSLATLKGSTLRPRDIAEAVLFLASDDSRYVS

SEQ ID NO: 86017 - protein, 291 aa, Vibrio pacinii
GRFVFRAAQERNDIEVVGINDLIDVEYMAYMLKYDSTHGRFNGTVEVEGGNLIVNGKTVRVTAERNPEDLKWDAIDVDVVAEATGLFLTDETARKHITAGAKKVVLTGPSKDATPMFVMGVNDATYAGQDIVSNASCTTNCLAPVAKVLNDKFGIESGLMTTVHATTATQKTVDGPSAKDWRGGRGASQNIIPSSTGAAKAVGVVLPELNGKLTGMAFRVPTANVSVVDLTVNLKTAASYEAICAAMKEASEGELKGVLGYTEDQVVSQDFIGEVQTSVFDAKAGVALTDK

SEQ ID NO: 86018 - protein, 248 aa, Brachypodium distachyon
GARGIGEAIVRLFVRHGAKVVIADIDEAAGEALAAALGPHVGFVRCDVSVEEDVERAVERAVSRHGRLDVFCNNAGVLGRQGPSSGANSIASLDAAEFCRVLRVNALGAALGMKHAARAMLLQGNNGSIVSVASVAGVLGGMGPHAYTASSTRCWGLTKNAACELGKHGIRVNCVSPFGVATSMLVNAWREDEDEDMVMGGAPPSASELEKTEEKVRGMATLKGPTLRAADVAEAALFLASDESSYVS

SEQ ID NO: 86019 - protein, 287 aa, Vibrio pectenicida
RAAQERNDIEVVGINDLIDVEYMAYMLKYDSTHGRFNGTVEVEGGNLIVNGKTVRVTAERNPEDLKWDAIGVDVVAEATGLFLTDETARKHITAGAKKVVLTGPSKDATPMFVMGVNDATYSGQDIVSNASCTTNCLAPVAKVLNDKFGIESGLMTTVHATTATQKTVDGPSAKDWRGGRGASQNIIPSSTGAAKAVGVVLPELNGLLTGMAFRVPTANVSVVDLTVNLKTAASYEAICAAMKKASEGELKGVLGYTEDQVVSQDFIGEVQTSVFDAKAGVALTDKF

SEQ ID NO: 86020 - protein, 1087 aa, Mycoplasma penetrans HF-2
MDKNRKYMNFNSVIINVNTSKKNKFILNGFNLNGLFSINEKTIMDNNIELFSEANLNVYIVIEKQYSNILKKHLVNIEKVQILLKEDFFNQKNFIKSDEKTLIVDDNFYFNQEILNNLLTNEKYSNLSTLIKLNYNTHFDYIGIFDSTSINYIDFKNNSISDDIKVLSNLVELKEKQYLPIKIYDYKTLSKMDSKYECDKGFLYFTPGPVQIREWVKEVLGEYVNHHRSLSIKEIYKEAAENIKWAFNSKKGYPIAMANTGLGAIESTFVNLLEQGDEILILSNGFFGENLIDIAKRHQLNQSLLQIKQGESFDLKEVENLIKNKKAVFMVYMDTSCGILNPVKKVGELCKDYGCLFIVDAISGILNEEFNFDEYGVTAAVSTSGKGFEVSPGLAFVCVSEQGMQISANIKKRKPKFLDWQTFKVRSLYDGLTPSTYPVNIFASLNKVCEEIKDNGGLTRLIDKKFNLNLYLSESLITLGFRHIIENENSRSNWVLVMETPNIIKANELRAYLYAMKNILIECGIADSSNRIVRLAISAAHDIEDVTQLIEAIKEYIDLKITSKGEVMKKFYITTPIYYPSGNPHIGHAFTTLIADVLTRYKKKLGYETFFITGMDEHGQKIEEKAKELNLKPQELVDKYAKVFDNLWKLLGIEYSHFIRTTAEYHKNVVQETFSELLKKDFIYLGVWKGLYCVSCEENYTKNIAVRKENDDKLYCAQLHPLIQKEEESYFLKIKQFKKYISSFLKDPNLVYPITRINELFNSFLNNDDFDDLSISRSNFSWGIQIKENPKHVVYVWLDALLNYLSGLGYRQKDDSNFQKFWNSQDAEIVQLMSKEITRFHCIYWPIMLEMLGLRKPTKYISHGWIITEQGKMSKSLGNVLDPIYFINTYGRDAFRYYLLKELSLKEDSVFSEKLLINTFNKDLANNVGNLFNRSIGMINKYRDGIIPKYSKPKLSFNIEFEKQLKQFDDEITTIIEKLNIQKILSRVIDLINECNFFIEQVKPWDLKKENNEKDLDCFLSLILNAVKRVIYYLEPVLIDGSKEALKQFNIDSSKFDIKFVTDFSSLDNQKINTPEPIYLRIESEDK

SEQ ID NO: 86021 - protein, 227 aa, Listonella pelagia
AERNPADLKWDEIGVDVVAEATGIFLTDETARQHITAGAKKVVLTGSSKDATPMFVMGVNQDTYAGQDIVSNASCTTNCLAPIAKVLNDKWGIESGLMTTVHATTATQKTVDGPSAKDWRGGRGASQNIIPSSTGAAKAVGVVLPELNGLLTGMAFRVPTANVSVVDLTVNLKEAASYEAICAAMKEASEGEMAGVLGYTEDQVVSQDFIGEVNTSVFDAKAGVALT

SEQ ID NO: 86022 - protein, 679 aa, Oryza sativa Japonica Group
MWKAKRGGGDLPRSFHKNSRAFKNEWISGIAIEHQFFTKFLTTATLVRALNATTKHHDDLKIQVRLDGTRLYDGYMAEYDLDNDFSVVEVYSVRDVQVGPFQSALESLPHGEVLAVGHDTSGEIMVETVELNGDSKVSEDDRDLHCKISKPWEGGPLLSVDGDMVHRPEASIGEKSNSHPEVHGDFLNQEQLDLDSMGYPKLPSSMLGAGMILVNSFEDPFGDIYGEGVWRKFSRRASILNRNVVALASFNGFFIEWSGSKMILTSASLVRDSGDENKIDENLRIKVFLNNQCKEGKLEHCNLHYNIALVSVKYRALRPLNTSFDCKSSRVVAVGRCFNSGTLMATSGRLVPWTGTLDCQFLACSTCKITKLKYGHGKVLWNMNRTAGIGSPLVNLDGNVIGMNFYDTRIGTPFLLWEEICKILASFETKSESSGDIGNASGACFWKMPRDVKNKVNRWSVPKPRWCRPEDAESDDDDKLAFDDTGQLQYSYILGRKVKLLRLTIPISVPIVEAKSTDEPGVDPFAQRKQKKKRVEKQGKNRLENLKKAAKVGALPSHIQLAATSLPITGTKADLPKKSRKEDLENVAGMGSATASGGKFDEKLPGEKPPKHPGKHKKFIPVAEGEGMGNLGKQQNDKILMSLLARNSEQLDVCKASSRIQWSILNCVLPTIIGTACSV

SEQ ID NO: 86023 - protein, 338 aa, Brassica napus
MPRVITNETYGCPPIRALTFDSLGLIKVTEARGKERGTPTVVNTWGEMNASRCVLAASMDDRPSNPLLAVARKDGNVEVLNPCNGDLHFAYSLFGDYGSSPEDDEVSGLHLFRKQKDDQAERSCTLLTCTKKGDVSLRTVQFPNARADSTDEAAPKTWKACGSGEVLFGKVDRSENFGLFGGKRVEVNIWDLEQCTKIWSAKSPPKDNLGIFTPTWFTCAAFLSNEDHRKFATGTKSHQVRLYDVSAQRRPVLSFDFHETAITAITEDPDGHTVYVGNASADLAAFDIRTGKLLGNFLGKCSGSIRSVVRHPHHQVIASCGLDRYLRVYDVKTRQLIS

SEQ ID NO: 86024 - protein, 81 aa, Zea mays
MVANGDAPARGSAAAAASLRRRRTTSGAAAGGGGASSMLQFYTDETAGRKMSPNTVLIMSIGFVAVVAVLHVFGKLYRTSN

SEQ ID NO: 86025 - protein, 236 aa, Vibrio vulnificus YJ016
MNSIQQNIEHITTQIHDSTQKCGRARDSVQLLAVSKTKPVEAILEAYHAGQRAFGENYVQEGVEKVRFFAEQHPEKSIEWHFIGPIQSNKSRLVAEHFAWVHTIDRDKIAQRLNDQRPAELPPLQVLIQVNTSGEASKSGVSGEEIFALAELISTLPNLTLRGLMSIPENVDDHVSQLAAFQPLAELQQRLLQRYPSVDTLSMGMSGDMDAAIESGSTMVRIGTAIFGHRDYSNKA

SEQ ID NO: 86026 - protein, 498 aa, Picea sitchensis
MALSLSDLLIAASDILHSKYEHTRVVDCNSSINIRRSNKMRFNFGSQGISALEFPCSGTAGKTFRHTNDILRAHMENREESYSSRPKSLEMFSSGDGQSEQRGESTNRDHVLSNSLSVKEEKNLGQLLGPERQWESIFPAYMQSRTDEDEQNPIPVESNRGNGCKGVDGARAAAAAAASARELESHVKLSSSATPLVSPSVSAPPGSSAKPPTEGSKNLTELMSADPIWAAMRAEARLEAEKEPLLSSYLYASILAHSCFERALGFVLANRLQNPTLLATQLMDVFDNVFLNDGDIQQSIRLDVQAVKDRDPSCRSYSWALLYLKGYHALQSYRAAHALWNRGQRVLALALQSRISEVFAVDIHPAARIGKGILLDHGTGVVIGETAVVGDRVSMLQGVTLGGTGKEIGDRHPKIGEGVLIGAGATILGNLTVGKGAMVAAGSLVLKDIPPHSMVAGTPANVIGFLEEQNPALTMKHDATKGFCRLVADDLLHGGAGI

SEQ ID NO: 86027 - protein, 272 aa, Vibrio vulnificus YJ016
MEHKNIAFIGAGNMVRAIVSGLVADGYPADKITATAPSETRRLPLEQQFGIQTTSDNFMAATQADVIVLSVKPQMMEEVCKPLQSVDFSNKLVISIAAGINCARLNEMLATQLNLVRVMPNTPSQLGLGMSGLYAPVSVAEQDRHFAEQLMQAVGKTCWVDEESGINHVIAAAGSAPAYFFLFMEAMQAEAMAQGFDKQTARLLVQQSALGAASMVVENPDTELATLRENVTSKGGTTAEALRTFNEHQLSDIVAKAMQAAVARAQEMEKLF

SEQ ID NO: 86028 - protein, 412 aa, Triticum aestivum
  misc_feature (236)..(236): Xaa can be any naturally occurring amino acid
  misc_feature (246)..(246): Xaa can be any naturally occurring amino acid
  misc_feature (286)..(286): Xaa can be any naturally occurring amino acid
PASAIEAYPGDLIEQVCTKKQAGTGPEFPGYRRPTRPEDETIDAEILNSMAVTNDHFKTALTTSNPSALRETVVEVPNVSWEDIGGLENVKRELQETVQYPVEHPEKFEKFGMSPSKGVLFYGPPGCGKTLLAKAIANECQANFISIKGPELLTMWFGESEANVREIFDKARGSAPCVLFFDELDSIATQRGSSVGDAGGAADRVLNQLLTEMDGMNAKKTVFIIGATNRPDIIDXPLLRPGRLDXQLIYIPLPDVESRHQIFKACLRKSPLAKDIDLSALAKYTXQGFSGADITEICQRACKYAIRENIEKDIERERRRKDNPEAMEEDEVDEVAEIRAAHFEESMKYARRSVSDADIRKYQALAQTLQQSRGFGSEFRFPDQPAAGAASSAAADPFASAAAAAEDDDLYS

SEQ ID NO: 86029 - protein, 420 aa, Arabidopsis thaliana
MIEKKLSKMKMRTKSIPVRSSRKSLDSLLDDEANENTQCDERDVPHKKRRCLGTSETTDRGGSVEPLLDLDACIVCEVSDERVSRCCGVDCLLSFHGECLYADLGSTSSSSSSSSEDVSNPFCPYCWLKIVALKSKTLREKTVEAEKAVCKYLDKEMKSRDEGITLSGDEIGNQEQSTDIVSDHELQGEKDGCSSKPDADQGKVGTGKVIDEVGASEKVATEKFQDAEDDETAKDQGTRILNTGAGKKREVSSFLSMQESFSAKEQDQVQQNEKRRRRGLKIIDSDISSKGSSNERNGEDVTEQVTSSVQVTSPSGRMRNQQATTKVVAKSKTVRDISFFKMDQRRRLLWTYEEEEMLKVGVEKFAAEANKNMPWRKILEMGEKVFHETRTPADLKDKWRSMVKIMNKNEQGSTLTPTAM

SEQ ID NO: 86030 - protein, 175 aa, Cytophaga hutchinsonii ATCC 33406
MALIKSVLGKTPQFGENCWLADNATVVGNVEMGEFCSVWFNAVVRGDVNRIKIGNKVNIQDGVCIHCTYEKHATIIGDNVSIGHNAIVHGCIVEENVLIGMGAIVMDGCYIEKNSLIAAGAILLEGTRVESGSLYAGIPAKKVKDLAPEQFNTLIDRIANNYVTYAGWFKEEEEK

SEQ ID NO: 86031 - protein, 1097 aa, Cytophaga hutchinsonii ATCC 33406
MQVYIPDKPYEIFSLTYCFETIYNMKQRTFVLLFFILTLSSYAQTLKLETVIQKGHSASVKAVAVSPDGKILATGSRDKSVKLWDQQSGMEIRSLIGHDHTVNGLAFSPDGKLLATSSADGTARVWDILTGKEIFTSPKNSKYITDVAFNPDGKSFAYAGYPDSASIYAIPSGKLIKRLEVNADQGSGYGISLKYSNDGKWLAIGEDNKTANVYRTSDWHLAYTFKPAEGWCGGCGTYVEFSRDNKSLFKIAHNDKLSQYDLQTGSLIKTFGEPVDYLRGITLTKDGQHVIAASDSMLYNYTITSKTVVAYKLYLSETVNDIALSLDEKEILVASDNMTAWALEAASGKVIRTYQGALQEQDKGGLNYNADNYWEYNIARYLRLKNELLLTKDDNNFITGKTGVNAIQWNISTGAPNKLYEGHTKAVISMDQSADGSILATADGAGEVFLWNTKTGALINRIKPHTEPIFDVSLSRDGKYVATGSWDASIEVYDVQTGEVSSDMYLKENSCYSISFTPNGLYLLCGRLDKSLELREPDSKKVVLSFIGHTDVVSSIAFGADPNKALTASWDGTARIWDVTTGMMLQKFKGARGMLHSAIYSTDSKKIITGGDDRIIRIWDIQSGQVLKTLNGHQSEITSLSLSKDGKMLVSYSTDGVVKFWNLESGLEFYEHVHISSREWMARTPQGYFSATEQARADIHFVKGMDVYAPDQFFEYYRPDLIQQIFLNRGSSPTGMQNVENSLQLSPPPLIKLACIPNADGLQATLNIKVMDEGGGLSEIRLAHNGKNMAVALDPKKVVEGKGNSYIYSVPVSLVRGTNQFSGIAVSKGKIESAASLVSVVSDKAPSAAVCHVFAIGIDTYKNPAYTLNYAREDAEAFAESVKRNGANLYQKVIVHGLYDAAATRQNVLDTLKSLEAHIALNDVFIFYYAGHGSMVDQNFYFIPTECTSMYQATANNALSAETIQAGFKNIKALKQIIIMDACQSGGSVEVLAMRGANEEKAFAQLSRGAGIHVMASAGSEQNAKEILELKHGLFTYVLLEALNGKADGAPKDGKITIYELKSYLDDQVPELNSKYSGKIQFPYTFSRGSDFPIVLE

SEQ ID NO: 86032 - protein, 391 aa, Aspergillus nidulans FGSC A4
MSTQPAHPTLLIPGPIEFDDAVLHPSTPTNLSITSESHVAPGFVKVFGETLSMTRKLFQSTNPAAQPFVISGSGTLGWDFVASNLVEKGENALVLHSGYFADSFASCLETYGANATQLKAPIGERPSFEAIEQALKEKPYKIITITHVDTSTGVLSDIKTVAEIVRRVSPQTLVVVDGVCSVGCEEIAFDEWDLDVVLTASQKAIGCPPGLSIIMFSGRAIETFKSRKTPPSSYYSSMANWLPIMQNYENFKPSYFATPSTQLIHALHTTLSQITSRPMAERFAAHRRASDRVKAAVAELGLQQLASKVENQAHAMTAIWLPDGLAPPDVLPGLLKRGVIFAAGLHKEVATKYIRFGHMGVSIMDPARDDIEKAIAALKEAIADAKRAKGL

SEQ ID NO: 86033 - protein, 1421 aa, Arabidopsis thaliana
MGNTCVGPSRNGFLQSVSAAMWRPRDGDDSASMSNGDIASEAVSGELRSRLSDEVQNKPPEQVTMPKPGTDVETKDREIRTESKPETLEEISLESKPETKQETKSETKPESKPDPPAKPKKPKHMKRVSSAGLRTESVLQRKTENFKEFYSLGRKLGQGQFGTTFLCVEKTTGKEFACKSIAKRKLLTDEDVEDVRREIQIMHHLAGHPNVISIKGAYEDVVAVHLVMECCAGGELFDRIIQRGHYTERKAAELTRTIVGVVEACHSLGVMHRDLKPENFLFVSKHEDSLLKTIDFGLSMFFKPGLISLLLILKDPLPDLVFNVNSVILVEQLFLNSIPFLFADDVFTDVVGSPYYVAPEVLRKRYGPEADVWSAGVIVYILLSGVPPFWAETEQGIFEQVLHGDLDFSSDPWPSISESAKDLVRKMLVRDPKKRLTAHQVLCHPWVQVDGVAPDKPLDSAVLSRMKQFSAMNKFKKMALRVIAESLSEEEIAGLKEMFNMIDADKSGQITFEELKAGLKRVGANLKESEILDLMQAADVDNSGTIDYKEFIAATLHLNKIEREDHLFAAFTYFDKDGSGYITPDELQQACEEFGVEDVRIEELMRDVDQDNDGRIDYNEFVAMMQKGSITGGPPLVNCMVVKMKQIMRWPPWPPLFAVKFDVIVVVHQMDGLLDSDGGGDDSTDQSQRGGGTTTRKRPVVEIKWKGPKSVTLKRSVVRNLTEEGGFRGDGVVEWNEEFKRVCEFSVYKEGSFLPWFVSLTVFSGLNQGSKEKVRSFGKASLNIAEYFSLMKEDDVQVKVPLKDCDSSSVRSPHVHISLQFSPKESLPERQRSALPVLWSPLSAEAEKAESVVKVGLRKMKTFNNCMSSTQASEKESEKDGSSGSGSDGKSPERNLDSDSSYPFDTDSLDEGDAADESEENKENESSLADPVNYKTLRSANWARGSFHTVTNPEDEDLIYYSHRSPLAETGHCSDEVSNDVVSLEQAKGQMSKKRMLSWKKRKLSFRSPKQKGEPLLKKDCLEEGGDDIDFDRRQLSSSDESNSDWYRSDDAIMKPLSQFGDDDFVVGSWETKEIISRDGLMKLTARVFLASIDQRSERAAGESACTALVAVMAHWLGSNRDIIPTRSEFDSLIREGSSEWRNMCENEEYRERFPDKHFDLETVLQAKVRPICVVPERSFIGFFHPEKSEEEEGKEDASLDFLKGVMSFDSIWEELMKQEPEESASEPVIYIVSWNDHFFVLLVNHDAYYIIDTLGERLYEGCNQAYVLKFDKDAEIKRLPSVIKDNKADMGNQKQGGKNKSEQPERSKESEEQEEEEVVCRGKESCREYIKSFLAAIPIQQVKADMKKGLVSSLHHRLQIELHYTKHLHHHQPNMFESSATEVTVSEAAVSVTVAWSLASQFSNSGGFSCEMAELLGVKV

SEQ ID NO: 86034 - protein, 495 aa, Arabidopsis thaliana
MDLTQILLLSFLFLTISIKLLLTKSNRKPNLPPSPAYPLPVIGHLHLLKQPVHRTFHSISKSLGNAPIFHLRLGNRLVYVISSHSIAEECFTKNDVVLANRPDIIMAKHVGYNFTNMIAASYGDHWRNLRRIAAVEIFSSHRISTFSSIRKDEIRRLITHLSRDSLHGFVEVELKSLLTNLAFNNIIMMVAGKRYYGTGTEDNDEAKLVRELIAEIMAGAGSGNLADYLPSINWVTNFENQTKILGNRLDRVLQKLVDEKRAEKEKGQTLIDHLLSFQETEPEYYTDVIIKGIILALVLAGTDTSSVTLEWAMSNLLNHPEILEKARAEIDDKIGSDRLVEESDIVNLHYLQNIVSETLRLYPAVPLLLPHFSSDECKVAGYDMPRRTLLLTNVWAMHRDPGLWEEPERFKPERFEKEGEARKLMPFGMGRRACPGAELGKRLVSLALGCLIQSFEWERVGAELVDMTEGEGITMPKATPLRAMCKARAIVGKTI

SEQ ID NO: 86035 - protein, 397 aa, Kineococcus radiotolerans SRS30216
MNARVPAVLVLEDGRTFHGQAYGRVGQTVGEAVFSTGMTGYQETLTDPSYHRQVVVMTAPHVGNTGYNDEDQESGRIWVAGYVVRDPARVPSSWRSRRGLGEELDAQGVVGISGVDTRALTRHLRERGAMKVGVFSGEAAERPAAELLRAVQDAPDMVGTDLASLVSTDETYVVPAVGERRFSVTAVDLGIKSMTPHRLAERGIEVTVVPSTATLEEVLTSGADGGAPDGVFFSNGPGDPAAATHEIEVLQGVLERRIPFFGICYGNQLLGRALGFGTYKLKYGHRGINQPVMDLATRKVEVTAHNHGFAVEGKAGEVRETPYGRAEVSHVGLNDGVVEGLRCLDAPAFSVQYHPEAAAGPHDASYLFDRFVDLLSGTPASQLLDTTGKTDTTEKGA

SEQ ID NO: 86036 - protein, 362 aa, Frankia sp. EAN1pec
MSVRARIAVLPPGTHMLEFRELTMPPPGPFEVVVEQSAFGVCHSQLDRIFSPSRTAPMLLGHESIGTVVAVGAEVTYVREGDQVCITWIPRSPREGRPPSPSRLTFPDGEVATSHNCHTWGTHALVDEQYVVRMPEGTDPDLGSIIGCALMTGAGAVMNSIDLRAGQSVAVWGAGGVGLCAIAGAAILGAGRVIAVDVSDAKLALAGKFGATDGVNARETDPVEAIRQLTRHNDGTAGADYCLDCTGIGNNIPVSLAAVRPGIRGAGVRGGTDVLVGIPREPFSLDSFDLLNGEKSLAGSVGGGCDPVRDFATFVDWTNDGRFDPALLVTDRFGLDQINEAVDALHHGRVRGRAVVTVRDPA

SEQ ID NO: 86037 - protein, 352 aa, Oryza sativa Japonica Group
MDPFFRRASSDPLCLEDNSVQHGIERCPFLRNINEPTSFSFSSVNFPVPARGDKGPIFEDGPNFDMAFRVFHGQDGVVPLSHGSFERFEKPMPKPNPEFNPLAAKAATISLSAFGGFFSFGDFSNKRNKKNSNQKKPNNLPQNGGQPNNHEALSNEWLEMGQCPLAKSYRALSGVVPLVAKMMTPPAGMKLRCPPAVVAARAALSRTAFAKGLRPQPLPTKILVMALLGMAANVPLGIWREHTEKFSVQWFAAVHAAVPFIGMLRKSVLMPKTAMALTIAASILGQTIGSRAERIRLKRAAKVAAGSQGDASTRMSLKTGRYTDDVQFWDPLALRVESTIGTGTPVLVPTFH

SEQ ID NO: 86038 - protein, 193 aa, Solanum peruvianum
FVFAGVGSAIAYGKLTTNAALDPAGLVAIAVCHGFALFVAVSISANISGGHVNPAVTCGLTFGGHITFITGSFYMLAQLTGAAVACFLLKFVTGGCAIPTHGVGAGVSILEGLVMEIIITFGLVYTVFATAADPKKGSLGTIAPIAIGLIVGANILAAGPFSGGSMNPARSFGPAMVSGNFEGFWIYWIGPLV

SEQ ID NO: 86039 - protein, 256 aa, Brachypodium distachyon
GARGIGEAIVRLFVRHGAKVVIADIDEAAGEALAAALGPHVGFVRCDVSVEEDVERAVERAVSRHGRLDVFCNNAGVLGRQTRAAKSILTFDAGEFDRVLRVNALGAALGMKHAARAMVAAAPRRAGSIVSVASVAGVLGGLGPHAYTASKHAIVGLTKNAACELGAHGIRVNCVSPFGVATPMLINAWRQGHDASAADDADADIDLDVAVPSDEEVGKMEEVVRGLATLKGSTLRPRDIAEAVLFLASDDTRYIS

SEQ ID NO: 86040 - protein, 244 aa, Brassica napus
  misc_feature (213)..(213): Xaa can be any naturally occurring amino acid
MADNKDGVTPKSSAAFPLRNPNVTLNERNFAAFTNRSAAAHPWHDLEIGPEAPAVFNCVVEISKGGKVKYELDKNSGLIKVDRVLYSSIVYPHNYGFIPRTICEDSDPIDVLVLMQEPVLTGSFLRARAIGLMPMIDQGEKDDKIIAVCADDPEFRHYRDIKELPPHRLAEIRRFFEDCIHKTTSNITFVSVFTMGCFVLAYASFFQFSLNRXLVDKKNENKKVAVEGFLPAQAAIDAIKDSMD

SEQ ID NO: 86041 - protein, 117 aa, Vibrio angustum S14
MQLTDTEKFHLSGEAGQDIQKCMQVIVNRAKAFGALNEILNIVELAKRADYGIVISRRSGEREDTSIADLAVALNSPKVKFGSFARTESMAKYNRLLRLKHALAKSNEPPYEISKVV

SEQ ID NO: 86042 - protein, 246 aa, Psathyrostachys juncea
GARGIGEAIVRLFVKHGAKVVIADIDDAGEALAASLGPHVGFVRCDVSVEEDVERTVDRAVTRYGRLDVFCNNAGVLGRQTSAAKSILTFDAGEFDRVLRVNAMGTALGMKHAGRAMMARRYGSIVSIASVAGVPGGLGPHAYTASKHAIVGLTKNAACELGAHGIRVNCVSPFGVATPMLINAWRQGHAADDAIDLDIAVPSDQEVEKMEEVARSLSTLKGSTLRPSDIAEAVLFLASDDSRYVS

SEQ ID NO: 86043 - protein, 278 aa, Vibrio penaeicida
RADIEVVGINDLIDVEYMAYMLKYDSTHGRFNGTVEVEGGNLIVNGKTVRVTAERNPEDLKWDAIGVDVVAEATGLFLTDETARKHITAGAKKVVLTGPSKDATPMFVMGVNQDTYAGQDIVSNASCTTNCLAPIAKVLNDNFGIVSGLMTTVHATTATQKTVDGPSAKDWRGGRGASQNIIPSSTGAAKAVGVVLPELNGKLTGMAFRVPTANVSVVDLTVNLEKGASYEQICATMKEASEGPLKGVLGYTEDQVVSQDFIGEVQTSVFDAKAGIAL

SEQ ID NO: 86044 - protein, 252 aa, Psathyrostachys juncea
GARGIGEAIVRLFVKHGAKVVIADIDDAGEALAASLGPHVGFVRCDVSVEEDVERTVDRAVTRYGRLDVFCNNAGVLSRQTSAAKSILTFDAGEFDRVLRVNAMGTALGMKHAGRAMMARRYGSIVSIASVAGVLGGLGPHAYTASKHAIVGLTRNAACELGAHGIRVNCVSPFGVATPMLINAWRQGHDASAADDADADIGLDVAVPSDQEVEKMEEVVRSLATLKGPTLRPRDIAEAVPFLASDDSRYVS

SEQ ID NO: 86045 - protein, 454 aa, Alkaliphilus metalliredigens QYMF
MKNNLFVIFGATGNLTYKKLLPALYRLMDQNLISSATKIICIGRKNFTTKSYIEDALTQVKEEINWSVFKKSLFYYQMDIESMPDYIALKTFIENNCQMYTDNSIFYLATAPGLFPIIARGISEGNLVSKEDLKGRVVFEKPFGEDLDSAKKYNQMVRDYFDENQIYRIDHYLGKEMIQNILVVRFSNKIFEDIWNNKGIKSVTILAKETGGVMNRGGYYDGSGALKDMVQNHLMQMLSLIAMEPPEDFDTDDIRQRKVQVIQKLKANFNAENLLVGQYKGYKKEKGVDPDSKTETFVFLKAEIDTERWKGVPFYILTGKQLDEKKSEIIIEFLENSHSHKKWPKDSIQSNRLIIRVDPEDGITFQINTKIPGLSSDVKPVVLDYCHGCQAIGNLPEAYEKLLLDIVLGDTTLFPRWDEIEHSWQFIDQVKAYLGDTTPIEYTNFEELRKKVIK

SEQ ID NO: 86046 - protein, 239 aa, Vibrio ponticus
NLIVNGKTVRVTAERNPEDLKWDAIGVDVVAEATGLFLDDATARKHITAGAKKVVLTGPSKDATPMFVMGVNHTSYAGQDIVSNASCTTNCLAPIAKVLNDKFGIESGLMTTVHATTATQKTVDGPSAKDWRGGRGASQNIIPSSTGAAKAVGVVLPELNGKLTGMAFRVPTANVSVVDLTVNLKNGASYEAICAAMKEASEGELKGVLGYTEDAVVSQDFIGEVQTSVFDAKAGIALT

SEQ ID NO: 86047 - protein, 253 aa, Melica altissima
GARGIGEAIVRLFVRHGAKVVIADIDDAAGEALAAALGPHVSFVRCDVSVEEDVEGAVEWAVSRHGRLDALCNNAGVLGRQTRAAKSILSFDAGEFDRVLRVNALGAALGMKHAARAMMSRRAGSIVSVASVAGVLGGLGPHAYTASKHAIVGLTKNAACELGARGIRVNCVSPFGVATPMLINAWRQGHDASAADDADADIDLNIAVPSEEEVVKMEEVVRSLATLKGSTLRPRDVAEAVLFLASDDSRYVS

SEQ ID NO: 86048 - protein, 293 aa, Vibrio proteolyticus
GRFVFRAAQERNDIEVVGINDLIDVEYMAYMLKYDSTHGRFNGTVEVEGGNLIVNGKTVRVTAERNPEDLKWDAIGVDVVAEATGIFLTDETARKHITAGAKKVVLTGPSKDATPMFVNGVNFDTYAGQDIVSNASCTTNCLAPIAKVLNDKFGIESGLMTTVHATTATQKTVDGPSAKDWRGGRGASQNIIPSSTGAAKAVGVVLPEVNGKLTGMAFRVPTANVSVVDLTVNLVNGASYEDICKAMKDASEGELKGVLGYTEDAVVSQDFIGETCTSVFDAKAGIALTDKFV

SEQ ID NO: 86049 - protein, 472 aa, Clostridium thermocellum ATCC 27405
MAENHDYEREINRLFELQKKNVVRLRTSSIDERIAKLKKLKEYIWENKEKIQEAVYNDLRKPPEEVLLTEIYPVVSEIRHVIKNLKKWTKPKKVRTPISLFGAKSYYRFEAKGVVLIISPWNYPFELSIGPLITAIAAGNAVVLKPSELSPHTSGYIKKLVADIFDESEVAVVEGDAVVAQKLLEMGFNHIFFTGSTKVAKAVLKKASETLSSVTLELGGKSPVIIDGKFDIEEAAKKITWGKYLNAGQTCIAPDYVFVKKELLGDFVSHLKHYIKKYYYSDGSGRCSNYCGIINERHFNRLKNVFEVTVKEGAKVCEGGLFVENECYISPTVLTDVGRDSYIMEEEIFGPILPVLTYEKIDDVIEYINSKPAPLVLYVFSRDRKFYRHVINNVISGDCLINDVIAHFANPRLPFGGHNASGIGKSHGYYGFREFSHLRSIMIQPKRTMLQLLYPPYGEFVKKLIEWSTKYF

SEQ ID NO: 86050 - protein, 634 aa, Physcomitrella patens
MCSIPFGRKKSKKGDLAQDLLGDVFSTYSENGKLDAEGLLKFLQTEQGDSKSSLDDAKHLVELIRNERHKSKFPGFIVSSDLSKGDFKNYVLSPDLNGVLESTVHQDMTQPLSHYFIFTGHNSYLTGNQLSSDSSDVPIAAALQRGVRVVELDLWPDDKGGIKVTHGNTLTSPVAFEKCIKAIKANAFVSSKYPVVITLEDHLSSPLQALAAETLTNILGEDLYYPPSSDGFKELPSPESLKGKILISTKPPKEYLEAAVAQKSALKDEKILNELKKADKLQEQSTAPVKSPVEKKIAVPPSEKTKSISEEKDLSEKVGNLRVDSEGESADPAPASSPDGKKATLTADSESDDDDNKKNPEYARLITIHQSKPSKGTTVEDRLKVEGTVVRISLSETKLEKVTEEFPELVVKFTQRNILRVYPAGNRVNSSNYDPTAAWIHGAQMVAQNMQGYGKELWQAHGKFRGNGGCGYILKPKYLLEDLPNGKPFNPSAPGDTKMILKVKVMTTMGWDKAFPKYHFDLFSPPDFFTRLLVTGVPADVAKWKTSVIDDVWEPHWNEDHEFYLKCPELALLRIEVRDHDEGSQDEFEGQACLPMHEIKDGYRCVQMYDKKGSVLKGVKMLFHFQKRSFSPVQ

SEQ ID NO: 86051 - protein, 332 aa, Mycoplasma penetrans HF-2
MIDNINNCIIFGLSNGYLYAKEVAEKTNIQLGTIKTSKFADGEILVKSNSTVRGMHVFLFQSTCNPVNDNLMELLIAIDSLKRASAKTITVIIPYFGYARQDRKAKGREPITCKLVANFLEGAGATKVILIDIHSEQTQGFFDIPVDTLTASCVLFNEFRKNNPSVIKNLTVVAPDYGAVKNVRKITETLNLNLAIMDKRRPQPNVVEISNVLGDVMGRDCLLLDDMIDTGGTILQNIELLKERGCKKIFVMATHGVFSNGALEKFKLALDKGLIDQLYVADTIEANTKIEHPNIKVVSLSNFYAEILDAQINHKSVSKIYEKYWNMVLCGC

SEQ ID NO: 86052 - protein, 253 aa, Melica altissima
GARGIGEAIVRLFVRHGAKVVIADIDDAAGEALAAALGPHVSFVRCDVPVEEDVEGAVEWAVSRHGRLDVLCNNVGVLGRQTRAAKSILSSDAGEFDRVLRVNALGAALGMKHAARAMMSRRAGSIVSVASVAGVLGGLGPHAYTASKHAIVGLTKNAACELGAHGIRVNCVSPFGVATPMLINAWRQGHDASAADDADADIDLNIAVPSEEEVVKMEEVVRSLAALKGSTLRPRDVAEAVLFLASDDSRYVS

SEQ ID NO: 86053 - protein, 242 aa, Vibrio ruber
EGGNLIVNGKTVRVTAERNPEDLKWDAIGVDVVAEATGIFLTDETARKHITAGAKKVVLTGPSKDATPMFVNGVNFDTYAGQDIVSNASCTTNCLAPIAKVLNDKFGIESGLMTTVHATTATQKTVDGPSAKDWRGGRGASQNIIPSSTGAAKAVGVVLPEVNGKLTGMAFRVPTANVSVVDLTVNLVNGASYEDICKAMKEASEGELKGVLGYTEDAVVSQDFIGETCTSVFDAKAGIALT

SEQ ID NO: 86054 - protein, 146 aa, Lactobacillus acidophilus NCFM
MTKTWRLNERHYGALRGLNKDVSRKVFGVEQVLLWRRGFNSIPPAQGSPVIDRRYKLCDQHLMPRAESLHQTQNRLMPYYYDHIAPKLLNGEDQLIVAHGSSLRALIKKLENINDHDIVNLEVPNAEPIVYTMDDQLNIINKKILR

SEQ ID NO: 86055 - protein, 292 aa, Vibrio rumoiensis
GRFVFRASVERDNIEVVGINDLIDVEYMAYMLKYDSTHGRFNGTVEVKDGNLIVNGKTVRVTAERNPEDLKWNEINVDVVAEATGLFLTDETARKHITAGAKKVVLTGPSKDATPMFVMGVNHTTYAGQDIVSNASCTTNCLAPIAKVLNDKWGIESGLMTTVHATTATQKTVDGPSAKDWRGGRGASQNIIPSSTGAAKAVGVVLPEVQGKLTGMAFRVPTANVSVVDLTVNLANAASYADICAEMKRASEGELAGVLGYTEDAVVSQDFIGETNTSVFDAAAGIALNDKF

SEQ ID NO: 86056 - protein, 506 aa, Rhodopseudomonas palustris CGA009
MNLITTMHPDASTVFKARYGNFIGGRWVAPVDGRYFDNTTPITGAKLTEIPRSQKEDVELALDAAHTASVTWSKTTTTERSLILNRIADRMEANLDLLAIAETLDNGKPIRETRAADLPLAIDHFRYFAGALRAQEGSISEIDHDTIAYHFHEPLGVVGQIIPWNFPLLMAAWKLAPALAAGNCVVLKPAEQTPASILVWAELVGDLLPPGVVNVVNGFGVEAGKPLASSPRIAKIAFTGETSTGRLIMQYASENLVPVSLELGGKSPNIFFGDVTAEDDPFFDKAIEGFVMFALNQGEVCTCPSRALVQESIYDRFMERALARVAAIRQGDPRDPATMIGAQASQEQLDKILSYIDIGRHEGAELLAGGGRAQLPGGLAGGYYVHPTVFRGHNQMRIFQEEIFGPVVSVTTFKDEAEAIAIANDTQYGLGAGVWTRDGTRAYRFGRAIAAGRVWTNCYHAYPAHAAFGGYKQSGIGRETHKMMLDHYQHTKNLLVSYGTGPLGFF

SEQ ID NO: 86057 - protein, 287 aa, Neisseria meningitidis
MQKIRKAVFPVAGMGTRFLPATKASAKEMLPIVDKPLIQYAAEEAVAAGCTELIFITGRNKRNIEDHFDKAYELETELEMREKHKLLGYVQKILLDHVSCIFIRQAEALGLGHAVLCARPAVGNEPFAVILADDLIDAPQGALKQMVDIYNQSGNSILGVETVDPSQTGSYGIVEVEQLKSYQRVTNIVEKPKPEDAPSNLAVVGRYILTPRIFDLLTNLPRGAGGEIQLTDGIARLLDHEFVLAHAFEGKRYDCGSKLGYLEATVAYGLKHPELKDDFKELLKQFV

SEQ ID NO: 86058 - protein, 338 aa, Neisseria meningitidis
MNILVTGGTGFIGSHTVVSLLKSGHQVVILDNLCNSSINILPRLKTITGQEIPFYQGDIRDREILRRIFAENRIDSVIHFAGLKAVGESVAEPIKYYDNNVSGSLVLAEEMARAGVFSIVFSSSATVYGDPGKVPYTEDMPPGDTTSPYGASKSMVERILTDIQKADPRWSMILLRYFNPIGAHESGLIGEQPNGIPNNLLPYICQVAAGKLPQLAVFGDDYPTPDGTGMRDYIHVMDLAEGHVAAMQAKSNVAGTHLLNLGSGRASSVLEIIRAFEAASGLTIPFEIKPRRAGDLACFYADPSYAKAQIGWQTQRDLTQMMEDSWRWVSNNPNGYDD

SEQ ID NO: 86059 - protein, 386 aa, Hyphomonas neptunium ATCC 15444
MSKRDYYEVLGVERGVDEKALKSAYRKLAMKYHPDQNAGDTAAEDKFKEVGEAYAILSDPQKRAAYDRYGHGAFENGGMGGGSPFGGQGGNPEDIFQDLFSQVFGAGGFAGGRRRSGPQRGADLRYDLEITLEEAFYGKDETIHVPQAVACRPCEGTGAAPGTKPETCETCGGHGRVRAQQGFFTMERTCHICQGRGQIIRKPCKTCGGHGQVKEERKLQVKIPAGVESGMRIRLSGEGEPGTSGGPKGDLYIFVEVVEHDIFERDGPNLYCRAPVPMTTAALGGEIDIPTIDGGRARVAIPEGAQTGRKLRLRSKGMPSVRANGQTGDLYVEMFVETPQNLTARQKDLLRQFCDCSGADCHPESEGFLGKIKRFWGGEGDEKRPV

SEQ ID NO: 86060 - protein, 285 aa, Mycoplasma penetrans HF-2
MKYIKLANGLHMPIIGLGVYKAEGENCENTIIKAIDDYGYRMIDTAQVYFNEEFVGNAIKQTKIKREDIFITTKVWISNYGYNNTMYSISKSLKKLQTNYIDLVLLHQPFGDYYSAWKALEVLYKKGIVKAIGVSNFEADRLVDFCLHVDVKPVINQIELHPLRQRIEDLHWNNKYGVAVESWASFGRATSEIMENPILVSLAEKYNKTVPQIILRWLIQQNIVVIPKTVTESRLKENMDIFDFEISDDDMDLIKTINQNKTVSKHHHDPSTAEEIFSKFPEIRR

SEQ ID NO: 86061 - protein, 672 aa, Neisseria meningitidis
MNKSLSGSVEEYRELTLRGMILGALITVIFTASNVYLGLKVGLTFASSIPAAVISMAVLKFFKGSNILENNMVQTQASAAGTLSTIIFGLPGLLMAGYWSGFPFWQTTLLCIAGGILGVIFTIPLRYAMVVKSDLPYPEGVAAAEILKVGGHEEGDNRQGGSGIKELAAGGALAGLMSFCAGGLRVIADSASYWFKSGTAIFQLPMGFSLALLGAGYLVGLTGGIAILLGISIAWGIAVPYFSSHIPQPSDMEMAAFAMKLWKEKVRFIGAGTIGIAAVWTLLMLLKPMVEGMKMSFKSFGGGAPATERAEQDLSPKAMIFWVLSMMFILGVSFYHFIGDSHITGGMAWLLVVVCTLLASVIGFLVAAACGYMAGLVGSSSSPISGVGIVSIVVISLVLLLVGESGGLMADEANRKFLLALTLFCGSAVICVASISNDNLQDLKTGYLLKATPWRQQVALIIGCIVGALVISPVLELLYEAYGFTGAMPREGMDAAQALAAPQATLMTTIASGIFAHNLEWVYIFTGIAIGAVLIAADLVLKKSSGGKLALPVLAVGMGIYLPPSVNMPIVAGAVLAAVLKHIIGKKAENREGRLKNAERIGTLFSAGLIVGESLIGVIMAFIIAFSVTNGGSDAPLALNLQNWDAAASWLGLAFFVTGMFFFAQRVLKAGR

SEQ ID NO: 86062 - protein, 373 aa, Neisseria meningitidis
MSNQDFYATLGVARTATDDEIKKAYRKLAMKYHPDRNPDNKEAEEKFKEVQKAYETLSDKEKRAMYDQYGHAAFEGGGQGGFGGFGGFGGAQGFDFGDIFSQMFGGGSGRAQPDYQGEDVQVGIEITLEEAAKGVKKRINIPTYEACDVCNGSGAKPGTSPETCPTCKGSGTVHIQQAIFRMQQTCPTCHGAGKHIKEPCVKCRGAGRNKAVKTVEVNIPAGIDDGQRIRLSGEGGPGMHGEPAGDLYVTVRIRAHKIFQRDGLDLHCELPISFATAALGGELEVPTLDGKVKLTVPKETQTGRRMRVKGKGVKSLRSSATGDLYCHIVVETPVNLTDRQKELLEEFERISTGLENQTPRKKSFLDKLRDLFD

SEQ ID NO: 86063 - protein, 206 aa, Solanum lycopersicum
MSLSTTITTWGYTHHPFSDVGNKGRSRFRSPGFMPHLKMKFFTNPSSLSVSALLTKEQESKSKKQAMEFKEYVLEKAVSVNKALESAVSIKEPVMIHESMRYSLLAGGKRIRPMLCIAACELVGGVESTAMPAACAVEMIHTMSLIHDDLPCMDNDDLRRGKPTNHKIYGEDVAVLAGDALLALAFEHIATHTKGVSSDRIVRVIG

SEQ ID NO: 86064 - protein, 311 aa, Vibrio vulnificus YJ016
MVKSVMKPTKELLNEILHEVRPLIGRGKVANYIPALARVPAHKLAIAVYTNQGEVIKAGDADEAFSIQSISKALSLTLAMGLYQPDEIWRRVGKEPSGQAFNSLIQLEMEQGIPRNPFINAGAIVVADLLASRLSAPRQRLLEFVRQLSGETHICYDKVVAASEMMHSDRNAAIAYLMRSFGNFENEVIPVLNNYFHACALKMSCVDLAKTFSYLANKGVSVHTDQRVISPVQTKQLNALLATCGLYDGAGEFAYRVGMPGKSGVGGGIIAIVPGEMTIAVWSPELDPSGNSLAGTKALELLSERIGRSIF

SEQ ID NO: 86065 - protein, 539 aa, Arabidopsis thaliana
MAYASRIINHSKKLKDVSTLLRRENAATIRYYSNTNRAPLNREDTFNSRLGYPPLERISICSTSTLPVSIIFSTTRSNLSSAMGRPIFGKEFSCLMQSARGFSSGSDLPPHQEIGMPSLSPTMTEGNIARWLKKEGDKVAPGEVLCEVETDKATVEMECMEEGYLAKIVKAEGSKEIQVGEVIAITVEDEEDIGKFKDYTPSSTADAAPTKAEPTPAPPKEEKVKQPSSPPEPKASKPSTPPTGDRVFASPLARKLAEDNNVPLSDIEGTGPEGRIVKADIDEYLASSGKGATAKPSKSTDSKAPALDYVDIPHSQIRKVTASRLAFSKQTIPHYYLTVDTCVDKLMALRSQLNSFKEASGGKRISVNDLVVKAAALALRKVPQCNSSWTDDYIRQFKNVNINVAVQTENGLYVPVVKDADRKGLSTIGEEVRLLAQKAKENSLKPEDYEGGTFTVSNLGGPFGIKQFCAVVNPPQAAILAVGSAEKRVVPGNGPDQFNFASYMPVTLSCDHRVVDGAIGAEWLKAFKGYIENPKSMLL

SEQ ID NO: 86066 - protein, 244 aa, Frankia sp. EAN1pec
MTGSRTLLLLRHGESAWNAADRFAGWVDVPLSARGRVQAGRCGDLLRDTGLLPDVVHTSLLRRAVSTADLALDAADRHWIPVRRSWRLNERHYGALQGRNRMQVRAEYGADLLRFWRRSFHGTPPPIDPGSVFGQDDDARYRELGVHVPRTESIADVLDRLRPYYESEIANDLDAGRTVLVVAHGNVLRALIRHLGAQAGDPADDDLSEVRLPTGALLRYDLTDVGLPVRPGGVLLSASGATQK

SEQ ID NO: 86067 - protein, 268 aa, Oryza sativa Japonica Group
MGGGGGDDALYARCLVILYLISPITVFLLRFVSAPYGKLSRPGWGPAVPAALAWFLMESPTMCLPPLVLSAAASSSALRAAALLPAALYALHYVNRTLVHPLRLLRLRRAPAPVPILVAAFAFGFNLLNAYVQARSWALDAAAPHSTATATATPAAVARCLVGLALFAWGMRTNIAADKALLRLKEAGKGYQIPRGGLFDVVTCPNYFGEAVEWLGYALVAWTPAAWAFFLYTCSNLGPRARDHRRWYVGKFGDKYPASRKAFVPYIY

SEQ ID NO: 86068 - protein, 439 aa, Synechocystis sp. PCC 6803
MCCWQSRGLLVKRVLAIILGGGAGTRLYPLTKLRAKPAVPLAGKYRLIDIPVSNCINSEIVKIYVLTQFNSASLNRHISRAYNFSGFQEGFVEVLAAQQTKDNPDWFQGTADAVRQYLWLFREWDVDEYLILSGDHLYRMDYAQFVKRHRETNADITLSVVPVDDRKAPELGLMKIDAQGRITDFSEKPQGEALRAMQVDTSVLGLSAEKAKLNPYIASMGIYVFKKEVLHNLLEKYEGATDFGKEIIPDSASDHNLQAYLFDDYWEDIGTIEAFYEANLALTKQPSPDFSFYNEKAPIYTRGRYLPPTKMLNSTVTESMIGEGCMIKQCRIHHSVLGIRSRIESDCTIEDTLVMGNDFYESSSERDTLKARGEIAAGIGSGTTIRRAIIDKNARIGKNVMIVNKENVQEANREELGFYIRNGIVVVIKNVTIADGTVI

SEQ ID NO: 86069 - protein, 424 aa, Thermus thermophilus HB27
MKSEPLSYLGKDGGPWEIFTEQVDRVVPYLGRLAPLAESLKRPKRVLIVDVPVRLDDGSVAYFEGYRVHHNTARGPAKGGVRYHPEVTLSEVMALAGWMTIKNAAVGLPYGGGKGGIRVDPRKLSPGELERLTRRYTSEIGILLGPDRDIPAPDVNTGEREMAWMMDTYSMNVGRTVPGVVTGKPIALGGSLGRRDATGRGVFITAAAAAEKIGLQVEGARVAIQGFGNVGNAAARAFHDHGARVVAVQDHTGTVYNEAGIDPYDLLRHVQEFGGVRGYPKAEPLPAADFWGLPVEFLVPAALEKQITEQNAWRIRARIVAEGANGPTTPAADDILLEKGVLVVPDVIANAGGVTVSYFEWVQDFNSYFWTEEEINARLERVLRNAFEAVWQVAQEKKIPLRTAAYVVAATRVLEARALRGLYP

SEQ ID NO: 86070 - protein, 381 aa, Bacteroides thetaiotaomicron
MDDKGNIQTNMGYRVQHNNAIGPYKGGIRFHASVNLSILKFLAFEQTFKNSLTTLPMGGGKGGSDFSPRGKSNAEVMRFVQAFMLELWRHIGPETDVPAGDIGVGGREVGFMFGMYKKLAHEFTGTFTGKGREFGGSLIRPEATGYGNIYFLMEMLKTKGTDLKGKVCLVSGSGNVAQYTIEKVIELGGKVVTCSDSDGYIYDPDGIDREKLDYIMELKNLYRGRIREYAEKYGCKYVEGAKPWGEKCDIALPSATQNELNGDHARQLVANGCIAVSEGANMPSTPEAVRVFQDAKILYAPGKAANAGGVSVSGLEMTQNSIKLSWSAEEVDEKLKSIMKNIHEACVQYGTEADGYVNYVKGANVAGFMKVAKAMMAQGIV

SEQ ID NO: 86071 - protein, 419 aa, Thermus thermophilus HB27
MPLKAYRPPEDPGLWDTYLEWLERALKVAGVHPTTLEYLAHPKRLVTLSLPVVMDDGKVRIFQGYRVVHDIARGPAKGGVRLDPGVTLGQTAGLAAWMTLKAAVYDLPFGGAAGGIAVDPKGLSPQELERLVRRYTAELVGLIGPDSDILGPDLGADQQVMAWIMDTYSMTVGSTVPGVVTGKPHALGGSEGRDDAAGLGALLVLEALAKRRGLDLRGARVVVQGLGQVGAAVALHAERLGMRVVAVATSMGGMYAPEGLDVAEVLSAYEATGSLPRLDLAPEEVFGLEAEVLVLAAREGALDGDRARQVQAQAVVEVANFGLNPEAEAYLLGKGALVVPDLLSGGGGLLASYLEWVQDLNMFFWSPEEVRERFETRVARVVDAVCRRAERGGLDLRMGALALALERLDEATRLRGVYP

SEQ ID NO: 86072 - protein, 457 aa, Pasteurella multocida subsp. multocida str. Pm70
MATGKIVQIIGAVIDVEFPQDAVPKVYDALNVETGLVLEVQQQLGGGVVRCIAMGSSDGLKRGLSVTNTNNPISVPVGTKTLGRIMNVLGEPIDEQGEIGAEENWSIHRAPPSYEEQSNSTELLETGIKVIDLVCPFAKGGKVGLFGGAGVGKTVNMMELIRNIAIEHSGYSVFAGVGERTREGNDFYHEMKDSNVLDKVSLVYGQMNEPPGNRLRVALTGLTMAEKFRDEGRDVLFFVDNIYRYTLAGTEVSALLGRMPSAVGYQPTLAEEMGVLQERITSTKTGSITSVQAVYVPADDLTDPSPATTFAHLDSTVVLSRQIASLGIYPAVDPLESTSRQLDPLVVGEEHYNVARGVQTTLQRYKELKDIIAILGMDELSEEDKLVVARARKIERFLSQPFFVAEVFNGTPGKYVPLKETIRGFKGILDGEYDHIPEQAFYMAGTIDEVLEKAKKL

SEQ ID NO: 86073 - protein, 495 aa, Frankia sp. EAN1pec
MFVYATTVVHVTPRPRGARARETVVIEKRTIFIDGEWVSSAGTGTLTVINPATEEPLATLPRGHVDDVDRAAQAAARAFESWSRSTVDDRIDMLTRIADILDTRAEELARTIVSEVGTPITLARGSQSATAINDLRIAAASLKDIVWEERFDDTIVRRIPAGVAGAITPWNGPMRMIALKAGAAIAAGCTMVLKGTEVAPLSAFLFAEAAAEAGLPRGVFNLVSGTGPEIGEALATHPLVDIVSLTGSVRAGSRVMELASRSVKRVALELGGKSANIILADADLEKAVVDGLGDAFRNSGQVCGGLSRMLVPRGRLAEAEEIAAAKATSYVIGDPLDEATTLGPVVSDAQRDRVRRYIQTGVDEGLRLVAGGPEAPEHLDRGYYVQPTVFTGDNSSRLAQEEIFGPVVIIIPFDDTDEAVAIANDSDYGLAGAVWAADPARARDVGRRIRTGRVRINGAPIDMRAPHGGLKRSGIGREMGRYGIEEYLEYQSLIS

SEQ ID NO: 86074 - protein, 124 aa, Borrelia afzelii
MALNKEDILTWLEGAKTMEVVELVTAIEEKFGVTAAVATSVGGAASTGSIDSEEQTEFDVILMSFGDSKINVIKEVRSITGLGLGEAKALVESAPKAIKEGLSKSDAEELKKKLEAVGAKVEVK

SEQ ID NO: 86075 - protein, 194 aa, Synechocystis sp. PCC 6803
MSAYLFNQENEPDESDSITLYDEAGRPLDCYVENSLEQEDAQYLLLMPVDIPVVIIAWEEDDDETEDAEAILLEDQEEISGIFADAKAVLAELDLSLKYTAYTLTVSGELPPIEDEDILTLEIEGNDPAGEMEEEELQFLASFYHEEERYSIYTPLAPLLFLAKAISETQIELVHPDNDELKHILEELLFEDAD

SEQ ID NO: 86076 - protein, 253 aa, Lithachne humilis
GARGIGEAIVRLFVRHGARVVIADIDQAAGEALAAALGPPASFVRCDVSVEEDVERAVERVVVRHGRLDVLCNNAGVLGRQTRAAKSILSFDAGEFDRVLRVNALGAALGMKHAARAMMPRGAGSIVSVASVAGALGGLGPHAYTASKHAIVGLTKNAACELGAHGIRVNCVSPFGVATPMLINAWRQGHDASAAGDADADIDADIAVPSQEEVDKMEEVVRGFATLKGPTLRPRDIAEAVLFLASDDSRYVS

SEQ ID NO: 86077 - protein, 257 aa, Xanthobacter autotrophicus Py2
MSPSALITGAADGIGWAIARTLAATGWRLALVDLDEGAAAARAAELGAGHLAVRADVSVEEDVAEAMRRAVAAFGGLDAVVNNAGIADTHLPTVEQDAARFRKILDVDLTGVFLVSREAARVMLPRRSGSIVNLSSIAGITGLPRRNAYGAAKAGVVALTRSMACEFGPAGIRVNAVAPGYVETALVKALERDGRIDLGRIRRRIPLGFLAQPDDIAQAVAFLVSPAARYVTGTVLSVDGGWQAFGDAGDAFPPPAG

SEQ ID NO: 86078 - protein, 412 aa, Candidatus Blochmannia floridanus
MLEKQSDVIGNCTNRKVKFALLGPAFIAAIGYIDPGNFATNIQAGATFGYQLLWVVVWANIMAMLIQLLSAKLGIATGKNLAEHIRDQFPKSLVWIYWVQAEIIAMATDLAEFIGAAIGFQILLGISLLNGALLTGVATFLILTLQNYGRKPLELVVGGLLLFVAIAYVIELFYSKPQLIELGMSMLCPILPNKEAVFLSAGVLGATIMPHVIYLHSSLTQDSSVIATKSERYSSTKLDVAIAMTIAGFVNLSMMATAASVFHFRGHTGVASLDEAYLTLSPLLSHTAAVIFGLSLTAAGLSSTVVGTLAGQVVMQGFVRFYIPIVLRRIVTMFPSFIIIALKIDPTHILIMSQVLLSFGIALALVPLLLFTGNVNLMHELVNSFWMNFLGWIITMIVIALNIYLLIGIFSE

SEQ ID NO: 86079 - protein, 1713 aa, Aspergillus nidulans FGSC A4
MGNVLRDLKLGETSGAAIIENGDLVQWGKGYSETEFKPTKTLTGKNLISLSMSHDRIVALSSDGKVYSLPVSKHDQTSGKKAEEKSWLPFSSGKSSMSYRLIQPILKLGEKIVAISGGLEHVLLLTSSGRVFSAVSSTENFPSFGQLGVPGLTWATRPPGPVDAPHEVKTPNGVKVAQIATGDYHSLLLTKNGNVLAFGDNSFGQLGLGFDPNSPFLDTPTPILMESLYRDSSRSPRATGVAAGGANSFFTVDVHQDGQGQGSKSPSKVISDIWTCGRGIWGALGNGKWTHLQDHPTLLKALSGLVEYDEATQRLLPIRLNDISVGTTHVAAVLDNQTRLNRSASSLEGADDAGLDVVWWGGNEHFQLGTGKRSNLSKPAHINVSPETVSLDDKELARLQIMPAYRGIVGDRSVDMRQRVECGRHVSAIYTASPTFTSKQAIMPRENQKRGRRATEKAKKEASKRKRDEGIEEPTLKRLKPSADEDNAVTAGADYVPLEGEEYDDQYATGAADEMPFYGLLDSEEQEYFSRANEMLELNQFGDAEERRLFVDSVFREARGKELKIACSQSCSRLMEKLISVSDIHQIWRLFNKFIGHFLTLVQHRFASHCCERLFISAAPGVTQKASKTKSKKDDDIEMDEDEEPEPELPLAEMFMKVVEELQGNWGYLLTERFASHTIRVLLLVLAGEPVDVSSNDSVVASRKKERLGVVGGETQENNPSGEKRSVPESFEATLKKVMQDMVSVLDDTYLRALATHPVGNPVLQVLVRLELSHFGKSSAKQPTSIIKRLIPDENFEDDSETTRFIRGLLYDPVGSRLLETMVRCMPGKMFKSLYRNYLRDQMSSLARNQTAGYVVLRVLERLGRDDLHAVMEQIVPKIPSLIERSRTIVPKVLIERCLARGVDTKPIAKALESSYDSDPARRLEQMLRLETAMADNKEKSDKNGPPGESNPGSAAAEKLHGSLLAQTIVTAPGQLSELVFSSLLALSPEVLLSICKDPTASRVIQQALTSPASSPQFRRQFTTRFTSHMNELALDSSGSHVVDALWPATKDIYFIKERMAQELAQNELALRDSFVGRAVWRNWAMDLYKRRRGEWAAKAKGRDITNDSAEKPKSRLDMARASIDPKIQGSNYCCKFLYKLPVQWRRRHPEVAQTKCEIAVEDLLIPFIRSADEDTLGPEVQQNGVNKSNKTNGDHALVGTSLVDYKKPEELQDILQLDLPEQGTGQTGLVSVLRKVLRYSVNTWHQGFLDKLYASTNAPGVASELILAALNTNVHVYQVSPALSVIEKHTGKRLAALFGLNGPRAGGISVQGGSASNTTSIVIARNNLYPNTKTDGNGDYKFVLFTSAHGHYSIEKAAQMLGLGSSAAWSVPIDKEGRMIPSELEKLVQKALSENRTPFYVNATAGTTVLGSFDPFDDIAAICKKYNLWLHIDGSWGGSFAFSRRQRHKLAGAEKANSIAINPHKMLGVPVTCSFLLASDLRQFHRANTLPAGYLFHNNDDEDAVPVENGIGGFSELNSDSPEIWDLADLTLQCGRRADSLKLFLSWTYYGTAGYERQIDNACDTAAYLATIIQDHPDFILVSQNPTPCLQVCFYYGPNGKLLHPRGDSIVSDENQRAKANSKVTEQITHAIVGRGFMVDYAPPSGDEKAVGDGKFFRCVINVQTTRETVEGLVRAIEEVGPGVVKGLLSEGASAVKKRPGEQGHGPVVHRV

SEQ ID NO: 86080 - protein, 253 aa, Lithachne humilis
GARGIGGAIVRLFVRHGARVVIADIDQAVGEALAAALGPPASFVRCDVSVEEDVERAVERVVARHGRLDVLCNNAGVLGRQTRAAKSILSFDAGEFDRVLRVNALGAALGMKHAARAMMPRGAGSIVSVANVAGVLGGLGPHAYTASKHAFVGLTKNAACELGAHGIRVNCVSPFGVATPMLINAWRQGHDASAADDADADIDADIAVPSQEEVDKMEEVVRGFATLKGPTLRPRDIAEAVLFLASDDSRYVS

SEQ ID NO: 86081 - protein, 279 aa, Vibrio salmonicida
ERNDIEVVGINDLIDVEYMAYMLKYDSTHGRFNGTVEVVDGNLVVNGNTVRVTAERNPEDLKWDAINVDVVAEATGLFLTDETARKHITAGAKKVVLTGPSGDVPMFVMGVNAADYAGQDIVSNASCTTNCLAPIAKVLNDKWGIESGLMTTVHATTATQKTVDGPSAKDWRGGRGASQNIIPSSTGAAKAVGKVIPELNGLLTGMAFRVPTANVSVVDLTVNLKTAATYEEICAEMKRASENEFAGVLGYTEEAVVSQDFIGETQTSVFDAAAGVALT

SEQ ID NO: 86082 - protein, 224 aa, Pseudomonas syringae pv. tomato str. DC3000
MQPFVIAPSILSADFARLGEEVDNVLSSGADFVHFDVMDNHYVPNLTIGPMVCSALRKYGVTAPIDVHLMVSPVDRIIGDFIEAGATYITFHPEATQHIDRSLQLIREGGCKAGLVFNPATPLNLLEYVMDKVDMILLMSVNPGFGGQKFIPGTLNKLREARALIDASGRDIRLEIDGGVNVNNIREIAAAGADTFVAGSAIFNAPDYREVIEKMRAELALSRA

SEQ ID NO: 86083 - protein, 580 aa, Brassica napus
MAQVVATRSIQGSMLSPNGGSVSTRSDKLLKPASFAVKVLGNESKKSGRVSVRGGRKVDTTVRSARVETEVIPVSPEDVPNREEQLERFLEMQKFSDTSVGMWSKPTVRRKTKIVCTVGPSTNTREMIWKLAEAGMNVARMNMSHGDHASHKKVIDLVKEYNAQSKDNTIAIMLDTKGPEVRSGDLPQPIMLDPGQEFTFTIERGVSTPTCVSVNYDDFVNDVEAGDMLLVDGGMMSFMVKSKTKETVICEVVDGGELKSRRHLNVRGKSATLPSITEKDWEDIKFGVENKVDFYAVSFVKDAQVVHELKNYLQGCGADIHVIVKIESADSIPNLHSIITASDGAMVARGDLGAELPIEEVPILQGKIINLCRSMGKAVIVATNMLESMIVHPTPTRAEVSDIAIAVREGADAVMLSGETAHGKFPLKAAGVMHTVALRTEATITTSSEMPANLGQAFKNHMSEMFAYHATMMSNTLGTSTVVFTRTGFMAILLSHYRPSGTIYAFTNEKKIQQRLALYQGVCPIYMEFSDDAEDTFTKALATLLKQGMVKKGEEIAIVQSGSQPIWRSQSTHNIQVRKV

SEQ ID NO: 86084 - protein, 253 aa, Olyra latifolia
GARGIGEAIVRLFVRHGARVVIADIDQAAGEALAAALGPLVSFVSCDVSVEEDVERAVERAVVRHGRLDVLCNNAGVLGRQTRAAKSILSFDAGEFDRVLRVNALGAALGMKHAARAMMARGTGSIVSVASVAGVLGGLGPHAYTASKHAIVGLTKNAACELGAHGIRVNCVSPFGVATPMLINAWRQGHDAFAADDADADIDADIAVPSQEEIDKMEEVVRGLATLKGPTLLPRDIAEAVLFLASDDSRYIS

SEQ ID NO: 86085 - protein, 314 aa, Candidatus Blochmannia floridanus
MNKIYQDNSYTIGHTPLVRLNKIGNQFIMAKIESRNPSFSVKCRIGSNMIWDAEKKNILNPNITIIEATSGNTGIALAYVTAARNYKLLLTMPETMSIERQKLIRALGADIILTEGHLGMKGAINRATEIANDNPSKYLLLQQFSNPANPNIHERTTGPEIWYDTHGNIDIFVAGVGTGGTITGVGRFFKQIQNKKITIVAVEPKDSPVITQTLSGQSIKPAPHKIQGIGAGFIPKNLDLNLIDQVVTVETDAAISYAKFLMQKEGILAGISSGAALAAAVQLQQQEKHTNKNIVIILPSSGERYLSTILFSDS

SEQ ID NO: 86086 - protein, 292 aa, Vibrio scophthalmi
GRFVFRAAQERNDIEVVGINDLIDVEYMAYMLKYDSTHGRFNGTVEVVDGNLIVNGKTVRVTAERNPEDLKWDAIGVDVVAEATGLFLDDATARKHITAGAKKVVLTGPSKDATPMFVMGVNDSTYAGQDIVSNASCTTNCLAPIAKVLNDNFGIVSGLMTTVHATTATQKTVDGPSAKDWRGGRGASQNIIPSSTGAAKAVGVVLPELNGKLTGMAFRVPTANVSVVDLTVNLEKGASYETICAAMKAASEGELKGVLGYTEDQVVSQDFIGEVQTSVFDAKAGIALTDNF

SEQ ID NO: 86087 - protein, 125 aa, Klebsiella pneumoniae
REVMTTLWPFLEENPRYRQLALLERLVEPERVIQFRVVWVDDRNQVQVNRAWRVQFNSAIGPYKGGMRFHPSVNLSILKFLGFEQTFKNALTTLPMGGGKGGSDFDPKGKSDGEVMRFCQALMTE

SEQ ID NO: 86088 - protein, 255 aa, Pariana radiciflora
GARGIGEAIVRLFVRHGAKVVVADIDQAAGEALADALGPQVCFVRCDVSVEDDVERAVERAVARHGRLDVLCNNAGVLGRQTRAAKSILSFDAGEFDHVLRVNALGAALGMKHAARAMMARGAGSIVSVASVAGVLGGLGPHAYTASKHAIVGLTKNAACELGGHGIRVNCVSPFGVATPMLINAWRQGHDASTAADAGDDIDLDLDIAVPSEDEVEKMEEVVRGLATLKGPTLRPRDIAEAVLFLASDDSRYVS

SEQ ID NO: 86089 - protein, 1533 aa, Aspergillus nidulans FGSC A4
MDGQRQQPYVPAPPPSASQPSQAHIMPLPPPPPRYPPAQPQNVMPPPPPGPPPGSAYGTSKLTNPQLQSQSTLGWSNWGGRGIPQYLPPPPPPPMTHANQSSFARPSAVQNNNATSATYVPQPGTFGPGVGIPPFDVPSHSYDAPNTMVASERPRPPPNAPYGHGTSNASAYQLDGTIPSTPLTHTAPFSHETSHDVPSSAVPTGSPFKSVPQSASQANDLTKSSSHRHNNSNTTVGGMSASEAAVQWPLDRVLLWLAKNGFSHEWQETFKTLEIEGADFLELGHGQNGRPNLGKMHTVVYPQLAKECEANGTAFDLTRERDEGKRMRKLIRLIHDDAGPDNGGTFNKQHDFDDGHGSVPDEGPEFSPNINNVAQAPGSPSLNATNVSNSPNLKAPKYSHKPRSFTTPGSISHDSTTAELAMTEGSSTMLPRSDFSRNVLGTIGIDHQRKSPSMSSDNGVFAIPPHRPHEGSPKSGSPAAQHATLYAAPVSSATDLNAKYDARFGHNRVNSGERRYYETLKHDGSRPSPQTTQTAGDNASSYPKDHRMGFLNFFKKKSARNSDPNNPSPDDNTPDSPIYSKYHFNSSDVSVNERPLSASLSDYERMMMVRTKPAHRGKRFIFATMDGWNYRLIDTTDIDSVEKLRASICQNLGIYDWPDAQIFLTEPGQLEHDEPLNDTFLTLCQRSKSDSIGSLKLFVKTPHNVAGLGVSMPDRSAVSPTSAIPRKPLDGEAASRLSPLKPSSPQQLKPPASRLPLRDIQNSAAGTSPVDGEPDGSLQDQERKPQKSYRPTPAPLPRPDAYSETGYRRKEVINFDKPRISPYEDKKSEVLVPFRKPPSAPQESNTLSKVNSLRKKDGDRPRPHRSNQPPGIKEMMADMGMMSSLIGKPSSPNSGNTTATEDAHSSIDSAVDKSSQSTPPLTNTSYSPTTTATTTTTTTTASSSLSRSASQKRKSVGPEFDFEETQVSFQRSPALEEDSDDDSDDGLFAIPLANTKNSVKPGSPDTQARPRKPSLTVDTEAKPRTGLSVSFKSPSATRETFASSGGDASNSTAPYFIASNSPEEEKTPIRRNSLRNSFATGDVWASRPPVEGVIDQLDDFFPDIDLDAPYLDEQGTSPPSSPASKVAIDNELNRKDKQENSHHGMQPPPAPEDNTLGSSEPTMTSHGQGIVARRNVSRSGGGLTRMKSIREVAKGANQATRQRSVAASSGNKRSGDVHRRKSTKMFGAKIMQISPRRGSQLSQLDPIPQNSISSSSKPQRQPTFRIIRGQLIGKGTYGRVYLGMNADNGEVLAVKQVEINPRLAGQDTDKIKEMVAALDQEIDTMQHLEHPNIVQYLGCERGELSISIYLEYISGGSIGSCLRKHGKFEESVVKSLTRQTLEGLSYLHNQGILHRDLKADNILLDLDGTCKISDFGISKKSNDIYGNDSSNSMQGSVFWMAPEVIQSQGQGYSAKVDIWSLGCVVLEMFAGRRPWSKEEAIGAIFKLGSLSQAPPIPDDVSMNVTPAALAFMWDCFTVSNPSYSSFLRARSEV

SEQ ID NO: 86090 - protein, 287 aa, Vibrio mediterranei
RAAQERNDIEVVGINDLIDVEYMAYMLKYDSTHGRFNGTVEVEGGNLIVNGKTVRVTAERNPEDLKWDAIDVDVVAEATGLFLTDETARKHITAGAKKVVLTGPSKDATPMFVMGVNQDTYAGQDIVSNASCTTNCLAPIAKVLNDEFGIESGLMTTVHATTATQKTVDGPSAKDWRGGRGASQNIIPSSTGAAKAVGVVLPELNGKLTGMAFRVPTANVSVVDLTVNLKNGASYEAICAAMKAASEGALKGVLGYTEDQVVSQDFIGEVQTSVFDAKAGIALTDNF

SEQ ID NO: 86091 - protein, 574 aa, Candidatus Blochmannia floridanus
MISGISVSPGIALGKALLLKEKKIVINTKKITIKSIDKEIKKFLSGRSKTVEQLKEIKKKVRKKLDSKQESIFEGHIILLEDEELEQDIITLIKDELFTADAAVYSVIENQANALEKLKDEYLKERSIDVRDIGNRLLKNILNIPIINLNDITEEVIIITVDLSPSETAQLNPKKILGFITDLGGKTSHTSIMARSLELPAIVGTNTITTTVMDGDFIILDSLNNKIYINPDLNIIHTLKLLKKKYLSEKKQLTKLKNLPSITLDNHKVHICANISTVHDIVKAQENGAEGIGLYRTEFLFMNRNALPTEEEQFQAYKNAAESMYNQSIIIRIMDIGGDKNLPYMNLPHEDNPFLGWRAIRILMDRKDMLHTQLRAILRASFFGKLRIMYPMIISVEEIQQLNTELNFLKTQLHNSGEKFDENIKVGVMIETPSAAIIAHHLIKEVDFFSIGTNDLTQYTLAVDRGNKLISHLYNPMSPSILILIKKIIESSHIAGKWTAMCGEMAGDERAVPLLLGMGLDEFSMSAISIPKVKKIIRNTYYHDAQLLAQKALKCSTTEELMKLLSSHLPIQET

SEQ ID NO: 86092 - protein, 585 aa, Aspergillus nidulans FGSC A4
MADIATRELRQPIDIAEYLFRRLHEVGIRSVHGVPGDYNLAALDYLPKCGLHWVGNCNELNAGYAADGYARVNGIAALVTTFGVGELSAINAIAGAYSEFVPIIHIVGQPHSRSQKDGLLLHHTLGNGDYNVFSSMNKGISVTTANLNDTYDAATLIDNAIRECWIHSRPVYLALPTDMITKKIEGERLKTPIDLSLPANDPEKEDYVVDVVLKYLHAAKNPVILVDACAIRHRVLEEVHDLIEVSGLPTFVAPMGKGAVNETHRCYGGVYAGTGSNPGVREQVESSDLILSIGAIKSDFNTAGFSYRIGQLNTIDFHSTYVRVRYSEYPDTNMKGVLRKVIQRLGFIKADPVPHISNALPEHEKNSSEQRITHAWMWPMVGQWLKENDIVITETGTANFGIWDTRFPSGVTAISQVLWGSIGYSVGACQGAALAAKEQGNRRTVLWVGDGSLQLTLQEISTMIRNNLNPIIFVICNEGYTIERFIHGWDESYNDIQTWDIKGLPVAFGGKGRYKGYKVTTRDELTKLFASEEFSSAPCLQVSLCDLTHYLSDANFEQLVEVHMPREDAPASLKITAEAAASRNK

SEQ ID NO: 86093 - protein, 255 aa, Pariana radiciflora
GARGIGEAIVRLFVRHGAKVVVADIDQGAGEALADALGPQVCFVRCDVSVEEDVERAVERAVARHGRLDVLCNNAGVLGRQTRAAKSILSFDAGEFDHVLRVNALGAALGMKHAARAMMARGAGSIVSVASVAGVLGGLGPHAYTASKHAIVGLTKNAACELGGHGIRVNCVSPFGVATPMLINAWRQGHDASTAADAGDDIDLDLDIAVPSEEEVEKMEEVVRGLATLKGPTLRPRDIAEAVLFLASDDSRYVS

SEQ ID NO: 86094 - protein, 741 aa, Vitis vinifera
MVGKMEAVNGVKSGSNSTASTFQSAFFKPDLSLKSLKLKTKQQELLIRVSILTLVYILAFITRLFSVLRYESMIHEFDPYFNYRTTVFLTEKGFYEFWNWFDSESWYPLGRIIGGTLYPGLMVTAALIYSIIRFLRFAVHIREVCVLTAPFFASNTTIVAYFFGKELWDSGAGLVAAALIAICPGYISRSVAGSYDNEGVAIFALLLTFYLFVKAVNTGSLAWALASAFGYFYMVSAWGGYVFIINLIPLYAMVLLITGRYSMRLYVAYNCMYILGMLLAMQIRFVGFQHVQSGEHMAAMGVFFLMQVFYFLDWVKHLLSDTKLFQAFLRITVTCAVGVGAIALGVGTASGYISPWTGRFYSLLDPTYAKDHIPIIASVSEHQPTAWSSFMFDFHILLFLFPAGLYFCFKRLSDATIFIVMYGLTSMYFAGVMVRLILVATPAMCLISAIAVSATIKNLTQLVRTKSKVAHTGSTKGTTSGKASSKASLDQSLPFQRNGAIALLIGAFYLLCKYATHCTWVTSEAYSSPSIVLAARGAYGNRVIFDDYREAYFWLRQNTPPDAKVMSWWDYGYQITAMGNRTVIVDNNTWNNTHIATVGRAMSSYEDEAYEIMRSLDVDYVLVVFGGVTGYSSDDINKFLWMVRIGGGVFPVIKEPDYLVNGEYRVDKGAAPKMLNCLMYKLSYYRFGELQTEYGKPPGYDRARGVEIGNKDIKLEYLEEAFTTSNWIVRIYKVKPPNNRW

SEQ ID NO: 86095 - protein, 292 aa, Vibrio tapetis
GRFVFRAAQERADIEVVGINDLIDVEYMAYMLKYDSTHGRFNGTVEVEGGNLIVNGKTVRVTAERNPEDLKWDAIEVDVVAEATGLFLTDETARKHITAGAKKVVLTGPSKDATPMIVMGVNQDTYAGEDVVSNASCTTNCLAPVAKVLNDKFGIESGLMTTVHATTATQKTVDGPSAKDWRGGRGASQNIIPSSTGAAKAVGVVLPELNGLLTGMAFRVPTANVSVVDLTVNLKTAASYEAICAAMKEASEGELKGVLGYTEDQVVSQDFIGEVQTSVFDAKAGVALTDKF

SEQ ID NO: 86096 - protein, 292 aa, Vibrio tubiashii
GRFVFRAAQERNDIEVVGINDLIDVEYMAYMLKYDSTHGRFNGTVEVEGGNLIVNGKTVRVTAERNPEDLKWDAIDVDVVAEATGLFLTDETARKHITAGAKKVVLTGPSKDATPMFVMGVNQDTYAGQDIVSNASCTTNCLAPIAKVLNDEFGIESGLMTTVHATTATQKTVDGPSAKDWRGGRGASQNIIPSSTGAAKAVGVVLPELNGKLTGMAFRVPTANVSVVDLTVNLKNGASYEAICAAMKAASEGALKGVLGYTEDQVVSQDFIGEVQTSVFDAKAGIALTDNF

SEQ ID NO: 86097 - protein, 423 aa, Picea sitchensis
MEKRLSKRALSLKASPIQELSHLAQRCNAINLAEGFPDFPAPPAIKDAAIAAIRADFNQYRHVQAICDYLAYTLKLTQGLDVDPKKNIAICCGQSEAFAAAILAVVDEGDEVLLLDPAYETYEACITMAGGTPVYVALNPPCWTLELEKLILAFTPRTKAIVLNSPHNPTGKVFSKDELTVIAELCCRMHCIAITDEVYEHITFGSAVHISLASLPGMLERTIITSSISKTYSVTGWRVGWAIAPVEIASAIRNIHVKLTDSAPAPFQEAALTALQSVPEYFESLRMEYNERRDFMVDLLNRVGFKVHFKPQGAVFVFAELPETCAMSDVEYVAKLITVAGIAAVPGCGFFHTREKLSRQESSQSILDPVSRPESMGWCEGSHTLKDYRNRYIRFAYCKSKATLMAAADKLNKCNGLLVLHEI

SEQ ID NO: 86098 - protein, 144 aa, Brassica napus
IIRFKEVLLTATHLAIVMEYAAGGELFERICSSGRFSEDEARFFFQQLISGVSYCHSLQICHRDLKLENTLLDGSAAPRVKICDFGYSKSGVLHSQPKTTVGTPAYIAPEVLSKREYDGKVADVWSCGVILYVMLVGAYPFEDP

SEQ ID NO: 86099 - protein, 493 aa, Delftia acidovorans
MSQKFIDRHGLWSDAQKAAAVEVLKKIEQDGIQMIRLSWPDQYGLLRGKMLSVAALRSAFGSGSEITMAPFFFDTASAIVFNPFSSDGGLGNPELAGSPNVVMVPDPTTFRVLPWADRTGWMLADLYMRSGRPFPLSPRALLKKALGQLADLGYDFHGGLEVEWYLTRIVDPCLEPETLGGPGTPAAPPKVMPVAKGYSYLLENHLDEVEPIMAEVRQHLLTLGMPLRSIEDEWGPSQMETTFDVMSGLDMADTMVLFRNAVKQICRRRGYLASFMCKPKIEGFCASGWHLHQSLAARDSGVNAFVPQTGEPLSALGRAYVGGLLKHACAASSFTTPTVNGYRRRRPFSLAPDRVTWAEDNRAAMARVIAAPEDSASRVENRVGEPAANPYLYLASQLFSGIDGIRRQLDPGPLQETPYAADVPILPRNLAEALDVLEGSSFFREAFGEEFIHYWLHLRRSEWARFVAAEGADVDMAGDPVTDWEHREYFELF

SEQ ID NO: 86100 - protein, 368 aa, Glycine max
IEYRAPPRVSYVGPPPPVHVYLLKVGLSKNSHVTNSLLDLYAKCGAIREAQRVFSEMSERNAVSWTSLIVGLAVNGFGEEALELFKEMEGQGLVPSEITFVGVLYACSHCGMLDEGFEYFRRMKEECGIIPRIEHYGCMVDLLSRAGLVKQAYEYIQNMPVQPNAVIWRTLLGACTIHGHLGLGEIARSHLLNLEPKHSGDYVLLSNLYASERRWSDVQVIRRSMLKDGVKKTPGYSLVELGNRVYEFTMGDRSHPQSQDVYALLEKITELLKLEGYVPHTANVLADIEEEEKEQALSYHSEKVAIAFMLLNTPPGTPIRVMKNLRVCADCHMAIKLIAKIYDREIVIRDRSRFHHFRGGSCSCKDYW

SEQ ID NO: 86101 - protein, 426 aa, Vibrio parahaemolyticus RIMD 2210633
MDLAFDRHHIWHPYTSTLTPLTCYPVSSANGVHIKLEDGTELVDGMSSWWSTIHGYNHPHLNQAAHQQIDQVSHVMFGGITHQPAISLCKKLLSLAPNNLEHVFLADSGSVAVEVSLKMALQYWHAKGERRPKFLTLRHGYHGDTFAAMSVTDPDNSMHSLYKGFLPEHIFAQSPTCGYWDEWKPEDLADFEHKIDSHHQELAAVILEPIVQGAGGMRIYHPEFLKGVRRLCDKYDLLLIADEIATGFGRTGKLFACEHADIQPDILCVGKALTGGYMTLSATLASKHVADTVCGGDAGCFMHGPTFMGNPLACAVATASLELIEQGDWQQQTQQIEMLFSELLPKLEEYDLVKNTRWLGAIGVVETHRPVNMETIQALFVEHGVWIRPFGNLIYMMPPFISKPEDIEKLINAIDAALQRKDCFAS

SEQ ID NO: 86102 - protein, 480 aa, Colwellia psychrerythraea 34H
MSESIFCNYINGTWVEGESSLANISPADISDVIGHYAQANQEQAEAALDAAIKGQLEWQESGLEQRYSVLMAIGDELIARKDELGKLLAREEGKTLPEGAGEIYRSGQFFHYYAAEVLRQMGETADSVRPGIEIETRREPVGVVGIITPWNFPVATAAWKIAPALAFGNSVVLKPANQVPASAWALTEIISRQGLPAGTFNLVMGPGAEVGDLLINSKKINALTFTGSLETGRKVAIATATNLVKCQLEMGSKNALIVLDDADLDNAVECAVGGAFFGTGQKCTASSRLIVTEGIHDRFVDAVVARMKQLVVGHPLREGVHIGAVADARQMKQNLNYLEIAKKEGGKLVSGGDVITEETEGYYLTPALFTETTNAMTINRDEAFAPIACVIKVKDYDEALATLNDTNYGLVGGICTQSLKYATHFKRNAQTGCAMVNLPTAGTDYHVPFGGRKDSSFGSREMGSYAKEFYTIVKTTYIRS

SEQ ID NO: 86103 - protein, 150 aa, Euphorbia pulcherrima
MERSQLHRQVALTREALFDQGFLDEQFHQLEELQDDANPNFVEEVATLYYKDSARIIFNIEQALEKSPLDFNKLDSLMHQFKGSSTSIGAKKVKAESTLFREYCRAGNGEGCMKTFQQLKKEYAILKKKLETYFQLLRQVGPAQAACPPK

SEQ ID NO: 86104 - protein, 387 aa, Pseudomonas syringae pv. syringae B728a
MTVLKMTDLDLQGKRVLIREDLNVPVKDGVVSSDARILASLPTIRLALEKGAAVMVCSHLGRPTEGEFSAENSLKPVADYLSKALGRDVPLVADYLDGVDVKAGEVVLFENVRFNKGEKKNADELAQQYAALCDVFVMDAFGTAHRAEGSTHGVAKFAKVAAAGPLLAAELEALGKALGAPAQPMTAIVAGSKVSTKLDVLNSLSGICNQLIVGGGIANTFLAAAGHKVGKSLYEPDLLDTARAIAAKVSVPLPTDVVVAKEFAESAAATVKLIADVADDDMILDIGPQTAAHFAELLKSSGTILWNGPVGVFEFDQFGEGTKTLAKAIAESQAFSIAGGGDTLAAIDKYGVAQQISYISTGGGAFLEFVEGKVLPAVEVLEQRAKA

SEQ ID NO: 86105 - protein, 257 aa, Glycine max
MGSAASPPRALDAATQEDLKRVSAHRAVDMVESGMTLGLGTGSTAAHALDRLGALLRTGALRAVAGVPTSLKTEAHAARVGIPMLALADAAEIHLSIDGADEVDPDLNLVKGRGGSLLREKMIEGAGARFVVIVDESKLVPRLGCTGSSVPVEVVPFGSAYTLGLIRMVFDKLPGFHARLRTVKSKAGDGQEELFLTDNGNHIVEMFFEDGIHGNLRDISDSLLRITGVVEHGMFLGMATKVIVAKKDGTVAVLSKK

SEQ ID NO: 86106 - protein, 347 aa, Pseudomonas syringae pv. syringae B728a
MPQPRPYKVALNGYGRIGRCVVRALCERGAKAGFEVVAINDLADMASLEYLTRFDSTHGRFPGEVRVEGQYLHINDHRIKVLRSATPEGIDWAALEVDLVLECSGVYNTREDGQRFLDAGAPRVLFSQPMASERDVDATVVFGINQHKLTGRELLVSAASCTTNCSVPLLRLLDQAIGLEYMTITTIHSAMNDQPVIDAYHHEDLRRTRSAFQSIIPVSTGLARGIERLLPELAGRIQAKAVRVPTVNVSCLDITLQMSRDTDAVEINRILREAATSGPLKGLLAYTELPHASCDFNHDPHSAIVDASQTRVSGPRLVNLLAWFDNEWGFANRMLDVADHFLRVADQ

SEQ ID NO: 86107 - protein, 283 aa, Aspergillus nidulans FGSC A4
MAEPRARAARHKGQMNFPSECWFFLSSLRLLLLAYGDPAPHPSFPSEPLPETVRVLDEIVTDFVLEMCHGAAQHANYSRRQKIKVDDFRFALRRDPNKLGRVQELLRMERELKEARKQFDQNDDQVGNLKDAAGKRGLDDIGDGGDGKKSKGKGKKGARRDSDATEDTSMAKKRKHPALGCAVAHHGLPCLADYAGHHLALRYQTRRQGKVWLIQVTLNISRLNLGSQGKSIEQELAQCCRGGSLLIDDRLDVSRNPVNHTKNLLDRTLQGLNIGEEGGGTLL

SEQ ID NO: 86108 - protein, 385 aa, Pasteurella multocida subsp. multocida str. Pm70
MSEPAILVLADGSVFHGTSIGAKGHTVGEVVFNTAMTGYQEILTDPSYFRQIVTLTYPHIGNTGTNLEDCEANHVYASGLIIRDLPLLHSNFRSSMSLRDYLQTHNVVAIADIDTRRLTRILRDKGAQAGCIMTGEIDEAKALELAKSFGSMAGKDLAQEVSTGEIFTWTSGQWQLGKGFIEQTQAEFNVVAYDFGVKHNILRMLAERGCKITVVPAKTSAEQVLALNPDGIFLSNGPGDPEPCDYAISAIQTLLASKKPIFGICLGHQLLGLAAGGKTKKMAFGHHGANHPVQDLNTQKVFITSQNHGFEVDEASLPSHVRVTHRSLFDNSVQGIELSDQSAFSFQGHPEASPGPNDVAYLFDKFINEMRKANLSQLSTYVAHH

SEQ ID NO: 86109 - protein, 176 aa, Agrobacterium tumefaciens str. C58
MPLYRLADRVPQTPAPDRYWIAPDANVIGSVTLGEDVGIWFGATLRGDNEPISVGRGTNIQEGVMVHSDPGFAAVIGDMCTIGHHAIVHGCSIGDNSLIGMGATILNGAKIGHNCLVGANALVTEGKEFPDNSLIVGSPARAIRTLDEDTVAGIRRSAEKYIENWKRFSTDLAIIE

SEQ ID NO: 86110 - protein, 289 aa, Pasteurella multocida subsp. multocida str. Pm70
MLTPYAYHLVNVFAETYFGGNPLAVFPQADGLTDQQMQLIARQFNLSETVFVHQTTESSAVRKLRIFTPDYELPFAGHPTIGAAFVLHQQLNLPETYLLQTQAGLVKLFHEAKQICFGLQNHIDVEVIDDNLPQYTQLLGLSESDIAQIAWINTGSRQLLIQLTSLNALKTCQIHPALFQQIVKQSALYLWFVEQNQANVRLFFGSNGAVVEDPGTGSAAANLGGLCLKNGLTPLNWRIYQGDEIQRPNRLTLQVDESETIYVGGKVIAVGCGELFVPSGEGEPSQGCR

SEQ ID NO: 86111 - protein, 251 aa, Otatea acuminata
GARGIGEAIVRLFVRHGARVVIADIDDATGEALVAALGPHVSFVRCDVSVEEDVDRAVQRAVARHGRLDVLCNNAGVLGRQTSAAKSILSFDAGEFDRVLRVNTLGAALGMKHAARAMMTRRAGSIVSVASVAGVLGGLGPHAYTASKHAIVGLTKNAACELGAHGIRVNCVSPFGVATPMLINAWRQGHDADADADADIDLDIAVPSNEEVDKMEEVVRGLATLKGPTLRPRDIAEAVLFLASDDSRYVS

SEQ ID NO: 86112 - protein, 798 aa, Oryza sativa
  misc_feature (149)..(149): Xaa can be any naturally occurring amino acid
  misc_feature (192)..(192): Xaa can be any naturally occurring amino acid
MPRKVVSGPDYDDEYNDDYDEYDEDYDDYGGTGHSDDIQHPTKEKESSKKSSSMVPVLWRCSMCMFDNHESMVYCEMCGVFRESFMKSAKDGSIKVHGIPSDFGTPSMPKSDSTKMPVNTRTTDFGGDPEIKNASISHEKVGSTQYASXGSSSGAGKKVKHIALPEDVPVERTAQLISDHFQLKEDQSSRAXSSAQNEDVAQKLSSDIQKLGLEKNEVDTAKPYLPEEYKPEKWMFANEESGVLSQLNLAIVGHVDSGKSTLSGRLLHLLGRISKKDMHKNEKEAKEKGKGSFAYAWAMDESSEERERGVTMTVAVAYLETNKYRVVLLDSPGHKDFVPNMISGATQADAAILVVDACTGSFEAGMDGEGGKSVGQTKEHAQLIRSFGVEQLIVAVNKMDAIGYSKERFEFIKVQLGSFLRACNFKDSSVTWIPLSAVENQNLIKIPSDVRLTSWYQGFCLLDAIDSLQLPSRDVSKPLILPICDVIKSQSTGQLAAFGKLETGAIRIGSKVLISPCGEVATVKSIERDSNSCDIARAGDNVAVSLQGIDGSKLIAGGILCNPGFPVPVSNFLELRVLVLDVTIPILIGYQVEFHIHHVKEAARVTKIVALLDKAGKPSKTAPRFLKSKQNAVVQVTLDAPVCVEEFSKCRALGRAFLRSGGSTIAVGVVTRPCFGAHIVADSKRDIKDPEHPYSLEELNVVTEDSVEINDELSHVRVTFTPTVERCSMATVIGLCLRVKLMRSLPPRYKVDIRVAPGSHATETAVNKQLNDKERVAAALENPNLLDIVEECLSPTFA

SEQ ID NO: 86113 - protein, 285 aa, Vibrio vulnificus
AQERADIEVVGINDLIDVDYMAYMLKYDSTHGRFNGTVEVEGGNLIVNGKTVRVTAERNPEDLKWDAIGVDVVAEATGLFLDDATARKHITAGAKKVVLTGPSKDATPMFVMGVNHTSYAGQDIVSNASCTTNCLAPIAKVLNDKFGIESGLMTTVHATTATQKTVDGPSAKDWRGGRGASQNIIPSSTGAAKAVGVVLPELNGKLTGMAFRVPTANVSVVDLTVNLKNGASYEAICAAMKEASEGELKGVLGYTEDAVVSQDFIGEVQTSVFDAKAGIALTDNF

SEQ ID NO: 86114 - protein, 250 aa, Eragrostis tef
GARGIGEAIVRLFVKHGARVVIADIDDAAGDALAAALGPQVSRVRCDVSAEADMRRAVEWAVARHGRLDVFCNNAGVLGRQTRAAKSILSFDAGEFDRVLRVNALGAALGIKHAALAMAPRRTGSIVSVASVAGVLGGLGPHAYTASKHAIVRLTKNAACELGAHGIRVNCVSPFGVATPMLINAWRQGHDDVDDGGDADIDITVPSDEEVEKMEEVVRGFATLKGTTLRPRDVAEAVLFLASDESRYIS

SEQ ID NO: 86115 - protein, 580 aa, Lactobacillus acidophilus NCFM
MNKHPEYLLNKVSGPKDLKKLTIPEMEELATEIRTLILEKDAAKGGHLGPDLGIVEASIAYHYVFNAPKDKIVWDVSHQTYPHKMLTGRALAWLDPEHYEDVTPYTNPDESPYDYYAVGHTSTSIALATGMAKARDLMGEHENIMALIGDGSMTGGLAYEGLNNAAIEPHNLVVVVNDNQMSIDDNVGGLVTALKKLRDSNGETKENPFTAMGFDYRYIADGNDIKSMIEAFKAVKDVDHPILLHINTLKGKGYQPAIDNEEAHHWVMPFDLKTDKSTVPAPKSPSATSVAMDVMKEHIENGEKIMAINAAIPGVFGLDEIKDKYPENYHDVGIAEQESVAFAAGMAKEGAIPVLFENSTFLQRAFDQLSHDVAANDLPVVMMVAGGGISGTSKIHLGVFDQVMISNLPNWIYLAPTTLAEEKDMMEWAIKQRKHPVAIKMPTKKVPVGEEVKRNYSEIKYDIKPGKDIAVLALGDMYDMLGKEVTEKLGASLVNPISANILDKEALDKLADENKIIITLEDNLLDGGFGEKVASYLGNKDVKVLNYGQKRVYTDQIPLNDILKDNRMTVDQIVEDVKNA

SEQ ID NO: 86116 - protein, 281 aa, Vibrio wodanis
SVERNDIEVVGINDLIDVEYMAYMLKYDSTHGRFNGTVEVVDGNLVVNGNTVRVTAERNPEDLKWDAINVDVVAEATGLFLTDETARKHITAGAKKVVLTGPSGDVPMFVMGVNAADYAGQDIVSNASCTTNCLAPIAKVLNDKWGIESGLMTTVHATTATQKTVDGPSAKDWRGGRGASQNIIPSSTGAAKAVGKVIPELNGLLTGMAFRVPTANVSVVDLTVNLKTAATYEEICAEMKRASENEYAGVLGYTDEAVVSQDFIGETQTSVFDAAAGVALT

SEQ ID NO: 86117 - protein, 276 aa, Mycobacterium sp. KMS
MGAPLVALNDGNSIPQVGLGVWQTPPEDTERAVAAALAAGYRHVDTAAAYGNEEQTGRAIAQSGLDRSQVYLVTKLWNSEQGYDATLAAFEASVDRLGVDYLDLYLIHWPVPEKNLFVDTFKAFARLREDGRIRSIGVSNFEPEHLRVLIDSTGIVPAVNQIELHPLLPQRELRELHAQLGIATEAWSPLGQGSLLAHPTVTGVAESHGKTAAQALIRWHMQLGNIVIPKSVNPQRIESNFDVFDFELSEQDMASISSLEDGSRLGPDPKTFNFTG

SEQ ID NO: 86118 - protein, 499 aa, Caedibacter caryophilus
MENSQKSSFTAELRRVFWPIEWHENKKFLPMAAMMFCILFNYSTLRSIKDGFVVTGIGPEAISFLKTYVVLPSAVIMMVVYAKLCNIMSPQKVFYTIAWFFSLYLVFFAFVLYPYPEFFHPNHQTIEGLVIEYPNLKWFIRICGQWSIASFYAISELYGSMMLSLLFWQFANQITKTSEAKRFYSMFGLLGNFSLPLVAATLGYLLSSEINIVAEEHRFIPVICIVIFSNILGMFFYFWMNKNVLTDPRLYDSGEAAGKPKKKKTKLSLGESFKMIFTSKYLGLLVTLILAYGISINLVEGVWKAKLRELYPTKEAYTMFMGNFQAYQGVAAIIFMLVGSNILRRVSWATAAIFTPLMILVTGIGFFSFIIFDQTIGLYFAAFFGTGPLALAVIIGTAQNVLSKATKYSLFDSTKEMAHIPLDDEMKTKGKAAVDVIGGRFGKSGGGIIQSTFFILLPTYTFAEATPYFAGVFFVIVILWIFAVQGLSKEYQKLTTGEK

SEQ ID NO: 86119 - protein, 246 aa, Spartina pectinata
GARGIGEAIVRLFVKHGARVVIADVDAAVGDALASALGPAHVSCVRCDVSVEDDVRRAVEWAVARHGRLDVLCNNAGMLGRQTRAAKSILSFDAAEFDRVLRVNALGAALGMKHAALAMAPRRSGSIVSVASVAGVLGGLGPHAYTASKHAVVGLTKNAACELGAHGVRVNCVSPFGVATPMLINAWRQGHTDDADVDIDVPSDQEVEKIEEVVRGFATLRGATLRPRDIAEAVLFLASDESRYIS

SEQ ID NO: 86120 - protein, 238 aa, Glycine max
MSAAVSATKDVPFNAHLEEDIKNKEINKVVNVGEADQIPYNDDAEGTDSEAEEDPKLGLDLGPQCSLKEQLEKDKEDESLRKWKEQLLGGIDVSAVGENKEPEVKIVSLTIICPGRPDLILPIPFTSDAKKSIFTLKEGSQYQLKFSFTVSNNIVSGLKYTNVVWKTGLRVDNTKKMLGTYSPSQELYTYELEEETTPSGLFARGTYSARTKFVDDDRKCYLDTSYHFEIQKNWPTPI

SEQ ID NO: 86121 - protein, 292 aa, Vibrio xuii
GRFVFRAAQERNDIEVVGINDLIDVDYMAYMLKYDSTHGRFNGTVEVEGGNLIVNGKTVRVTAERNPEDLKWDEIGVDVVAEATGLFLTDETARKHITAGAKKVVLTGPSKDATPMFVNGVNFDTYAGQDIVSNASCTTNCLAPIAKVLNDKFGIESGLMTTVHATTATQKTVDGPSAKDWRGGRGASQNIIPSSTGAAKAVGVVLPEVNGKLTGMAFRVPTANVSVVDLTVNLVNGASYEDICKAMKEASEGELKGVLGYTEDAVVSQDFIGEVCTSVFDAKAGIALTDKF

SEQ ID NO: 86122 - protein, 390 aa, Alkaliphilus metalliredigens QYMF
MDLSLLSKRMFNLGSESAFEVLEKAKKLEAEGKNIIHFEIGEPDFDTPRNIIEAGKTALDEGYTHYTAAQGYLPLREAVTQYALEYKNIKTNPEEVVIVPGGKPIMFYTMTALINPGDEVIYPSPGFPIYESLIRFYGGIPVPLAIREENDFRLDVEELKSKLTTKTKLLLINSPANPTGGVLSEEDIDEIANVLIGKNIFVLSDEIYDRMIYDGSTKSIASIPEMKEWTIVLDGFSKTYAMTGWRLGYGIMNKTLAQKVTDLMINTNSCTAAFAQVAGIEALTGPQHAVDEMKSEFFNRREIIVDGLNGIKGFKCIKSPGAFYAFPNIKDTGMRSSELSDYLMNHAGVAVLSGSSFGAFGEGYLRFSYATSTENIKIALKRIDEAMKKL

SEQ ID NO: 86123 - protein, 250 aa, Ixophorus unisetus
GARGIGEAIVKLFVKHGARVVIADIDDAAGVALASALGPQVSFVRCDVSVEEDVKRAVDWALSRHGGRLDIYCNNAGVLGRQTRAAKSILFFDAGEFDRVLRVNALGAALGMKHAALAMAPRRAGSIVSVASVAGVLGGLGPHAYTASKHAIVGLTKNTACELGAHGIRVNCVSPFGVATPMLINAWRQGHDDAGDTDLDIDITVPSDEEVEKMEEVVRGFATLKGPTLRPRDIAEAVLFLASDESRYIS

SEQ ID NO: 86124 - protein, 297 aa, Zymomonas mobilis subsp. mobilis ZM4
MSESLAAYAGRILGHVSIDEGTPRWIGKLVAYDGLMLEATGFPMPIGHGALIMDANGQSSRAEVVGFRGNTTLLMALDADAPHNPGARVEPDRQLSIVHVGDGLLGRVIGALGEPLDNLGPIITDEYWPLVGKMGNPLNRGRVTQPFDMGVRAINALLTAGVGQRIAIMAGSGVGKSVLMGQMIAGAKADVIVTGLIGERSREVTDFVETKISDDVRPKSVVVAVPADHPPVLRLRAAMRATAIAEYFRAKGKNVLLLIDSLTRIAHAQREVGLSLGEPPTIKGYPPSALGLIPSFG

SEQ ID NO: 86125 - protein, 286 aa, Salinivibrio costicola subsp. costicola
RASVERNDIDVVAINDLIDVEYMAYMLKYDSTHGRFNGTVEVEGGNLIVNGKTVRVTAERNPTDLKWDEVGVDVVAEATGIFLTDETARQHIQAGAKKVVLTGPSKDATPMFVMGVNHSDYAGQDIVSNASCTTNCLAPVAKVLNDKFGIVSGLMTTVHATTATQKTVDGPSAKDWRGGRGASQNIIPSSTGAAKAVGKVLPELNGKLTGMAFRVPTANVSVVDLTVNLEKAASYDQICAAMKEASEGELKGVLGYTEDAVVSQDFIGEVQTSVFDAKAGIALTDN

SEQ ID NO: 86126 - protein, 278 aa, Clostridium thermocellum ATCC 27405
MVKIGFLGPKGTFSQEAMLAYTKGSNDFVGVDYNTMVELIMAVENDEIDEAVVPIENSLEGAVSTTMDMLAWDVDLKIKAEVVIEIKQNLMAKKGTDIKDIKYILSHPQPVGQCRKFLNSVFPHAVVKYVYSTAQAAKEVAQGDGNMASIGSLAAAKEYGLEVLKESIQDNDKNFTRFVVISKKEAKKAEKNKTSIVFSTENKPGSLYRILDIFNLWDINMTRIESRPAKNELGKYIFFVDINGHIEDEDVRDALTMVRRKTSFYKFLGSYPEFEIGC

SEQ ID NO: 86127 - protein, 190 aa, Hyphomonas neptunium ATCC 15444
MILVIDNYDSFTWNLVHYLEELGAKTHVVRNDQLTVDEALALKPDALLLSPGPCTPNEAGICLDLLKAAPDDLPVLGVCLGHQAIGQAFGGAVIHAREIRHGKISEIETNQSGLFEGLPERYQVVRYHSLAIRTDDLPDCLLADAHTDDGEIMAVHHKTRPVYGVQFHPESILTEHGHALLKNFLKKVKP

SEQ ID NO: 86128 - protein, 387 aa, Streptococcus thermophilus CNRZ1066
MNILTVSPLAEKKIKQGKQLLLAEDFPNIAENNQLVYLYSQSKEFLGTGYLSSQNKGIGWFLSPKKQQLTVTYFQGLFEKAKARRQSYYANDLTTAFRLFNQDGDDFGGLTIDLYGDYALFSWYNVFIYSLKDIIVEAFQTVFPEVLGGYEKIRFKGLDFESDHLYGQEAADTFTILENGVTYEVFLNDGLMTGIFLDQHEVRDGLVNGLALGKSVLNMFSYTAAFSVAAAMGGAVETTSVDLAKRSRELSTAHFEANGFSMENHRLVVMDVFDYFKYAKKKGLFYDLIVIDPPSFARNKKRTFSANKDYHKLIAQSLDILSEYGTIIASTNAANMTVQQFKKQLRKGLGDVSADFVNLQQLPVDFAVNPNDPTSNYLKVYTIKVNK

SEQ ID NO: 86129 - protein, 286 aa, Grimontia hollisae
FRASVERDDIDVVAINDLIDVDYMAYMLKYDSTHGRFNGTVEVEGGNLIVNGKTVRVTAERNPANLKWDEVGVDVVAEATGIFLTDETARQHITAGAKKVVLTGPSKDATPMFVMGVNHNSYAGQDIVSNASCTTNCLAPIAKVLNDKFGIESGLMTTVHATTATQKTVDGPSAKDWRGGRGASQNIIPSSTGAAKAVGVVLPELNGKLTGMAFRVPTANVSVVDLTVNLKEGASYEAICAAMKEASEGELKGVLGYTEDDVVSQDFIGEVNTSVFDAKAGIALTD

SEQ ID NO: 86130 - protein, 665 aa, Vitis vinifera
MSVERLFEGKEVPSWREQLTVRAFVVRFVLSVLFTFIVMKLNLTTGIIPSLNVSAGLLGFFFVSVWTKFLDKSGLLKQPFTRQENTVIQTCVVASSGIAFSGGFGSYLFGMSQAIAKQSENAGGNEEYKNPAVAWMIGFLFVVSFLGLFSVVPLRKIMIVDFKLTYPSGTATAHLINSFHTPQGAKLAKKQVRVLGKYFSFSFLWGFFQWFFAAGDDCGFAGFPTFGLKAYKYKFFFDFSATYVGVGMICPHIVNISLLVGGILSWGLMWPLIETRKGDWYPADLPSSNIRGLQGYKIFIAIATILGDGLYNFFKVLGQTLLGLFYQLQYKNMSGVPPIEDRSSPRSSSTCYNDTRRTQVFLKDQIPTSFAIGGYIAIAAISMATLPHIFPQLKWYYILVIYLVAPTMAFCNAYGCGLTDWSLASTYGKLAIFSIGAWAGAAHGGVIAGLAACGVMMNIASTASDLMQDFKTGYLTLASPRSMFVSQFIGTAMGCVISPCVFWLFYKAFDDLGQSGSEYPAPYALVFRNMAVLGVEGISNLPKNCFTLCCVFFGAAILVNLVRDTVGRKRAQFIPIPMAMAIPFYLGPYFAIDMCVGSLILFIWQRINKAKAEAFGPAVASGLICGDGLWTLPSSILALAGIKQPICMKFLSRATNARVDKFLGA

SEQ ID NO: 86131 - protein, 332 aa, Streptococcus thermophilus
MAILVLGGAGYIGSHMVDRLVEKGQEKVVVVDSLVTGHRAAVHPDAIFYQGDLSDQDFMRKVFKENPDVDAVIHFAAYSLVGESMEKPLKYFDNNTAGMVKLLEVMNECGVKYIVFSSTAATYGIPEEIPILETTPQNPINPYGESKLMMETIMKWSDQAYGIKYVPLRYFNVAGANLMVRLVRTRSETHLLPIILQVAQGVREKIMIFGDDYNTPDGTNVRDYVHPFDLADAHLLAVEYLRKGNESTAFNLGSSTGFSNLQILEAARKVTGKEIPAEKADRRPGDPDILIASSEKARTVLGWKPQFDNIEKIIASAWAWHSSHPKGYDDRG

SEQ ID NO: 86132 - protein, 375 aa, Methanosarcina mazei Go1
MTQYKVPVLPGDGIGPEIIAEGRKVIDAAGERFGFDVEWIEYPHGADHYLETGELISEETLKELSGYPAIYLGSIGDPRIAPGVLEKGILLTARFYFDQYINLRPIKLLEGVWTPIKDKTSKDIDFVVVRENTEDFYIGIGGRAKKGASKDLLEVKRTLYSAKFGLDIETDSEEIGYQIGLISKEGTKRVIEYAFDLAENRKKHVSSVDKANVLSDIYGFWREEFNAVAEKHPGFTTDFNFVDAITMWFVKNPEWFDVVVTPNMFGDIITDLGAMIQGGLGLAPGGNINPNGTSMFEPIHGSAPKYKGQNKVNPIATIWAGAMLIEQLGEKEAADTIVNAIQKNILDGKVKTYDMGGKNTTSDVGDDIARIIKGE

SEQ ID NO: 86133 - protein, 496 aa, Triticum aestivum
MAGTGVFADVLDGEVYKYYADGEWRASASGKTVAIVNPTTRQTQYRVQACTQEEVNKVMDAAKVAQKSWARTPLWKRAELLHKAAAILKEHKTPIAESLVKEIAKPAKDAVSEVVRSGDLVSYTAEEGVRILGEGKLLVSDSFPGNERNKYCLSSKVPLGVVLAIPPFNYPVNLAVSKIGPALIAGNSLVLKPPTQGAVAALHMVHCFHLAGFPKGLISCVTGKGSEIGDFLTMHPGVNCISFTGGDTGIAISKKAGMVPLQMELGGKDACIVLEDADLDLVAANIVKGGFSYSGQRCTAVKVVLIMEAVADTVVEKVNAKLAKLKVGPPEDDSDITPVVTESSANFIEGLVMDAKEKGATFCQEYRREGNLIWPLLLDHVRPDMRIAWEEPFGPVLPVIRINSVEEGIHHCNASNFGLQGCVFTRDINKAIMISDAMESGTVQINSAPARGPDHFPFQGLKDSGIGSQGITNSINMMTKVKSTVINLPSPSYTMG

SEQ ID NO: 86134 - protein, 441 aa, Burkholderia pseudomallei K96243
MSDKATRIELLDWRTVPMRAFHLTWIAFFVCFFAWFACAPLMPLIAREFRLSADQVANVNIAAVAATIAVRLVVGPLCDRFGPRRVYAGLLACGAIPVFAVTLSHDYLTFLLCRLGIGAIGASFVITQYHTSVMFAPNVVGTANAAAAGWGNAGAGAAQAAMPLVVAAALLLGLPDACAWRAALAVPGAAMLVMAIVYWRGTQDCPQGDFVALRARGVTIDSGKKGGFASFAAACGNYRVWMLFVTYGACFGVEVFMHNIAALYYVNHFALSLKDAGLAAGIFGLLALFARALGGWLSDRVAARRGLDVRATLLFALILGEGLGLLWFAHAGSVPVALVAMVAFGLFTHMACGATYALVPFIDRRALGGVAGIIGAGGNAGAVAAGFLMKGVGDIQQTLTLLGLFVTVSAFCALAVRFSAEHKAREAALRERALAASGFTH

SEQ ID NO: 86135 - protein, 540 aa, Zea mays
KKRHTLPPPLSYRYSTLANTNLHITAVMDKAYVAALSVAFLFLVHYLVGRAAAGGGKGRKRLPPSPLAIPFLGHLHLVKTPFHSALGRLAERHGPVFSLRMGCRRAVVVSSPECARACFTEHDMSFANRPRFESMRLVSFDGAMLSVSSYGPYWRTLRRVAAVQLLSAHRVACMSPVICAEVRAMVRRMARLAAGGAARVQLRRRLFELSLGVLMETIARTKTSRSEACAADTDVSPEASELTRISEEIMPYLGTANLWDYLPFLRWFDVFGVRNKLMAAVRWRDAFLRRLIDAERRRMDGDGDGEKKSMIAVLLSLQKSEPELYTDTMIMALCGDLFGAGTETTSVTTEWAMSLLLSHPEALKKAQAEIDAVVGNSRRLITADDVPRLGYLHCVINETLRMYPAAPLLLPHESAADCKVGGYDVPRGTLLIVNAYAIHRDPAVWEDPGSFLPERFEDGKAEGRLLMPFGMGRRKCPGETLALRTVGLVLATLLQCFDWDTVDGAEVDMTESGGLTMPRAVPLEAMCKPRAAMCDVLREL

SEQ ID NO: 86136 - protein, 227 aa, Pasteurella multocida subsp. multocida str. Pm70
MELVFIRHGFSEWNAKNLFTGWRDVNLTERGIEEAKSAGKKLLEAGFEFDIAFTSVLTRAIKTCNIVLEESNQLWIPQVKNWRLNERHYGALQGLDKKATAEQYGDEQVHIWRRSYDISPPDLDPQDPHSAHNDRRYAHLPSDVVPDAENLKITLERVLPFWEDQIAPALLAGKRVLVTAHGNSLRALAKHIEGISDADIMDLEIPTGQPLVYKLDDNLKVVEKYYL

SEQ ID NO: 86137 - protein, 341 aa, Streptococcus agalactiae NEM316
MAKIISLGEVLLRLSPPQYHTLMQANHLKCQFGGSELNVLASLAQLGHHVGLVSALPDNDLGKMARQFILSQQISPAAIIKKEGRLGIYYYEQGFSVRTNKVIYDRNYSSFWESTLSDYDFTSIFKGVDWFHVSGITPALTKDLYEVTRFLMTKAKEGGVKVSIDLNFRESLWSSFQEAREQLSPLLGLLDVCFGLEPIYLAGESEDLKDELGLSRPYLDIELLEKITQKIVQEYGLDYIAFTQREMEYTNQYMLKSYLYHNNMLYQTDKTGVEVLDRVGTGDAFAAGLIHALLEKETPQRALEIAMATFKYKHTIQGDINIMTRDDIAYLIEKETNDIKR

SEQ ID NO: 86138 - protein, 182 aa, Glycine max
  misc_feature (167)..(167): Xaa can be any naturally occurring amino acid
MESAALSRIGLAGLAVMGQNLALNIAEKGFPISVYNRTASKVDETVDRARNEGSLPLTGQYTPRDFVLSLQRPRSVIILVKAGAPVDQTIAALSDHLDPGDCIIDGGNEWYENTERRMSLVADKGLLYLGMGVSGGEDGARHGPSLMPGGSHQAYSNVQDILHKIAXQVEDGPCVTYIGEGG

SEQ ID NO: 86139 - protein, 412 aa, Nocardia farcinica IFM 10152
MDLTAAAAPESSVSPIVSLFWIAAVAVAAPLISRLLRGYVPDVVLLLIFGIIVGPHALGWADSGGGVSLLSELGLGMLFLLAGYELDPALLRGRPGKQAWVVWLCCLALAFAAVTLFAGHASTTARIAVAIAMTSTALGTLLPIMKQDGLLGLPLGRAVLTHGAVGELGPIVAMSVLLTSRSVGSAVVVLVLFVIAAGLIGLVQQRVLDRVPGATQLLRRLGGGTVQLPVRVVFLLLLVLMTVAEVFELDVVLGAFAAGLILRRLIPDGVAEVGRAWETIGFGVFVPVFFVVSGMGIDIGAVLGEPLLWLSFVVSIALARGLPVWLGERFVPHGENLVSGRARVQLALYAATGLPIIVAVTQVATATGLLPVAIASTMVAAGATTVLLFPLLARLLRPRTAPETARSHPAHE

SEQ ID NO: 86140 - protein, 205 aa, Pasteurella multocida subsp. multocida str. Pm70
MSDIKLNYHKTHFLTSAPDIRALPEDSGIEIAFAGRSNAGKSTALNALTNQKSLARTSKTPGRTQLINLFEVEPQCRLVDLPGYGYAAVPEQMKIQWQKALGEYLQKRQCLAGVVILMDIRHPLKDLDQQMIEWAVASELPVLLLLTKADKLSQSARSKQVKMVREAILPFQGDVQVEAFSALNKTGIDRLAAKLDSWFAPVLSE

SEQ ID NO: 86141 - protein, 303 aa, Nocardia farcinica IFM 10152
MTAIHSLTALDKAHVLADALPWLQKFRDKIVVVKYGGNAMIDEELKRAFAADMAFLRTVGVHPVVVHGGGPQISAMLKKLGLHGEFRGGFRVTTPEVMDVVRMVLFGQVGRELVGLINAHGPYAVGISGEDAGLFTATRRTVVVDGEPTDIGLVGDVTEVNPDAVLDLIGAGRIPVVSTIAPDADGVVHNINADTAAAALAEGIGAEKLVVLTDVEGLYTNWPDRSSLTSSIDAGALAELLPRLDAGMVPKMEACLRAVRGGVPTAHVIDGRVPHAVLLELFTGEGIGTMVTPSAASDGVVPA

SEQ ID NO: 86142 - protein, 408 aa, Nocardia farcinica IFM 10152
MTPVPKGDTPMSTSDLQQRWSAALMNNYGTPKVALVRGAGVVVYDADGKRYLDFLGGIAVNSLGHGHPAILAAVTQQLGTLGHVSNLYVSEPVIELAERLLAHFGDGAGKAFFCNSGTEANEAAFKIARLTGRRKIVACEEGFHGRTMGALALTGQPSKRAPFEPMPPGVVHVPYGDAAALAAAVDADTAAVFLEPIMGESGVVVPPMDYLVKAREITARHGALLVLDEVQTGIGRTGKFYAHQAAGIVPDVITLAKGLGGGLPIGAVLAQGRAADLLTPGMHGTTFGGNPVCAAAALAVLRTIDQEDLLAHVESVGKRLSDGIALLEHPLIDHVRGAGLLLGIVLTDNVSGEVEARAREAGYLVNAPKPNIVRLAPPLVLTETQADNFVVDLPAILDGAAADAKGAR

SEQ ID NO: 86143 - protein, 316 aa, Nocardia farcinica IFM 10152
MMSGELRHFLRDDDVSPTEQAEILALAAELKRAPFSRRPLEGPRGVGVIFEKNSTRTRFSFEMGIAQLGGHAVVVDGRDTQLGREETLADTGRVLSRYVDAVVWRTFEQSRLDEMASAATVPVVNALSNEFHPCQVLADLLTLTERKGDLAGRKLAYFGDGANNMAHSLLLGGVTAGLNVTIAAPAGFEPLPWVLEAARKRAADTGATVTVTGDPQAAAEGADALVTDTWTSMGQENDGLDRVGPFRPFRLDAALLAEAKPDVSVLHCLPAHRGDEITDEVLDGPHSAVWDEAENRLHAQKALLVWLLAKREGAAL

SEQ ID NO: 86144 - protein, 250 aa, Ixophorus unisetus
GARGIGEAIVKLFVKHGARVVIADIDDAAGVALASALGPQVSFVRCDVSVEEDVKRAVDWALSRHGGRLDIYCNNAGVLGRQTRAAKSILSYDAGEFDRVLRVNALGAALGMKHAALAMAPRRAGSIVSVASVAGVLGGLDPHAYTASKHAIVGLTKNTACELGAHGIRVNCVSPFGVATPMLINAWRQGRDDAGDTDLGIDITVPSDEEVEKMEEVVRGFATLKGPTLRPRDIAEAVLFLASDESRYIS

SEQ ID NO: 86145 - protein, 559 aa, Mycobacterium smegmatis str. MC2 155
MSTSEYRSLNAESDLPISADELSALATQLFAAGIRPGPDTPPQTAPVAPRGNVPGTAHPVAPPTEFVAVPSAVWSVPAHTSPVPEPVAPQTDPLVPPGVADLTAFTVPGGIVPTLPGVLAGARTAVPAAESPDYYFLRDTRAHQPVPQFPDRHEIFDVNAIRADFPILRETVNGKPLIWFDNAATTQKPQAVIDRLSHFYAHENSNIHRAAHELAARATDAYEDAREAVRRFIGAAKAEEIIFLRGTTEAINLVAHAWGGKHLGPGDEIVITHLEHHANIVPWQLLSRQTGAVLKVAPVDDAGNLLLGEFEDLLGPRTKLVAATQVSNALGTVTPVETIVELGHRYGARVLIDGAQSIPHMPIDVAALGADFFVFSGHKIYGPTGIGVLYGREDALAETPPWQGGGNMIADVTLERSLYQGPPNKFEAGTGNIADAVGLGEAIRYVERVGIERIAAYEHALLEYATPRLAAIPGVRIVGTAQEKASVLSFVLAGHEPLEVGKALNAEGIAVRAGHHCAQPILRRMGLEATVRPSFAFYNTFDEIDVFIDAVRRIAEGSV

SEQ ID NO: 86146 - protein, 250 aa, Setaria italica
GARGIGEAIVRLFVKHGARVVIADIDDAAGEALASALGPQVSFVRCDVSVRRTSSAAVDWAQSRHGGRLDVYCNNAGVLGRQTRAAKSILSFDAGEFDRVLRVNALGAALGMKHAALAMAPRRAGSIVSVASVAGVLGGLGPHAYTASKHAIVGLTKNASCELGAHGIRVNCVSPFGVATPMLINAWRQGHDDAGDADLDLDITVPNDEEVEKMEEVVRGFATLKGPTLRPRDIAEAVLFLASDESRYIS

SEQ ID NO: 86147 - protein, 530 aa, Vibrio vulnificus YJ016
MISTANITQQFGAKPLFENISVKFGEGNRYGLIGANGCGKSTFMKILSGELEPTSGNVSYDPNERVAKLNQDQFAYEEFTVIDTVIMGHKELWKVKQERDRIYSLPEMSEEDGMRVADLEVEFAEMDGYMAEAKAGELLLAVGIPMEQHYGLMSSVAPGWKLRVLLAQILFADPDIMLLDEPTNNLDMDTIRWLEETLNARNCTMIIISHDRHFLNSVCTHMADLDYGELRVYPGNYDEYMTAASQARERLLSDNAKKKAQIAELQTFVARFSANASKAKQATSRAKQIDKIKLDEVKASSRQNPFIRFEQSKELFRNALIVENLSQGFEDDLFSDFNAIFEVGERVAIIGENGVGKTTLLNTLAGVLEPRTGEFKWSENANIGYYAQDHAHEFAEDLNLMEWMGQWRQEGDDEQVVRGFLGRMLFGQDDIKKSVKVLSGGEQGRMLLGKLMMHKPNMLLMDEPTNHMDMESIESLNNALEQYKGTLFFVSHDRVFVDSLATRIIEIRDGKITDFKGTYSEYLKSRGVES

SEQ ID NO: 86148 - protein, 526 aa, Candidatus Blochmannia floridanus
MKQCTRQCILIIDFGSQYTQLLLRRIRELGIYAKVCDWNISQDLLVSLNPNGIIFSGGPDSVTNKHSSSISKVVFKIGVPILGICYGMQILVSQCGGNIRSVSNKGEFGYAQVEILSQKNTLIGNLYDYINDQGHCVLEVWMSHKDIVETMPQGFTVIGITENQQIAIIINEKCRWYGIQFHPEVTHTKKGKDILKRFAVDICRCEVTWKPVYIVKNIIKTIKKVVGQDRVVLAFSGGIDSLVTALLLKYAINHEQFVCVFVNNGLLCCNEINRISNFCKKYQDLNIIHLSEEKRFLSALTGVIDPEEKRKIIGKIFVEIFQAQISQLKNIKWLAQGTIYSDVIESGMSCASANIIKSHHNVGGFPSSVNIQLLEPIKDLFKDEVRNIGLYLGLPLNVVNQYPCPGPGMAIRILGEVREEYCNILRRVDYIFMEELNKSDLYNTVDQAFAVFLPVQSVGVQGDQRKYKWVIVLRAIETEDFMTAQWVRLPYTFLNKVSNRIVNEVEEVSRVVYDISCKPPATIEWE

SEQ ID NO: 86149 - protein, 482 aa, Xanthobacter autotrophicus Py2
MSSDVTYPDVQLHIDGVWRDADGGKRIPVINPATEEEIGSVAHCSIADLDEALAATERGFATWSRTSAFERSKLMRKAADILRERANSIARLMTLEQGKPLPEARMETLAAADVIDWFAEEARRAYGRVIPARAPGVYQLVIKEPVGPVAAFTPWNFPINQVVRKLCGALAAGCSIIVKAPEETPASPAELIRAFVDAGVPKGVIALVYGVPAEVSEYLIPHPVIRKITFTGSTPVGKKLAALAGAHMKRVTMELGGHSPVIVFDDADVQAAAKQIATAKFRNAGQVCVSPTRFLVQEKVYEQFVDTFVTVAKAVKVGNGLDEGTTMGPLANDRCIPAMEALIADARQKGAEVKTGGSRIGNKGYFFEPTVVTGVTREMRMMNEEPFGPLAMLLPFADFDEAITEANRLPYGLASYAYTSSAKTAQAVAHQVQAGMMTINHLGLALPEVPFGGVRDSGYGSEGGSEAIEAYLNPKFVSQAGV

SEQ ID NO: 86150 - protein, 193 aa, Solanum chilense
FVFAGVGSAIAYGKLTTNAALDPAGLVAIAVCHGFALFVAVSISANISGGHVNPAVTCGLTFGGHITFITGSFYMLAQLTGAAVACFLLKFVTGGCAIPTHGVGAGVSILKGLVMEIIITFGLVYTVFATAADPKKGSLGTIAPIAIGLIVGANILAAGPFSGGSMNPARSFGPAMVSGNFEGFWIYWIGPLV

SEQ ID NO: 86151 - protein, 252 aa, Sorghum bicolor
GARGIGEAIVRLFVKHGARVVIADNDDAAGEALASALGPQVSFVRCDVSVEEDVARAVEWALSRHGGRLDVYCNDAGVLGRQTRAAKSILSFDAGEFDRVLRVNALGAALGMKHAALAMAPRRAGGSIVSVASVAGVLGGLGPHAYTASKHAIVGLTKNAACELGAHGIRVNCVSPFGVATPMLINAWRQGHDDGAADADLDLDITVPSDEEVEKMEEVVRGLATLKGPTLRPRDIAEAVLFLASDESRYIS

SEQ ID NO: 86152 - protein, 480 aa, Alkaliphilus metalliredigens QYMF
MNTLGKSHFYIDRRPLITLFLIKYKNAILLLFSFVVFFIFISNDNIPQDLSIQAYQALVIFLFANFLWITNVIPLAITSLMVMGLLATFNVLPDEKIYSFFGNSALFFIIGAFIISAGISTSGLNKRIAYYFLSRFGDKPHRLTLSIFLLSAFLAHVMPAHAVAAMLFPILMSISKRLELEQSSILGKYMFFALAWGSVLGGVVTLLGGARNPLALGILEEATGESIGFLDWMIAVAPPIYLIMLIVSIYLVKKVSASTRDTEILKELFSEAGERMSKIQLKEIKALLILVGTIYMWIFQSKRFGIANVALISAALFFVLNVIDWEDAKKEINWGAIFMYGGAIALGKALEETGLLEYINQHYISNMNFSTLGLILVVFSISVFLTEGVSNAAVVVILLPVVIRTTIALGLPSTLAVYLVAVPSGLAFMFPMSSPPNAIAFSSGYIKTSDSLKIGFILNMLSIAVITVFALTYWRIIGIY

SEQ ID NO: 86153 - protein, 325 aa, Arabidopsis thaliana
  misc_feature (29)..(29): Xaa can be any naturally occurring amino acid
MAKDGPNWDGLLKWSLSHSDGTRPTCQLXSEEDRKWFAEAMQSQTVDVVKRLKEITQVLQTPQQVLEAHEVTPQDIEGLLDELQEHVESIDMANDLHSVGGLVPLLGYLKNSNANIRAKSADVVSTIVENNPRSQESVMEANGLESLLLRFTSDTDMHSRTQALGAISSLIRNNKPGITGFRIANGYSGLKDALETDSVRFQRKALNLLHYLLQENDSDSDIAIEFGLHHLMMHLVSSFDADVREAALRGLLELVKARKDCSTCGSSIVKGDERLRQILKDRIKAISRVKAMSLFMSQEDLSAAKEERQLLDSLWTTIFNEPSSL

SEQ ID NO: 86154 - protein, 248 aa, Orthoclada laxa
GSRGIGEAIVKLFVKHGARVLIADIDDAAGEALASALGPHASFVRCDVSAEEDVKRAVDCALARHGRLDVYCNNAGVLGRQTRAAKSILSFDAGEFDRVLRVNALGAALGMKHVALAMVPRRAGSIVSVASVAAVLGGLGPHAYTASKHAIVGLTKNAACELGAHGIRVNCVSPFGVATPMLINAWRQGHDDAGDADIDIDITVPSDEEVEKMEEVVGARTLKGPTLRPRDIAEAVLFLASNESRYIS

SEQ ID NO: 86155 - protein, 84 aa, Brassica napus
MASQQEKKQLDERAKKGETVVPSGTGGKSFEAQQHLAEGRSRGGNTRKEQLGSEGYQQMGRKGGHSTRDKTDEEDAEDESRTRT

SEQ ID NO: 86156 - protein, 274 aa, Xanthobacter autotrophicus Py2
MHNVTANGAEIPALGFGTFRVSAADTLRMVPAALKLGFRHIDTAQIYGNEAEVGEGIASSGVKRGDIFLTTKVWVSNYAHDAFLASVDESLKKLKTDYVDLLLLHWPNPAVPLAEQIGALNAVRAAGKVRHMGVSNFNTALMAEAIALSDGPLVTNQIEFHPYIDQSKVIRAARAAGLSLTAYYAMADGKVFADPVLKDIAAAHKRTVAQVVLRWVVQQEGFVALSKTVSEARAAENAAIFDFALTEAEMAAICALAHPDGRIVSPEGLAPVWD

SEQ ID NO: 86157 - protein, 206 aa, Synechococcus elongatus PCC 7942
MAIPLLQIDAFTQQPYRGNPAAVCLLTEPLPDTQLQAIAAEMNLSETAFLLTDQTAWQLRWFTPACEVDLCGHATLAAAQALQEWGRAQRGQTLRFHTRSGLLQAKLSDRGIELDFPLQPPQGLETSLDLAAGIGAPVVASRTSELGYWLLELASVEQVRTLQPDQAAIAQWPCQAVVVTAAAQAGDDCDFVSRFFAPRFGIPEDP

SEQ ID NO: 86158 - protein, 250 aa, Anomochloa marantoidea
GARGIGEAIVRLFVKHGAKVVIADIDDAAGEALAASLGQHVSFARCDVSEETDVALAVEGVVARYGRLDVLCNNAGVLGRQTRAAKSILSSDAGEFERVLRVNALGAALGMKHAARAMTAGRRAGSIISIASVTGVLGGLGPHAYTVSKHAIVGLTKNAACELGAHGIRVNCVSPFGVATPMLIDAWRQRGMEDAEDHIDIDIAVPNEEEVDKMEDVVCGMATLKGPTLKARDIAESVLFLASDESRYVS

SEQ ID NO: 86159 - protein, 592 aa, Saccharomyces cerevisiae YJM789
MTEDFISSVKRSNEELKERKSNFEFVEYKSKQLTSSSSHNSNSSHHDDDHQHGKRNIFQRCVDSFKPPLDGSFDTSNLKRTLKPRHLIMIAIGGSIGTGLFVGSGKAIAEGGPLGVVIGWAIAGSQIIGTIHGLGEITVRFPVVGAFANYGTRFLDPSISFVVSTIYVLQWFFVLPLEIIAAAMTVQYWNSSIDPVIWVAIFYAVIVSINLFGVRGFGEAEFAFSTIKAITVCGFIILCVVLICGGGPDHEFIGAKYWHDPGCLANGFPGVLSVLVVASYSLGGIEMTCLASGETDPKGLPSAIKQVFWRILFFFLISLTLVGFLVPYTNQNLLGGSSVDNSPFVIAIKLHHIKALPSIVNAVILISVLSVGNSCIFASSRTLCSMAHQGLIPWWFGYIDRAGRPLVGIMANSLFGLLAFLVKSGSMSEVFNWLMAIAGLATCIVWLSINLSHIRFRLAMKAQGKSLDELEFVSAVGIWGSAYSALINCLILIAQFYCSLWPIGGWTSGKERAKIFFQNYLCALIMLFIFIVHKIYYKCQTGKWWGVKALKDIDLETDRKDIDIEIVKQEIAEKKMYLDSRPWYVRQFHFWC

SEQ ID NO: 86160 - protein, 157 aa, Zea mays
LARYAIICQENGLVPIVEPEILVDGPHDIDRCAYVTETVLAACYKALNEPHVLLEGTLLKPNMVTPGSDSKKVTPEVIAEYTVRTLQRTVPAAVPAVVFLSGGQSEEEATRNLNAMNKLSRRANYPRQGLQVLSCFSLRARFGTPAYELGCGVWFAR

SEQ ID NO: 86161 - protein, 187 aa, Arabidopsis thaliana
GFASGSLDEDAASVRLFAERGMEFFVAQSYSKNLGLYAERIGAINVVCSSADAATRVKSQLKRIARPMYSNPPVHGARIVANVVGDVTMFSEWKAEMEMMAGRIKTVRQELYDSLVSKDKSGKDWSFILKQIGMFSFTGLNKAQSDNMTDKWHVYMTKDGRISLAGLSLAKCEYLADAIIDSYHNVS

SEQ ID NO: 86162 - protein, 218 aa, Brassica napus
MQHEKEPKILLTTSRDPSAPLTRFVKELNIVFPNASKLNRGSQVISEIIETARSHDFTDVIFVSENRGKPDGLIISHLPFGPTAYFQLLNVVTRHEIQTKKEMGKMSEQYPHLIFERFTTQMGKRVMNILKHIFPVPKLDAKRIVTFSNESDYISFRNHVYDKGEGGPKSIELKEIGPRFELRLYQVKLGTLEQDEAEVEWVLRPYMNTAKKRKFLGE

SEQ ID NO: 86163 - protein, 324 aa, Gibberella zeae PH-1
MVNVPNIKLNSGFDMPQIGFGLWKVDDNCAEVVYNAIKAGYRLLDGACDYGNEKACGEGVARAIKEGIVKREDLFIVSKLWQTYHDKKNVEPITRRQLADWQIDYFDLFLIHFPVALEYVDPEVRYPPGWHYDDAGTEIRWSKATNQETWEGMEDLVEKGLAKSIGISNFQAQGIYDMLKYAKIRPATLQVELHPYHQQSELVSLAKAEGIALTAYSSFGPTGFIELDMDIAKSASPLMQHEVFTTLASKYNKTSAQVLLRWATQQGLAVIPKSTTPQYMAQNFDCFEWSIDEEDMKRISKMNLNLKFNKPTNYFPTEKLWIFG

SEQ ID NO: 86164 - protein, 355 aa, Oryza sativa Japonica Group
METTGGGGSPKEAVVPSAASGDTTLGRHLAHRLVQVGVSNVFAMPGDLNLTLLDHLIAEPGLHIVGCCNELNAGYAADGYAWARGVGACTVTFTVRGQLLHGRRRRSHRFWNQVTGDEAGAAFRNQECAGAAPSLPSAVARRSGSVVVDGGSASPSSPPSPSSETTASWDRHAVCSEPVALTNLNFKQEGNNVESAAAGCPEEPGHGCLVTVTTTRGRRATTSAATAADARGRALLASWRRGRRVMSARPPLLVGLWLVSSPYGDVDLLVETPTPAGPWHAARGEVKLSIAFAAAAPSLVSKYAPPRCHPSRMWGHLAIANRPSSRPCVRVRREVATTGTTGMEARVAPHTLSAA

SEQ ID NO: 86165 - protein, 163 aa, Dunaliella tertiolecta
ASAQQPLNQQAPPPPTSFASQLQHTLGQQQFCDPTLIDRGLQHADKRRRDWIDVDALNEDDTQACSAYAVPIFEHLREAELVRRPNALYPEAFQTDVNAKMRAILVDWLVEVAEEYKLCADTLYLSVNYIDRFLSIHPVQRSNLQLVGIACMWIASKYEEIYP

SEQ ID NO: 86166 - protein, 309 aa, Salmonella enterica subsp. arizonae serovar 62:z4,z23:--
MSKKIAVIGECMIELSQKGADVQRGFGGDTLNTSVYIARQVDSAALTVHYVTALGTDSFSQQMLDSWQGENVDISLTQRMENRLPGLYYIETDDTGERNFYYWRNEAAAKFWLESEQTAAICKALASFDYLYLSGISLAILSPASRDKLLSLLRECRANGGKVIFDNNYRPRLWTSREETQQVYQKMLECTDIAFLTLDDEDALWGKKPVEEVIARTHTAGVHEVVVKRGADSCLVSTQGEALVDVPAVKLPKEKVIDTTAAGDSFSAGYLAVRLTGGSAADAAKRGHLTASTVIQFRGAIIPHDAMPQ

SEQ ID NO: 86167 - protein, 198 aa, Glycine max
  misc_feature (136)..(136): Xaa can be any naturally occurring amino acid
  misc_feature (162)..(162): Xaa can be any naturally occurring amino acid
  misc_feature (182)..(182): Xaa can be any naturally occurring amino acid
  misc_feature (190)..(190): Xaa can be any naturally occurring amino acid
DRICFTHHPSSVICSSKYNLESTGESLQYLSMYDNRCLRYFKGHKQRVVSLCMSPINDSFMSGSLDHSVRIWDLRVNACQLSSRFKNGILRLRGRPAIAYDQQGLVFAVAMEGGAIKLFDSRSYDKGPFDTFLVGXGTPAEVCDIKFSNDGKSMLLTTTNNXIYVLDAYGGEPACGFSLEPXLVPHRGYXTQDGKYWW

SEQ ID NO: 86168 - protein, 419 aa, Pseudomonas syringae pv. syringae B728a
MLELAAGFICLTALLTYVNYRFIGLPPTIGVMVTALMFSLLLQGLSFLGYPGLEDRVQQLIGQIDFGDLLMNWMLSFLLFAGALHVNLGDLRSYRWPIGLLATFGVLIATTVIGALAYWIFALFGWHVSPLYCLLFGALISPTDPIAVLGVLRTANASKPLKTTIVGESLFNDGTAVVVFTVLLGIAQLGETPTVGETALLFVHEAVGGVLFGGLIGYAVYLMIKSIEQYQIEVMLTLALVIGGSAMASELHVSGPIAMVVAGLIIGNLGRNLAMNDMTRRYMDGFWELLDDMLNALLFALIGMELLLLPFSWQHLIAASLLAAAILLSRFVTVAPAILLLRRWRKVPHGTIRILTWGGLRGGVSVALALALPTGPERDLLLSITYIVVLLSILLQGLTIGKLVNAVTRAPQAKDPAEH

SEQ ID NO: 86169 - protein, 488 aa, Streptococcus agalactiae NEM316
MTNELIMQAFEWYLPSDGNHWKKLEDSISDLKKLGVSKIWLPPAFKGTSSDDVGYGVYDLFDLGEFDQNGTIRTKYGRKEEYLKLIKSLKANGIKPFADIVLNHKANGDHKEKFQVIKVNPENRQEALSEPYEIEGWTGFDFPGRQGEYNDFKWHWYHFTGLDYDAKNNETDIFMIVGDNKGWADDDLIDDENGNFDYLMYNDIDFKHPEVIKNLQDWAKWFIETTGIEGFRLDAVKHIDSYFIQTFINDIRTKIKPDLEVFGEYWKSDQTSMKDYLEATQFQFSLVDVTLHMNFFDASHQNRDFDMRTIFDDSLVIDNPEYAVTFVENHDTQSGQALESRVEDWFKPLAYGLILLRQQGTPCLFYGDYYGIQGEFGQPSFKEVIDKMAELRQNYVFGKQVDYFTHSNCIGWTCLGDEEYNSCLAVVLTNGDQGWKHMEVGEIYAGKTFVDYLGNCEQEVVIGDDGWGDFLVESASISAWVPKIEEAN

SEQ ID NO: 86170 - protein, 506 aa, Neptuniibacter caesariensis
MIYAKPGTEGSVVSFKERYGNFINGQWKEPVKGQYFTNHTPVTGEAVCEIPRSTSEDIELALDAAHAAKSAWGKTSVAERSAVLLKIADRIEENLERLAVAETWDNGKAVRETLAADVPLSADHFRYFAGCIRAQEGSLGEIDETTVAYHFHEPLGVVGQIIPWNFPLLMAAWKLAPALAAGNCIVLKPAEQTPVSILVLLECIGDLLPAGVLNVVNGFGAEAGQALATSTRIAKIAFTGSTPVGSHIMKCAAENIIPSTTELGGKSPNIYFKDVMDQDDGFVSKAIEGAVLAYFNQGEVCTCPSRLLVHEDIADEFIGKVIERAGQIKRGNPLDTDTMVGAQASQEQFDKILGYMDIGREEGAEILMGGGVEQLEGEYGNGYYIKPTLIKGTNDMRVFQEEIFGPVVSVTTFKTEEEALAIANDTEFGLGAGVWSRDTNVAYRMGRGIEAGRVWMNCYHLYPAHAAFGGYKKSGVGRETHKMMLEHYQQTKNMLVSYSEQPLGFF

SEQ ID NO: 86171 - protein, 136 aa, Candidatus Blochmannia floridanus
MIQKERTLSIIKPDAVSKGIIGAIISRFESSGLLIVSAKMLQLTTDQVLEFYNEHKNKFFFKDLMEFMISGPIFVQILEGNYAIRRNREIMGNTDPMKALAGTIRFDYGESCTKNVIHGSDSESSAKYEIAYFFDI

SEQ ID NO: 86172 - protein, 250 aa, Anomochloa marantoidea
GARGIGEAIVRLFVKHGAKVVIADIDDAAGEALAASLGQHVSFVRCDVSEETDVVLAVEGVVARYGRLDVLCNNAGVLGRQTRAAKSILSFDAGEYERVLRVNALGAALGMKHAARAMTAGRRAGSIISIASVAGVLGGLGPHAYTASKHAVVGLTKNAACELGAHGVRVNCISPFGVATPMLINAWRQRGMEDAEDHIDIDIAVPNEEEVDKMEDVVRGMATLKGPTLKAGDIAESVLFLASDESRYVS

SEQ ID NO: 86173 - protein, 274 aa, Candidatus Blochmannia floridanus
MHPMLNVAIIAIRKGGNFLIKQYEFLGRNYTELSSDHIKTLLSKIRAESNQIITTIIKKFYPLHIIIDIKNYSNTSTLQNNNIYWIIESIDNDINFIKQFPFFVLSITIKHHTNIKIGVIYDPIHNELFSACRGKGAQFNGYRIRPHHHKNILQTFNKIILSIVNMNINHTFDINISNTLNNFHKKYNITIDLRCTGSLMLDLVYAAINRIDGCYIMYYHNTIKLASSFLIIQESGGLITYLDKNKKDNDQNSKHIIVGNPKIIKFILPLIKKF

SEQ ID NO: 86174 - protein, 568 aa, Mycobacterium smegmatis str. MC2 155
MTVGAYPLSPAHRAAALDRLASDEFDVLVVGGGVVGAGAALDAATRGLRVGLVEARDYASGTSSRSSKLFHGGLRYLEQFNFSLVFEALRERSLVLNTLCPHLARPVPFIYPLQTRFDRAYAGLGIGVYDVMGAGRGVPGHHEHLGRARTLESFPSGSPAIRGAIRFYEGQVDDARHTMMLVRTAAHFGAVCANSTRVTGFVRDGERVAGVGVRDLDGGREFEVRAKQVINATGVWTDETQGMAGGQGQFRVRASKGVHLVVPRSRINSSTGIITRTEKSLLFVIPWGSHWIVGTTDTDWSLDLAHPAASRADIEYLLGHVNTLLADPLTADDVVGVYAGLRPLLAGESDSTSKLSREHAVASPVPGLTVIAGGKYTTYRVMAKDAVDLAVRGLGRAVPSSCTERVPLLGADGYPAAWNARRRTAEDTGLAVTTVAHLLGRYGTLTDELLEIIAHRPDLGVPLAGAPEYLKVEAYYAASHEGARHLEDVLTRRTRISIEVADRGVAAAREVADLIAPVLGWSQTDIAREIEHYDARVAAERESQHQLDDYTADAARLGAPDVRVGVTQ

SEQ ID NO: 86175 - protein, 367 aa, Prochlorococcus marinus str. AS9601
MVLLNKIKNKLRINYRKKRWPGLIEAYKQYLPVTKKTPIISLNEGNTPLILSESISNLIGNRTKVFLKYDGLNPTGSFKDRGMTMAISKAKEEGREAVICASTGNTSAAAAAYASRGGLKPYVLIPEGFVAQGKLAQALMYGAEIISINGNFDKALEIVRDLSSEHPIELVNSVNPYRIQGQKTAAFEIVDDLGYAPDWLCIPMGNAGNITAYWMGFKEYSKIKSNLKLPIMMGFQSEGSAPLVKNIIVKDPETIATAIRIGNPVNREKAKKVRKESKGDFQSVTDEEIINAYKILAKEGVFCEPASAASVAGLIKNKNRIQKESTIVCVLTGNGLKDPDCAIKNNDAIFRKNIEPSLKNITKILGY

SEQ ID NO: 86176 - protein, 810 aa, Zea mays
MASQGEPSSSDPKGKKDYSTAILERKKSPNRLVVDEATNDDNSVVALHPDTMERLQLFRGDTVLLKGKKRKDTICIVLADETCEEPKVRMNKVVRKNLRVRLSDVVSVHQCPDVKYGKRVHILPIDDTIEGITGNLFDAFLKPYFLEAYRPLRKGDLFLVRGGMRSVEFKVIETDPAEYCIVAPDTEIFCEGEPIKREDEERLDEVGYDDVGGVRKQMAQIRELVELPLRHPQLFKSIGVKPPKGILLYGPPGSGKTLIARAVANETGAFFFLINGPEIMSKLAGESESNLRKAFEEAEKNAPSIIFIDEIDSIAPKREKTHGEVERRIVSQLLTLMDGLKSRAHVIVMGATNRPNSIDPALRRFGRFDREIDIGVPDEVGRLEVLRIHTKNMKLAEDVDLELIAKDTHGYVGADLAALCTEAALQCIREKMDIIDLEDETIDAEILNSMAVSNDHFKTALGTSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMNAKKTVFIIGATNRPDIIDPALLRPGRLDQLIYIPLPDEQSRLQIFKACLRKSPVAKDVDLNALAKYTQGFSGADITEICQRACKYAIRENIEKDIERERRRKDNPEAMEEDEVDDIAEIKAAHFEESMKYARRSVSDADIRKYQAFAQTLQQSRGFGSEFRFPDQPTAAAGSAGAADPFASAAAAADDDDLYS

SEQ ID NO: 86177 - protein, 193 aa, Solanum habrochaites
FVFAGVGSAIAYGKLTTNAALDPAGLVAIAVCHGFALFVAVSISANISGGHVNPAVTCGLTFGGHITFITGSFYMLAQLTGAAVACFLLKFVTGGCAIPTHGVGAGVSILEGLVMEIIITFGLVYTVFATAADPKKGSLGTIAPIAIGFIVGANILAAGPFSGGSMNPARSFGPAMVSGNFEGFWIYWIGPLV

SEQ ID NO: 86178 - protein, 249 aa, Pharus lappulaceus
  misc_feature (79)..(79): Xaa can be any naturally occurring amino acid
  misc_feature (114)..(114): Xaa can be any naturally occurring amino acid
GARGIGEAIVTLFVKHGAKVVILDIDDAAGEALAAALGPHASYVHCDVSAEADVERAVERAVARHGRLDVLCNNAGVLXRQTRAAKSIASFDAGEFDRVLRVNALGAALGMKHXARAMLPRGAGSIVSVASVAGVLGGLGPHAYTASKHAVVGLTKNAACELGSHGIRVNCISPLGVATPMLINAWRQSAADGPNDDVDVALAVPSEEEVEKMEEVVRGLGTLKGPTLRPRDIAEAALFLASDESRYVS

SEQ ID NO: 86179 - protein, 249 aa, Pharus lappulaceus
GARGIGEAIVTLFVKHGAKVVILDIDDAAGETLAAALGPHASYVHCDVSAEADVERAVERAVVRHGRLDVLRNNAGVLGRQTRAAKSIASFDAGEFDRVLRVNALGAALGMKHAARAMLPRGAGSIVSVASVAGVLGGLGPHAYTASKHAVVGLTKNAACELGSHGIRVNCISPFGVATPMLINAWRQSAADGPNDDVDVALAVPSEEKVEKMEEVVRGLGTLKGPTLRPRDIAEAALFLASDESRYVS

SEQ ID NO: 86180 - protein, 493 aa, Xanthobacter autotrophicus Py2
MAAAERTADHYPSFRTQALIDGVFAPAASGRTFDAVNPATGKVLAQVAACDSADVDRAVKAARAAFEDRRWAGLRPVERKRILQRFAELIRAHRDELALTETLNMGKPIADARSIDVRAAADCFAYYGECCDKVYGEVAPTTADNLALVLREPLGVVGCVTPWNFPMIMAAWKVAPALAMGNSVVLKPAEESPLTALRLGELALEAGVPAGVFNVVPGLGVEAGKALGLHMDVDAIAFTGSTEVGRYFLRYSSDSNLKRVFLELGGKTAFVVAHDVPDLDEVAQAVASGIFFNQGEMCTAASRLLVDNRIREDLVARVAALAPRWMPGDPQDPAARAGAVVSFEHQGRILSAIEEGVASGALLVTGGTAVRQETGGAFVAPTVFDGVVPSSALAQKEIFGPVLSVIGFDGLEEAVAIANGTVYGLGAAVWSGDLSAAHKVARRFKAGIVYVNCFDADDITTPFGGVKQSGFGRDKSLHALDKYCDLKTVWTRL

SEQ ID NO: 86181 - protein, 247 aa, Anomochloa marantoidea
GAGGIGEAIVRLFAAHGAKVVIADIDDAAGEVLAAAVGGEASYVHCDVAEEAEVEAAVGAAVARHGRLDVLCNNASVLGWQTRAARGIAVLDAAEFDRVLRVNALGTALGMKHAARAMVPRRAGSIVSVSSVAGVLGGLGPHAYTASKHAVVGLTKNAACELGAHGVRVNCISPFGVATPMLVNAWRHRSPTSSSDDDETAAPTESEVGKMEEVVSELGTPKGTTLRAADVAEAALFLASDESRYVS

SEQ ID NO: 86182 - protein, 182 aa, Glycine max
MGDYTIRISTSLIEQLARDDEKQMKRRTRKPKPRKVVEQPEEPQDNGRELPTEPKSSPAPVLPFPPPMYLPVTPAPPPPPPVIQEVEAIRAVVVESEKVLEKLQKKEATMREELTKRAKELHDKEFKLPYQNPSPCTDERAGCAECYRSNVQDPLKCAEAVKRFEACVRMAIRGGTTMGAAQ

SEQ ID NO: 86183 - protein, 478 aa, Xanthobacter autotrophicus Py2
MTSAPLSNSTAHWRALDAAHHLHPFSDTKALNAEGVRVITRAEGVYVFDSEGNRILDGMSGLWCSQVGHGRRAIVDAIAQQLHQLDYYNTFFKTTHPGAAELAAAISDVAPAHMNHVFFTSGGSEAVDTVLRMVRHYWAALGKPEKSIFISRRNGYHGSTLGGASLGGMKPMHAQGGLPIPGIIHVAQPYWWAEGGEMGREEFGLFAAREVARAIDEAGPENVAAFIGEPIQGAGGVIIPPANYWPEVEKICRERDVLLVCDEVICGFGRTGRWFGADFMGVKPDLITFAKGITSGYFPLGGVIVGDKVAEGFIEHGGDFNHGFTYSGHPGGCAAALANLRIMHEEKLVERVRTDIGPYLQERWLKLAEHPLVGEARMVGLIGALELTPEKASRAAFAAEEGTVGLICRDFSFREGLVMRAVRDGMILAPPFTLSHEEADELVAITWRVLDLTYAELHKRGMMVPVPRVPARPVQASA

SEQ ID NO: 86184 - protein, 250 aa, Danthonia spicata
GAQGIGAAIVRLFVRHGARVVIADIDDAAGEALAAALPGSCCSYEHCDVSVETDVERAVQRTVARHERLDVLCNNAGVLGQQTRAAKSIASLDAAEFDSVLRVNALGAALGMKHAARAMLATRGGGGSIVCVASVAGVLGGMGPHAYTASKHAVVGLTKNAACELGKHGIRVNCISPFGVATRMLVNAWSQGAGGGGGGDDDAGEPSEDEVEKMEEVVRGLATLKGATLRARDIAEAALFLASDESRYVS

SEQ ID NO: 86185 - protein, 375 aa, Zymomonas mobilis subsp. mobilis ZM4
MSELDYYSLLEVERTADDKTIKTSYRRLAMRYHPDRNPGDSDAEERFKAISEAYDCLKDPQKRAAYDRYGKDAFQGGGGFGGFGGGAQDFGGFSDIFESVFGEFMGGRGQARSSVQRGADLRYDLKISLEEAFKGKTVDIEIDVASVCDACHGSGAKAGSGRKTCDTCHGSGRIRVQQGFFVVEQSCPVCQGKGEVISDPCPECHGEGRCEKHKTLSVNIPAGVDDGTRIRLSGEGEAGVHGGPAGDLYIFIHVTPHQVFQRESYNLFAHVPISFTKAALGGSIHVPSLDGEQYEISIPAGIQSGKQLKRRGAGMPVLNGRGRGDLIIQIDVETPTRLTAKQRELLEQFRETETGEECPKSSGFFSKLKTILTGE

SEQ ID NO: 86186 - protein, 173 aa, Arabidopsis thaliana
MKSVGSAALKMVEEVRRQFNTIPGLMEGTAKPDYATCVKISTDASIKEMIPPGCLVMLTPLIVGFFFGVETLSGVLAGSLVSGVQIAISASNTGGAWDNAKKYIEAGVSEHAKSLGPKGSEPHKAAVIGDTIGDPLKDTSGPSLNILIKLMAVESLVFAPFFATHGGILFKYF

SEQ ID NO: 86187 - protein, 483 aa, Vitis vinifera
MVETKPGPLLKTQSARCMDCGTPFCHQNSGCPLGNKIPEFNELVHQNRWREALDRLLETNNFPEFTGRVCPAPCEGSCVLGIIENPVSIKSIECSIIDKAFEEGWMVPRPPPKRTGKRVAIVGSGPAGLAAADQLNRMGHFVTVFERADRIGGLMMYGVPNMKADKVDVVQRRVNLMAEEGVNFVVNASVGTDPSYSLDRLREENDAIVLAVGATKPRDLPVPGRELSGIHFAMKFLHANTKSLLDSNLEDGNYISAKGKKVVVIGGGDTGTDCIGTSIRHGCSSVVNLELLPQPPQTRAPGNPWPQWPRIFRVDYGHQEAAAKFGKDPRSYEVLTKRFIGDENGVLKGLEVIRVQWEKDASGKFQFKEVEGSQEVIEADLVLLAMGFLGPEVTVAEKLGLERDNRSNLKADYGRFATSVEGVFAAGDCRRGQSLVVWAISEGRQAASQVDKFLMREDEHLTNNWQDDNIKRQQKSIKHTVMT

SEQ ID NO: 86188 - protein, 175 aa, Triticum aestivum
MAPAVMASSATTVAPFQGLKSTAGLPVSRRSGSAGLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNMRQVQCVSFIAFRPPGCEESGKA

SEQ ID NO: 86189 - protein, 327 aa, Hyphomonas neptunium ATCC 15444
MTDIHPHLPPEWAPQAALWAGWPRLAEEWGGDLTAARSEIAGFIRKAASFVPVKIACGSREAAASARLATGGAGEIVEIPTGDIWLRDTGPVVTGTGASRQAQVFRFNGWGGKYLMEGDTETAGEVARVESLPARRHSLILEGGGIDADGEGRLLTTRQCLLNPNRNPQLSQAEIEASLTAALGVDEFIWLGDGLMNDHTDGHVDNIARFIAPGHVLCQHPADRNDPNAETLQEIERTLVSHGLMVSSIPSPGLVHFGDGVPVPASHMNFTITNRAVLVPVYEDRFSAVALSDLKALFPGREVIGLPARAILAGGGSFHCMTREIPA

SEQ ID NO: 86190 - protein, 482 aa, Zea mays
MALTRIGLAGLAVMGQNLALNIAEKGFPISVYNRTTSKVDETVQRAKAEGNLPVYGFHDPASFVKSIQKPRVVIMLVKAGAPVDQTIATLAAHLEQGDCIIDGGNEWYENTERREKAMEERGLLYLGMGVSGGEEGARNGPSLMPGGSFEAYKYVEDIVLKVAAQVPDSGPCVTYIGKGGSGNFVKMVHNGIEYGDMQLISEAYDVLKSVGKLTNSELHQVFSEWNKGELLSFLIEITADIFGIKDEHGDGYLVDKVLDKTGMKGTGKWTVQQAAELSVAAPTIEASLDSRFLSGLKDERVEASKIFQGDYYSTGSPVDKAQLVEDVRQALYASKICSYAQGMNIIKAKSAEKGWGLNLGELARIWKGGCIIRAIFLDRIKKAYDRNPGLASLLVDPEFAQEIMDRQAAWRRVVCLAINNGVSTPGMSASLAYFDSYRRDRLPANLVQAQRDYFGAHTYERVDMPGSFHTEWFKIARNISNN

SEQ ID NO: 86191 - protein, 494 aa, Colwellia psychrerythraea 34H
MTEVTCNLEAAGIKDSQLIKPFSYINGSWHSSETQFPVINPSTGEVVAQVSNADVAETELAVSAAKGALKMWSAKSANERATLLRNWFNLVMENQDDLGRILTLEQGKPLAEAKGEIAYGAAFLEWFAEEGKRVYGDTIPALSSDKKIVVIKQPVGVVASITPWNFPNAMIARKAAAALAAGCTFVVRPSESTPLSALAMAELAERAGIPAGVFNVVVGSNSRGMGQVLTQHPDVAKFTFTGSTGVGKLLLTQCATTVKKVSMELGGNAPFIVFNDADIDAAVQGAIISKYRNAGQTCVCTNRILVQQGVLEEFTEKFKNAVAELHIGDGLVEGVNLGPMISDKAVCDVEKLVADSIAAGAKVAFGGQRSEAGELFYQPTILTGVTNDMPIAANEIFGPVSPIIAFETEEEAIELANDTEYGLAAYFYSRDIGTVWRVAEGLEFGMVGINEGIISNAAAPFGGVKQSGNGREGSKYGLDDYLEIKYLCMGGLDK

SEQ ID NO: 86192 - protein, 361 aa, Brassica napus
PRVRGRVGGHESSTTAAPKAKPGRSDNKAEEFGSGVQEAEKNKLVFFEGSSYNFDLEDLLRASAEVLGKGSYGTTYKAILEEGTTVVVKRLKEVAAGKREFEQQMEAVGRISPHGNVAPLRAYYFSKDEKLLVYDYYQGGNFSMLLHGNNEGGRGALDWEQRLKICLGAAKGIARIHSSSGAKLLHGNIKSPNVLLTQDLNACVSDYGIAPLMSHHTLLPSRSLGYRAPEAIETRKHTQKSDVYSFGVLLLEMLTGKAAGKTTGHEEVVDLPKWVQSVVREEWTGEVFDVELIKQQHNVEEEMVQMLQVAMACVSKHPDSRPSMEEVVNMMEEVRPSNGSGAGSGNRASSPEMIRSSDSPG

SEQ ID NO: 86193 - protein, 185 aa, Kineococcus radiotolerans SRS30216
MSDLLVVPDAERVAATVVAGFRDVVDFPQPGVVFKDITPLLADARAFATVVEALAALARASGASAVAGIEARGFMLAAPAAERAGLGFWPVRKAGKLPAPVLRREYALEYGTAALELSAGTVGAGERVLVVDDVLATGGTARAACELLEEAGAQVVALAVLLELAPLGGRPRLGDRPVVALHTQT

SEQ ID NO: 86194 - protein, 513 aa, Physcomitrella patens subsp. patens
MRGAAVRKARLAKLVAQQYSQRQLRTSAVNHAVPRTESAQASSSGGLLSKLLGERPTTPVPALYEPLQGVHLPPALPEDVKPSETNVTTLTNGVRIASQNIAGPTSTIGIYVDSGSKNETPYCTGSSHLLERMAFKSTANRSHFRLVREVEAIGGNVVANASRELMCYTGDAIKTFMPEMVELLVDTVRNPLFNEWEVQEQLAKVKSETAEMLNNPQVAIYEAIHSAGYVGGLGQPLMAPESSLGRLNGGVLHDFVKENYTAPRIVVAASGVDHEDLLSVAEPLLADLPSFDQPIPVETHYVGGDWRQSVDFPLSHIAIAFEVPGGWRNEKDSYAVTVLQQLLGGGGSFSAGGPGKGMYSRLYTGVLNKWEQVQSFTAFSSIYNDTGLFGIHATSSGDFVPKLVDLACEQLTLVATPGKVSEAELQRAKNSTISAVLMNLESRAVVTEDIGRQILTYGHRKPVAELIQGVQALTVQDIADVSSRVITTPLTMASWGDIVRVPRFDAVARVFQV

SEQ ID NO: 86195 - protein, 352 aa, Bordetella parapertussis 12822
MFFTGPPPARQCRRAPAPAGHASRNHHAMQAIARLSRFVGNTFAIWVLLFAALAYYSPEHFKWLGQYIVPLLGLIMFGMGLTLSKDDFREVLHRPRDVLIGVLGQFIIMPSLAWLLTAVLDLPPEVAVGVILVGCCPGGTASNVMTFLARGDVALSVAITSVTTLLAPIVTPALIYLLASQWIEVSAAAMFWSIVQVVILPIVLGVLAQYLLREKVKVCVDALPLVSVAAIVAIVAAVVAGNQARIATSGLMIFAVVVLHNGLGLLIGYLLGRACGLGVAKRKTLSIEVGMQNSGLGVALATAHFSPLAAVPSAIFSVWHNISGPLAATLLRRFKDDEADAPAPATSAAAAR

SEQ ID NO: 86196 - protein, 538 aa, Hypocrea jecorina
MSQISRTQSIMATTAQEHLETGGRINWLASLNTAFTPARNFRRTSIICTIGPKTNSVEALNKLRDAGLNVARMNFSHGSYEYHQSVIDNVRASVAAHPGRPVAIALDTKGPEIRTGNTAGDVDIPISAGTVMNFTTDEKYATACDTQNMYVDYKNITKVIQPGRVIYVDDGVLAFDVLSIKDDQTVEVRARNNGFISSRKGVNLPNTDVDLPALSEKDKADLRFGVKNNVDMVFASFIRRAQDIKDIRDVLGPEGKQIQIIAKIENRQGLNNFAEILEETDGVMVARGDLGIEIPAAEVFAAQKKMIAMCNIAGKPVICATQMLESMIKNPRPTRAEISDVGNAVTDGADCVMLSGETAKGNYPAESIHEMHEASLKAENTIPYVSHFEEMCTLVKRPVSTVESCAMAAVRASLDLGAGGIIVLSTSGDSARLLSKYRPVCPIFMVTRNPTTSRFSHLYRGVYPFLYPEQKPDFDTVNWQEDVDKRIKWAVTRAIELKTLTAGDTVVVVQGWKGGMGNTNTLRIVRADPDHLGIGQME

SEQ ID NO: 86197 - protein, 227 aa, Sordaria macrospora
IAAAETPVMDELSKSATGFTELDASSLAVGLPEGLMGNSEVGHLNIGAGRVVWQDVVRIDQTIKKGELGQNDVIKSTFERARNGNGRLHLCGLISHGGVHAKQTHLYALLRAAKEAGVPKIYIHFFGDGRDTDPKSGAGYMQELLDTIKEIGIGELATVVGRYYAMDRDKRWERVEVALKGLYLGEGEESTDPVKTIKERYEKGENDEFLKPIIIGGDERRIKEDDT

SEQ ID NO: 86198 - protein, 298 aa, Physcomitrella patens subsp. patens
MGLGLKHPHSPNDPFLAKLAAAASTEMGKAQLAGARSDSDGPPLLDILTNPVMMAAPAQVERTSGYNEHRPRRPPPDLPSLLLHSRIVYIGMPLVPAVTELVIAELLYLQYADPRQPIYVYINSTGTSRADGETVGLETEGFAIYDTLMNVRNQIQTVAVGAAIGQACLLLASGDKGMRYMMPHATAMIQQPRLPSTGQMSAIDVHIRAKELINNRDTLVGLLAKHTGNPYEKVAKVMQRPFYMNPKKAVEFGVADKILWRGQEAMAETMKTEDWDKGAGIRVVERSASNGAGDSGLG

SEQ ID NO: 86199 - protein, 178 aa, Physcomitrella patens subsp. patens
MYAGLNRGIFGVQNARKVEIASLLQLLEAANPDPRPTDNLDKVKGDWKLLYSTISILGSKRTKLGLRDFINLGDFVQIIDVDQEKAVNRVTFSVAGLGMLSGSFTIEASYKIVSPTRVDIKFQNSTLVPDQLLSLFQKNYDLLLSIFNPEGWLEITYIDDSLRIGRDDKGNVFLLERM

SEQ ID NO: 86200 - protein, 486 aa, Pasteurella multocida subsp. multocida str. Pm70
MIKHWINGKEVASEETFDNFNPATGEVICQVASGGEKEINAAVQAAKDAFPKWSKTPAKERARLMRKLGELIDQNVAKLAELETLDTGLPIHQTKNVLIPRASHNFDFFAEVCTRMNGHSYPVDDKMLNYTLYQPVGVCGLVSPWNVPFMTATWKTAPCLALGNTAVLKMSELSPLTANELGRLALEAGIPEGVFNVVQGLGSTAGHALVTHDDVRAISFTGGTATGKHILKHAGLKKYSMELGGKSPVLIFDDADLDRALDAALFTIFSLNGERCTAGSRIFIQETVYDEFVKQFAARAKRLIVGDPQDFNTQVGSMITRQHYDKVTGYIRIGLEEGATLLAGGLERPQNLPAHLQKGHFIQPTVFADVDNRMRIAQEEIFGPVVCLMKFKDEAEALRLANDVEYGLASYIWTKDIAKALRLSNGIEAGMVFVNSQNVRDLRQPFGGIKASGIGREGGEYSFEVFAELKNVCISMHDHPIPRWGL

SEQ ID NO: 86201 - protein, 393 aa, Cytophaga hutchinsonii ATCC 33406
MAIPILQLKKGKERSINNRHPWIFSGAVAKLPENEEGTIVAVTDFENKKLGYGFLSHKSQIVCRMFEWDTLTEEVLTENYWAVKLKNAFALRQTVIQFGKTNVYRLLHAEGDFFPGIIADVYADVVVLQVLIRGVEKIVPAIQKALVEIGFKHIYIKAKTSSTVLEDIRTGSGWLLGGVEVPVIVKENDVLFEVDFIDGQKTGFFVDQRENRELLRSYSKGKKVLNTFCYTGGFSVYAASGGAEVVDSVDISKEAVALAGKNMELNYPGYKHGTIAADCFDFLGDIEKDYYDIIVLDPPAFAKSAKAVANACRGYKQINLKAFRKIKKGGLLFTYSCSQNIDKDLFQKIVFGAAADSYRNVRIIHQMHQPADHPINIYHPEGEYLKGLVLYVE

SEQ ID NO: 86202 - protein, 238 aa, Triticum aestivum
  misc_feature (14)..(14): Xaa can be any naturally occurring amino acid
AQIGEVVDVRLATXHEDGHPKGFGHVEFATAEDAQKALDSLNGGDLMGRPVRLDMAAERGASAPRTRDGGSFGKPSGGPSLSVFVKGFDSSQQEDAIRSSLQEHFSKCGEITRVSVPMDYENGASKGIAYMDFTDESSFSKALELSGSDLGGCNLYVAEAKPKGQFGGVGGRSGGRDGGGRFGRSGGGRFGRSGGRDGGSRFGRSGGRDGGRGGGRGFQSRQSAGTASAGKKTTFGDD

SEQ ID NO: 86203 - protein, 478 aa, Desulfococcus oleovorans Hxd3
MIIPVVLAGGSGTRLWPLSRELYPKQLMALVGDRTMLQSTLERLSGVNDMGAPIVICNGNHRFMVAEQLRLSGITPRSIMLEPVGRNTAPAIAVAALTAVADHSNPILLVLPADHFIVGIPRFHDALNAGQRHADEGALVTFGVAPTTPETGYGYIKKGDPVSAGQDHSPETEGAARIEAFVEKPDAETARAYLRSGRYFWNSGMFMFRAADILDEMRQQVPEIVAACEQALSSGCRDLDFFRLDADAFARCPSDSIDYAVMEKTDRGVMVPLDAGWNDLGSWEALWHTGEKDKSANVISGDVVVHDVSDSYLRSTSRLLAAVGLSGHVVVETPDAVLICPRNRTQDLKLIVDTLKAGSRAEAMVHKTDYRPWGTCETLVVGERFHVNRLTVKPGQQLALQRHTLRAEHWVILSGTARVTKGRDAFTVTADQSVYIPEGVAHRLENAGDGPLEVIEVQTGTAIQDTDIERLEDVYGRK

SEQ ID NO: 86204 - protein, 258 aa, Hordeum vulgare
GARGIGEAIVRAFVRQGARVVIADIDDAAGEALAAALGGAWCSYVHCDVSVEADVERAVGCCVARHGRLDVLCNNAGVLGRQAAPSGAGAGARSGGIASLDAAEFDRVLRVNTLGAALGMKHAARAMLQSRGVGSGVSIVSVASVAGVLGGMGPHAYTASKHALVGLTKNAACELGEHGIRVNCVSPFGVATSMLVNAWRHGVDEEGGASAAPVSAEEVEKTEEMVRGMATLKGPTLRAGDIAEAALFLASDESRYIS

SEQ ID NO: 86205 - protein, 249 aa, Orthoclada laxa
GSRGIGEAIVKLFVKHGARVLIADIDDAAGEALAAALAPGCCSYEHCDVSVEADVERAVQRAVARHGRLDVLCNNAGVLGRQTRAAESILCLDPDEFERVLRVNALGAALGVKHAARAMLPRRAGSIVSVASVAGVMGGMGPHAYAVSKHAVVGLTENAACELGQHGIRVNCISPFGVATPMLVNAWRQHDDDDGTIMAAAAPAPSEEEVEKMEEVVRGLGTLKGATLRPRDVAEAALFLASDESRYIS

SEQ ID NO: 86206 - protein, 234 aa, Chasmanthium latifolium
AASGIGKATAKEFVRNGAKVVLADVQDDLGHAIAAELGADASCYMRCDVTDEVQVAAAVDLAVARHGRLDVVLSNAGVVGSLARPPLGALDLADFDRVMAINTRGVMAGVKHAARAMVPRRSGSIICMASIAGVLGSVAPHPYSVSKAAVVGLVRAVAGELARSGVRVNAISPNYIPTPLVMRILEEWYPEKSAAEHRQIVERDINEMEGVVLEPEDIARAALYLASDESMYVN

SEQ ID NO: 86207 - protein, 502 aa, Triticum aestivum
  misc_feature (179)..(179): Xaa can be any naturally occurring amino acid
MSFRDESGGEDGSGGRSSSASDLRKPFLHTGSWYRMSAAGGGAMDRLGSSAYGLRDSSISALLCTLIVALGPIQFGFTCGYSSPTQDAIMADLGLTLSEFSLFGSLSNVGAMVGAIASGQIADYLGRKGSLMIAAIPNIIGWLAISFANDSSFLFMGRLLEGFGVGVISYTVPVYIAGXEIAPQNMRGALGSVNQLSVTIGILLAYTLGMFVPWRILSVLGILPCSILIPGLFFIPESPRWLAKMGKMEDFESSLQVLRGFETDISAEVNEIKRSVASSRRRTTIRFAEIKHKRYSVPLMIGIGLLILQQLSGVNGIFFYAASIFKAAGLKNSNLATCGLGAVQVVATGITTWLTDKAGRRLLLIISATGMTISLLVVSVSFFVKDNIEEASHLHFVMSMLSLAGLVAFVLAFSLGMGAIPWIIMSEILPVNIKSLAGSTATLANWMTSWLITMTASLMLNWSNGGTFAIYAAVSMGTLLFVCLCVPETKGRTLEEIAFSFR

SEQ ID NO: 86208 - protein, 301 aa, Burkholderia sp. 383
MRALEPAASHANTHAAAPIHASHPIDYIVVDAFTRTPLEGNPVAVFLVDVPLPAERMQRIAREMNLSEVVFVMPPKQGGDVHVRIFTPVNELPFAGHPLLGTAVALRHVKAQDRFVFETGMGLVPFDVRSDAPGEAYVTMQQPIPTWTRFDRAERLLEALGVEASVLPVEAYRNGPRHVFVTLPDASALSDVHPDHRALAEFEDMSAMCVAPAGDHWRCRMFSPAYGVVEDAATGSAAGPIAIHLARHGLISWGEPLHLLQGVEIRRPSHMHALVHGSEHGIEAVEVSGHGVVVARGRLGV

SEQ ID NO: 86209 - protein, 166 aa, Desulfococcus oleovorans Hxd3
MNGTKHILSILVDNQPGVLSRIAGLFSGRGYNIESLCVATTTDPGISRLTMVTIGDEAIVEQIQKQLNKLINVIKVIDLTGTQYVQRELILIQVRAKPENRAEILRIVDIFRGKVVDVGAENYMIEATGSEEKLAAFLMLLKPLGIKEIARTGPIALQRDANSKGK

SEQ ID NO: 86210 - protein, 234 aa, Orthoclada laxa
AASGIGEATAREFVRNGAKVVLADVQDDLGRALAAELGAGAACYTLCDVTDEAQVAAAVDLAVARRGRLDVVLNNAGVGGSLARPALGALDLADFDRVMAVNARGVLAGVKHAARVMVPRRSGSIICTASIAGVLGSVTPHPYSVSKVAIIGLVRAAAGELARSGVRVNAISPNYIPTPLVMRILEEWYPERSAEEHRRIVEGDINEVEGVVLEPEDIARAALYLASDESKYVN

SEQ ID NO: 86211 - protein, 277 aa, Oryza sativa
MAFRLSNNVIGALNLVTLLLSAPILGGGIWMATRGDGGECDRHLSSPAIALGAVLMAVSLAGLVGACCRVTWLLWVYLLAMFALIVALLGFTAFAFAVTNRGAGEAVSGRGYREYRLGDYSTWLRRHVGSSKNWDKIRSCLAGADVCRSLQDRNETWAQFVADDLSPVQSGCCKPPTSCNFTYGGGTRWGKTARLSSADPDCDEWSNDADEVCYGCRSCKAGVVAALKRDWKRVAIVNVVFLAFIVVVYSVGCCAFKNSRRDSVHRRSGGWKQAGYA

SEQ ID NO: 86212 - protein, 400 aa, Xanthobacter autotrophicus Py2
MSLISSALKRIKPSQTIAISNKARELKAAGRDIVALSAGEPDFDTPENIKEAAIAAIRRGETKYTAVDGIPELKAAICRKFKRENDLDYKPSQVTVGTGGKQVLFNALVATVDAGDEVLIPAPYWVSYPDIVEFCGGKPVPVMTTIEDNFKLRPDVLEAAITPKTKWLIFNSPSNPSGAAYSFDELKALTDVLVKYPQVWILTDDMYEHLVYDDFKFVTPAQVEPKLYNRTLTMNGVSKAYCMTGWRIGYAAGPEALIKAMGTLQSQSTSNPSSIAQWAALEALDGPQDFIAANNKVFKERRDLVVSMLNQAKGLHCPKPEGAFYVFPSCAGTIGKTTPGGVTIASDEDFATQLLEAEGVAVVHGSAFGLGPAFRISYATATSDLEEACRRIQRFCGSLS

SEQ ID NO: 86213 - protein, 234 aa, Setaria italica
GASGIGEATARELVKNGARVVLADVQDDLGRALATDLGADAASYTRCDVTDEAQVAAAVDLAVARHGKLDTIFNNAGVVGSLARSPLGALDLDDFDRVMAVNTRGVMAGVKHAARVMVPRRSGSIICTASIAGVLGMITPHPYSVSKSAVVGLVRAVAGEVARSGVRVNAISPNYIPTPLVMRILEEWYPERSADEHRLIVERDINEMEGVVLEPEDIARAAVYLASDESKYVN

SEQ ID NO: 86214 - protein, 452 aa, Cytophaga hutchinsonii ATCC 33406
MTEKEIVDYIKNNDIQKIKFAFADIDGVLRGKLIHTDKFLDGLKEGLGFCDVVFGWDSADAGYDNVSATGWHTGYPDKLAQIDLSTFRLIPWENNTPFFLADYKNNDQTALPICPRTLLKRIAQECSAMGYHAAFAQEFEWFNFRETQQSLVEKNFHDLTPLTNGMFGYSILRPSLEDAYYNDLFDLLGAFDIPLEGLHTETGPGVYECAYFHDEVVRAADKATLLKTAVKEIANKHGIIATFMAKISDKLPGCSGHIHQSLWNTGKTENLFYDPNQEHNMSDLFKHYVAGQLYCLPHIVPMLAPTVNSYKRLVEGAWAPTTLTWGFDNRTTALRVLNHSKKTARLEQRVSGSDTNPYLAIAASLASGLYGIKHKLSLDVPPTTGNGYANKSNGSIASNLMDATQLMKNSSIAKELFGEAFVQHFTATREWEWRQFSKHVSDWEMKRYMEII

SEQ ID NO: 86215 - protein, 531 aa, Bordetella bronchiseptica RB50
MSLPFDWSFPYASRKMPVLASNAVATSQPLAAQAGLRMLLAGGNAVDSAIATAIALTVVEPVMNGIGGDLFALVWHGGRLHGLNSSGCAPAAWTPEYFAGRETMPPTGWGAVTVPGQVAGWKALSERFGKLPFAALFEPAIAYAEQGFPVSPTIARQWATQAPKLAGEPGFADAFLPQGQAPQAGQWWRFPAQARTLREIAETGGASFYQGELARRIADFARQTGGALREQDLAEHRPEWVEPISQSFRDYELHEIPPNGQGIAALMALGMLEQFDLEAMGRDSADYYHVSIEAMKLAFADLHQHVTDPRHMRVNAAALLDPAYLAERARLISMDRSSVPAAGAPATGGTVYLTAADADGTMVSFIQSNYHGFGSGVVVPDTGISLHNRGMNFVLTPGHVNQVAPRKKPMHTIIPAFMTRKGQPAMSFGVMGGSMQAQGHLQMATRLAAFGQNPQAMSDAPRFRVENGPVVNVEAHLPADVVQTLRDRGHNVAVAPADSLEFGSAQLICRLPEGGYLAASDSRRDGQAVGF

SEQ ID NO: 86216 - protein, 363 aa, Vibrio vulnificus YJ016
MGFKCGIVGLPNVGKSTLFNALTKAGIEAANFPFCTIEPNTGVVPVPDLRLDELAKIVNPQRILPTTMEFVDIAGLVAGASRGEGLGNKFLANIRETDAIGHVVRCFENENIVHVAGKVSPIEDIEVINLELAMADLDSCERAIQRQAKKAKGGDKDAKFELTVLEKLLPVLTEGGSARTVELSKEELAAVGYLNFLTLKPTMYIANVNEDGFENNPYLDAVREFAAKENNVVVPVCAAIESEMAELEDDERAEFLADMGIEEPGLNRVIRAGYELLSLHTYFTAGVKEVRAWTIPIGATAPKAAGKIHTDFEKGFIRAEVIAYDDFIQFKGENGAKDAGKWRLEGKEYIVKDGDVVHFRFNV

SEQ ID NO: 86217 - protein, 347 aa, Salmonella enterica subsp. arizonae serovar 62:z4,z23:--
MKIRVFMATVLLLISHCVFSTTSLPHIVILATGGTIAGTAANNTQTAGYKSGELGVQTLINAVPEMNNIARVDGEQVANIGSENMTSDIILKLSQKVNALLARDDVDGVVITHGTDTLDETAYFLNLTVKSDKPVVFTAAMRPASAISADGAMNLLEAVTVAADPNAKGRGVMVVLNDRIGSARFVTKTNATTLDTFKAPEEGYLGVIVNGQPQFETRVEKIHTLRSVFDVRNIKKLPNVVIIYGYQDDPEYMYDAAIAHHADGIIYAGTGAGSVSVRSDAGIKKAEKAGIIVVRASRAGNGVVPLDKGQPGLVSDSLNPAKARVLLMTALTQTHKPELIQNYFSTY

SEQ ID NO: 86218 - protein, 450 aa, Salmonella enterica subsp. arizonae serovar 62:z4,z23:--
MTKHYDYIAIGGGSGGIASINRAAMYGQKCALIEAKELGGTCVNVGCVPKKIMWHAAQIREAIHLYGPDYGFDATINQFDWSKLIASRTAYIDRIHTSYDNVLGKNNVDVIKGFARFVDAKTIEVNGETITADHILIATGGRPSHPGIPGVEYGIDSDGFFALSALPERVAVVGAGYIAVELAGVINALGAKTHLFVRKHAPLRSFDPMISETLVEVMNAEGPQLHTHAVPKAVVKNADGSLTLELEDGRTENVDCLIWAIGREPSTDNINLAAAGVKTNEKGYIIVDKLQNTNVEGIYAVGDNTGAVELTPVAVAAGRRLSERLFNNKPDEYLDYSNIPTVVFSHPPIGTVGLSEPQAREQYGNEQVKVYQSSFTAMYTAVTTHRQPCRMKLVCVGPEEKIVGIHGIGFGMDEMLQGFAVALKMGATKKDFDNTVAIHPTASEEFVTMR

SEQ ID NO: 86219 - protein, 132 aa, Triticum aestivum
MATYYPSGASALLLPVPRTRAAFPQMFPGPASGRSSPCAAVRPQRRGREAVGVVRACFNPFGDERILREALKEPVAFMGGVFAGLLRLDLNEDPLKEWVTRTVEASGIAEENSAEESNEGAQNDGPQQIEIE

SEQ ID NO: 86220 - protein, 295 aa, Candida albicans SC5314
MPAQLQVNTDYFTLNNGNKIPAVGLGTWQATNEDEAYRAVLAALKNGYKHIDTAAIYGNEEQVGKAIKDSGVPREELFVTTKLWNADHKNIEEALETSLKKLGLNYVDLYLIHWPASIDKSTNKPYTDFDYVDTYRGLQKVYKNSKKIRAIGVSNFTKKKLERLLSSEGVDVVPAVNQIEAHPLLTQPELYDYLKEKGIVLEAYSPLGSTNSPLFKNETIVKIAEKNGVEPAQVLVSWAIQRKTVVLPKSVTESRVISNLKTFTLPSEDFETLNKLSEKDGVVRTCNPAFNNFDD

SEQ ID NO: 86221 - protein, 452 aa, Mesorhizobium loti MAFF303099
MTTQVSEHNHDDAICPVDPAISSLRATAKGIDTRVVRGRITRAVGTLVHAVLPDTRIGELCLLQDPRTGLSLEAEVIGLLDDGVLLTPIGDLVGLSSRAEVVATGRMREVPVGNDLLGRVIDSRCRPLDGKGQIETTETRPLHGRAPNPMTRRMIERPLPLGVRVLDGLLTCGEGQRIGIYGEPGGGKSTLLSQIVKGAAADVVIVALIGERGREVREFIERHLGEEGLRRAVVVVETSDRSAVQRAQCAPMATALAEYFREQGLRVALMLDSLTRFCRAMREIGLAAGEPPTRRGFPPSVFSMLPGLLERAGMSERGSITAFYTVLVEGDGTGDPIAEESRGILDGHVVLSRAIAARSHFPAIDVLQSRSRVMDAVVSRTHRKAASFFRELLSRHAETEFLINVGEYKQGGDPLTDRAVESIDELREFLRQSEDEISGFEETVAWMSRLTA

SEQ ID NO: 86222 - protein, 289 aa, Candida albicans SC5314
MSAQLKTNNDRIALNNGNKIPVIGLGTWESNKDAFLTALKLGYRHIDTATIYKNEEQVGQAIKESGIPREELFITTKVWNNDHKNVEQALETSLKKLGLDYVDLYLVHWPVSIDKTTKEPYPDYDYVDTYKELQKIYKTTTKIKSIGVSNFTKSQLERLLSADGVDVVPAVNQVEAHPLLPQPELYEYLKEKGITLEAYSPLGTSSSPLIKNKTIVEIADKNGVDPAQVLISWAVQRKTVVLPKSVTESRLVSNLKTFELSAEDFDTLNKLSEKEGITRIINPFKNFQD

SEQ ID NO: 86223 - protein, 486 aa, Azoarcus sp. BH72
MRQIENFIAGEYVAAASGRRFEKRSPVDNRVIASISEAGRPEVDAAVQAARAALHGEWGGLTADQRVELLYGVANEITRRFEDFVEAETADTGQPSHVMRHVFIPRGAANFKVFADVVKNVPTEAFQMATPDGAGALNYAIRVPKGVIGVICPWNAPFLLMTWKLGPALACGNTVVVKPSEETPNTAALLGEVMNAVGVPKGVYNVVNGFGPDSAGAFLTQHPGVDAITFTGETRTGAAIMKAASEGMRDVSFELGGKNAGIVFADADFDAAVDGIFRSAFLNTGQVCLGTERVYVERPIFERFVQALKLKAEAVKYGRPEDHTANYGPLISQEHKRKVLSYYAKAVEEGATVVTGGGVPDMPGELAEGAWVQPTIWTGLPETAAVVREEIFGPCCHIRPFDSEQEVVALANATDYGLSTTIWTTNLARAHRVAARVEVGITWINSWFLRDLRTAFGGSKQSGIGREGGVHSLEFYTETRNVCVKL

SEQ ID NO: 86224 - protein, 593 aa, Paracoccus versutus
MRMTTEESFVKVLQLHGIEHAFGIIGSAMMPVSDLFPRAGITFWDCAHETNAGMMADGFTRSTGRMSMAIAQNGPGVTGFVTPVKTAYWNHTPLLLVTPQAANRTIGQGGFQEMEQMRIFADCVCYQEEVRDASRIPEVLNRVIMQAWRNSAPAQINIPRDFWTQVIDVELPQVVAFERPAGGEQAVAEAAKLLSGAEFPVILSGAGVVLSGAIPELARLAERLDAPVCSNYQHNDSFPGSHPLAMGPLGYNGSKAAMEIIARADVVLALGTRLNPFSTLPGYGIDYWPKDARIIQVDINADRIGLTKKVTVGIQGDAAKVARGILAQLAPTAGDAGRAERKALVAQTRSRWAQELSSLDHEEDDPGTEWNEDARRRDAGLMSPRQAWRAIMQAVPKEAIVSSDIGNNCAIGNAYPSFEAGRKYLAPGLFGPCGYGFPAILGAKIGNPDVPVIGFAGDGAFGISMNEMTACGREDWPAITMVIFRNYQWGAEKRNTTLWYDNNFVGTELDRDTSYAKIAQACGLVGVQVKSQEELTAALHDAVERQMKNRETTFIEVLLNQELGEPFRRDAMKKPVVVAGIDPADMRPQQGAA

SEQ ID NO: 86225 - protein, 159 aa, Cytophaga hutchinsonii ATCC 33406
MSSADKNLSSYSGEIPNLSSRVFGIVVAEWNEEITEPLYEGAVEVLLKHGIPKANIIRTNVPGTFELSLGAQWLAMKKGVDAVICLGCVIQGETRHFDFICNAVSIGITEVNLKFNKPVIFGVLTTDNKEQAFDRAGGKHGNKGDEAAITALKMLAQTI

SEQ ID NO: 86226 - protein, 456 aa, Bordetella parapertussis 12822
MTTLSSAQQQDIQYQLHSYTNAVKHRDVGPRIITHGEGVYVFDDQGNRYLEGMAGLWSVAVGFGEQRLVEAAARQFQELPYYHTFTHKSHPSVIALAERLIGYTDGRMAQAFFTNSGSEANDTVVKLVWYYNNALGRRDKKKIIARQRGYHGVTVASTSLTGLPGNHKDFDLPLPQIRHTACPHYYRYGLPGETEEDFATRMAGELEAMILREGPDTVAAFIGEPVMGAGGVIVPPRTYWQKIQAVCRKYDILVIADEVITGFGRLGQRFGSQVFDIEPDIMVLSKQITSSYQPLGAVLLNARVADVVAEHSGRLGTFGHGYTASGHPVATAVALENLRLIDERGLIEHAAEMGALLHLELQALSSHPLVGEVRGVGLIAGVELVADKATRQPFDPLGKAGGYAYERAHDHGLIVRGIQDTVAFCPPLIITAEQVRDMVARFARTLDDVAAHVAQG

SEQ ID NO: 86227 - protein, 444 aa, Cytophaga hutchinsonii ATCC 33406
MRVLKFGGTSVGKPERMHSVAKLISSPDPKVVVLSAVSGTTNALVDISTKLCKKDIKAAEDAIEKLFTPYHAFVEELYTTEAGKYKGHAIMRTYYELIKSYVTAPSFGDKETRFFLAQGELISTNLFQEYLAEQGYSSALLPALEFMKTDADSEPMLEYIEEKLNEQLAKHPNKQLYITQGYVCLNSDGEVDNLKRGGSDYTATLIGAALRMEEIQIWTDIDGMHNNDPRIVKRTFPIPEISFDEAAELAYFGAKILHPTCIRPAQVRKVPVRLLNTMQPEQKGTVINSKPSDRDITAIAAKDDITAIKIKSSRMLQAHGFLRKVFEIFENYKTSVDMITTSEVAVSLTIDDAKNLEQIVKELKEFSIVEVDTDQTIICIVGNFGKEKTGISKRLFDAMETIPVRMISYGGSASNISILINSTLKNETLNALNERLFFQAETVK

SEQ ID NO: 86228 - protein, 208 aa, Cicer arietinum
MGYWKSKVLPKIKKVFVSESSTKKAAAAEVSKSFDESKEVYNKEFEEKKTELQPKVLVVYEALSTQIKSLVKERDEAGLKKNTTEVNKFIEELVKIDFPGSKAVSEASSKFGPALISGPIFYVFEKVSTFIVTEEKVEETTPTTETKTEEETSGVKEKEIVIEEGKKEEKIESVEEKVVADPVSDDKQEEKVVETVVTAVEKEEPIKP

SEQ ID NO: 86229 - protein, 497 aa, Bordetella parapertussis 12822
MSTLPPLSHWESLAAGLTLRNQAFIDGRWHDGRAGPLAAINPATGQLLAEVTACSQADIDQAVAAARRAFESGVWSRMPRRERKQCMLRLAALIREHAEELALIETLDMGKPIGDTMAFDIPETAHTYAWYAETIDKQYDEIAPTDADALATITREPLGVVAAVVPWNYPLLMASWKVAPALAAGNSVILKPAEQSSLSALRLAELALQAGIPAGVLNVVPGAGPVAGRALGLHMDVDCLAFTGSTATGKRFMEYSGQSNLKQIWLECGGKSPHIIFDDCPDLDRAALAAAIGIFNNQGEVCIAGSRLYVQAGIYDTFVSKVEACARAMQPGNPLDPASPMGAMVDERQMARVLEYVESGRREGARLRMGGERVRADSGGYYIEPTIFECARPDLTIVREEIFGPVLAVTRFDGEDEVVAQANASAYGLGSGLWTADLSRAHRVSRRLRAGLVWVNCYFDGDVTVPFGGVKQSGFGRDKSLHALDKYTSLKTTWIRL

SEQ ID NO: 86230 - protein, 458 aa, Pseudomonas syringae pv. syringae B728a
MTSQDGLKRGLSARHIRFMALGSAIGTGLFYGSASAIQQAGPAVLLAYLIGGAAVYMVMRALGEMAVHDPVSGSFSHYATRYMGPLAGFVLGWTYAFEMIIVCLADVTAFGIYMGFWFPEVPRWIWVLGIVFLIGALNLCNVKVFGETEFWLSILKVSAIVAMIVAGFGIMIFGIGSSASGSEIGISNLWAHGGFMPNGVTGLIASFAVVMFAFGGIEIIGITAGEAKDPRRSLPQAINAVPLRILLFYVLTLFVLMCIYPWPQIGTQGSPFVQIFDNLGIASAATILNIVVISAAVSAINSDIFGAGRMMYGLAREGQAPASFARVSRHGVPWMTVLVMGIALLGGVLLNYLIPKDVFLLIASLATFATVWVWLMILLTQVSMRRSMSREEAAQLKFAVPFWPYGPAAAIAFMLFIFGVLGYFPDNRAALIVGAIWIVLLLIAYAVWVKPKALNTTH

SEQ ID NO: 86231 - protein, 506 aa, Zea mays
MASPAMVPLRQLFVDGEWRPPAQGRRLPVVNPTTEAHIGEIPAGTAEDVDAAVAAARAALKRNRGRDWARAPGAVRAKYLRAIAAKNVIERKPELAKLEALDCGKPYDEAAWDMDDVAGCFEYFADQAEALDKRQNSPVSLPMETFKCHLRREPIGVVGLITPWNYPLLMATWKIAPALAAGCTAVLKPSELASVTCLELADICKEVGLPSGVLNIVTGLGPDAGAPLSAHPDVDKVAFTGSFETGKKIMASAAPMVKPVTLELGGKSPIVVFDDVDIDKAVEWTLFGCFWTNGQICSATSRLLIHTKIAKKFNERMVAWAKNIKVSDPLEEGCRLGPVVSEGQYEKIKKFISNAKSQGATILTGGVRPAHLEKGFFIEPTIITDITTSMEIWREEVFGPVLCVKEFSTEDEAIELANDTQYGLAGAVISGDRERCQRLSEEIDAGCIWVNCSQPCFCQAPWGGNKRSGFGRELGEGGIDNYLSVKQVTEYISDEPWGWYQSPSKL

SEQ ID NO: 86232 - protein, 114 aa, Oryza sativa
  misc_feature (48)..(48): Xaa can be any naturally occurring amino acid
SSPFSTPPPPISTSSSSAAAIVDGGNEWYQNTERRIEEAAARGILYLXLMPGGHIDAYNNIRDILEKAAAQTEDGACVTFVGPGGAGNFVKMVHNGIEYGDMQLIAEAYDVLRR

SEQ ID NO: 86233 - protein, 99 aa, Aspergillus niger
HKWLPHLLCLAYGLTTPISIAIGLGLRTAYNPGSKTSLIVQGVFNAISAGVLIYSALVELLARDFIFDPCRTRRRSKLLYMVFCTLLGAGIMALIGKWA

SEQ ID NO: 86234 - protein, 234 aa, Pennisetum glaucum
GASGIGKATAAEFVRNGAEVILGDVQDNLGHALAAELGADAATYTRCDVTDESQVAAAIDLAVARLGRLDVVFNNAGVSGHLLPYRLGALDMADFDHVMAIKARAVVVGVKHAARIMAPRRSGSIICTASTDGVIGGVAMLPYSVSKASVVGLVRAAAGELARSGMRVNAISPHYIPTPLVMGAMAEWYPGMSDGERRRVVEKEMNEMDGPVLEAEDVARAALYLASDESKYVN

SEQ ID NO: 86235 - protein, 370 aa, Methanothermobacter thermautotrophicus str. Delta H
MKCYLTGCIAGPLAFSEDLELIDYEPFPVDEIPGRLAESQMGGVSPEERIMLERLTPEYDEVVVEASPSPEYAGFRNLRFEVPSRAGIHLRENLEDILAEILDMPAGDFIHDALMSVARERLRESLRETDRFIIQSINALDELDEETGKLIERLREWYSLHFPELDGIKSHEQYVELIAEYGDRDQILKNFRMDVDESLGSDITSEDLHILRGLAESIRGLQRLREETERYIDIKMEKLAPNLRALAGSNVGARLIAHAGGLRELAMLPSSTIQVLGAEKALFRHLKSGAKPPKHGVIFQHPSIRSSPWWIRGKVARLLAGKIAIAVRKDVFSREFDPGIVESFNERFEAIKSNNPKPPARKKGFRKKRK

SEQ ID NO: 86236 - protein, 558 aa, Listeria innocua Clip11262
MVQLFSAFDRETIERNLQEEKFDLVIVGGGITGAGIALDATSRGMSVALVEMGDFASGTSSRSTKLVHGGLRYLQQFEIKEVADLGKERAIVYENGPHVTTPEWMMLPFHKGGNMGKTTASFGIRLYDYLAGVKKNERRKILSAKETLAKNPFVKKDGLKGSGYYVEYRTDDARLTIEVMKKAVELGANAINYTKAEHFLYDDKKQVVGVTVTDRLTGKAYDIKGHRVINAAGPWVDKVRKLDYATNNKHLRLTKGIHLVIDKQKFPMEQAVYFDTPDGRMVFAIPRDKKVYVGTTDTVYDEAVINPKALESDHNYVIKAINYMFPDVHISEKDIESSWAGVRPLIYEEGKDPSEISRKDEVWFSESGLITMAGGKLTGYRKMAEKLLDGVSKTLSKETGKKYKPVQTKHLPISGGDIGGSEQLEAFLSKKAKEGNNRFGWTLEEGREIAKRFGSNIDQLFTYAQEHKDQNETTLPNSLYAELRYSIQHEAVTTPIDFLLRRTGYLLFDMPYLLEWKDAVVDEMAKQFHWSDDVKQTYIEELNIQINDAREPADWHDR

SEQ ID NO: 86237 - protein, 232 aa, Pharus lappulaceus
AASGIGKATAAEFVRHGAKVILSDIQDDLGRSVAAELGPQAAYTRCNVTDEAQVAAAIDLAVARHGRLDILHNNAGILVSDGGSALSSLDLAVFDRTMAVNARAVVAGVKHAARVMVPRRSGCILCTASVAGILGSQAPHGYSISKAAVIGLVRSVAGELARHSVRVNAISPYSIPTPLVLNYLAEIYPEASIEELKRMVMDLNELEGTVMDTEDIARAAVYLASDEAKCVT

SEQ ID NO: 86238 - protein, 233 aa, Otatea acuminata
AASGVGKAAATEFIKNGAKVILANVQEDVGRSIAAELGPRATYTRCDVTDEAQVAAAVDRAEELHGHLDILYNNAGIAGSMAPTSLGSLDLEEFAASWRSNARSVVSGVKHGARVMVPRQSGCILCTASIAGQQGGLMPHAYNISKATVIGLVRSVAGELASHGVRVNSISPHGIATPFGMGALAQLLPESSDEERKRMIEKDLSELRGAVLEAEDVARAAVYLASDEAKYVS

SEQ ID NO: 86239 - protein, 234 aa, Eragrostis tef
GASGIGAAAARLFASSGATVVIADVQDELGETVAASASAAGKCRYMRCDVTDEAQVEATVAAVVAAHGRLDVMLSNAGVLLPTGSVMDMDLRELDRVMAVNFRGAAACVKHAARAMVSQAEAGQGARGGAIVCTASVASVQGGWGPASYTASKHALLGLVRAAAGELGPHGVRVNCVSPGGVATPLSCGFMGVGPEELEAMTVPFNVLQGKVLRAEDVAEAALFLASDQAAFVS

SEQ ID NO: 86240 - protein, 227 aa, Flagellaria indica
AASGIGEAAARLFASAGATVVLADIQDSLGAGVAASIGPDRCRYMHCDVAREEQVEATVDATVAAHGRLDVMFSNAGVLLPAGAVMDTDMSALDRTMAVNFRGAAACVKHAARAMVAAGTRGSIVCTGSVATCQGGFGPAPYTASKHAVLGLVRAAAGELGRHGVRANCVSPGGVVTPLSCKLMGMDAEALEKLMSAANLLHGTALKAADVAEAALSLASDQAAFVT

SEQ ID NO: 86241 - protein, 349 aa, Zymomonas mobilis subsp. mobilis ZM4
MRIALLAGDGIGPEITAEAVKILKAVVGQEIEFDEALIGGAAWKVTGSPLPEETLKLCKNSDAILFGSVGDPECDHLERALRPEQAILGLRKELDLFANLRPARLFPELQAESPLKENIVTGTDLMIVRELTGDVYFGTPRGQRKDDQNRREGFDTMRYNEDEVKRIARIGFETARSRSGNLCSIDKSNVLETSQLWRTVVLEIAQEYPDVELSHMYVDNAAMQLVRAPDQFDVIVTGNLFGDILSDLASACVGSIGLLPSASLNSEGKGLYEPIHGSAPDIAGLGKANPLATILSGAMMLRYSLKREADADRIEKAVSTALEKGARTADLGGKMTTSEMGNAVLAALN

SEQ ID NO: 86242 - protein, 447 aa, Streptococcus thermophilus CNRZ1066
MFMRTLKKVSLAEVNQSIDTPNHNRFWQNLKAFLGPGALVAVGYMDPGNWITSVVGGATYKYSLLFVILISSLIAMQLQQMAGKLGIVTQMDLAQATAFHSPKWLRYTLWVVLELALMATDLAEVLGSAIALNLLFGIPIMVAILVTILDVFLLLLIMKLGFKKIEAIVSTLILTILVIFVYLVALSEPSITGILEGYLPTPTLFGHYAAGHTNHQLTLALGIVGATVMPHNLYLHSSLSQTRKVDHSNDDDVTKAVRFMSWDSNIQLTLAFVVNSLLLILGASLFFGHASDISAFSQMYNALQDSKIAGAVASSTLSTLFALALLASGQNSTITGTLTGQIVMEGFLHMRLPQWVIRLFTRLFALLPVIIVAILYGDQEKTLDQLLVYSQVFLSLALPFSIFPLIYYTSKKSLMGKHVNAKWNTYLGYAIAIVLTILNLKLIFDTF

SEQ ID NO: 86243 - protein, 350 aa, Photobacterium profundum SS9
MVEDIKFYEPEDNHGFLSNFALSPITLSDVVWPSSEHYYQAQKFTDLSIQNKILNAKTPDEAFKISRDFAEQEKDDWMEVRGAVMRFIVFEKFRQNTYFTHLLVSTGDHVLKEHSHKDDYWGDGGDGSGRNELGKILMDVREYFAKKEPFNLVHFVDSAKLPTQWGTFQMYGFIEVKTGKEHLALVYGQPTPGEPTLIRLHSECLTGDALFSQRCDCGFQLARAMENIVKKGSGVLLYLKQEGRGIGLINKIRAYHLQDEGADTVEANERLGFAADMRDYAFCRGMLSFLNIESVSLMTNNPRKINALTDNGINVVERVTLQEGNNPFNEGYLKTKSAKLGHMFDAEFIK

SEQ ID NO: 86244 - protein, 337 aa, Moorella thermoacetica ATCC 39073
MAKVLVTGGAGYIGSHVVKALGERGYRVLTYDSLVTGHPWAVLYGDLVVGDLLDAAKLEAVIRDFRPDAVMHFAAHIVVPESVAQPLKYYINNVQGTLNLLACMQKSGVNKLIFSSSAAVYGIPERIPVPEEAPLHPINPYGHSKAMVERILQDLSAAGGITYVSLRYFNVAGADRDGRIGEGKEDATHLITLATRTAAGKRPYLSVFGTDYPTPDGTCIRDYIHVEDLAAAHVLALEYLLDGGKSEVFNCGYGRGYSVLEVIAAAKKVTGVDFPVRYEGRRPGDPPALVADARKIRERLGWVPAYDNLEGIIYSAWQWERKRNSVPARPATISTRR

SEQ ID NO: 86245 - protein, 146 aa, Pseudomonas syringae pv. phaseolicola 1448A
MKTVAQLLKLKDLQNQQVHTIGPDQMVLDALRLMAEKNIGALPVVEGNVVVGVVSERDYARKVILKGRSSVGTPVREIMSNKVITVDSQQSVEACMGIMTDSHLRHLPVVEDGRLLGLLSIGDLVKEAIAEQASLIQQLEQYIRGE

SEQ ID NO: 86246 - protein, 213 aa, Brassica napus
MECPKEPLESQCSLSEMDDFDLTRALDKPRLKIERKRSFDERSMSELSTGYSRHDLDMAHSPGSRSFVDTPLSYVRNSFEPHPMVAEAWEALRRSMVFFRGQPVGTIAAYDHASEEVLNYDQVFVRDFVPSALAFLMNGEPDIVKNFLLKTLQLQGWEKRVDRFKLGEGVMPASFQVLHDPVRKTDTIVADFGGSAIGRVAPVDSGVWVDHTS

SEQ ID NO: 86247 - protein, 376 aa, Physcomitrella patens subsp. patens
MSERMSTMSDKMKELFQVSTQADKLVEDATGEDMEGPDWQKNLEICDLINLEKLSGQDTARAIKKRIMLKSVQIQHLALTLLEMVVKNCEKMFSEVASEKVLDEMVKMVDDRSTSTANRDKSLKMIEAWGESTEELRYLPIFEETYKSLKSRGIRFPGRDEESLAPIFTPPQSVTRPSPPGNGGIAGSFHSRDLTGFVAHDVSAEDTKEVFDVARNSVELLNTVLTSSPQQEALKEELTLTLVEQCRSSQFKVQRIVERTGDADPVLFEALNVNDDLQRVLTKFEEMSKGTAEQTQPAAESTFVHVQALDDDDTHGTAEEASLVRKRDLKPSAPPSSTHDDAAMADLDEMIFGNRAAAEGSNQKSKKQNADDLIMF

SEQ ID NO: 86248 - protein, 399 aa, Rhizobium leguminosarum bv. viciae 3841
MNTSEKLIATEQRLGAHNYKPLDVVLTRGEGVYVWDTDGNRYLDCLSAYSAVNQGHCHPKILAAMVEQAGRLTLTSRAFRNDQLAYLYEELAALTGSHKILPMNSGAEAVETAIKAVRKWGYEVKGVPEGKAEIIVCADNFHGRTLSIISFSTDPEARTGFGPYTPGFRIIPFGNAEAFAAAINANTVAALIEPIQGEAGVIIPPAGYFTRIRELCTANNVTLILDEIQTGLGRTGKLLAEEHEGIEADVTLIGKALSGGFYPVSAVLSNSEVLGVLKPGQHGSTFGGNPLACAVARAALKVLTEEGMIENAAVMGDYFTEGLRSIRSNIVRDVRGRGLMMAIELVPEAGGARQYCHALKERGLLAKDTHDHTIRLAPPLVITKEQVDWAVSQIEKTIG

SEQ ID NO: 86249 - protein, 160 aa, Physcomitrella patens subsp. patens
MRWVGLDQEPGLSAAFADHGSRAYGRSPHKLVGGFANYAGQSSSREARGIATPLRMIPAIAQIREDSPRQMMHQSAPVNVPDWSKILGAEKKHKWADEDVDSDKEDEQEERLPPHLHIQREYAQSQMTTFSVCEGAGRTLKGRDLSRVRNAVLRQTGFLD

SEQ ID NO: 86250 - protein, 422 aa, Pseudomonas aeruginosa
MKDLKVAVVGLGYVGLPLAVEFGKKRTVVGFDINQGRIAELRQGIDSTLEVDAAELKEASELSFTFNLQDLQKCNVFIVTVPTPIDEHKQPDLTPLVKASESIGKVLKKGDIVIYESTVYPGATEEDCVPVLEKFSGLRFNEDFFAGYSPERINPGDKEHRVSSIKKVTSGSTPEIAELVDSLYREIITAGTHKASSIKVAEAAKVIENTQRDLNIALINELAIIFNRMGIDTEAVLKAAGTKWNFMPFRPGLVGGHCIGVDPYYLTHKAQSIGYHPEIILAGRRLNDGMGAYVVSQLVKAMLKRRIHVDGARVLLMGLTFKENCPDLRNTKVVDIVRELAEYNIQVDVFDPWVSAEDAMHEYGITPVGTPSHGAYDGIILAVAHSEFKNMGAENIRKLGKAEHVLYDLKYLLDEDKSDLRL

SEQ ID NO: 86251 - protein, 424 aa, Bordetella parapertussis 12822
MDNAELTRRKEAATPRGVGVMCNFYADRAENAELWDTEGRRYIDFAGGIAVLNTGHRHPQLMQALQAQMSRFTHTAYQIVPYASYIQLAERINQLAPGDFAKKTALFTTGAEAVENAVKIARAATGRPAVVAFGAAFHGRTLLGMALTGKVVPYKVGFGPFPADIYHVPYPNALHGVSTDDALAALGTLFKTDVDPRRVAAIIIEPVQGEGGFNICPPAFMQALRALCDDHGILLIADEVQTGFGRTGKLFAMEHYGVAADLTAMAKSLAGGMPLSAVCGRAEVMDAPPPGGLGGTYAGNPLAVAAALEVIRIIEAEDLLARGTRLGHQLRDHLEAQRHDVPEIAEVRALGAMVAVEFRQPGSDAPSPEFARQVQARALEQGLLLLTCGSDGNVIRFLFPLTIPEAVMREALDILARTLRGQNA

SEQ ID NO: 86252 - protein, 341 aa, Pseudomonas aeruginosa
MMSRYEELRKELPAQPKVWLITGVAGFIGSNLLETLLKLDQKVVGLDNFATGHQRNLDEVRSLVSEKQWSNFKFIQGDIRNLDDCNNACAGVDYVLHQAALGSVPRSINDPITSNATNIDGFLNMLIAARDAKVQSFTYAASSSTYGDHPGLPKVEDTIGKPLSPYAVTKYVNELYADVFSRCYGFSTIGLRYFNVFGRRQDPNGAYAAVIPKWTSSMIQGDDVYINGDGETSRDFCYIENTVQANLLAATAGLDARNQVYNIAVGGRTSLNQLFFALRDGLAENGVSYHREPVYRDFREGDVRHSLADISKAAKLLGYAPKYDVSAGVALAMPWYIMFLK

SEQ ID NO: 86253 - protein, 506 aa, Cytophaga hutchinsonii ATCC 33406
MNKKVILMILDGWGLGTNPKVSAIAAAKTPFVDSLFVNYPHSKLEASGLAVGLPVGQMGNSEVGHMNIGAGRIVYQDLVKINLAVENNTLADEPAIKDAFNYAKTNNKKVHFIGLVSDGGVHSHVNHVKGLCNIANQYGLKDVYVHAFTDGRDCDPKSGLGFVKELQESMAKSTGKIASLVGRYYAMDRDNRWERVKLAYDVMVNGEGTHAADALKAIEESYAAGVTDEFIKPVVLVDANDKPIAKIEPGDVVICFNFRTDRGREITVALTQKDFHEQNMFKLDLYYVTMTNYDDTFNNVKVIFDKDNLSNTLGEVLQGASKKQIRIAETEKYPHVTFFFSGGREEPFKGEKRLMAASPKVATYDLAPEMSANEIKEKIVVELKSKDPDFVVLNFANPDMVGHTGVFEAAVKACEVVDSCTEAVVTTALENGYTAIVIADHGNADYMINEDGTPNTAHTTNLVPCILIDNEYKKPLKDGKLGDLAPTILALMGIEKPKEMTGESLL

SEQ ID NO: 86254 - protein, 355 aa, Bordetella parapertussis 12822
MAAKHRIAVIAGDGIGKEVMPEGLRVLEAAATRFGIDFQWDHFDWSCDYYARHGKMMPDDWAAQIGGHEAIFFGAIGWPDAVPDHEALWGSLFRFRRDFDQYINLRPVRLMPGVPTPLANRKPGDIDFFIVRENTEGEYSNSGGRLFAGTEREVVIQESVFTRVGADRVLKFAFELARKRGKHLTAATKSNGISISMPWWDERVAEMAASYPDVRWDKYHIDILCAHFVQHPDWFDVVVASNLFGDILSDLGPACTGTIGIAPSANLNPERKFPSLFEPVHGSAPDIYGKGIANPIGQIWSGALMLDFLGYPQAAAAVVAAIEQVLVDGPRTPDMQGKATTAEVGSAIAALVAAG

SEQ ID NO: 86255 - protein, 759 aa, Pseudomonas syringae pv. syringae B728a
MLNTLRKIVQEVNSAKDLKAALGIIVLRVKEAMGSQVCSVYLLDAEVNRFVLMASEGLNKRSIGKVSMAPNEGLVGLVGTREEPLNLENAADHPRYRYFAETGEERYASFLGAPIIHHRRVVGVLVIQQKERRQFDEGEEAFLVTMSAQLAGVIAHAEATGSIRGLGRQGKGIQEAKFVGVAGSPGAAVGVAVVMLPPADLEVVPDKTVTDIAAELALFQNALEGVRGDMRTLSAKLATQLRPEERALFDVYLMMLDDASLGSEVTDVIKTGQWAQGALRSVVSEHVKRFELMDDAYLRERASDVKDLGRRLLAYLQEARQQALVYPDNTILVSEELTPAMLGEVPEGKLVGLVSVQGSGNSHVAILARAMGIPTVMGLVDFPYSKVDGIDLVVDGYHGEVFTNPSEIMRKQFGKVVEEERQLSQGLDALRELPCVTLDGHRMPLWVNTGLLADVARAQQRGAEGVGLYRTEVPFMINQRFPSEKEQLAIYREQLAAFHPLPVTMRSLDIGGDKSLSYFPIKEDNPFLGWRGIRVTLDHPEIFLVQTRAMLKASEGLNNLRILLPMISSTHEVEEALHLIHRAWGEVRDEGTDVPMPPVGVMIEVPAAVYQTRDLARQVDFLSVGSNDLTQYLLAVDRNNPRVADLYDYLHPAVLQALQSVVRDAHAEGKPVSICGEMAGDPAAAVLLMAMGFDSLSMNATNLPKVKWMLRQINLSKAKELLAQLMTNDNPQVISSSLQLALKNLGLSRMINPSSVKGH

SEQ ID NO: 86256 - protein, 306 aa, Arabidopsis thaliana
LRHQSPSKEKLSSVTQSDEAEAAAAAISAAAADADPAGLWTQIKAEARRDAEAEPALASYLYSTILSHSSLERSIFFHLGNKLCSSTLLSALLYDLFLNTFSYETSLRNATVADLRAARVRDPACISFSHCLLNYKGFLAIQAHRVSHKLWTQSRKPLALALHSRISDVFAVDIHPAAKIGKGILLDHATGVVVGETAVIGNNVSILHHVTLGGTGKACGDRHPKIGDGCLIGAGATILGNVKIGAGAKVGAGSVVLIDVPCRGTAVGNPARLVGGKEKPTIHDEECPGESMDHTSFISEWSDYII

SEQ ID NO: 86257 - protein, 237 aa, Methanothermobacter thermautotrophicus str. Delta H
MLGAVATGVASRGVVPIENSIEGPVGVTLDLLAWEYDLCIEGEIILRVRHNLLVNRGVSLNEIREVYSHPQSLAQCRGFLEKLGVSTHSTPSTAAAARTIMGRRECAAIGTRRAADIYGLEVIAENIQDFDPNFTRFIVLSEGDHEPTGRDKTSIVFSLSEDKPGGLHEILGFFADAGVNLTKIESRPSKRGLGKYIFFVDFQGHRKDPHVMDILRSISDRTPFFKILGSYPEMTDY

SEQ ID NO: 86258 - protein, 237 aa, Cicer arietinum
LLFLYVTILTIIGYSHQSDPKAGGTDCDGVGILGIAWAFGGMIFILVYCTAGISGGHINPAVTFGLFVGRKVSLLRAVFYMAAQCAGAISGTGLAKGFQKAYFDRYGGGANFVHDGYNKGTALGAEIIGTFVLVYTVFSATDPKRNARDSHVPVLAPLPIGFAVFMVHLATIPITGTGINPARSFGSAVIYNEGKIWDDQWIFWVGPIIGATVAAIYHQYILRGSAIKALGSFRSNA

SEQ ID NO: 86259 - protein, 435 aa, Dendrobium crumenatum
MSKEFGIEAPLSKIAVSKAHGEDSPYFAGWKAYEENPYDAVDNPNGVIQMGLAENQLSFDLLEEYLEQHPEASSWGSGMSSFRENALFQDYHGLQTFRKAMASFMEKIRGGRSKFDPDRIVLTAGATAANELLTFILADPGDALLVPTPYYPGFLRDLQWRTGVTIFPVHCHSSNGFQLTLASLESAYADAKASNFNVKGLLITNPCNPLGTVASLSLLQDIILFISDKNIHLISDEIYFGCVFSSTNLFSISDLITNAVSYQIHIVYSLSKDLGLPGFRVGALFSYNDRVVKTARRMSSFSLVSSQTQKLLAFMLSDEEFTVNYIKKNRERLRERYELVVGGLKEAGIECLKGEAGLFCWVNMEELMEDKTEEGELRLWKVMVDELKLNISPGSSCCCSEPGWFRVCFANTSRETLEVALRRLKDFARKKTKNI

SEQ ID NO: 86260 - protein, 310 aa, Thermus thermophilus HB27
MDRPLLIFSGQSNRPLAQAIAEALGLPLGKSTTLRFANDNLFVRYEESLREGDVFIVQSFVPPVQDHLMELLMMVDAAKGASAARVTAVIPYFSYARSDKKDAPRISITARLIADLLQTAGADRVLTMTLHSPQVHGFFKIPVDHLSAEPVIANYFATRVDLENAVVVAPDAGDLKRASALARRLGLPLAFIDKERVSDTEVRVRMLVGEVEGKTALIVDDEISTAGSLVEAVEALMQAGAKEVYAAATHGVYVGPALDRIAKSPVKEVAATDTCPPKEGPKLRTLTVAPLFAEAIWRIHRGESVSSLFT

SEQ ID NO: 86261 - protein, 254 aa, Bacillus licheniformis ATCC 14580
MDRKVVIVTGGSSGMGKAIAKKQAEEGWNVMITGRTQETLEAAKEEIETFAGQVAVCRMDVRSVEDVEQMITEAAGRFGTIDALVNNAAGNFICPAEKLSVNGWKAVIDIVLNGTFYCSQAAGRYWIKEKKRGQILNMVATYAWGAGAGVVHSAAAKAGVLSLTRTLAVEWGSAYGIRCNAIAPGPIERTGGAEKLFESEEAAHATIKSVPLKRLGTPEEIAGLAAFLLSEQAGYVNGECVTMDGGQWLNPRPF

SEQ ID NO: 86262 - protein, 492 aa, Cicer arietinum
LHQVIKANDDLSREHHQFFLYQMLRALKYMHSANVYHRDLKPKNILANSNCKLKVCDFGLARVAFNDAPTSIFWTDYVATRWYRAPELCGSFSSKYTPAIDIWSIGCIFAEVLLGKPLFPGKSVVHQLDLITDLLGTPLPETITGVRNDNARKYLAGMRKKLPVPFEQKFPNADPLALRLLQRLLAFDSKNRPTAEEALADPYFKGLAKVEREPSCKPISKLEFEFERRRITKDDVRELIYREILEYHPQLFKDYMNGTEGANFLYPSAIDQLRKQFAYLEENDGKSGSVLPPERKHVSLPRSTVYSGSILPSNQRTPALYEKKKMVEETSKSWGAAGENSRNQLRGVQPPPRVPAKPGRVVGPVLHYEDERITKSSNDPRIVIQNTTQAVSSRDAFQTHPPNTKTTSGIHKEQGKNEFPSLQSNLHATATTDLNNNPYRRRVINNNLNDPVTTIDAKMLQAQSHLGVVGAAAVAVATHSHRYSRGIQYGLF

SEQ ID NO: 86263 - protein, 203 aa, Aspergillus niger
RKASSVESESVQSELPANFGEVVKGIYRSSFPYPWNLTALKKLGLKTIITLVDEPYPPSHVMFVKENGIAHHRILVQANKDPAVKIPDSVMCRILELLLDKSNHPILVHCNKGKHRTGCVVACFRKLQAWDSCDVIEEYLRYAFPKPRLLDENYIDGFDPSKLHQLAQSSGVKTWQPSGLFKMPSGEQDRDKELTNCHVPPSL

SEQ ID NO: 86264 - protein, 350 aa, Arabidopsis thaliana
MGSSGGYRKGVTEAKLKVAINGFGRIGRNFLRCWHGRKDSPLDIIAINDTGGVKQASHLLKYDSTLGIFDADVKPSGETAISVDGKIIQVVSNRNPSLLPWKELGIDIVIEGTGVFVDREGAGKHMEAGAKKVIITAPGKGDIPTYVVGVNADAYSHDEPIISNASCTTNCLAPFVKVLDQKFGIIKGTMTTTHSYTGDQRLLDASHRDLRRARAAALNIVPTSTGAAKAVALVLPNLKGKLNGIALRVPTPNVSVVDLVVQVSKKTFAEEVNAAFRDSAEKELKGILDVCDEPLVSVDFRCSDFSTTIDSSLTMVMGDDMVKVIAWYDNEWGYSQRVVDLADIVANNWK

SEQ ID NO: 86265 - protein, 187 aa, Methanothermobacter thermautotrophicus str. Delta H
MEMETKVTVHDAMTSNVITADPGISVAEAASIMTEKKVGSIIVKSNSEPEGLITESDIIRKVVSRDLRASEVTVGEVMTRNLISIEPDRELSEAARLMAKNSIRRLPVVRDGALVGILTSSDVMMVAPELTEILVENARIEENRVQLPENERSVPGVCEICGNFEEYLEEYDGKYICEECKEDLEGE

SEQ ID NO: 86266 - protein, 253 aa, Glycine max
  misc_feature (235)..(235): Xaa can be any naturally occurring amino acid
MSATFKYQPTGLHGWGAPRSSSRNLARFFSMRFACNSRHHKILHASVSHPSSLSISHDSSTETESTLILIRHGESLWNEKNLFTGCCDVPLTKRGVEEAIEAGKRISYIPVDMIFTSALIRAQMTAMLAMTQHHQEKVPIIIHNESERATAWTQVYSEKTTKQSIPVITAWQLNERMYGELQGLNKQETAERYGKEKVHEWRRSFDIPPPKGESLEMCSQRAVAYFKDFIEPQLXSGKHVMGAAHGNSLRAII

SEQ ID NO: 86267 - protein, 825 aa, Alkaliphilus metalliredigens QYMF
MIRIKAIIMAGGKGTRLKPLTCNIPKPMVPILNKPTMEYTVELLRKHNIKDIAVTIAHLPTVITDYFHDGGKWDVNLSYYTEETPLGTGGSVKNAEEFIDDTFIVLSGDSLTDINIKKAIEFHKNKGSKATLILKNEQMPIEYGVVITNDNGRITRFLEKPSWGEVFSNTINTGMYILEPEVLDYFQPGENFDFSKDLFPKLLEDDIPMYGYVTEDYWCDVGALNSYTETHFDILSGKVNIGLEGHQIEDGIWVGEGTQIGSGVKITPPVYIGKNCVIHEGVKIDAYTTIGDHCNIENNTSLKRSIIWNHSTLGRNSRCRGSIVCNHVHIKEHVDLYENAVIGEGSILEGRVVVKPDIRLWPYKKVEENTVVNQNLVWGTKASKTIFGFKDICGHINIDINPEFASKLGTAFASTLEEESIVILSSDASNASQMIKNALIAGVHATGAGVINIGNVVMPVNRFAVTDLRGSGGIHVRMDYSDKKLIHIEFVDKIGANIQRNTEREIENVFNREDFKRCNVEQIKSTTNIENFNYYYINNGGRLLKNSSNIKRQNPSLIVSSKSDTIQQLATEFLESIGCDVKQDYNLKGDKRIQDYLVEMTPRIKKGKVNLAVIISEDGEDIILIDGAGRIIEQEKYDALIAMMILKEGKQKKLILPYTAPYIIEEMAHIYGVEVQRVKSNPASIMNAMLAVENGQSQGLSQYTLTYNAIWAIGGILDFLVEKNIKLEDLVDELPNFYYIKEEIPCDWKDKGRIIRQIIEENQHKSIEMFEGVKINDEKGWTLILPDSTKPLFNIYTEGSSQEYAKELSIFFSGKVKELLKNQEE

SEQ ID NO: 86268 - protein, 396 aa, Arabidopsis thaliana
MASVTFSVPKGFTEFSGLRSSSASLPFGKKLSSDEFVSIVSFQTSAMGSSGGYRKGVTEAKLKVAINGFGRIGRNFLRCWHGRKDSPLDIIAINDTGGVKQASHLLKYDSTLGIFDADVKPSGETAISVDGKIIQVVSNRNPSLLPWKELGIDIVIEGTGVFVDREGAGKHMEAGAKKVIITAPGKGDIPTYVVGVNADAYSHDEPIISNASCTTNCLAPFVKVLDQKFGIIKGTMTTTHSYTGDQRLLDASHRDLRRARAAALNIVPTSTGAAKAVALVLPNLKGKLNGIALRVPTPNVSVVDLVVQVSKKTFAEEVNAAFRDSAEKELKGILDVCDEPLVSVDFRCSDFSTTIDSSLTMVMGDDMVKVIAWYDNEWGYSQRVVDLADIVANNWK

SEQ ID NO: 86269 - protein, 499 aa, Saccharomyces cerevisiae
MLRIRSLLNNKRAFSSTVRTLTINKSHDVVIIGGGPAGYVAAIKAAQLGFNTACVEKRGKLGGTCLNVGCIPSKALLNNSHLFHQMHTEAQKRGIDVNGDIKINVANFQKAKDDAVKQLTGGIELLFKKNKVTYYKGNGSFEDETKIRVTPVDGLEGTVKEDHILDVKNIIVATGSEVTPFPGIEIDEEKIVSSTGALSLKEIPKRLTIIGGGIIGLEMGSVYSRLGSKVTVVEFQPQIGASMDGEVAKATQKFLKKQGLDFKLSTKVISAKRNDDKNVVEIVVEDTKTNKQENLEAEVLLVAVGRRPYIAGLGAEKIGLEVDKRGRLVIDDQFNSKFPHIKVVGDVTFGPMLAHKAEEEGIAAVEMLKTGHGHVNYNNIPSVMYSHPEVAWVGKTEEQLKEAGIDYKIGKFPFAANSRAKTNQDTEGFVKILIDSKTERILGAHIIGPNAGEMIAEAGLALEYGASAEDVARVCHAHPTLSEAFKEANMAAYDKAIHC

SEQ ID NO: 86270 - protein, 267 aa, Triticum aestivum
MGFAQLVIGPAGSGKSTYCSGLYQHCETVGRRIHMVNLDPAAEHFSYPVSTDIRELISLDDVMEELGMGPNGGLIYCMEHLEDNLDDWLDEQLENYLDDDYLVFDCPGQIELFTHVPVLRVLVEYLTRKNFPVCAVYLLDSQFVSDVTKYISGGMASLSAMIQLELPHINILSKMDLVSNKKDVEDYLNPEAQVLLSQLNRQMAPRFHKLNKALAELVDDYNMVNFIPLDLRKESSIQYVLSNIDNCIQYGEDADVKVRDFIPEDDD

SEQ ID NO: 86271 - protein, 338 aa, Arabidopsis thaliana
MADKKIRIGINGFGRIGRLVARVVLQRDDVELVAVNDPFITTEYMTYMFKYDSVHGQWKHNELKIKDEKTLLFGEKPVTVFGIRNPEDIPWAEAGADYVVESTGVFTDKDKAAAHLKGGAKKVVISEPSKDAPMFVVGVNEHEYKSDLDIVSNASCTTNCLAPLAKVINDRFGIVEGLMTTVHSITATQKTVDGPSMKDWRGGRAASFNIIPSSTGAAKAVGKVLPALNGKLTGMSFRVPTVDVSVVDLTVRLEKAATYEEIKKAIKEESEGKLKGILGYTEDDVVSTDFVGDNRSSIFDAKAGIALSDKFVKLVSWYDNEWGYSSRVVDLIVHMSKA

SEQ ID NO: 86272 - protein, 232 aa, Oryza sativa Japonica Group
MPKRTTHTYSSEDALPEGPESDLFVYYCKHCASHVLITDTQLQKMPKRKTDRAHVLDKKKHLSRLNVKEAGKVLLKRGEGKLEKQFRMSCLGCGLFVCYRSEEELELAPFIYVVDGALSSVAAETNPHDAPVPPCITQLEGGLVQVAIEVEDRAQRSAITRVNADDVRVTVAAPAARGEANNELLEFMGKVLGLRLSQMTLQRGWNNKSKLLIVEDLSARQVYEKLLEAVQP

SEQ ID NO: 86273 - protein, 414 aa, Legionella pneumophila subsp. pneumophila str. Philadelphia 1
MSFKQLALIEPLNRAVSELGYTTPTSIQLKAIPLILNGHDLLGSAQTGTGKTASFVLPILQKASQQTQTSPNRVKVLILTPTRELAIQVHESIIQYGKYLTLRSAVIYGGVKSHNQIKQLDSGLEILVATPGRLLDLYQQRAVKFDEIDTLVLDEADRMLDMGFIHDIKKIIKLLPLKRQNLLFSATFTPEVRALARNILNKAVEIDIAPRNTAVKTIKQTVYSVDRNHKLALLSHLLHKNNWGQTLVFSRTKHGANKLVKQLAESQIYSVAIHGNKSQAQRIKALADFKSGKVQTLIATDIAARGIDIEKLACVVNFDLPHVPEDYVHRIGRTGRAGASGLAVSLVSTEEIKLLLSIEKLINQKLERIKIKDFEFLHNFSDFVSAKIQKFAPPKAGYKGNISRKSRTAFNKSA

SEQ ID NO: 86274 - protein, 208 aa, Arabidopsis thaliana
VVWDEQTNQFKRRHGYDRVNDDNDVPIIEAKESDEPGVDPFAKRLDDKKKRVGKQEKNRLQNLKAAEKAGALPSHVQLAATSLPISGTKAQPKKIGKDELGDVAGLAATSTASGGKFDKKLPGEKPPKKQGKHHKYLPVVSGRGDVNAEKEQTNNVLSKIFSKHSHEILNVGKAINMYNVKKEKKKSGRSDKLKPKKDITKKPANKAK

SEQ ID NO: 86275 - protein, 108 aa, Arabidopsis thaliana
MASSMLSSATMVASPAQATMVAPFNGLKSSAAFPATRKANNDITSITSNGGRVNCMQVWPPIGKKKFETLSYLPDLTDSELAKEVDYLIRNKWIPCVEFELEHGFVYP

SEQ ID NO: 86276 - protein, 78 aa, Coprinopsis cinerea okayama7#130
MFPLLTPEVLGALIALYEHKIFTQGVIWGINSFDQMGVELGKVLAKKILAQLEKPEDVQGHDSSTTGLIHYYQKWRKE

SEQ ID NO: 86277 - protein, 158 aa, Triticum aestivum
  misc_feature (138)..(138): Xaa can be any naturally occurring amino acid
CRSPGRPTRPREHKYGKDVYPFNFQNGSLIGGGKLDPDIPLSNQEDLIVWMRAAALPQFRKLYGVGAGGLQADETITMHITNNYNTYSFGGKKSLVLTTSTWLGGKNDFLGYAYLITGSSSIFLSILFALIHVKIPRXLIRPHGDAAYLSWSRKNGNN

SEQ ID NO: 86278 - protein, 699 aa, Saccharomyces cerevisiae
MTAQLQSESTSKIVLVTGGAGYIGSHTVVELIENGYDCVVADNLSNSTYDSVARLEVLTKHHIPFYEVDLCDRKGLEKVFKEYKIDSVIHFAGLKAVGESTQIPLRYYHNNILGTVVLLELMQQYNVSKFVFSSSATVYGDATRFPNMIPIPEECPLGPTNPYGHTKYAIENILNDLYNSDKKSWKFAILRYFNPIGAHPSGLIGEDPLGIPNNLLPYMAQVAVGRREKLYIFGDDYDSRDGTPIRDYIHVVDLAKGHIAALQYLEAYNENEGLCREWNLGSGKGSTVFEVYHAFCKASGIDLPYKVTGRRAGDVLNLTAKPDRAKRELKWQTELQVEDSCKDLWKWTTENPFGYQLRGVEARFSAEDMRYDARFVTIGAGTRFQATFANLGASIVDLKVNGQSVVLGYENEEGYLNPDSAYIGATIGRYANRISKGKFSLCNKDYQLTVNNGVNANHSSIGSFHRKRFLGPIIQNPSKDVFTAEYMLIDNEKDTEFPGDLLVTIQYTVNVAQKSLEIVYKGKLTAGEATPINLTNHSYFNLNKPYGDTIEGTEIMVRSKKSVDVDKNMIPTGNIVDREIATFNSTKPTVLGPKNPQFDCCFVVDENAKPSQINTLNNELTLIVKAFHPDSNITLEVLSTEPTYQFYTGDFLSAGYEARQGFAIEPGRYIDAINQENWKDCVTLKNGETYGSKIVYRFS

SEQ ID NO: 86279 - protein, 697 aa, Streptomyces coelicolor A3(2)
MTRSVYVTGIDRGDGRQVVELGVMELLTRQVDRVGVFRPLVHDGPDRLFELLRARYRLSQDPATVYGMDYQEASLLQAEQGVDELVSALVDRFHLVARDYDVVLVLGTDYADTQFPDELSLNARLANEFGASVLPVVGGRKQTADSVLAETHNAFRAYDGLGCDVLAMVTNRVAREDRDEIAERLAHRLPVPCWVVPDEPALSAPTVSQIAHALGAEIVLGDDSGLARDALDFVFGGAMLPNLLAALTPGCLVITPGDRADLVIGTLAAHSAGTPPIAGVLLTLNEVPGEGILTLAARLAPGTPVLSVTGTSFPTAERLFSLEGKLGAATPRKAETALGLFERYVDTAELNKRVSAPSSDRVTPMMFEHKLLEQARSDLRRVVLPEGTEERVLHAAEVLLRRGVCELTLLGPVEQIRKKAADLGIDLGGAELIDPAASELRDSFAEKYAALRAHKGVTVELAYDVVSDVNYFGTLMVQEGFADGMVSGSVHSTAATIRPAFEIIKTKPDAAIVSSVFFMCLADKVLVYGDCAVNPDPDAEQLADIATQSASTAAQFGVEPRIAMLSYSTGTSGSGADVDKVREATELVRSRRPDLSVEGPIQYDAAVEPSVAATKLPGSAVAGQASVLIFPDLNTGNNTYKAVQRSAGAIAVGPVLQGLRKPVNDLSRGALVQDIVNTVAITAIQAQQSPTEKASAQ

SEQ ID NO: 86280 - protein, 193 aa, Prosthecochloris aestuarii DSM 271
MVIVIDNYDSFTYNLVQYLGELGADVHVYRNDEISVDEVLQLEPERIVISPGPGVPEDAGISIALINAVKGKIPLLGVCLGHQAIGQALGGKVVRAAAVMHGKTSQIYHNDTGIFHGLPNPFIATRYHSLIVERQTLPSILKVSAWTADEVIMGMDCRELMLYGVQFHPESIMTHEGKSIIRNFLDLSGHTNE

SEQ ID NO: 86281 - protein, 401 aa, Bacillus licheniformis ATCC 14580
MKLADLRKSGHAPSLLSSFLYFDVSFMIWVLLGALGVYVTADFDLSPSQVGLIVAIPTLAGSFFRIALGILTDRFGPKKTAVGGMLVTMIPLLWGWQFGSSVAELYIIGILLGVAGASFSASLPMASRWYPPHLQGLAMGIAGAGNSGTLLATLFGPRLAEQVGWNGVMGLALIPLTLVLFSYFLMAKEPPNQPAPKPLKDYFAVFKERDTWYFCLLYSVTFGGFVGLSNFLSYFFASQYAVPAVRAGEFVTLVVASGSCLRPVGGLIADKIGGVRLLQFLFIGVALCMFSVSMLPSLGVVTAALFIGMGCLGMGNGAIFQFVPQRFQQEIGMVTGIVGAAGGIGGFFLPNILGTLKQITGTYSSGFLTFTVIAFLALGLLLFAQAGWKKQWKAEEKSIRI

SEQ ID NO: 86282 - protein, 454 aa, Deinococcus radiodurans R1
MSIQSFEEKSVPMTVDRVLDDLGLGRFQWKLLAICGLTWAADAMEVLLMGFALPGISAAFELPKGSPAATMLLTATFAGMLFGAWFWGYLADRVGRRSVFLTTVALGVVFGLAGALAPTLTWLLVARFLTGFAIGGTLPVDYSMMAEFVPTAWRGRFLVYLESFWAVGTVVVAALAWWVSTAFAPAEGWRWLLGLAALPGLVGLIARIGIPDSPRSLLARGEEAQARAALQKVAQANGGTLPAAPLAHPEQPPRVSPAQLFRGVLARRTPLLMVTWFGLSLGYYGIFSWLPSFLRAQGLDLGAVYRSTLLLALAQVPGYLLAAYLVEKIGRRVTLVGFLTLGAVGAYLFLLAHDANTVLLTSALLSFALLGAWGSLYAYTPELFPTPLRTTGMGLVSGVARLASVVSPSIGAMLLTGNLTLALTVFAVCFALAALAAWGIGVETRGQALAETAE

SEQ ID NO: 86283 - protein, 504 aa, Pseudomonas syringae pv. syringae B728a
MLEQYVKKILTSRVYDVAIETPLQGARQLSERLGNQVLLKREDLQPVFSFKIRGAYNKLAQLPAEQTARGVVTASAGNHAQGLALAARELGIKATIVMPRTTPEIKVEGVRSRGATVVLHGDSFPEALAYSLKLVDEQGFVYIHPYDDPDTIAGQGTVAMEILRQQPGQLDAIFVPVGGGGLIAGIAAYVKYLRPEIKVIGVEPDDSNCLQAAMAAGERVVLSQVGLFADGVAVAQIGHHTFEVCRHYVDEVITVSTDEICAAIKDIYDDTRSITEPSGALGVAGIKKYVEQRGVSGQTLVAIDSGANVNFDRLRHVAERAELGEGREAIIAVTIPEQPGSFKAFCEAIGKRQITEFNYRYHTDREAHIFVGVQTHPENDPRSALIASLTGQGFPVLDLTDNELAKLHIRHMVGGHAERVDDEVVLRFEFPERPGALFNFLNRLGGRWTISMFHYRNHGAADGRVVAGLVVPEEERHLVGAALDEIGYRYWDESENPAYRLFLG

SEQ ID NO: 86284 - protein, 223 aa, Pseudomonas syringae pv. syringae B728a
MTQDQLKQAVAQAAVDFILPKLDDKSIVGVGTGSTANCFIDALAKHKAAFDGAVASSQATAARLKAHGIPVYELNTVSDLEFYVDGADESDEHLNLIKGGGAALTREKIVAAVANTFICIADGSKLVPVLGAFPLPVEVIPMARSHVARQLVKLGGDPVYREGVLTDNGNIIIDVHNMSITNPVELEAQINAIVGVVTNGLFAARPADLLLLGTAEGVKTLTR

SEQ ID NO: 86285 - protein, 329 aa, Bordetella parapertussis 12822
MASNIVKAVRIEQHGGPEVLQVVDVEVPPPAANEVTIRQHAAGLNFIDIYFRTGLYPHPLPHGLGFEGAGVVEAVGADVRHLKKGDRVAYGQSPLGAYAQARNVPAAQVVKLPKGIGFDEAAALMLKGLTVQYLFRQTYRLQGNETILFHAAAGGVGLIACQWAKALGVKLIGTVSSPEKAELARAHGAWATIDYSRENVVERLLELTGGKKVPVVYDGVGKDTWETSLDCIEPRGLMVSFGNASGPVAGVNLGILNQKGSLYVTRPSLGVHVNTHEKLAAAADELFGLVLKKKIKVRIDQRYSLAQAGDAQTALAGRKTTGATVLTLD

SEQ ID NO: 86286 - protein, 511 aa, Streptomyces coelicolor A3(2)
MHNPGNATPDRFPAQDRFADGAQYIAGRLTKGTSGRTHTVVDPATGEDVLTYDLAGPDDVDAAVAAARAAFPGWAGATPGERSDALHRFAAVLAERAEDFARAESLQCGKPLKLTREFDVPGTVDNAAFFAGAARHLQGQSAGEYSGDHTSYVRREPIGVVGSIAPWNYPLQMAAWKILPAIAAGNTIVLKPAEITPLTSLMFAQAATEAGIPDGVINVVSGTGREAGEHLVAHPDVAMTSFTGSTAVGKRVAEVATATVKRLHLELGGKAPFLVFDDADLDAAVHGAVAGSLINTGQDCTAATRAYVQRPLYEAFVEKTAALMDTVRVGDPFAPGTDLGPLVSHVQRDRVAAFVDRARSYARVVTGGEVPQGDLKDGAYYRPTLVADAAQDSEVVQSEIFGPVLVVLPFDTDDEGIRLANDTPYGLAASAWSRDVYRANRATREIKAGCVWINDHIPIISEMPHGGYKASGFGKDMSAYSFEEYTQVKHVMFDNTAVAAKDWHRTVFGDR

SEQ ID NO: 86287 - protein, 580 aa, Deinococcus radiodurans R1
MPPGEDPMSHKTLPLTDHYDVKRGEDGHRYLRPLVRGFNLTRIPLLNKGTAFTAEEREAHGLDGLLAPQVDSLEVLIERAYREFSKRGAALEKHVYLRNLQDRNEVLFYALLSHHVEEMLPIVYTPTVGDAVKKFSQIYRYPRGLTLSTRTIERAEQALANVPLNDVRIIVATDSSAILGIGDQGFGGMAISIGKLSLYTVAGGVGPDKTLPVELDVGTGRADLREDPHYLGVKHERLTGEEYFAFIDKFVEATIQRYPKAIIQWEDFSKDAAFEVLARYRKVVPSFNDDIQGTGAVVLAGVLNACRIKGEALKDQVVVVHGAGAGGAGVAAAIREGMHREGLSPDEIARRVFVLDSRGLLTDDRSMEAYKQALATPRALVSGWSGTDLLGVVREAKATVLLGLSGVPGTFDEDIVKAALANTPRPLVFPLSNPTAHSEALPEDILRWTDGAAIVATGSPFAPVEHGGQTHEIGQGNNAFIFPGLGFGAILARVREITDEMVTEAAYALADYTQAHHPGRTYPPVNELSQASVQVAVAVIKQAIKDGVATEFSVRRLSDGELRAFVERKFWEPKFLPYHS

SEQ ID NO: 86288 - protein, 321 aa, Mesorhizobium loti MAFF303099
MQTDSTLHDDAQARGASGRLPSEIWMQDGVRRVEQALARLLCAEDDGETELMAAMRYATLHGGKRTRALLCLATGALADTPAPMLDDVGAAIEMMHACTLVHDDLPAMDDDVLRRGLPTVHVKFGEATAILVGDALQAHAFLTLASLDAPSDNRIALVRELAQAVSAEGAAGGQAMDLSLVGKHVELDRIVAMHRMKSGALVRASVRMGALCAIAEDAAHAALYCALDRYSACFGLALQVVDDILDATADTATLGKTPGKDAAAQKPTCASIMGLQAARQLALDLLRDAGEAIPPLGTRAERLAQMLQRANAYLFKHAPCA

SEQ ID NO: 86289 - protein, 440 aa, Lactobacillus plantarum WCFS1
MSEKFDVVYLGSGHGTFDGAIPLAARGKKVAVIEADSIGGTCPNRGCNAKITLDQPVALKNQVANFQGYGLRGEPTIDWQANFDHERDVIAGLPDMIAGLMTSAGVTLINGRGTFVDDHTIQVADKTYTADKIVIATGQHPHRLDIPGTELAHDSNDFLNLTTLPHHITVIGAGYIGLEFANMALTAGSQVTLLMRGDQALRQFHQPFVERLLAILVEQGLVLKREWVPTAIKSTGDHFEVLSADDKVTTDWILDATGRQPNTANLGLEKIGVDYTAAGITVDDHLQTSVAGIYASGDVLAKDQPKLTPTAIFESQYLTHLFMGDTNAPIKYPAIPSVVFTSPRLAQVGTLPTSDTHDIKVTVNDLKDDWFRQTTRDVTGHNLLVTDDQHRLIGAAELGEQAENTINTLLPAIQYQLTPAQREQLVTLFPSIGAAVWSAI

SEQ ID NO: 86290 - protein, 478 aa, Aspergillus niger
EIRLEDEVYNYLMFWMAQHPSTKRSTQFVASTKISSGARYYDSDDEGDLGDEDEYDENGNVVSDFDDYWAKTVARDKFKRLRFTPAEGSHYFWFRGRLLTFTRAKEENNNTISYMRYVPERLFISCFGRDPTILKELLAEAQRAWVARDGNSTVIYRGQKNGGYTDWVRCMARHPRPLSTVVLDPAQKQSFIKDIKEYLHPRTRRWYSNRGIPYRRGYLLHGPPGTGKTSLCFAASGLLGLPLYLLEPFNLPKGSSWDEDDLMSLFQDLPRRCIVLLEDIDCAGMTSKRAANSTQDDKNKSDPNNANTNPAAAPNTATNTPAGSSTDKKPSEETTDNKGITLSGLLNVIDGVAASEGRILIMTTNHPEKLDAALLRPGRVDMTITFGYAHSQDIRELFSSIYSTLEGDLRSVSPNRRKDAITSHDGKANGVKKTTIGDGMEERPPVSDKIVRLAKDFAAGIPAGEFTAAEVQGYLVEL

SEQ ID NO: 86291 - protein, 473 aa, Oryza sativa Japonica Group
MPAWCSKGSGAMARGRGRWLLPTRLLNVCLAALCRGGSLAAAESVLVDAIRLGLPPDVVTYNTLLAAHCRAAGLEAGLVVMGRMREAGVEPDAVTYNSLIAGAARRGLPIHALDLFDEMLRSGIAPDSWSYNPLMHCLFRSGHPEDAYRVFADMAEKGIAPCDTTYNTLLDGMFRAGYAMNAYRMFRYLQRAGLPVSIVTYNTMINGLCSSGKVGYARMVLRELGRTDHAPNIITYTAVMKCCFKYGRFEQGLDTFLSLLDRGYISDVYPYCTVISALVKKGRLGEANNYCDLMLQNGSRLDSVCYNTLIHMRCQEGKLDDAFELVSMMEDGGLESDEYTFAILVNGLCKMGHIEAAEKQLFYMEIKGMQSNVVAYNCLVDALCKFQEVDAAIRLLQCMKLKDDFTYTSLVHGLCRVGRYHMASKFLRICLHEGNNVLASAKRAVIAGLRSSGFKNDLRKVRVALNMAKLLRP

SEQ ID NO: 86292 - protein, 388 aa, Zea mays
MASATVLKSSFLPKKSEWGATRQAAAPRPPTVSMVVRASAYADELVKTAKTIASPGRGILAMDESNATCGKRLASIGLENTEANRQAYRTLLVTAPGLGQYISGAILFEETLYQSAVDGRKIVDILAEQGIVPGIKVDKGLVPLAGSNNESWCQGLDGLASREAAYYQQGARFAKWRTVVSIPNGPSELAVKEAAWGLARYAAISQDNGLVPIVEPEILLDGEHGIERTFEVAQKVWAETFYAMAENNVMFEGILLKPSMVTPGAEAKDRATPEQVAAYTLKLLHRRIPPSVPGIMFLSGGQSEVEATQNLNAMNQGPNPWHVSFSYARALQNTCLKTWGGQPDKVKAAQDALLLRAKANSLAQLGKYTSDGEAAEAKEGMFVKNYSY

SEQ ID NO: 86293 - protein, 481 aa, Burkholderia sp. 383
MANVTYTDTQLLIDGEWVDAASGKTIDVVNPATGKPIGKVAHAGIADLDRALAAAQRGFDAWRKVPAHERAATMRKAAALVRERADAIAQLMTQEQGKPLTEARVEVLSAADIIEWFADEGRRVYGRIVPPRNLGAQQTVVKEPVGPVAAFTPWNFPVNQVVRKLSAALATGCSFLVKAPEETPASPAALLRAFVDAGVPAGVIGLVYGDPAEISSYLIPHPVIRKVTFTGSTPVGKQLAAMAGLHMKRATMELGGHAPVIVAEDADVALAVKAAGGAKFRNAGQVCISPTRFLVHNSIRDEFTRALVKHAEGLKVGNGLEEGTALGALANPRRLTAMASVVDNARKVGARIETGGERIGTEGNFFAPTVIADVPLEADVFNNEPFGPVAAIRGFDKLDDAIAEANRLPFGLAGYAFTRSFANVHLLTQRLEVGMLWINQPATPWPEMPFGGVKDSGYGSEGGPEALEPYLVTKSVTVMAV

SEQ ID NO: 86294 - protein, 596 aa, Zea mays
MTSTAVGGEPAAGHGYWRWSKADFFPEPSFQSWRAYGGALLSTGPRLRDRVTSRSSEAVEAGTLLAQSENPLRRCLSWVDLAFLGFGSVVGSGVFVLTGQEARFDAGPAIPLAYAAAGFSALLSSFCYAELAGEIPSAGGSFSYLRVELGDLAAFIAAGNILLEAVVGAAGLGRSWTSYLAALIGRDSDALRIHVPALADGFNLLDPIAVVVLCATSALAVSGARLTSTVNSVASAVGIAIIAFVLAAGFSHFEPANLAPSFFPFGAAGVFRAAAVVYWSYTGFDMVATMAEETKNPGRDVPLGLISSMSAITLVYCAMSLALVGMQRYSDIDANAAYSVAFAAAGMKWARYVVALGALKGMTSGLLVGALGQARYTTQIARTHMIPPYFALVHPRTGTPIYATIAVTLGAACVALFSSLDVLASVSSISTLFIFALVAVALLVRRYYVAGTTSPAQARTFVGFLALIVLSSIGLSVYYNSGYAARWPGYVAFGALWAAGTAGLALFAEQQRAPRVYGAPLMPWLPAMSVATNLFLMGSLGSLAYMRFGICTAAMLVYYVLFSVHATYDMVHSEGQTTSAPDAATDGVEQRKIMPV

SEQ ID NO: 86295 - protein, 452 aa, Triticum aestivum
  misc_feature (197)..(197): Xaa can be any naturally occurring amino acid
  misc_feature (234)..(234): Xaa can be any naturally occurring amino acid
  misc_feature (312)..(312): Xaa can be any naturally occurring amino acid
MSAYCGKYKDELIKNAAYIGTPGKGILAADESTGTIGKRFASINVENVEDNRRALRELLFCTPGALQYLSGVILFEETLYQSTKGGKPFVDILKAGNVLPGIKVDKGTIELAGTNGETTTQGFDDLGKRCAKYYEAGARFAKWRAVLKIGATEPSQLSIDQNAQGLARYAIICQENGLVPIVEPEILVDGPHDIDRXCAYVTEIVLAACYKALNDQHVLLEGTLLKPNMVTPGXSDSKKVAPEVIAEYTVRTLQRTVPAAVPAIVFLSGGQSEEEATLNLNAMNKLQTKKPWNLSFSFGRALQQSTLKAWSXGKTENEEKARAAFLVRCKANSEATLGTYKGDATLAEGASESLHVKDYKYEAAEDGREKRQGEQAGVWSPVTCESTKEEGRLRSTHDLASSVGGSSRPCQRWDLWMGIIALLWSDLMCHIFSTSAVSIVHTVSCCLRLRRL

SEQ ID NO: 86296 - protein, 368 aa, Populus trichocarpa
MANSKGSANIRNLMYSGKHPLLPPKSPFPSVSPSYIDHVPSNSFGSKTAQKPREGNTHHQRTSSETLFIEEQPSWLDDLLNEPETPVRRGGHRRSSSDSFAYIDVANASNIDYAEQDDYMYKNVMSIPSWRSHDFDHHQDVRQASLYSEMNLTKQKNRVWDSSLNAPTFPSSLSSVRENAGMQSSGSSCAPREADCVSESEKQDPLDGPHDPKISLEKKDSSNSKSSASDTDTKRAKQQFAQRSRVRKLQYIAELERNVQALQAEGSEVSAELEFVNQQNLILSMENKALKQRLENLAQEQLIKYLEHEVLEREIGRLRALYQQQQQPQQMKPSSHRRSNSRDLDSQFANLSMNANSSRDPVTGSLRI

SEQ ID NO: 86297 - protein, 208 aa, Oryza sativa
MAAAEAAAEAAAALEGSEPVDLLNHPSGIIPTLQNIVSTVNLDCKLDLKAIALQARNAEYNPKRFAAVIMRIREPKTTALIFASGKMVCTGAKSEQQSKLAARKYARIIQKLGFAAKFKDFKIQNIVGSCDVKFPIRLEGLAYSHGAFSSYEPELFPGLIYRMKQPKIVLLIFVSGKIVLTGAKVRDETYTAFENIYPVLTEFRKVQQ

SEQ ID NO: 86298 - protein, 444 aa, Bacillus licheniformis ATCC 14580
MKRQAKKGDLKWWQLSMIGVGCTIGTGFFLGSSIAIKKSGFSVLAAFLLAALGTFLVFQQLAKLTADHPVEGSFCSYAREAFGNWAGFSNGWVYWSSEMLIIGSQLTAISLFTRHWFNEIPLWVFASIYAILGLIVIFTGRSSFEKTENILAVLKTAAILMFIIIAVLALCGLLPGKTPEVQFPDRVHELFPFGFMGLWTGLIYTFYAYGGIEVMGLMAIHLKDPKDSSKSGSLMLITLAVVYVVSIGLAMLLVPRGTFTEQNSPFITSLKDFHLDLIMDIFNGIFIIAGFSTLTASLFAVTTLMGTMAKNGDAPACFAKKEKAKVSWPALGLTVLVLAASIVLSLILPKQLYEHMTTAASLMLLYNWMFILLSSKKLTKPKMKGNVQIVTALVLILFAVSGTLFEKNSRPGFFVSLLFLAVIAAVTMLMKKKWADQEEKNGQT

SEQ ID NO: 86299 - protein, 711 aa, Oryza sativa Japonica Group
MDPAPATPRWNLERPYLTGRFHQEAKVAAAAQGAGSKPYSLDSFSRGGGGGGGAESVIGSYAVSVQELLVIDDLLSALVGIEGRYISIKRVRGKEGYVVFQIDSSMDLALQELTRRIFPLCEDFVLVYHFVESRSHFKSGLVNHALAAALRAFLLDYQAMVAQLEHQFRLGRLSVQGLWFFCQRMMSSLNALAVLVEKAISNNTSGSATLNLLQSQAKAMAGDSAVRSLLEKMTECASAAYLRMLERWVYEGVIDDPYGEFFIAENKSLQKESLTQDYDAKYWQQRYSLKDGIPSFLTNVAATILTTGKYLNVMRECEYTVQVPLSESSKLMGFGSNHQYLECIKSAYDFASGELLTLMKDKYDLIGKLRSLKRYLLLDQGDFLVHFMDIAREELTKKPEEISVEKLQSLVDIALRSTAAASDPSHEDLTCCVERSSLLKKLSTLKDLDCAYPSDKLVAADVDHPMPLSVTGLETFCLSYKVQWPLSLVISRKSLTKYQLIFRLLFHCKHVSRQLCTAWQIQQGFRSVKILGTPVLRSSILCRSMLKFVNSLLHYLTFEVLEPNWHLMHDRLQTARSIDEVIQIHDFFLQKCLKECLLLLPELLVKIEKLKALCLQYATSIQLLIPSIDVAKPENTSKSRMPRSKIKETKNRGQQLKLASENVVMSESILKFEAEFNSELQSLIPTLSNSSQAEPYLTHLGQCILGVGVDQ

SEQ ID NO: 86300 - protein, 405 aa, Pseudomonas sp. KD
  misc_feature (404)..(404): Xaa can be any naturally occurring amino acid
MVTDALEQWARQQRARLTSCSAVRISGKVSAVSGILLECQVPAAKIGDLCEVSKADGSSMLAEIVGFTDQCTLLSALGTPAGIQVGARIQPLGIAHRIGVDDQLLGSVLDGFGRPLLGDGLGAFADVHDCRSTTAVIADALPPMQKPRISNPLPTGIRAIDSAILLGEGQRVGLFAGAGCGKTTLLAEMARNMDCDVIVFGLIGERGRELREFLDHELDDELRQRSVLICATSDRSSMERARAAFTATAIAEAYRQRGMKVLLLIDSLTRFARAQREIGIAAGEPIGRGGLPPSVYTLLPQLVERAGMSENGSITAIYTVLIEADSMNDPVADEVRSLLDGHIVLSRKLAERGHYPAIDVSASISRILGNVTSREHVQANNRLRQLMAAYKQVEMLLRLGEYQXG

SEQ ID NO: 86301 - protein, 352 aa, Chlamydomonas reinhardtii
MGHNFLSLEDYTPPDWASGIPLAPSRRFRLGMLPTPIHEWRLPGLPEGVRVLVKRDDLSGMQLSGNKVRKLEFLLAAAAAGGHDCVVTIGGIQSNHARATAVAARYLGLDCHLILRTSRQDVDSDPGLVGNLLVERLAGAQLHMVTKEEYGAVGSTALLEQLALELQAAGKNPYVIPVGGSSALGTWGYLQAIDEIIHQSREMGETITDIAMACGSGGTTAGLALGSHLSGLGARVHAYGVCDTPSYFYDYINGLFQGLGLEALAVQSLLRAVQARGAGYAISTEEELATVQAVAAATGVVLDPVYSGKAVHALLREVRADPGAWRGRTVLFVHTGGLLGMYDKLDQLGPLV

SEQ ID NO: 86302 - protein, 384 aa, Solanum lycopersicum
MGSLCSRNKHYSQADDEENTQTAEIERRIEQETKAEKHIQKLLLLGAGDSGKSTIFKQIKLLFQTGFDEEELKNYIPVIHANVYQTTKILHDGSKELAQNELEASKYLLSAENKEIGEKLSEIGGRLDYPHLTKDLVQDIEALWKDPAIQETLLRGNELQVPDCAHYFMENLERFSDVHYIPTKEDVLFARIRTTGVVEIQFSPVGENKKSGEVYRLFDVGGQRNERRKWIHLFEGVTAVIFCAAISEYDQTLFEDERKNRMMETKELFEWVLKQPCFEKTSFMLFLNKFDIFEQKVPKVPLNACEWFKDYQSVSTGKQEIEHAYEFVKKKFEESYFQCTAPDRVDRVFKIYRTTALDQKLVKKTFKLVDETLRRRNLFEAGLL

SEQ ID NO: 86303 - protein, 303 aa, Bacillus cereus ATCC 10987
MKRWQMEWLLVSVALVWGANYTIGKYGVAFMSSIQFNSLRFLVASPVLLLITFLMERSLRIERKDWLRLVAVGIVGTTMYQTMFMLSVKYTSATNASLLIAMSPIFTGILAVLHKQERFSMKVQIGSIVAFIGAAFVLLTGHTGGATYEYAWLGNIIGLVAAIAWGWYPILAQPLITKYSAMRVTSWSTLIGIVPLVIYCLFNVNTLTWPVDTPSWGSLAYSIVFATIFGLAMWYVGISQIGSTKVMVYMYLVPLFAVIFAAVIIGEQINMMQLVGGLIIFIGLYVVKKGGMKKPALNLKKVS

SEQ ID NO: 86304 - protein, 308 aa, Chlamydomonas reinhardtii
MTCTPTSRRLSASRARTDLEAAREECSMAVCGAVEGLLNKTGLRPKDIDILVTTCSVFCPTPSMASMLVNKFGMRSDVQSYHLGGMGCANGVVGINLVADLLKAHPNSTAVFVTTETLSANYYAGRDRHRLLGLLLFRMGGAAVCLTNKPGLRARAKYELLHRVRVHMGQSDDAFRAIRHCEDSEGLLGVYLGKNVCKEASKAMQLAMIEERRPESTIRHFILHAGGAKVLDGLGEALQLDASRLGPSRDTLWDYGNVSSSTTWYALAHVETVGGVRRGERVLQVGVGSGIKCGVNVWKALRDIHEEQ

SEQ ID NO: 86305 - protein, 272 aa, Streptomyces coelicolor A3(2)
MTDVTPDPLRADLLKIAQEAAHRAGELLRDGRPADLAVAATKSSPIDVVTEMDIAAEKLITGLIAERRPDDGFLGEEGAAMEGTSGSRWVIDPLDGTVNYLYGLPTWAVSIAAEQDGERVAGVVVAPMRGESYHAVLGGGAWATGAWEGERRLVCRSAAPLDQALVSTGFNYVADVRAEQAEIARRLIPLVRDIRRGGSAAIDLCDVAAGRLDGYYERGLHPWDLAAGDLIAREAGAVTGGRPGERPTGALTIAATPAVFEPLQRLLTDFGA

SEQ ID NO: 86306 - protein, 464 aa, Pseudomonas syringae pv. phaseolicola 1448A
MAVYNYDVVVLGSGPAGEGAAMNAAKAGRKVAMVDSRRQVGGNCTHLGTIPSKALRHSVKQIIQFNTNPMFRAIGEPRWFSFPDVLKNAEMVISKQVASRTSYYARNRVDVFFGTGSFADETSVNVVCSNGVVEKLVANQIIIATGSRPYRPADIDFSHKRIYDSDTILSLGHTPRKLIIYGAGVIGCEYASIFSGLGVLVELVDNRDQLLSFLDSEISQALSYHFSNNNVMVRHNEEYERVEGLDNGVILHLKSGKKIKADALLWCNGRTGNTDKLGLENIGLKANGRGQIEVDENYRTSVSNVYGAGDVIGWPSLASAAYDQGRSAAGSMVDNGSWRYVNDVPTGIYTIPEISSIGKNEHELTQAKVPYEVGKAFFKGMARAQISGERVGMLKILFHRETLEVLGVHCFGDQASEIVHIGQAIMSQPGEANTMKYFVNTTFNYPTMAEAYRVAAYDGLNRLF

SEQ ID NO: 86307 - protein, 478 aa, Rhizobium leguminosarum bv. viciae 3841
MAEAATPKIGSVGRVTQVIGAVVDVAFEGELPKILNALETSNNGNRLVLEVAQHLGENVVRTIAMDSSEGLVRGQEVADTGAPIMVPVGNETLGRIMNVIGEPVDEAGPLVTAHKRAIHQDAPSYVEQSTESQILVTGIKVVDLLAPYARGGKIGLFGGAGVGKTVLIMELINNVAKAHGGYSVFAGVGERTREGNDLYHEMIESNVNKHGGGEGSKAALVYGQMNEPPGARARVALTGLTVAEHFRDQGQDVLFFVDNIFRFTQAGSEVSALLGRIPSAVGYQPTLATDMGQMQERITTTTTGSITSVQAIYVPADDLTDPAPATSFAHLDATTVLSRSIAEKGIYPAVDPLDSTSRMLDPMVVGEEHYEVARKVQSTLQRYKALQDIIAILGMDELSEDDKIAVARARKIERFLSQPFFVAEVFTGSPGKLVALEDTIKGFKGLVNGEYDHLPEAAFYMVGSMEEAVEKAKKLAAA

SEQ ID NO: 86308 - protein, 905 aa, Paracoccus pantotrophus
MPDPSSFSPMQQQKALWLSTTAFTLCFAVWTIFSIIGITIKEELGLTEFEYGVLIATPILTGSLVRLILGVWTERYGGRLVFSLQMLFTGLATWALTWADSYAGFLLAALGVGMAGGSFIIGVAYVSKWFPAQRQGTALGIFGMGNVGAAVTKFIAPFILVAWGWQAVAQIWAVGIALMGVVFLLVARDDPDFEARRAQGIAGPTLAEQFAPLKKLQVWRFALYYFFVFGGFVALALWLPHYLTQVYGVDLRVAGMAAAAFSLSASIFRAYGGILSDRFGARTVMYWTFGFSALFLFMLSYPPTDYTIRGKDGLISFSTEMGLWPFVVTLFALGFFMSLGKAAIFKHIPVYYPNHVGAVGGLVGMIGGLGGFVLPIVFGAALDLTGIWTSCFALLLLIVVVSMAWMHLSIRAMERRAQGRALDRLPNFPELAEVHDPERTVMPRVLDDWRPENPTFWAEQGRRIARRNLWISIPALTLAFAVWMVWSVVVAKLPLIGFGFTQDQLFWLAALPALSGATVRIFYSFMVPIFGGRLWTTLSTASLLIPAMGIGYAVQDPATPYVIFVALALLCGLGGANFASSMANISFFFPKSEKGNALGLNAGLGNLGVSLMQFLVPIVITMGVFGAMGGAAQELSDGSRLWMQNAGFIWVPFIIASTIAAWLGMNDITDARASFREQAVIFTRLHNWVMCLLYIGTFGSFIGYSAGFPLLIKLAFPDVNALQFVFLGPLVGALSRAGTGWLSDRVGGGRVTFWVFAGMIASVGLVIVSLQALSFWGFFAGFMALFFFTGVGNSSTFQMIPVIMRKEVARLEPQLSPEDRRRQSDRESAAIIAFTSAIGAYGGFFIPKAYGSSIALTGSAIGALWAFLGFYVLCLAVTWVFYTRPGGLLHDIERGRASAGAASPA

SEQ ID NO: 86309 - protein, 144 aa, Fuchsia cylindracea
NVLDKIKEFSERVRNGSWVGATGKVLKDVIAVGIGGSFLGPLFVHTALQTDPEASKNASGRALRFLANVDPIDVARSISGLNAETTLVVVVSKTFTTAETMLNARTLREWISSALGSSAVAKHMVAVSTNLPLVEKFGIDPKNA

SEQ ID NO: 86310 - protein, 285 aa, Physcomitrella patens subsp. patens
MGEMEAGFAKLQGEDFEYYMQTYSIVLGRNSKKSSVDVDLAGLGGGMNISRQHARILYDFEMQRFVLEVLGKNGCYVEGVLHYPGTSPVKLDSQDLLQIGEKRFYFLLPAKKIARSVASGSSPINPRKRAVGGSRAASATLASAPWMAQQEVEPSPPQGSTTGAREGHGYDEEGADVLHEQAEEREVVKIILEKLKSQYHPGEWMAVSKLHADILDHFRNRQMSPQLMSIMGVDEDGQELDGKGNGKAWSGLVSLLKKYQGNFVINTKLKGGIRVEYVSLYPEEQ

SEQ ID NO: 86311 - protein, 460 aa, Zea mays
MAATAAALRCCFPGSSGVGSGFVKPNSSRRGWCAAAVAAPSREAEPVSSLGHRTRVDFPILHQEFDDAKLVYFDNGATSQKPCSVMKTLDEYYRSYNSNVHRGIHALSAKATHAYEDARRKVANFVNAADSREIVFTRNATEAINLVAYSWGLSNLKEGDEIVLTVAEHHSAIVPWQFVSQKTGATLKYVGLTKENVPDIEQLKGFLSNKTKIVVVHHVSNVLGSMLPIEEIVTWSNRVGAKVLVDACQSVPHMPVDVQKLGADFLVASSHKMCGPTGVGFLHGKFEILSSMEPFLGGGEMIADVFEDKSTYAEPPSRFEAGTPAIGEAIGLGAAIDYLSCIGMEQIHEYEKELGTYLYESLLSVPNVQIYGPAPSQTVHRAPLCSFNIENVHPTDIAEILDLQHSVAIRSGHHCAQILHRTLGINASARASLHFYNTKDEVDTFVDALKATVDFLTDRY

SEQ ID NO: 86312 - protein, 180 aa, Bacillus licheniformis ATCC 14580
MAERMVGKQAPRFEMEAVLANKEFGKVSLEENMKNDKWTVLFFYPMDFTFVCPTEITAMSDRYDEFEDLDAEVIGVSTDTIHTHLAWINTDRKDNGLGQLKYPLAADTNHEVSREYGVLIEEEGVALRGLFIINPEGELQYQTVFHNNIGRDVDETLRVLQALQTGGLCPANWKPGQATL

SEQ ID NO: 86313 - protein, 357 aa, Clostridium pasteurianum
MKEFKIAVIPGDGIGPDIVREAVKIMTKVGEKYDTKFNFVEVKAGGDAIDAYGEPLPKETIDVCKSSAAVLLGAVGGPKWDNLEGSKRPERALLGLRGALGLYANLRPAKVYNVLKSASPLKNEIIDEGVDLLVVRELIGGIYFGDRGTKEVNGVETAFDTEKYNVDEVKRIAHSAFKAAMKRRKKVTSVDKANVLDASRLWRKTVNEVSKEYPEVELSHLYVDNTAMQLVRKPSQFDVILTNNIFGDILSDEASMITGSIGMLASSSIREDSFGMYEPIHGSAPDIAGLDIANPLAQILSAAMLMEYSLDMSEAARDVEAAVEKVLNEGYRTADIYIEGTKKVGTSEMGNLVLERL

SEQ ID NO: 86314 - protein, 136 aa, Fuchsia cylindracea
VSIDGLPLPFESGEIDFGEPGTNGQHSFYQLIHQGRVIPCDFIGVVKSQQPVYLKGEVVNNHDELMSNFFAQPDALAYGKTPEQLKKENVSEHLIPHKTFTGNRPSLSILLPSLDAYRIGQLLAIYEHRVAVQGFI

SEQ ID NO: 86315 - protein, 134 aa, Hauya heydeana
ERVRNGSWVGATGKELKDVIAVGIGGSFLGPLFVHTALQTDPEASKNARGRELRFLANVDPIDIARNISGLNPETTLVVVVSKTFTTAETMLNARTLREWISSALGPSAVAKHMVAVSTNLPLVEKFGIDPNNA

SEQ ID NO: 86316 - protein, 312 aa, Thermus thermophilus HB27
MTDLEAPLRRFEEALSELVQSDVLFIRLIHQDLVTAGGKRIRPRLVFLASRALGGAPFELELALAVELLHSATLLHDDLIDDAETRRGKEAAFRKYGNAVSVLSGDFLLSRLLHVIAKTGRMELVERFAEVAKTLSEGEVLQFQVAALEDYSLENYERIITAKTAVLMALATEGPALLLGAESRVREALYRYGLLYGQAFQMRDDYLDLMGTPEVLGKPVGGDLREGKATLIPLLLMERYPEVREVLRRRAREAGDLERVRALARESGAAEEAVRRIRERAEAAAQALEALPPSPFREALRELALKEAERVR

SEQ ID NO: 86317 - protein, 450 aa, Azoarcus sp. BH72
MPFQSSSDLLQRSLAAVWHPCTQMKHHETLPLVPIVRGEGAWLIDADGRRLLDGISSWWVNLFGHCNRRINAALREQLETLEHVMLAGFTHPPAVELAERLAALTGHRLGHAFYASDGASATEIALKMSVHYWRNRGEAGKNRFISLAGSYHGETAGALAVTDVALFRDAYAPLVRPGATVPTPDIRLAVAGESASSLARRAAQALEAHLAEHHAETAALIVEPLVQGASGMVMYDAEYLRQARALCDHYQVHLIADEIAVGCGRTGTFFAWEQVAADDAAGWPDFICLSKGISGGYLPLSLVLSSDDIYAAFYDDSSTRAFLHSHSYTGNPLACRAALATLDIFREDDVVAENRGRAERMRRQADERFANHPAVRHLRQQGMILAFDVDTGTLGAGEFARRFFAAALDHGLLLRPIGNTVYFMPPYVLGEDELRHLVDGAAAALERALR

SEQ ID NO: 86318 - protein, 334 aa, Erythrobacter sp. NAP1
MSKQALPKPFLPLIGERTLFQQSIDRVSGRPNFAKPTVVAGEAHHGLIADQASGDIRIVIEPCARNTAAAIAIAAHSLSPDDIMLVCPSDHHISDESTFHSAAMAAARLASQDWLVSLAIEPTGPATGYGYLQTGEALGGGNRIGRFVEKPDLETAKRFLASGNYSWNAGIFAFRAGFLLDELNSHRPEMAALVAESFRKGQKTDTTFRPAPSPFEQIAGESIDYAVMENTSRAAMVAADMGWSDIGDWDSLAKAICEDAGRANEDGNVAKGRADFLDSEGVLTFSDGPRVSVVGLENICVVVDGDEVLVTSRDQAQLVGKLPGASSKGGAKCR

SEQ ID NO: 86319 - protein, 576 aa, Lactobacillus plantarum WCFS1
MAEKVLKGIAASDGVAIAKAYMLVDPDLSFEKTTVSDTDAEVARLHDAFDASKAELKVIKDKAVENLGEEEAEVFEAHITILSDPEMLGQIEGKIKDDKVNAEEALKEVTDTFISMFEAMTDNAYMQERAGDIRDVTKRVLSHLLGVTLPSPALIDSEVIVVAHDLTPSDTAQLDRKYVKGFITDIGGRTSHSAIMSRTLEIPAVVGSESATTDIKEGDTVVLDGINGDALVAPTDAEVADYQQKAKDFVAQKAEWAKLKNEATVSKDGKHFELASNIGTPDDMDGVLDAGSEAIGLFRSEFLYMNSSELPDEDTQFEAYKKVVEGMNGKPVIVRTMDIGGDKELPYLPLPDEMNPFLGYRAIRISLDRDDIFRTQLRALLRASHYGQLRIMFPMIATLDEFRKAKAIFEEEKAKLVAAGTPVADDIKLGIMIEIPAAAILADQFAKEVDFFSIGTNDLIQYSFAADRGNEQVSYLYQPYNPSLLRLIKHVIDAAHANGRFTGMCGEVAGDQIAVPLLMGLGLDEFSMSSTSVLKTRSLMKKLDTKEMAKLADKALNECVTNEEVKELVEKNVFGK

SEQ ID NO: 86320 - protein, 381 aa, Mycobacterium smegmatis str. MC2 155
MEVSGALLLELGVILVALTVLGTAARRFALSPIPLYLVAGLALGEGGLAPVPATVEFVNTGASIGVVLLLLTLGLEFSIGEFASSLRRHLPSAWIDLVLNALPGAIAGWLLDLGAVGILALAGVTYISSSGVIARLLGDLRRLGNRETPAVLSILVLEDFAMAAYLPLLAVLAAGGTLLHALLGMAVAIAALVVAFVVSYRWGHHVTRFVSHPDNEQLLLRVLGLTLIVAALAEFIHASAAVGAFLVGLTLTGDSAHRARLVLSPLRDLFAAIFFLAIGLSVHPSDLIPMLPAAFVLAVVTAGTKVLTGQFAARRDGVARAGQLRAGTALIARGEFSLVIIGLVGQTYERLEAIATPYVFILAIAGPVLTRYLGARPVVRT

SEQ ID NO: 86321 - protein, 395 aa, Nocardia farcinica IFM 10152
MKAVTWQGRRKIAVDEVPDPRIQQPTDAIVRITSTAVCGSDLHLYEVLGPYMTPGDVLGHEPMGIVEEVGAQVRDLKPGDRVVVPFQISCGHCAMCDTGLPTQCETTQVRSQGSGAALFGYSELYGQVPGGQAEYLRVPYADHTHITVPEGPDDQRFLYLSDVLPTAWQAVEYAAVPDGGSVTVLGLGPIGDMACRVAAHRGYRVIGVDRVPERLSRVAARGIEVIDFSAVDADLGDVIRDRTDGRGTDAVIDAVGMEAHGSPIGSVAHRSAALLPDVVARKVMDTAGVDRLAALHEAIDIVRRGGTISLVGVYGGMVDPLPMRVLFDKQIQLRMGQANVTRWAPEILPLLTDDDPLGVDTFATHRLPLSKAPAAYEMFQQKADGAVKIVLDPAA

SEQ ID NO: 86322 - protein, 176 aa, Triticum aestivum
  misc_feature (160)..(160): Xaa can be any naturally occurring amino acid
MGPQPVMASSATTVAPFQGLKSTAGLPVSRRSGSAGLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNMRQVQCXSFIAFRPPGCEESGKA

SEQ ID NO: 86323 - protein, 157 aa, Desulfococcus oleovorans Hxd3
MPKLMEAGLSAKGKTFALIASRFNDFITDRLVSGAVDALVRNGAADKDIHLVKVPGAFEIPLLAKKMAEKGEYDAIVCLGAVIRGSTPHFDYVCAEVSKGIAQVSLEFSVPVIFGIVTTDTIEQAIERAGTKAGNKGWNAAVSAVEMANLMEVVTRA

SEQ ID NO: 86324 - protein, 404 aa, Desulfococcus oleovorans Hxd3
MAVLSIEEAIKDVRAGKMVILVDDEDRENEGDLMIAAEKTTPEAVNFMAKYGRGLICLALDAKKVEELDLPLMVDRNTSPFGTGFTVSIEAKQGVTTGISAADRATTILAAVADGARPDDLVRPGHIFPLRARRGGVIVRAGQTEGSVDLARLAGLKPAGVICEVMNDDGTMARMPQLEEFSEAHGIGICTIADLIEYRMRTESFVRKVVETTIPSMFGGIFKVIVYENDMEDFQHIALVKGEIDPDKPVLVRVHSECLTGDIFGSLRCDCGNQLHKAMEMMEKEGAGILLYVRQEGRGIGLVNKLKAYNLQDQGYDTVEANEQLGFKADLRDYGIGAQVLADLGVKKMRLITNNPKKIVGLEGYGLSVVEQIPIEIEANEHNKRYLECKKLKMGHLLNLDCTP

SEQ ID NO: 86325 - protein, 256 aa, Streptococcus thermophilus CNRZ1066
MEDIMPKNVLIIGATSGIGEATARAFAREGANLILTGRRVERLEALKAEFEATYPNQKVWTFALDVTDMEMVKDVCQAILKSVGQVHVLVNNAGLALGLIAYQDYEEWDLLTMLDTNVKGLMMVTRQILPSMVATNEGHIINMGSKAGIYAYAGAAVYSATKAAVKTFSDGLRIDTIATDIKVTTIQPGIVETDFSQVRFHGDKDKAAKIYQGLEALQAQDIAEAVLYVTKQPRRVQISDMTIMANQQATGFTIHR

SEQ ID NO: 86326 - protein, 133 aa, Vitis vinifera
MKPVTGVGRVTIKRTKNILFFISKPDVFKSPNSETYVIFGEAKIEDLSSQLQTQAAQQFRMPDMGSVMAKSDISAAAAGTQADEEEEVIDETGVEPRDIDLVMTQAGVSRSKAVKALKTHNGDIVSAIMELTT

SEQ ID NO: 86327 - protein, 642 aa, Streptomyces coelicolor A3(2)
MPLLTRITGPRDLDRLSLEELTQLAEEIRTFLVDAVSKTGGHLGPNLGVVELTLALHRVFESPKDKVLWDTGHQSYVHKLLTGRQDFSKLKMKGGLSGYPSQGESEHDVIENSHASTVLGWADGIAKANQVMERDDHVVAVIGDGALTGGMAWEALNNIAAAKDRPLVIVVNDNERSYAPTIGGLANHLATLRTTDGYERFLARTKEVLERTPVVGRPLYDTLHGAKKGLKDFIAPQGMFEDLGLKYVGPIDGHDLEALESALTRAKRFGGPVIVHCLTEKGRGYQPALQDEADRFHAVGKIHPDTGLPISTSGADWTSVFGDEMLKLGKEREDVVAITAAMLQPVGLDKFAKAFPDRVYDVGIAEQHGAVSAAGLAHGGVHPVFAVYATFLNRAFDQVLMDVALHKCGVTFVLDRAGVTGTDGASHNGMWDMSILQVVPGLRLAAPRDADQVRAQLREAVVVDDAPTVVRFSKGAVGPAVPAVGRVGGMDVLRAPGTGTPDVLLVSVGALAPMCLEVADLLNKQGISTTVVDPRWVKPVDEAMAPLAERHRVVVTVEDNSRVGGVGSAVAQALRDAGVDVPLRDFGIPPRFLDHASRAEVLAEIGLTAPDIARQVTGLVARLDGRYDRAGAEVDQVEAARD

SEQ ID NO: 86328 - protein, 306 aa, Vibrio vulnificus YJ016
MNKLVVLGSVNADHVLQVPSFPRPGETLHGRNYQVIPGGKGANQAVAAARLGADTGFIACVGDDSFGINIRENFKLDGIQIDGVKMQPNCPTGIAMIQVSDSGENSICISAEANAKLTEAAIESDLPRIRDARFLLMQLETPICGIELAAREAKAAKTNVILNPAPARTLSDELLACIDVITPNETEAQVLTGIEVVDNESAQQAANVLHQKGIEIVMITLGSKGVWLSENGRGQRICGFKVDVTDTTAAGDTFNGALVTGLLEDMPLESAIKFAHAAAAISVTRFGAQTSIPTRKEVDEFLAAHS

SEQ ID NO: 86329 - protein, 371 aa, Helicobacter hepaticus ATCC 51449
MLLFTPGPTPVPESIRNAMSEPTLHHRTPEFEAIFAQARKGLLEILKMPEVLMLASSGTGAMEACVCTFTQNKVLSINSGKFGERFGKIAKAHKIPYTEIINDWDTPVSAKSVLEVLQKESEIDCFCIQMCESAGGLRHPVEEIAQAIKAHNPRIVVVVDAITAMGVEEIDTTYIDALIGGSQKAFMLPPGLSIIGLSHYAIELANERNIGFYFNLKTELKNQAQNTTAWTAPTTIITGLTRYFELINGNMQQVYAQTKARSLATQKALESLGLKIYPKSPAIAMNTIYDEVNAAPLRKILKNEFALNVAGGQDKLKTSIIRINQMGLIALNESVWVVNAIELALERLNLRKFDGTGNKVFLTTYYEILDK

SEQ ID NO: 86330 - protein, 250 aa, Mesorhizobium loti MAFF303099
MHRRNLIRAFIALGVCPICAQTARAASAHWGYGGSVGPEHWADLDTRNFACSAGRQQSPIDIAGTVKADIPRIDISWLKGGGRMVNNGHTIQINMPEGSTLTRGDRVYQLAQLHFHAPSEHHVAGMSFPMEAHFVHKDTKSDTLGVLSALLMPGATNNSFAGLAKVFPARPGEEMAVDEFDPNGLLPASLGYWTYEGSLTTPPCTENVEWMVAMEPVEVDTADIKRFTTLYASNARSIRPSNRRFILGLS

SEQ ID NO: 86331 - protein, 87 aa, Hauya heydeana
GGRYSVCSAVGVLPLSLHYGFAVVEKFLQGAHSIDQHFSSAPFEKNIPVLLGLSSVWNVSFLGYPARAILPYSQALEKFAPHIQQVS

SEQ ID NO: 86332 - protein, 303 aa, Bordetella parapertussis 12822
MKQSHLACADWLRERAQHVEHVLDELLPGADIAPTRLHEAMRYAVLGGGKRVRAVLVYAAGQACPVNGSTLAVGASMDRAAAAVELIHAYSLVHDDLPCMDDDTLRRGRPTVHVQFDEATAMLAGDALQPLAFELLAGMPIAPALVVQAAQVLARAAGSQGMAGGQAIDLHSVGRMLTRDELQTMHSMKTGAMLACSVTLGGIVAGASSTARQALDSYAQAIGLAFQVVDDILDVTADTASLGKTAGKDAADNKPTYVSLLGLDQARALAQELRQAAHQALAPLGESGARLGQLADFIVLRDR

SEQ ID NO: 86333 - protein, 764 aa, Oryza sativa Japonica Group
MGISNALQWWEEWQLRVLLLGSLAFQYFLFITASRHKFPIRSYLRSFIWFVYLGSDALAIYALATLFNRHKKQDVGHTHNNDVLEILWAPILLIHLGGQDSITAYNIEDNELWMRHVLTALSQITVAIYVFCKSWPGGDRRLLQSAILLFVPGILKCLEKPWALNRASINSLVSFDEKVRRTINRQGKQIDSIEDFVRSARGFFCGNDHLEKPSRSADFTPDELFVDLASPCTDNRVRKLMSFSALCGDEAYYLLQNNLSDTFDLLYTKEKMSLKTPPTEELETGLHHFVELYKQLNYTLFSSLSEFFGTVIRELAMFLPFTAIGLFHQSNRKSYNDKDVKVTYALLCCTAVIEFYNPFVKVFTSVTLNQRSSSVSKLSQRPRQRYLYQHQDDMVSQYNLLGYFVRNKKHSTIMNFVGFFGCRNYLDRRWRMKSCFSSRSITNVVLGHVKRWWKDHITDVFTYRMFNDIRGQWSLKVEGCFQGLGWSLEGAFDESVLLWHLATDLCFYHISPSHGREHATTMCIERSSGLNNRCPTWCEKSIHHKNAVQCREMSNYMTYLLFVNPEMLMPGTRRNLFTDAYNELKGVVKEKNPPLDERELAERIIAEVQQQLEEITGEDKSPSSKRGLIEDAWSIAEELLKLEDDEKMWRVIEGVWVEMLCFSAARCRGYLHAKGLGTGVEFLSYVWLLLHYMGMETLAEKLARGDLQNRGHSGNLRTFHVRESSGEEQVAGPSTSYANGDNGDQHVVAPFSEDGFTLAGDENV

SEQ ID NO: 86334 - protein, 620 aa, Bordetella parapertussis 12822
MTTELLDRILSPADLRQLDRRELKRLADELRGFVLESVSRTGGHLSSNLGTVELSLALHYVFDTPHDRIVWDVGHQSYPHKILTGRREGMAHLRQQGGISGFPKRSESEYDAFGTAHSSTSISAALGMAVASRNAGVQRQHIAVIGDGAMSAGMAFEAMNNAGVTPNINLLVVLNDNDMSISPPVGALNRYLARLMSGQFYAAAKNVGRAVLQHVPPVLELARRLEEHAKGMVTPATLFEEFGFNYVGPIDGHDLDALVPTLQNLRALPGLQFLHVVTRKGQGYKLAEADPVLYHGPGKFDPAVGIQQAKAPARKTFTQVFGQWLCDMAERDERLVGITPAMREGSGLVEFEQRFPQRYFDVGIAEQHAVTFAAGLACEGQKPVVAIYSTFLQRGYDQLVHDVALQNLDVTFALDRAGLVGADGATHAGNYDIAFLRCVPNMVVAAPSDESEARLLLSTCYEHPGPASVRYPRGAGCGAAVGEGLATVPLGKGLVRREGRRIAILGFGTLVQAALGAAGQIDATVADMRFVKPLDRELVLELAARHDALVTVEEAAIMGGAGSAVLETLAEAGVTLPVLQLGLPDAFIDHGDQAALLAGLGLDAAGIERAIRARFGALLA

SEQ ID NO: 86335 - protein, 454 aa, Pseudomonas syringae pv. syringae B728a
MSANNPQTLEWQALSSEHHLAPFSDYKQLKEKGPRIITRAEGVYLWDSEGNKILDGMSGLWCVAIGYGREELADAASKQMRELPYYNLFFQTAHPPVLELAKAISDIAPEGMNHVFFTGSGSEGNDTMLRMVRHYWALKGQPNKKTIISRVNGYHGSTVAGASLGGMTYMHEQGDLPIPGVVHIPQPYWFGEGGDMTPDEFGIWAAEQLEKKILELGVENVGAFIAEPIQGAGGVIVPPDSYWPKIKEILSRYDILFAADEVICGFGRTSEWFGSDFYGLRPDMMTIAKGLTSGYVPMGGLIVRDEIVAVLNEGGDFNHGFTYSGHPVAAAVALENIRILREEKIVERVRSETAPYLQKRLRELSDHPLVGEVRGVGLLGAIELVKDKTTRERYTDKGAGMICRTFCFDNGLIMRAVGDTMIIAPPLVISFAQIDELVEKARTCLDLTLAVLQG

SEQ ID NO: 86336 - protein, 136 aa, Hauya heydeana
VSIDGLPLPFETGEIDFGEPGTNGQHSFYQLIHQGRVIPCDFIGVVKSQQPVYLKGEVVNNHDELMSNFFAQPDALAYGKTPEQLQKENAPQHLIPHKTFTGNRPSLSILLPSLDAYRIGQLLAIYEHRVAVQGFI

SEQ ID NO: 86337 - protein, 395 aa, Erythrobacter sp. NAP1
MLDNLEPQSPDALLALIKLHAADERPDKIDLGVGVYRTGQGATPVFGAIKAAEKWLVENQDSKSYLGPEGDMGFVNALKPYIFGEDPTMGGRIQGMQTPGGTGAVRLAAALAQAAGMTRLHMGTPSWPNHAQIFGDIDLEWVAFDHANPDGTANIDAVLAAIKSAGPGEGVLLHGCCHNPTGIDYTADQWDAIGDALVESGTFPIIDTAYHGLGHGLDEDVAGLRSVLAKVPEAFIAYSCDKNFGMYRDRVGAFYIMSKSGPEGTDTLDKAFSNANALARASWSMPPDHGAAAVRVILRDPEMTQQWLDELDQMRARMRQVRDYLAKAGVAGSVDLAPLGIQNGLFSVLPISKEQVQALREDHGIYMAGSGRINVAGLTMDNIDKFIGAIADVTG

SEQ ID NO: 86338 - protein, 458 aa, Pseudomonas syringae pv. syringae B728a
MSVPPRAVQLNEANAFLKEHPEVLYVDLLIADMNGVVRGKRIERTSLHKVYEKGINLPASLFALDINGSTVESTGLGLDIGDADRICYPIPDTLCNEPWQKRPTAQLLMTMHELEGDPFFADPREVLRQVVAKFDEMGLTICAAFELEFYLIDQENVNGRPQPPRSPISGKRPHSTQVYLIDDLDEYVDCLQDILEGAKEQGIPADAIVKESAPAQFEVNLHHVADAIKACDYAVLLKRLIKNIAYDHEMDTTFMAKPYPGQAGNGLHVHISILDRDGKNIFTSEDPEQNAALRHAIGGVLETLPAQMAFLCPNVNSYRRFGAQFYVPNSPTWGLDNRTVAVRVPTGTADAVRIEHRVAGADANPYLVMASVLAGVHHGLVNKVEPGAPVEGNSYEQHEQSLPNNLRDALRELDDNPVMAKYIDPKYIDIFVACKESELEEFEHSISDLEYNWYLHTV

SEQ ID NO: 86339 - protein, 381 aa, Ludwigia peploides
NVLDKIKEFSERIRNGSWVGATGKQLTNVIAIGIGGSFLGPLFVHTALQTDREACECARGRQLRFLANVDPIDVARNIMGLNPETTLVVVVSKTFTTAETMLNARTLREWISSALGPSAVAKHMVAVSTNLPLVEKFGIDPKNAFAFWDWVGGRYSVCSAVGVLPLSLQYGFAIVEQFLLGARSIDQHFNSAPFEKNIPVLLGLLSVWNVSFLGYPARAILPYSQALEKFAPHIQQVSMESNGKGVSIDGLPLPFETGEIDFGEPGTNGQHSFYQLIHQGRVIPCDFIGVMKSQQPVYLKGEVVNNHDELMSNFFAQPDALAYGKTPEQLRKENVPEHLVPHKTFTGNRPSLSILLPSLNAYNVGQLLAIYEHRVAVQGFI

SEQ ID NO: 86340 - protein, 501 aa, Calylophus toumeyi
MASPALISETEAWKDLKAHVEGIKRTHLRELMGDAERCQSMMVEFDNIFLDYSRQQASPDTINKLYKLADAAHLKQKIDRMYNGDHINSTENRSVLHVALRAPRNSTICSDGKNVVPDVWNVLDKIKDFSERVRSGSWVGATGKVLKDVIAVGIGGSFLGPLFVHTALQTDPEASKNARVRELRFLANVDPIDAARNISGLDPETTLVVVVSKTFTTAETMLNARTLREWISSALGPSAVAKHMVAVSTNLPLVEKFGIDPNNAFAFWDWVGGRYSVCSAVGVLPLSLLYGFAVVEKFLQGAHNIDQHFSSAPFEKNIPVLLGLLSVWNVSFLGYPARAILPYSQALEKLAPHIQQVSMESNGKGVTIDGLPLPFESGEIDFGEPGTNGQHSFYQLIHQGRVIPCDFIGVVKSQQPVYLKGEVVNNHDELMSNFFAQPDALAYGKTPEQLKKENVSEHLIPHKTFIGNRPSLSILLPTLDAYRIGQLLAIYEHRVAVQGFV

SEQ ID NO: 86341 - protein, 508 aa, Physcomitrella patens subsp. patens
MAPPALQKNLESDQPRQVTSVITGYLSIVVLGASGDLAKKKTFPAIFNLYTQGFLPDELKIIGYSRSKMTTEELHTTIRGYLKADRQDPTKKSEDVIHQFLSKVTYMQGAYDTDEGYIRMNEEVSRFELEKDDKDSSTHRLYYFALPPSVYPEVSEKVRKHCMNPRGWTRVIVEKPFGKDLESSEALSSELGALFTEEQLYRIDHYLGKEMVQNLLIMRFANRFFQPIWNRDNIAHVQIVFKEDFGTEGRGGYFDEYGIIRDIIQNHLVQVLCLVAMEKPVSLSPEHIRDEKVKVLQCVEPINEEQVVIGQYEGYTDDPTVAKSSNTPTFASLALRINNERWDGVPFIVKAGKALDAKKVEIRVQFRDTPGDIFNCKKLGRNEFVMRLQPKEAMYMKLTVKEPGLDMKAIQSELDMSYNQRYEEVVIPEAYERLILDTIRGDQQHFVRRDELRVAWEIFTPLLHRIDAGKIPLLPYKQGSRGPREADELNAQTGYVRSEGYIWKSPTN

SEQ ID NO: 86342 - protein, 395 aa, Lactobacillus plantarum WCFS1
MTLFRDDLNETISHIQVSTIRQFDEEVSAIPDMVKLTLGEPDFNTPEHVKAAAKKAIDDNYSHYTGMAGLLELRQAAAHFQETKYGVHYDAEDQVLVTVGATEAIATALTTICNPGDAIIIPSPIFPAYIPIIQEAHAKPLFMDTGVNDFVITPKMVDDFIAAHPDENFKGIVLNYPNNPTGVTYVEDEIKALADCFHRHNLWVVSDEIYSELTYGSDHVSIAKFIPDEVILINGLSKSHAMTGWRIGFLFASKEMTAQLKKVHQYYVTAATTIAQKAGVEALTNGIDDAQPMRQEYQARRDFVYQTMSKLGFKIARPTGAFYIFAKIPAGFEQDSMAFCKDLARKNQLAIIPGTGFGAEGEGYVRLSYAASMEKLHQAMDRLTAYMQEPANCIN

SEQ ID NO: 86343 - protein, 597 aa, Zea mays
SPHLSEANPWVCVAESFLRVAAFVFPSSADPSPCGCQALLESKKTHGELGDFTTNRRSPLLLAIVEGERERERPRSVGFGFGRQLQLSATATMGLRVAATAPAPAGVRVLGRGAARVTPRPWAAVGGRRRFSVRMSVATTEATTTIAVGASEDQALEARNSKTVVAVILGGGAGTRLFPLTRRRAKPAVPIGGAYRLIDVPMSNCINSGINKVYILTQFNSQSLNRHLSRAYDFSNGVAIGDGFVEVLAATQRPGTEGKRWFQGTADAVRQFDWLFDDAKSKDIEDVLILSGDHLYRMDYMDFVQSHRQRGAGISICCLPIDGSRASDFGLMKIDDTGRVISFSEKPKGDELKAMQVDTTVLGLSKEEAENKPYIASMGIYIFKKDILLNLLRWRFPTANDFGSEIIPASAKEIDVKAYLFNDYWEDIGTIKSFFEANLALAEQPPRFSFYDADKPMYTSRRNLPPSMVNNSKITDSIISHGCFLDNCRIEHSVVGVRSRIGSNVHLKDTVMLGADYYETAVERGELLAEGKVPIGIGENTTIQKCIIDKNARIGKKVVISNSEGVDEADRTSEGFYIRSGITVVLKNAIIADGLVI

SEQ ID NO: 86344 - protein, 491 aa, Gaura lindheimeri
WKDLKAHVEGVKRTHLRELMGDSERCQSMMVEFDNIFLDYSRQQASPDTINKLYKLADAAHLKQKIDRMYNGDHINSTENRSVLHVALRAPRNSAICSDGKNVVQDVWNVLDKIKDFSERVRNGSWVGATGKELKDVIAVGIGGSFLGPLFVHTALQTDPEASKNARGRELRFLANVDPIDAARNISGLDPETTLVVVVSKTFTTAETMLNARTLREWISSALGPSAVAKHMVAVSTNLPLVEKFGIDPNNAFAFWDWVGGRYSVCSAVGVLPLSLQYGFAVVEKFLQGAHNIDQHFSSAPFEKNIPVLLGLLSVWNVSFLGYPARAILPYSQALEKLAPHIQQVSMESNGKGVSIDGLPLPFQSGEIDFGEPGTNGQHSFYQLIHQGRVIPCDFIGVMKSQQPVYLKGEVVNNHDELMSNFFAQPDALAYGKTPEQLKKENVSEHLIPHKTFTGNRPSLSILLPTLDAYRIGQLLAIYEHRVAVQGFVWG

SEQ ID NO: 86345 - protein, 393 aa, Oryza sativa
  misc_feature (38)..(38): Xaa can be any naturally occurring amino acid
  misc_feature (206)..(206): Xaa can be any naturally occurring amino acid
  misc_feature (270)..(270): Xaa can be any naturally occurring amino acid
MSVLTYVLDNIGSSCSRSHSLSEAETAENAKSADIDRXILQETKAEQHIHKLLLLGAGESGKSTIFKQIKLLFQTGFDEAELRSYTSVIHANVYQTIKILYEGAKELSQVESDSSKYVISPDNQMSFTLSYHHEIGEKLSDIDGRLDYPLLNKELVLDVKRLWQDPAIQETYLRGSILQLPDCAQYFMENLDRLAEADYVPTKLEXFIHRTIEEGRGILVRISPIPPKSLFDEPFEPIPTDFMILQKNTPPLLYEPIKYILCFSQVCKCXQLLPIEWSVHQLVKIVPQDHDSDELWSAIRNTFCAQKLRMHTINTLMSMIFEKKIQKVKAALYTHTEFKRIVKKFEELYIRSSRPDCVDHVFKIYRTTALDQKLVKKTFKLIDESMRCSREGI

SEQ ID NO: 86346 - protein, 223 aa, Streptococcus pyogenes MGAS10394
MDLLTNKKKIFETIRLSTEAANRTNDGVSVIAVTKYVDSTIAGQLIEAGIEHIAENRVDKFLEKYDALKYMPVKWHLIGTLQRRKVKEVINYVDYFHALDSVRLALEINKRADHPVKCFLQVNISKEESKHGFNISEIDEAIEEIGKMEKIQLVGLMTMAPANASKESIITIFRQANQLRKNLQLKKRKNMPFTELSMGMSNDYPIAIQEGSTFIRIGRAFFH

SEQ ID NO: 86347 - protein, 76 aa, Desulfococcus oleovorans Hxd3
MSIEDKVKRILAERLEVDPSEIRPDAEFISDLGADSLDIVELLMSLEDEFDIEISDDEAEQIMTVKDAVEFITKRL

SEQ ID NO: 86348 - protein, 374 aa, Burkholderia sp. 383
MTLAGTLEIVDELRAGRMVLLVDEEDRENEGDLVIAADHVTPDAINFMARFGRGLICLTLTAERCEQLKLPPMADHNGTPFGTAFTVSIEAAEGVTTGISAADRAHTIRAAVRAGARPDDLVQPGHVFPIAARPGGVLVRAGHTEAGCDLAALAGLTPASVICEVMNDDGTMARLPELKVFAAQHGLKIGTIADLIHYRREHESLVERVGERPLHTPWGRFRAIEYRDTVHGAPHLALVRGEPDPSTPVLTRVHECHSLLDLLDAEPSAHSWPLHAALQRIDAAGCGVAVLLDCDMRGDPMRAPASHARRDGRVTGIGSQILRELGVRRLNVLSSPFRLPALSGHDLEIMAFIPLGDDDPESARGALASPLRVA

SEQ ID NO: 86349 - protein, 219 aa, Edwardsiella ictaluri
MTQDELKKAVGWAALKYVRPGTIVGVGTGSTASHFIDALATMKGQIEGAVSSSDASTARLKSLGIPVFDLNEVDSLDIYVDGADEINGAMQMIKGGGAALTREKIVAAVAKKFVCIVDASKQVDILGSFPLPVEVIPMARAYVARELVKLGGQPVYRQGVLTDNGNVILDVHNLQIMEPCKLENAINAIAGVVTVGLFANRGADVALVGCADGVKTLTL

SEQ ID NO: 86350 - protein, 774 aa, Rhodopseudomonas palustris
MAGERMASYSEDLQAAALGYHRRPKPGKLEIQASKPLANQRDLALAYSPGVAAACNAIAADPAQAAELTVRSNLVAVVTNGTAVLGLGNIGPLAAKPVMEGKAVLFKKFAGIDVFDIEIAAETVDRVVETVAALEPTFGGINLEDIKGPECFEIEAMLKDRMKIPVFHDDQHGTTIIVGAAVKNALALTGKDISKVKIVAAGAGAAALACLNLLVSLGAQRKNIFVCDLEGLVYQGRNVLMDRWKEVYAQKTDKRTLAEVIPGADIFLGLSGPNVLSQDMVKQMAELPLVMALANPTPEIMPEDVRKVRPDAMICTGRSDFPNQVNNVLCFPYIFRGALDVGATAINEAMKHAAVDAIVQLAREAPADPVSVGLDNDEAFGFGPGSLIPSPVDPRLILRIAPAVAMAAMDSGVATRPITSFDDYYAQLERFAFRSGLVMKPVFAKAKGQPVRVINAEGEDEKVLHAVQTILEEKLARPILVGRPSVVEARIKRSGLSIRPGEDFDLVNPQDDPRYRSYVQSYIDIAGRAGVTPAAARAVVRTNSTVIAALAVARGEADAMICGLDGRYMNHLRHVRDVIGRRPGVSDYAALALLITKKGPIFIADTQVRPNPTAEELAELAALAAVHVQRFNIKPKIAFLSHSDFGSFPTDSSLKMRRATAILAEKHPEIEADGEMQGDSALSETSRQMILPHSRLTGVANVLIMPNLDTAIVAYQMIKVVGEALPVGPILIGPALPAHILTPSATARGILNMTAVAVVEAQERAGRHQGTLFA

SEQ ID NO: 86351 - protein, 394 aa, Legionella pneumophila subsp. pneumophila str. Philadelphia 1
MHLKRTLSLTLLAFYGLGTILGAGIYALVGEVAKEAAQFTPLSFLIASIIALFTAISYAELSSRLPLSAGSALYVRRAFHQKWLSGLIGWIVVLTGVISAATLSHGFVKYFQLFLPLPPSLIITILTVILAGVAVWGIRESATLILYMTLMEVGGLLMIIYYGRYSFASIDIQSFSLPHSFDGVLIGAFIAFYAFIGFEDMVNTAEETINPEKTLPKAIFLALISATILYVAVAWVIVSTIPSNALVKTDMPLIEIIKLQGQSPLLFSIIALISITNGILVQIIMASRLIYGMANQQNAPQIFSFVYSKTQTPVNSTLLVSLIILLFAYALPITTLAKLTSSIILCIFIIIHASLIKIKLTKKKPTNAISFPIVFPMISILLTLAFLIIQFFLK

SEQ ID NO: 86352 - protein, 446 aa, Saccharomyces cerevisiae
MDDKVSEKESSPKQTEEDSEGKMAHVQPASYVNKKKYVFGKTLGAGTFGVVRQAKNTETGEDVAVKILIKKALKGNKVQLEALYDELDILQRLHHPNIVAFKDWFESKDKFYIITQLAKGGELFDRILKKGKFTEEDAVRILVEILSAVKYMHSQNIVHRDLKPENLLYIDKSDESPLVVADFGIAKRLKSDEELLYKPAGSLGYVAPEVLTQDGHGKPCDIWSIGVITYTLLCGYSAFRAERVQDFLDECTTGEYPVKFHRPYWDSVSNKAKQFILKALNLDPSKRPTAAELLEDPWIICTELKTHNLLPGLKEGLDARQKFRNSVERVRLNMKIQKLRDLYLEQTESDSDFDEGSQANGSVPPLKATDTSQLSKKLSEEEQSKLKSELTSKAFAQLVNTVLAEKEKFLNINRVCSSDSDLPGSDIKSLDEAKEKPEGKDTKTEE

SEQ ID NO: 86353 - protein, 488 aa, Bacillus cereus ATCC 10987
MNSATNQATSKTETTKGKGELRRGLKSRHLTMISLGGTIGTGLFLASGGVIHSAGPGGALIAYAAIGIMVYFLMTSLAELAAYMPVTGSFSTYATKFVDPSLGFALGWNYWYNWAITIAAELAAVTLIMKFWFPNTPSLIWSGLCLAIIFLLNYLSVKGFGESEYWFALIKVVTIIIFLIVGFMMIFGIMGGETVGFKNFTVADAPFNGGIMAIIGVFMAAGFSFQGTELLGVAAGETSDPERNIPKAIRSIFWRILLFYILAILVIGLLIPYTTESLAASDVTVSPFTLIFEKAGVAFAASVMNAVILTAVLSAGNSGMYASTRMLWDLARQGKAPKFLGKLDSRGVPVNALIVTSIVGSIAFIASLFGDGVVYIWLLNASGMSGFIAWVGIAISHYRFRKAYIAQGKDLKDLPYKAKWFPFGPLFAFTLCIIVILGQNYGAFMGESIDWNGVLVSYIGLPLFLVLWLGYKFTKKTKVIPLDKCELK

SEQ ID NO: 86354 - protein, 536 aa, Helicobacter hepaticus ATCC 51449
MLQTINLSMRYATKKLFENVNIKLDAHKRYGLIGANGAGKSTLLKILSGIYEASSGEVVIEKGLKMGVLGQDQYAFEELSLKDAVLIGNQRLYEAIKRKEYLYENGDLSDEKVNEELGELEMICAEEDPMYECDVIIEKILEDLGFESAMHNELMKTLTGGDKFKILLAQVLFPKPDILLLDEPTNNLDLHSIAWLEENLKRHEGTLVVISHDRHFLNSVCTHILDMDFGSVREFSGNYDDWYIASTLIAKQQEAERNKKLKEKEELESFIARFSANASKAKQATSRQKQLEKLNIQTLAVSSRRDPSIVFKPNRPIGNEALECENISKNYGELCVLKNVSLKILPGDKIAIIGANGVGKSTLCKILIEELKADSGIIKWGATTQRGYFPQNVSEEIKGEESLYEWLRGFDKKKESGEIRNALGRMLFSGEEQEKPINALSGGEKHRMVLSKLMLEGGNFLVLDEPTNHLDLESIIALGEALYKFSGNVICVSHDRELIDAYANRIIELVTDSENKGAKIIDFRGSYEEYIEGEKK

SEQ ID NO: 86355 - protein, 193 aa, Haemophilus somnus 129PT
MSVIPMVVEQTSRGERSYDIYSRLLKERVIFLTGEVEDRMANLIVAQLLFLEAEDPAKDINIYINSPGGSVTAGMAIYDTMQFIKPDVRTLCIGQACSMGAFLLAGGTAGKRAALPHARVMIHQPLGGFRGQASDIQIHAQEILKIKQTLNERLAFHTGQSIEQIEQDTDRDNFMSAEQAKLYGLVDEVLIKR

SEQ ID NO: 86356 - protein, 285 aa, Bacillus cereus ATCC 10987
MKISVYVASAFSKDHKGGNKAGVVFMENILTTTQKMAIAKKLGYAETAFISESEIADYKIEYFTPKEEVDLCGHATIGSFAILMHVNKLFKNRYTIETNSGVLTITIKDDIIFMEQNEPIFYDVISPNEFIDCFDSKAIDNTYPIQIVSTGLKDILIPIKSETLLHTLQPNFEKIKEISKYYNVVGMHLYTFNDNRIICRNFAPLYDINEEAATGTSNGALACYLYEQHYLQKEVYVFEQGYSLHSPSEILVKLATDSKNKIEKVYVGGKGYYCETKYLTVENIE

SEQ ID NO: 86357 - protein, 409 aa, Brucella suis 1330
MQAQSLAEVTVISKAAAVIVAAGRGERAGQSAEGPKQYRLIGAEAVLARTLRAFTDCPLIGTIAVVIHPDDHALYRRAVPEKHENVILVTGGPTRQESTRLGLLALKDEAPQYVLIHDGVRPFIGQDLLERIIANLTPDNGVLPALAVPDTLKRAAADGMVETTISRTGLFAAQTPQAFPYAPILDAHEKAFAINRTDFTDDAAIAEWQEIAVRIIEGSADNTKLTWAKDIEMADKRLRQDHAVFPDIRTGNGYDVHSFEPGDHVTLCGVKIPHEAKLNGHSDADVALHALTDALLATRGAGDIGTHFPPSDSQWKGAASRIFIEHAAKIVREAGGRIANVDVTLISEAPKIGPHRAAMTQALCDMLGIAADRVSIKATTNEKLGFVGRREGIAAIATATVIYPGEVPE

SEQ ID NO: 86358 - protein, 371 aa, Epilobium canum
ERVRNGSWVGATGKELKDVIAVGIGGSFLGPLFVHTALQTDPEASKNARGRELRFLANVDPIDAARNLSGLNPETTLVVVVSKTFTTAETMLNARTVREWISSALGPSAVAKHMVAVSTNLQLVETFGIDPNNAFAFWDWVGGRYSVCSAVGVLPLSLQYGFAVVEKFLQGAHSIDQHFLSAPFEKNIPVLLGLLSVWNVSFLGYPARAILPYSQALEKLAPHIQQVSMESNGKSVSIDGLPLPFETGEIDFGEPGTNGQHSFYQLIHQGRVIPCDFIGVVKSQQPVYLKGEVVNNHDELMSNFFAQPDALAYGKTPEQLKKENVSEHLIPHKTFTGNRPSVSILLPTLDAYRVGQLLAIYEHRVAVQGFI

SEQ ID NO: 86359 - protein, 123 aa, Physcomitrella patens subsp. patens
MQAVRAAVLKRMRVGVSAPWMQAPIFTNGPRLFSTEAHGTYLDKHVVTDRVLSVVKKMNKVDSAKVTPNAHFQNDMGLDSLDTVEVVMGFEEEFAIEIPDADADKIFSCADAIEYIASQPRAK

SEQ ID NO: 86360 - protein, 420 aa, Bacillus anthracis str. A2012
  misc_feature (184)..(184): Xaa can be any naturally occurring amino acid
  misc_feature (201)..(201): Xaa can be any naturally occurring amino acid
MVQKVKERVKIEDILMAHTCMKDIVIKTPLQRDTVLSEKYDCDVYVKREDLQLIRSFKIRGAYNLIRSLSKEQLQNGVVCASAGNHAQGVAYTCNLLKIPSKIFMPTTTPKQKVSQVQFFGGDFAEIVLVGDTFDSSFQEAQRYCEENRMTFVHPFDDPYVVAGQGTVAVEIMHDMEKPVDYIXTAIGGGGLASGVGTYVXGVSPATQVIGVEPMGAASMKEAFLQNDNVALEKIDSFVDGAAVKKVGKLTFETCKDVIDDIVLVPEGKVCTTILELYKKNAIVAEPAGALSIAALDLYRDEIKGKTVVCTLSGGNNDIDRMQEMKERSLIYEGLKHYFIIEFPQRSGALREFLDKGLGPEDDITRFEYIKKHNKENGPALVGVELKHKEDYEQLIIRFKENNIQFMELNKNPVLFDLLI

SEQ ID NO: 86361 - protein, 371 aa, Epilobium canum
ERVRNGSWVGATGKQLKDVIAVGIGGSFLGPLFVHTALQTDPEASKNARGRKLRFLANVDPIDAARNISGLNPETTLVVVVSKTFTTAETMLNARTLREWISSALGPSAVAKHMVAVSTNLQLVEKFGIDPYNAFAFWDWVGGRYSVCSAVGVLPLSLQYGFAVVEKFLQGAHSIDQHFSSAPFEKNLPVLLGLLSVWNVSFFGYPARAILPYSQALEKLAPHIQQVSMESNGKGVSIDGLPLTFESGEIDFGEPGTNGQHSFYQLIHQGRVIPCDFIGVVKSQQPVYLKGEVVNNHDELMSNFFAQPDALAYGKTPEQLKKENVAEHLIPHKTFTGNRPSLSILLPTLDAYRIGQLLAIYEHRVAVQGFI

SEQ ID NO: 86362 - protein, 371 aa, Epilobium brachycarpum
ERVRNGSWVGATGKELKDVIAVGIGGSFLGPLFVHTALQTDPEASKNAKGRELRFLANVDPIDAARNLSSLNPETTLVVVVSKTFTTAETMLNARTVREWISSALGPSAVAKHMVAVSTNLPLVEKFGIDPNNAFAFWDWVGGRYSVCSAVGVLPLSLQYGFSVVEKFLQGAHSIDQHFSSAPFEKNIPVLLGLLSVWNVSFLGYPARAILPYSQALEKLAPHIQQVSMESNGKGVSIDGLPLPFETGEIDFGEPGTNGQHSFYQLIHQGRVIPCDFIGVVKSQQPIYLKGEVVNNHDELMSNFFAQPDALAYGKTPEQLKKENVSEHLIPHKTFTGNRPSVSILLPTLDAYRVGQLLAIYEHRVAVQGFI

SEQ ID NO: 86363 - protein, 435 aa, Bordetella parapertussis 12822
MPGGRACARLQGFVALQSCGAPAARGLFPPLFLSPFRIPIMRKFSRIERLPPYVFNITGELKMAARRRGEDIIDMSMGNPDGATPQHIVDKLVEASTRPDTHGYSVSKGIPRLRKAICDWYMRRYAVEFDPDSEAIVTIGSKEGLAHLMLATLDRGDTVLVPNPSYPIHIYGAVIAGANIRSVRMTPGIDFFEELERAVRESIPKPKMMILGFPSNPTAQCVDLSFFERVVALAKEHDILVVHDLAYADVCFDGYVAPSIMQVPGARDVAVEFFTMSKSYNMAGWRIGYMVGNRELVGALARIKSYHDYGTFTPIQVASIAALDGPQDCVNEIVAQYQRRRDVLARGLHEAGWNVEIPKASMYIWAQIPEPYRAMGSLEFTKRVLSDAKVAVSPGIGFGEYGDEYVRFALIENEQRTRQAVRGIKDMFRKDGLLK

SEQ ID NO: 86364 - protein, 373 aa, Epilobium brachycarpum
ERVRNGSWVGATGKQLKDVIAVGIGGSFLGPLFVHTALQTDPEASKNASGRKLRFLANVDPIDAARNISGLNPETTLVVVVSKTFTTAETMLNARTLREWISSALGPSAVAKHMVAVSTNLQLVEKFGIDPYNAFAFWDWVGGRYSVCSAVGVLPLSLQYGFAVVEKFLQGAHSIDQHFSSAPFEKNLPVLLGLLSVWNVSFFGYPARAILPYSQALEKLAPHIQQVSMESNGKGVSIDGLPLPFESGEIDFGEPGTNGQHSFYQLIHQGRVIPCDFIGVVKSQQPIYLKGEVVNNHDELMSNFFAQPDALAYGKTPEQLKKENVAEHLIPHKTFTGNRPSLSILLPTLDAYRIGQLLAIYEHRVAVQGFIWG

SEQ ID NO: 86365 - protein, 192 aa, Brassica napus
DDPTVPDDSNTPTFATTILRIHNERWEGVPFILKAGKALNSRKAEIRIQFKDVPGDIFRCQKQGRNEFVIRLQPSEAMYMKLTVKQPGLEMQTVQSELDLSYGQRYQGVSIPEAYERLILDTIKGDQQHFVRRDELKVAWEIFTPLLHRIDKGEVKSIPYKPGSRGPKEADQLLEKAGYLQIHGYIWIPPTL

SEQ ID NO: 86366 - protein, 441 aa, Lactobacillus plantarum WCFS1
MQSHRHQSLEEINQSVAVPDVHQTAFWRKFLAYSGPGALVAVGYMDPGNWLTSLAGGGQFQYRLLAVLALAIIVAMFMQGLAIRLGVVARQDLAQAIASKLPRPVRYAAWILNEVAMMATDMTGVIGTAIALKMLFGLPLLAGILLTIADVLVVLLFLRFGIRRVEVIVLVAILTVGIIFGIEVGRAHVQFGNVLLGLVPTPLIVKNHTALVLSLGILGATIMPHNLYLHSSLAQSRRYDYHNPAQVTEALRFANWDSTVHLIAAFLINALLLVLGGTLFFGHTNALASLQAVFDGLKSTTVVGALASPVMSWLFALALLITGLISSITSTLAGQIVMEGYLHIRLPLWQRRLLTRAVTLIPILIIGMLVGFSDAAFENLIIYAQVALSIALPFTLLPLVALTNDASLMKAHVNRPAVTWVGYGLAGIITVLNIYLVYSLF

SEQ ID NO: 86367 - protein, 166 aa, Megacorax gracielanus
SAILPYSQALEKLAPHIQQVSMESNGKGVSIDGLPLPFETGEIDFGEPGTNGQHSFYQLIHQGRVIPCDFIGVVKSQQPVYLKGEVVNNHDELMSNFFAQPDALAYGKTPEQLKKENVSEHLIPHKTFTGNRPSLSILLPTLDAYRIGQLLAIYEHRVAVQGFIWG

SEQ ID NO: 86368 - protein, 353 aa, Hypocrea virens
MGCGMSTEDKEGKARNEEIENQLKRDKMMQRNEIKMLLLGAGESGKSTILKQMKLIHEGGYSRDERESFKEIIFSNTVQSMRVILEAMESLELPLEDQRMEYHVQTIFIQPAQIEGDVLPPEVGGAIEALWKDHGVQECFKRSREYQLNDSARYYFDNIARIAAPDYMPNDQDVLRSRVKTTGITETTFIIGDLTYRMFDVGGQRSERKKWIHCFENVTTILFLVAISEYDQLLFEDETVNRMQEALTLFDSICNSRWFIKTSIILFLNKIDRFKEKLPVSPMKNYFPDYEGGDDYAAACDYILNRFVSLNQHETKQIYTHFTCATDTTQIRFVMAAVNDIIIQENLRLCGLI

SEQ ID NO: 86369 - protein, 322 aa, Synechococcus sp. CC9311
MPIASDITALVGRTPLVRLNQLPQRSGCLAELVAKLESFNPTASVKDRIAGSMVQAAEEAGTISPERTVLIEPTSGNTGIALAMVAAARGYRLILTMPDTMSTERRAMLRAYGAELQLTPGNEGMQGALDLAVELVSEIPHAYLLQQFDNAANPAVHAATTAEEIWMDTDGQIDALVAGVGTGGTITGCARVLKQRNPDLKVIAVEPAGSPVLAGGAPGPHRIQGIGAGFVPAVFDQSLIDEILGVSDQEAMEVGRRLAREEGLLSGVSSGAAVAAAIRIGQRPEMAGKRIVVILASFGERYLSTPMFSASAATPAWRDGQL

SEQ ID NO: 86370 - protein, 460 aa, Lactobacillus plantarum WCFS1
MSKQTHLSRQMESRHVLMISLGGVIGTGLFLSSGYTIHQAGPIGTLLAYTIGAILVYLVMLCLGELSVAMPYTGAFHVYAKKYIGPGTGFTVAILYWLTWTIALGSEFTAAGLIMQTWFPHIATWIWSLVFMVVIFTVNALSVRWFAETEFWFASIKVIAIIAFIVLGGLAMVGILPLHGHTSAPFLSNYTRNGWFPNGFGGVFTTMLTVNFAFSGTELIGITAGETKDPAHTIPTAIKTTLWRLIIFFIGSMFVMAALIPYKQAGVTQSPFVLVFKAIGIPYAADLMNFVVLTAIMSAANSGLYASTRMLWSLANEGTIPKVFKRTTKRDVPLVALITSMLGGILALLSSVYAAGSVYLVLVSISGLAVVIVWMAIALSEINFRKAYLKSGQSLDQLTFKTPGYPVVPWLAFILSGLSCILIWFDPNQRIALYYTIPFVAICYLGYYLNQRYRRTHAAK

SEQ ID NO: 86371 - protein, 279 aa, Pyrococcus furiosus DSM 3638
MLVIGSGAKHLEGEIKEKAPITNVEIKKFPDGEKYVRILEKGDKAIVVQSTYKPQDEFLIEALLLGDALRENGYRKLKIVIPYMAYSRQDRVTKEGEPISIRAVLKMLGLYYDELYVMDIHNPKTLEFFPGRAENILPSKEIAEYFSDKLGEGIILAPDKGALERAKAIAEILGLEYSHFEKKRISPTEVQMTPVNIDVKGKNVLIVDDIISTGGTMIKATEILRKLGAEKVFVAATHGVFAEGAIERLSKAVDELAVTNTIPTPVSKISIVPEILNLL

SEQ ID NO: 86372 - protein, 521 aa, Xanthomonas campestris pv. vesicatoria str. 85-10
MTNIHTDKILILDFGAQYTQLIARRIREIGVYCEIWAWDHDPSEIAGFGAKGIILSGGPESTTSPGAPVAPQEVFDSGLPVFGICYGMQTLAAQLGGATEAADQREFGHAEVDVVAADALFSGLTDHAGASRLNVWMSHGDHVSQVPPGFTITATTDRIPVAAMSNEAKRWYGVQFHPEVTHTLQGQTLLRRFVVDVCGCQTLWTAANIIEDQIARVREQVGDDEVILGLSGGVDSSVVAALLHKAIGDKLTCVFVDTGLLRWQEGDQVMAMFAEHMGVKVIRVNAADRYFAKLEGVSDPEAKRKIIGNLFVEIFDEESNKLANAKWLAQGTIYPDVIESAGSKTGKAHVIKSHHNVGGLPEHMKLGLVEPLRELFKDEVRRLGVELGLPRTMVYRHPFPGPGLGVRILGEVKREYAELLAKADAIFIDELRKADLYDKTSQAFAVFLPVKSVGVVGDARAYEWVIALRAVETIDFMTAHWAHLPYDFLGTVSNRIINELRGVSRVVYDISGKPPATIEWE

SEQ ID NO: 86373 - protein, 3360 aa, Lactobacillus plantarum WCFS1
MFKVGRTWVFTAMASFVLTAAPQLVSHADTVSADTSSDTASSATSSASSGADTSSAAASAAALAAATASSTSTSTTSDSSTASSSSETASNSNSESSSDSSSSDDSASDASSASETSTTNATSTSSTSSSSVSTASSSASSASSSSSSSSSSATSSSLTDSSSSSAASSSTTSLSSSASVAASTVSTASSVASTTKSASTAASTAAIAAYSSVSAASSHTDSTAAKAASSSASLAGSYATLASSYASLVNNLTTQAAVSAAQSAYQEALNAADLSRHYNSIANMYLDALTNGVGSNVDNAIAYSGANSLAYSAASAASSYAALASTATSTASSAATQGLINLASSNYSAASSAASAATVAASSAAEAANSAYLAMQYDKNNTAVTSAYTVASSTAAAASTAAVNATTAAVAASSAYAAVSSNAANNDYEATSTAYAVTSSAATEALGQYAAGSTASSAASFANSTAISDLASAASSSANVANTAKSTASSAASVAATQTGTQASAYASSAATAASSASSAYAVASTAAKSAVSASDPATADSYARVAQSASSLAASYAATAESNATLAAKFSTDVANEQTVSSNATLTTSTATQSVSTGDTVTITNKVGLDSGYSVSGTPTYVWYVSTDGTTWTTISGATSATYTTTATTSGTYYYQAVVSGKRVTAIILTSSFKAAGNVITIVVTNPEGTYTEIASSYASQANSAASVATSQAVAASSAISLASSSANLTGSLASYYTSQANSSYNAASSYASVASEAASIATMASTSAASYEAEGAYTSANIWAGMASSYASVATEYASSASSAASEAAASLDTALKNAVNEDGGDTAADYLASSYASMAASSANVAGDQASLAASYAANAANAYNVAGSSFNTTATSSYNAAASSAAVAASSYAAAASEAASLAASYAADGNYNSAALQQSYAALRLTYATDQLNAASSAASAITQTVVQAQSSYYNSIATAASSAASAAESAAGNAISVASSLSAKYASNTTLGSSYVAQTNNYAVTTLGAAAAATSAAEMAAQYTSQASSAVAAGDYAMASSYVTNASAAASEATSYAALSTSNAALGSTAASNATNYSNNTNSYKSTNTGNATTILGIVISGGMTSQPAAVTSTVSGGTFTLSASSALGLGGVALSSKTTWYVQVNGTWMTLDKASAYIESYDAVDSAGLLSTSSSLTVTIKAGYTGSLLFQAVQGFSWDLANWFTVYTFASNLAEVDVYSSNIPATNISIAGDDYVINPTNSSSGSNDKVTSQFTSTTNPENATGKITWTTSDSSIATIDDSGLLTVVSNGTVTITATITNADGTSYSSSKTITIGSGLEDTSVDAGSDLTWVPDGSTTGTGTDITYQWYYSSTADGTGTALSGQTGTTLNLSDLTVGQSGYYYLVITGSNTTNGTTTTTTVTLGRAYLTVNAVSTEAADSAASEAANYANQATEYGSVASSYANIAGEYASKNSEASSYAEQATAAASDAQSAATAASTAASNAAAAQSNADSAEAAGENSAASSYAEEAKKKASEASEAKKKASSAADDAGYYADLAANVSEDDSDSDSDGDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDGDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSNSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDADSDSDSDSDSDSNNDSDSDTITDSDSNDGTNSDNGSNSGSDGSSSSNTGSGSGNTTGSTGNNSGTGTGTTTSSTASNNGAASTSTTSLSAAATSGVSATAATLAVTTPSSDGAATTSATAATSVVYAAASAQDVDATSDQTDSDSKSSNDSDKDKKSADTDSADDKVGSSNTDENGKTASDTSNNAGTIFGGLLTAAAAAGLGWWFFLFGRRRKDDDEDDENQK

SEQ ID NO: 86374 - protein, 616 aa, Xanthomonas campestris pv. vesicatoria str. 85-10
MSQPAESSELINVVVLLGAAVVAIPLFRRLGLGSVLGYLAAGLAIGPFGLGLFNEPQAILHVAELGVVMFLFVIGLEMRPSHLWSLRKEIFGLGTLQIAVCALVLTGVGMLLGFALPVAFVAASGFVLTSTAVVMQLLAERGDVALPPGQKIVAILLFEDLLIVPLLAIVAWMGASGDPQAASQRWQGIGIGLACIVGLLAAGRWLLNPLFRILAASKAREVMTAAALLVVLGAALLMQVGGLSMAMGAFLAGVLLSESTFRHQIEADIEPFRGILLGLFFLGVGMSLDLRVVAADWRLIVVGVLALMVGKGVCIYAVARLMRSDHRQALDRGVLMAQGGEFAFVLFAAASASGVIDAQVNASLTAIVVLSMALTPLFVLLQRRLTPAAAVSLDGVEAASGQTGSVLIIGFGRFGQVASQSLLARDVDVTIIDNDIEMIQSAEEFGFKIYYGDGTRLDVLHASGAHSARAIAVCVDNQEAANRIVELATREFPHAKLLVRSYDRQHSLQLVAAGVDYQIRETFESAVLFGKVALVELGVDEDEAGMISRQIRRRDAERFELEIAAGDARAGAKLMYGNTVPTAPRPTPFTRPRRGSRTLNPDAVPQAEPAETQTRD

SEQ ID NO: 86375 - protein, 297 aa, Xanthomonas campestris pv. vesicatoria str. 85-10
MSQRIRKAVFPVAGLGTRFLPATKTVPKEMLPIIDKPLIQYAVDEAIQAGCDTLIFVTNRYKHSIADYFDKAYELEQKLERAGKLEQLELVRHALPEGVRAIFVTQAEALGLGHAVLCAKAVVGDEPFAVLLPDDLMWNRGDAALTQMANVAEASGGSVIAVEDVPHDKTASYGIVSTDAFDGRKGRINAIVEKPKPEVAPSNLAVVGRYVLSPKIFDLLEATGAGAGGEIQLTDAIAELLKEEQVDAFRFEGRRFDCGAHIGLIEATVHFALEHEKHGGPAKEILRNALAQADARG

SEQ ID NO: 86376 - protein, 135 aa, Coprinopsis cinerea okayama7#130
MAIFGLWIINKAGGLVYQRNFADGLAQLTSNEYLVLAGTLHGIHAITSRLSPMGPSSGAQVIEGETFKMTIFLTATGTKFVLLTSLNESIAEILLQRIYEAYADSVMKNPFHTPEMPIRSDGFESRVTAIIGTGQ

SEQ ID NO: 86377 - protein, 372 aa, Arabidopsis thaliana
MTEQEICVRVTRAAAKRKASTAMGIDGDRVNKKRVVLGELLNVSNVNLLANLNQKKETQKPKRNLKPPPAKQIKSAPVAIIDLESKSDIDSRSDDPQMCGPYVADIYEYLRQLEVKPKQRPLPDYIEKVQKDVTPSMRGVLVDWLVEVAEEYKLGSETLYLTVSHIDRFLSLKTVNKQKLQLVGVSAMLIASKYEEISPPKVDDFCYITDNTFSKQDVVKMEADILLALQFELGRPTINTFMRRFTRVAQDDFKVPHLQLEPLCCYLSELSILDYKTVKFVPSLLAASAVFLARFIIRPKQHPWNQMLEEYTKYKAADLQVCVGIIHDLYLSRRGGALQAVREKYKHHKFQCVATMPVSPELPVTFWEDVTI

SEQ ID NO: 86378 - protein, 402 aa, Glycine max
MAIQHHNDQLEHNENVSSVLDALYCDEGKWEEEEEEKEEEEDEGENESEVTTNTATCLFPLLLLEQDLFWEDEELNSIFSKEKVQHEEAYGYNNLNSDDDNNNNNNTSNNNVHLDSCLSQPRREAVEWMLKVNAHYGFSALTATLAVTYLDRFLLSFHFQREKPWMIQLVAVTCISLAAKVEETQVPLLLDLQVQDTKYLFEAKTIQRMELLVLSTLKWKMHPVTPLSFLDHIIRRLGLRTHLHWEFLRRCEHLLLSVLLDSRFVGCLPSVLATATMLHVIDQIQHSGGIEYKTQLLSVLKISKEKVDECYNAILQLSKANKYGHNNINNTSKRKYEQIPSSPSGVIDAAFCSDGSNDSWAVGSSLLYSPPEPLFKKSRTQGQQMNLSPLKRFIIGIVGTSP

SEQ ID NO: 86379 - protein, 154 aa, Alteromonadales bacterium TW-7
MKIIEGNKYAPGKKFAIVISRFNDFIGSSLLEGAVDELKRTGGVSDDDITVIYVPGAVELPLAAKRVAAKKEYDAIIALGVVIRGGTPHFDLVAGESNKGLAQVSLEYDIPVAFGVLTTESIEQAIERAGTKMGNKGGEAALGALEMVNVLDKI

SEQ ID NO: 86380 - protein, 247 aa, Helicobacter hepaticus ATCC 51449
MKKRFLLFFITSFLQAAHWGYGIDDGAEKWASLSPDYALCKTGKRQSPINITRSHLKPTENQLRFLYKHQEKVKNIINNGHSVQINFQNGSAVRLKNTYYSLVQLHFHSPSETQIEGKNFPMEMHIVHQDKQGNTLVIAALFEEGKENPSLHKIIESMPQKVNQSKPFGTLNINNILPKQNGYYAFDGSLTTPPCNENVQWVVFVNPIQISKKQIETFQAVLHHNARNVQPLGDRVIEVAPPLPITY

SEQ ID NO: 86381 - protein, 370 aa, Alteromonadales bacterium TW-7
MNLHSAQEIIDDIKAGKMVILMDDEDRENEGDLIIAAEHISAEAINFMATHGRGLICLTMTQERCEQLDLPLMVKNNGAAFSTNFTMSIEASKGVTTGISAADRARTVQAAIAKGAVPSDIVQPGHIFPIMAQPGGVLTRAGHTEAGCDLARLAGLEASSVIVEILNADGTMARRPDLEVFAKEHDIKIGTIADLIEYRNLNETTIEKVAKCKLPTEHGEFDLVTYKDTIDGQLHYVLLKGEIKAQEPTLVRVHLQSTFNDILLSDRSADRSWGLSDAMAYIAKNDGVLVILGKQESTEELEATVKAFAAADAGENVTPRKFQGTSRTVGVGSQILADLGIEQMRLMSRPKKYHALSGFHLEVIDYIEPQ

SEQ ID NO: 86382 - protein, 184 aa, Populus trichocarpa
MALFISIAATGILEMQWGGVGIDDWWRNEQFWVIGGASAHLFALFQGLLKVLAGVSTNFTVTSKAADDGEFSELYLFKWTSLLIPPTTLLIMNIVGVVVGVSDAINNGYDSWGPLFGRLFFALWVIIHLYPFLKGLLGKQDRMPTIILVWSILLASILTLLWVRINPFVSKGGPVLELCGLNCD

SEQ ID NO: 86383 - protein, 577 aa, Saccharomyces cerevisiae YJM789
MKGDRSRQNMAVTKKPKLKKNDEPKKVLKTAATEKGEGSKRYSLWNFWISTLFLKLLLIPDYFSTDFDVHRNWLAITNKLPISEWYYEHTSQWTLDYPPFFAYFEWFLSQFVPKSVRDDGCLDIVEIGKFGLPTIVFQRLTVIFSEILLFVILQIYINTTKLSERSQSFVVASSIVLSPGFLIIDHIHFQYNGFLFAILIGSIVAAKNKRYILCAVLYTTAICFKHIFLYLAPCYFVFLLRAYVLNVNNFKFKSYKDFLFLIRWANLLKLATVVVGIFTICFLPFAHQMPQVLSRLFPFSRGLTHAYWAPNFWALYSFMDKILTTVMLKLPYVHTFATKFIKPPLIPQNIKEINERLAANNNGSKGLVQDVFFVILPQIPPKLTFILTIFYQVLAVLPLLFDPSFKRFVGSLTLCGLASFLFGWHVHEKAIMLVIIPFTFLVGFDRRLLVPFMLVASAGYVSLYPLLYKGQDFFIKTLYTYVWCIIYFAAFRKTTKISSSVERRIFFLDRLALTYIFSLLPIVTVLQILDEVKWRYSFLQKFEFLGLMIYSVYCSLGIISSWFALSWLYNFDELLWQ

SEQ ID NO: 86384 - protein, 468 aa, Rhizobium leguminosarum bv. viciae 3841
MSYDVIIIGTGPGGYVCAVKAAQLGLKVAVVEKRATYGGTCLNVGCIPSKALLHASEMFHQAGHGMSALGIDVPAPTLNLGNMMAHKDATVKSNVDGVAFLFKKNKIDAFQGTGKIVSAGKVSVTADDGKVQDIEGKNIVIATGSDVAGIPGVQVEIDEKTIISSTGGIALEKVPETLIVVGGGVIGLELGSVWSRLGAKVTVVEYLDTILGGMDGEVSKQFQRMLAKQGIDFNLSAKVTGVEKADKGAKVTFEPVKGGDKVTLDAEVVLIATGRKPYTAGLGLEEAGVTLDNRGRVEIDGHYKTNVDGIYAIGDVVKGPMLAHKAEDEGVALAEILAGQHGHVNYEVIPSVVYTQPEIASVGKTEEELKAAGVAYKVGKFPFTANGRARAMLATDGFVKILADKETDRVLGGHIVGFGAGEMIHEIAVLMEFGGSSEDLGRTCHAHPTMSEAVKEAALATFFKPIHM

SEQ ID NO: 86385 - protein, 637 aa, Saccharomyces cerevisiae YJM789
MGVRSAAKEMHERDHNSDSSSLVTSLMKSWRISSASSSKKPSLYKMNTTESTSLPSGYASSADRDRRTSDGNFEAMAKQQASTRRTSNSYSPLRYVSPTLSTASNESPRPALLLRQHHQRHHHHQQPRHSSSGSVGNNCSNSTEPNKKGDRYFKDLDEDWSAVIDDYNMPIPILTNGGFGTPVAPTRTLSRKSTSSSINSISNMGTSAVRNSSSSFTYPQLPQLQKEKTNDSKKTQLEIENERDVQELNSIIQRISKFDNILKDKTIINQQDLRQISWNGIPKIHRPVVWKLLIGYLPVNTKRQEGFLQRKRKEYRDSLKHTFSDQHSRDIPTWHQIEIDIPRTNPHIPLYQFKSVQNSLQRILYLWAIRHPASGYVQGINDLVTPFFETFLTEYLPPSQIDDVEIKDPSTYMVDEQITDLEADTFWCLTKLLEQITDNYIHGQPGILRQVKNLSQLVKRIDADLYNHFQNEHVEFIQFAFRWMNCLLMREFQMGTVIRMWDTYLSETSQEVTSSYSMSSNDIKPPVTPTEPRVASFVTPTKDFQSPTTALSNMTPNNAVEDGGKMRQSSLNEFHVFVCAAFLIKWSDQLMEMDFQETITFLQNPPTKDWTETDIEMLLSEAFIWQSLYKDATSHWL

SEQ ID NO: 86386 - protein, 209 aa, Campylobacter upsaliensis RM3195
MKLEQILEKTKNVHLVAASKYVDANTIKEFYHKGISEFGENQVKALSEKKELLKDENLTIKWHFIGTLQSNKINLLIKQRPILWQSCNSLKLAKAVDKRLNYILDTLLEINSASEENKSGIELNKAFEEYLQIQEECKNLNLKGVMCIGTHSNDVKKIQKSFEDTYRIYEKLQKHGANICSMGMSSDFELALKCGSNMLRLGSILFKSP

SEQ ID NO: 86387 - protein, 181 aa, Populus trichocarpa
MASSVISSAAVATVNRTPAQANMVAPFNGLKSTSAFPVTRKANNDITSIASNGGRVQCMQVWPPTGLKKFETLSYLPDLTTEQLAQEIEYLLRNKWVPCLEFELEKGWVYREHHQSPGYYDGRYWTMWKLPMFGCTEASQVLIELEEAKKAYPNSFIRIIGFDNTRQVQCISFIASKPKGV

SEQ ID NO: 86388 - protein, 1091 aa, Deinococcus radiodurans R1
MTPRVLIANRGEVAVRIERAVSALGWQSVAVYAPDDAGSLHVRRADEAVALSGRGAAAYLDGAALLRVAQEHAATHVHPGYGFLSENADFARACAQAGLVFVGPDPDTLDLFGDKSRARGLAQRLGVPVIPGTDGATTLEEAAAFMQAQGGAPVMLKACSGGGGRGMRVVRQAGDLAAAFEQASREARLAVGQGDLYAERLIERARHIEVQVAGDGQSVTHLWERDCTVQRRHQKLLEFAPAPHLPQAVRTALIGAALQLAQEVKYRCLGTFEFLVTPGGDFYFIEANPRLQVEHTVTEEWCGTDLVTAQLRLAAGETLTAVGLATQPADAAPPPGQAVQARVNMETLGADGQVHVGGGQVQTFTPPGGPGVRVDTFVTTGLTPSPQYDALLAKVVVHRRDAALPGLLRQAATALSEFQIAGVSTNLAFLQALLHHPDVQHYELSTHWLDERLPELVTQAAEYDDVSASTQAPTSSGPSPLPDATPGTERLTAPTTGMLVAYDVHPGQRVRRGECLAVVEAMKIEFQIEAPRDGQVVACHLTAGSSVTLGQPLLDLAADEGADDAVAAEEERDLDALPASYADWQRRLRATTDEARPAAVEKRHAAGKLTARENVAALLDAGSFNEHGALALAAQRGRRSEEELLALSPADGLITGVGTVNAGQFPDTAACAVAAYDYTVLAGTQGYFNHHKLDRLIALAGQWKWPLVLFAEGGGGRPGDTDMPVAAALVTPTFLNFAALSGQVPLVGVAAGACFAGNAALLGCCDVVIATRDSSIGLGGPAMIEGGGLGVVAAGDIGPAEVLAQKGVVDLLAENDAEANELARRYLTYFQGDVTGWEAADQRELRWVIPQVRKRAYDVRALLHLLADTGSVLELRRAFAPGLLTALVRIGGKAFGVIANDPAVLGGAIDAAGADKAARFLNLCDTHRLPVLSLVDTPGFMVGPASEAEGAVRHVSRLFVRAAKLTVPFFAVVTRRAYGLGAQAMAAGSLHAPALTVSWPGGEFGPMGLEGAVRLGYRRELAAVSDPQEREALYQKLVAQAYAQGEAVNVAAHLEVDAVIDPAETRNWLLRALRVSPYSAQRREGGLVDPW

SEQ ID NO: 86389 - protein, 282 aa, Mycobacterium avium subsp. paratuberculosis K-10
MSKVPTIELNDGARIPQLGFGVYQIKPDETAAAVRAALDIGYRHIDTAEMYGNEREVAQGIRDAGLDRSEVFVTSKLNNGFHEPDAARRAFDATLNALGSDYVDLFLIHWPLPTLYGGDFVSTWRVLEEFARDGRARSIGVSNFQVAHLERLAAETDTVPAVNQVEVHPYFTNEKVRGYAREHGLAIEAWSPIAQGGVLGDAVINRIADGLGRTAAQVVLRWHIQRGDIVFPKTVNPDRMKSNFELFDFELDERAMEAISALDRGESGRRGPNPDTFDYIPR

SEQ ID NO: 86390 - protein, 425 aa, Rhizobium leguminosarum bv. viciae 3841
MATEIRVPTLGESVSEATVGTWFKKVGDAIKADEPILELETDKVTIEVPAPASGTLSEIVVAAGETVGLGALLGQIAEGAAAAAAPAAAAPTAAPAAPAPAQPAAAAPAQPAVAAAAASSSSASVSTMPPAPAASKMLAENNLSADQVDGSGKRGQVLKGDVIAAVAKGISAPAAVPAATPAAARGPSTVEDASREERVKMTRLRQTIAKRLKDAQNTAAMLTTYNEVDMKAVMDLRNKYKDIFEKKHGVKLGFMGFFTKAVTHALKELPAVNAEIDGTDVIYKNYCHVGMAVGTDKGLVVPVIRDADQMSIAEIEKELGRLAKAARDGSLSMADMQGGTFTITNGGVYGSLMSSPILNAPQSGILGMHKIQERPVAIGGQVVIRPMMYLALSYDHRMVDGKEAVTFLVRVKESLEDPERLVLDL

SEQ ID NO: 86391 - protein, 171 aa, Wolbachia endosymbiont of Drosophila simulans
MSLVSNNFIESTISREKLRAIQTPQIFNFKELLSCHQSTKEFTDDSSLMIEHKKRVVIIKGEKSNFKLTTKEDINMAKLLFEEPKFRVGTGYDIHKFIKVQNGAESFIKICGVKIEHNMAIEAHSDGDVAIHAIVDAILGALGYGDIGEHFPPSSSEWKDCNSSHFLDFAA

SEQ ID NO: 86392 - protein, 246 aa, Agrobacterium vitis
DDYVALVGRSGINPEAARTIVRTNTTVIGALSLKRGEADALICGVEGRFDRHVHDVGQILGKKPNVRDFSGLSLLISQRGAVFMTDTFVTENPTAEEVAEMTILAAQAIRQFGITPKAALLSHSNFGSRNCESARKMRAALEILRKEAPELEVDGEMQGGSALSETLRRRAIPNSTLSGDANLLVFPNLDSANISLGLVRTFTDALHVGPILLGAAQPAHVLSTSVTSRGVVNMAALAVVEANQPD

SEQ ID NO: 86393 - protein, 378 aa, Physcomitrella patens subsp. patens
MQNADYSEQSSDADENKVIKSPSSFDYRVTLFNTELSRRRIHLAELQRLSSQGIPDTGGIRATTWKVLLGFLPRNRDDWATELEKKRATYAVFREEMIINPSEVTRRKEEMEAMKAAELEALEGPLQRHEISHDDHPLSLGSKSVWHQFFQDTELAEQINRDVKRTHPDMPFFCGDNDSARENQEALKRILFIFAKLNPGIRYVQGMNEVLAPLYYVFKTDIDESNVKHAEEDSFFCFVELLSDFRDHFCQQLDNSAVGIRSTILQMTQLLRKHDEELWRHLEITSKVNPQFYAFRWITLLLTQEFNFADSIRLWDSLLSNPDGPLEILLRVCCSMLLCLRSRLLAGDFTTNLKLLQHYPSVDINRLLKVADDLKELK

SEQ ID NO: 86394 - protein, 281 aa, Megacorax gracielanus
ERVRNGSWVGATGKELKDVIAVGIGGSFLGPLFVHTALQTDQEASKNARDRELRFLANVDPIDVARNISGLNPETTLVVVVSKTFTTAETMLNARTLREWISSVLGTSAVAKHMVAVSTNLPLVEKFGIDPNNAFAFWDWVGGRYSVCSAVGVLPLSLQYGFAVVEKFLQGAHSIDQHFSSAPFEKNIPALLGLLSVWNVSFLGYPARAILPYSQALEKLAPHIQQVSMESNGKGVSIDGLPLPFETGEIDFGEPGTNGQHSFYQLIHQGRVIPCDFIGVV

SEQ ID NO: 86395 - protein, 367 aa, Campylobacter upsaliensis RM3195
MSLAVGIVGLPNVGKSTTFNALTKAQNAQSANYPFCTIEPNRAMVEVPDERLKELAKIVKPEKILHSLIEFVDIAGLVKGASKGEGLGNKFLSNIRETEVILHIVRCFDDENITHVEGGVDSIRDIEIINTELILADIEQLSKKIEKLNKEVRANQKGAKESLELATSLLEHLNKGFSASSYEGRESELYQNLIKELRLLSAKEVIYGANVDEEGINKDNQFVLALKEYAKKNNQEVIKLCAKIEEELVGLSDEEGAEFLNSLGIKESGLAQIIRTAFSKLGLISYFTAGEIEVRSWTIKRGYKAPKAASVIHNDFEKGFIKAEVISYEDFIQFRGENGAKEAGKLRLEGKDYIVCDGDVMHFRFNV

SEQ ID NO: 86396 - protein, 371 aa, Hauya elegans
ERVRNGSWVGATGKELKDVIAVGIGGSFLGPLFVHTALQTDPEASKNARGRELRFLANVDPIDVARNISGLNPETTLVVVVSKTFTTAETMLNARTLREWISSALGPSAVAKHMVAVSTNLPLVEKFGIDPNNAFAFWDWVGGRYSVCSAVGVLPLSLHYGFAVVEKFLQGAHNIDQHFSSAPFEKNIPVLLGLLSVWNVSFLGYPARAILPYSQALEKFAPHIQQVSMESNGKGVSIDGLPLPFETGEIDFGEPGTNGQHSFYQLIHQGRVIPCDFIGVVRSQQPVYLKGEVVNNHDELMSNFFAQPDALAYGKTPEQLQKENVPQHLIPHKTFTGNRPSLSILLPSLDAYRIGQLLAIYEHRVAVQGFI

SEQ ID NO: 86397 - protein, 182 aa, Campylobacter upsaliensis RM3195
MKELSQKERDFLIQSIRVIPNFPKEGIIFRDITTLLNDIKALSFLLKHLEDRYKDMNLDFIVGTESRGFIFASMICARLNLPFVPIRKPGKLPYKTFSCSYDLEYGSDTIEIHQDAFRSVEKAKVLLVDDLIATGGTALASYDLIQKAGGICVESCFLINLKDLNGWKKLNALCPVYSVLEF

SEQ ID NO: 86398 - protein, 269 aa, Lopezia grandiflora
ERVRNCSWVGATGKELKDVIAVGIGGSFLGPLFVHTALQTDQEASKNARGRELRFLANVDPIDVARNISGLNPETTLVVVVSKTFTTAETMLNARTLREWISSALGTSAVAKHMVAVSTNLPLVEKFGIDPNNAFAFWDWVGGRYSVCSAVGVVPLSLQYGFGVVEKFLQGAHSIDQHFSSAPFEKNIPVLLGLLSVWNVSFLGYPARAILPYSQALEKLAPHIQQVSMESNGKGVSIDGLPLPFETGEIDFGEPGTNGQHSFYQLIHQ

SEQ ID NO: 86399 - protein, 330 aa, Oryza sativa Indica Group
MGNSRRPAAAATAPSPSPPASDLEVGFAKLQGEDFEYYMQTYSIVLGRHSRRRNQPVGVGVGVGVGGGGGGGGDAAADDVDVDLGILGGGMNVSRRHARIFYDFPRRRFALEVLGKNGCLVEGVLHEPGGEPVKLDSQDLLQMGDAQFYFLLPTRSVFATDAARRASAAAPRAVPPPPSSSSSDDDGEEEREAAVAKRPRNGDAGALAGRKSEKGSKGYRQSDNLQLLQLEEKDVISSTATVLSDLCGPQEWVPMDRLHEVMFQKYGDLWHHNRVRKYLTSEDWPKSETDGRPWHGLSLLLRKYPEHFVINIRMSGGRSIEFVSLVSLQP

SEQ ID NO: 86400 - protein, 506 aa, Moorella thermoacetica ATCC 39073
MGIWRTKKIADLMQEAGDNQKLKRSIGTPELVALGVGAIIGSGIFVLTGVAAANYAGPALVFSFILSGLAAGLAALVYAEMAAMIPVTGSAYTYAYASLGEIIAWLVGWNLVLEYLVASGAVAVGWSGYITDMLASVGVFLPRALVNSPLSGGLVNLPAILITVVMTGVAIVGTTTSARTNKIIVGVKILVILAFLALGAPRVNPAYWHPFLPFGVTGVVHGAAIIFFAYIGFDAVATAAEEVRDPARELPLGIIGSLALATILYVAVTIVLTGLTPYTNLNTPSPVTTGLLAAGVRGASLIVGTGALAGLTSVLLVNIFAQSRVFMAMGRDGLLPPLFTRVHPRFHTPWLTTLIVGAFITLIGGFLPVDIIAELANVGTLSAFFVVSVGVMVLRRTQPDLKRPFKVPLMPWTPLLAIAFAVYLFFNLPGLTWIRFGVWVTLGLVVYFAYGRRHSVLAREEESKAVPRPTYRPSPLEMPAPARKPFPFKLPAPDLLRMFLPRWRRD

SEQ ID NO: 86401 - protein, 96 aa, Lopezia grandiflora
GRVIPCDFIGVMKSQQPVYLRGEVVNNHDELMSNFFAQPDALAYGKTPEQLKKENVSEHLIPHKIFTGNRPSLSILLPTLDAYRIGQLLAIYEHRV

SEQ ID NO: 86402 - protein, 230 aa, Lopezia grandiflora
AILPYSQALEKLAPHIQQVSMESNGKGVSIDGLPLPFETGEIDFGEPGTNGQHSFYQLIHQGRVIPCDFIGVMKSQQPVYLRGEVVNNHDELMSNFFAQPDALAYGKTPEQLKKENVSEHLIPHKIFTGNRPSLSILLPTLDAYRIGQLLAIYEHRVAVQGFIWGINSFDQWGVELGKSLATQVRKQLHASRVNGEAVEGFNFSTKTLLTRYLKETSDVPADPSTLLPKI

SEQ ID NO: 86403 - protein, 511 aa, Dechloromonas aromatica RCB
MHDIIRQLEKKREMARLGGGQKRIDSQHKKGKLTARERLELLLDPDSFEEWDMFKEHRCVDFGMDQAEKTPGDGVVVGYGTINGRLVFVFSQDFTVFGGSLSETHAEKICKVMDQAMKVGAPVIGLNDSGGARIQEGVASLGGYADVFQRNVMASGVVPQISMIMGPCAGGAVYSPSMTDFIFMVKDSSYMFVTGPEVVKTVTHEDVTAEELGGAVTHTTKSGVADLAFENDVEALSMLRRFMNFVPSNNKEKPPVTPTNDPVDRMDYSLDTLVPDNANKPYDMKELLVKVVDDNDFFELQADYAKNIIIGFGRVDGHPVGIVANQPLVLAGCLDIKSSIKAARFVRFCDAFNIPVVTFVDVPGFMPGTTQEYGGIIKHGAKLLYAYAECTVPKVTVITRKAYGGAYDVMSSKHLRGDVNLAWPSAEIAVMGPKGAVEIIFREEKSDPAKLAQREAEYKEKFANPFVAGARGFIDDVIMPHATRKRIARSLAMLRDKKLDNPWRKHGNIPL

SEQ ID NO: 86404 - protein, 344 aa, Xanthomonas campestris pv. vesicatoria str. 85-10
MTDRLRFPAEWEPQSAVLLAWPHAGTDWAERLADVEETYIALVTAISRFEPVVICVADDDLQIYAEARLRSARVDMTRVRFVIAAYNDTWLRDSGPITLRQEAGFRLMDFRFTGWGGKFEASLDDQLVSSLDAAQVFVPAQVETIDFALEGGAIETDGAGTLLTTWKCLHERHPQRTRESLSSDLATWLAQERVLWLDHGYLEGDDTDAHIDTLARFAGPDAIVYQGCDVPGDSHYVELQAMGAELAALRRADGQPYRLFVLPWAQPILDEGRRLAASYANFLIVNGAVLMPAYGDAADATAQAVLAQAFPQHEIVPVPCRALIWQNGSLHCLTMQLPAGLLAA

SEQ ID NO: 86405 - protein, 427 aa, Alteromonadales bacterium TW-7
MQLHNLKDNSQKVSFVEAVKTGLGRNQGVFFPESLAPMADVDALLDMDFVTRSSKILSHLIGDELPSSTVADMVKNAFNFPVKLVEVEENTYCLELFHGPTLAFKDFGGRFMAECLAQFNQGEKVTILTATSGDTGAAVAHAFYNKPNIDVVILYPKGKISLAQQKLFTTLGGNIHCYAVDGSFDDCQELVKKSFLDDEVKSTLGLNSANSINISRLVAQVCYYFEAIAQLPKEKRATAHISVPSGNFGNVCAAMIGAVIGLPVGKLSATTNQNDTVPRFILDKNWLPNATLESLSNAMDVSKPNNWPRVQTMLDNNWFSYDNFYSISVDEENTQTVMKNIHQTGYVAEPHTAIAYQGLVNNRAPGAAGIFLATAHPAKFKESVEGILNIELDMPKPLSDALAKPCLASDINADYDALRTEILAKLA

SEQ ID NO: 86406 - protein, 805 aa, Alteromonadales bacterium TW-7
MRVLKFGGSSLADFACLEQVAQLVKAQLKDEMLLVLSAPGGMTDSLVALASSAEQGQDFSSLWEALTSRCNELKAAVEKGYGPIDHWPNFEELKNKLDGVSLIKCCPDQVRAFVISFGERVSVSLMQRLLNSHKAVYLEATSCVASTGGFIDAEVDLVASKAHFQAALKEKPATIYIMPGFTASNDKGELTTLGRNGSDYSAAIAAACLEADVCQIWTDVDGVYSADPRYIKKATKVDFLSYKEAMELSYFGAKVLHPKTILPCAKAGVPCEIKNTHNPDAQGSLIGNDYSSDEPVKAISSLQDLAMLTVSGPGMKGKVGMASKVFNALAHDNVSIVLITQSSCEFSISFCVHESDLALALTALQTAFELESQAGLIEPVQVQRNLAIVTLVGDNMRAHRGLAAKFFASLSQAQVNIVAIAQDSTESAISAVIDGELCNDAVKICHENFFTHVPSIDVFLLGCGLVGQELISQLERQQAWLEKRNIKLNLYGVANSRQLHLDSEGIAFSDWQQKLAVSEQSFDLKLVEQFVKQNHLVNPVLVDCTSSDALAAQYVDFLNAGFHVVAANKKATTSSYTYYQDLIAATQKNNRKFLYETNVGAGLPVIDNLQSLFGAGDELLEFSGILSGSLSYMFGALQDGLSLSEATIKAKESGFTEPDPRDDLSGTDVARKLLIIAREAGMKLELTDIEVESVLPQGFAEGDSIDEFMAKLPSLDADFNARIEQAASEGKVLRYVGTIKEGHCKVGIEAVDSSHALNVIRDGENALAILSQYYQPRPFVIRGYGAGSEVTAAGVFADVLKTLSR

SEQ ID NO: 86407 - protein, 293 aa, Arabidopsis thaliana
MEFFQKAKAIRMRNSHNKYLTADDDEETVTQNRNGSTKNARWTVEPVRDSFHVIRLKSCYGKYLTASNERFLLGATGKKVIQLKLSRVDSSVEWEPLREGSKIKLRTRSGNYLRGNGGLPPWRNSVTHDVPHLSATQDSISWDVDVVEILTDSEFKTESAKAPPPKTTSPPPHRRPTSSPLSAESPRTSSSLSDRSDSDSVESPPKSDGRTIYYHVADEEGHVEDETTVGYAFTFKGNSVAELTQTLREETCMEDAVVCTRSPLNGKLFPLRLQLPPNNGTLHVILLPSSASL

SEQ ID NO: 86408 - protein, 460 aa, Burkholderia sp. 383
MNQPEDQLHRGLEERHINLMALGATIGVGLFLGSASAIRVAGPAILLTYLLGGIAIFLIMRALGEMAIANPVAGAFSRYARDYLGPLAGYLTGWTYWFVWIVTCMAEITAVGVYMHMWFPGVPNWIWALAALMAMGSVNFIAVKLYGEFEFWFALIKIVTIVLMIIGGGLMIAFGIGNGGVAIGLSNLWAHGGFMPNGINGVIAALPIVMFAYLGVEMLGLTAGEARNPEKSLTKAVNSVFWRVLIFYIGALFVIMSLYPWDQIGTQGSPFVMTFSRLGIPAAAGIINFVVLTAALSSCNSGLFSTARMLYNLAQQGQAPSKLGKVNRNGVPVYGVIVSVALLLIGVLLNYLAPQHVFTWLTSVSTFGAIWTWCVILIAQMRFRRTLSADKIARLPIRVPFYPLGSFVALGFLVLVVVLMAFTPDTRVALVIGPVWIVLLGITYALFYANRPAASVPTKS

SEQ ID NO: 86409 - protein, 531 aa, Mycobacterium avium subsp. paratuberculosis K-10
MTVLQSALDRKAPGFTEAASAALAKLEEIDTELANALAGGGPKYVERHHARGKLTARERIELLVDQDSPFLELSPLAAWGSSFKVGASTVTGIGVVEGVECMIVANDPTVKGGTSNPWTLKKILRANQIAFENRLPVISLVESGGADLPTQKEIFIPGGRMFRDLTRLSAAGIPTIALVFGNSTAGGAYVPGMSDHVVMIKERSKVFLAGPPLVKMATGEESDDESLGGAEMHARVSGLADYFAVDELDAIRIGRRIVARLNWVKQGPTPKAVTEPLFDTEELIGIVPADLRIPFDPREVIARIVDGSEFDEFKPLYGSSLVTGWARLHGYPIGILANARGVLFSEESQKATQFIQLANRSNTPLLFLHNTTGYMVGKDYEEGGMIKHGSMMINAVSNSTVPHISLLIGASYGAGHYGMCGRAYDPRFLFAWPTSKSAVMGGAQLAGVLSIVARAAAEARGQQFDEQADAAMRAAVEGQIEAESLPLVLSGMLYDDGVIDPRDTRTVLGMCLSAIANGPIEGTSNFGVFRM

SEQ ID NO: 86410 - protein, 349 aa, Clostridium difficile 630
MKARLILEDGTVFIGKAFGYLEESVGEVVFNTSMIGYGEVLTDPSYYGQIVTMTYPLVGNYGINLSSAESEKVQVKGFIVREKSDSPSNFRCEIDIDQYLKQNKVIGLEGIDTRALTKILRNNGTMKGIITLEDSKLEDVKHKLDKFSNTEAVRTVTRKEVEHIKGNGPKVAVMDFGVKRNILRSFIARGCDITIFPATTSPEDVLSINPDLIFLSNGPGDPEDLEDVIENIKALIGKKPIVGICLGHQLLALALGGKTAKLKFGHRGGNHPVKDLEEGKVFITSQNHGYYVSEVPEQMKVTHINLNDNTVEGMRHEKLDVYSVQYHPEACPGPKDNDYIFDKFLELVK

SEQ ID NO: 86411 - protein, 473 aa, Candidatus Kuenenia stuttgartiensis
MKTFILAGGGGERLWPLSRNNFPKQFLKLNGSMSLLQQTVDRLLGAVSPEDIIVITNHNYQFHVSSALNSLPGMNGSVSGAHTILEPLSRNTAPAIALGVKYCKEILRCTEDEIIFLSPSDHIIKPTEAFAERVRHAEEIAQKGYIVTFGIKPDKPETGYGYLKFSDQSSGNCAKKFFKVERFAEKPDRDTAKQYIHEGNYYWNSGMFAFSIQTIMEELQRYAPEITEIYHLGYEEMLLQFQHMPDISIDYAVMEKSDKVVALPFDLYWNDVGSWDSLFDILDKDANGNVLQGDVMAIDTKDSFLLGKKRLITTVGLENCLVVETDDAILIAKKGEAQKVKDIVKKLRENSRPEAVEHVTTYRPWGSYTVLENGPRYKIKRIVVNPKEKLSLQMHYHRSEHWVVVKGSAKVTTGDKESFIHENESAYIPKSTIHRLENPGKIPLEIIEVQNGEYLGEDDIVRCDDVYGRTQGA

SEQ ID NO: 86412 - protein, 906 aa, Bacteroides fragilis YCH46
MDKKRVYTFGNGLAEGKAGMRNLLGGKGANLAEMNLIGVPVPPGFTITTDVCTEYYEMGQEKVVSLLKEEVEKAIANIENLMRSKFGDVENPLLVSVRSGARASMPGMMDTILNLGLNDEVVEGLTRKTGNARFAWDSYRRFVQMYGDVVLGMKPVNKEDQDPFEAIIEEVKHAKGVKLDNELEVEDLKELVKKFKAAVKAQTGKDFPTCAYEQLWGAICAVFNSWMNERAILYRKMEGIPDEWGTAVSVQAMVFGNMGDTSATGVCFSRDAATGEDLFNGEYLINAQGEDVVAGIRTPQQITKIGSQRWAQLAGVSEEERASKYPSMEEAMPEIYKQLDELQTKLENHYKDMQDMEFTVQEGKLWFLQTRNGKRTGAAMVKIAMDLFRQGMIDEKTALMRVEPNKLDELLHPVFDKSALKQAKVLTRGLPASPGAATGQIVFFADDAAEWHAAGKRVVMVRIETSPEDLAGMAVAEGILTARGGMTSHAAVVARGMGKCCVSGAGALNIDYKARTVEVDGVLLKEGDFISLNGSTGEVYQGKVETKAAELSGDFADLMKLADKYTRLQVRTNADTPHDAEVARNFGAVGIGLCRTEHMFFEGEKIKAMREMILAENAEGRRKALAKILPYQQADFKGIFKAMAGCPVTVRLLDPPLHEFVPHDLKGQQEMADTMGVSLQYIQQRVESLCEHNPMLGHRGCRLGNTYPEITQMQTRAILGAALELKKEGIETHPEIMVPLTGILYEFQQQESVIRAEADNLFEEVGDRIDFKVGTMIEIPRAALTADRIASSAEFFSFGTNDLTQMTFGYSRDDIASFLPVYLEKKILKVDPFQVLDQNGVGQLVRMATEKGRAIRPDLKCGICGEHGGEPSSVKFCHKVGLNYVSCSPFRVPIARLAAAQAAIEE

SEQ ID NO: 86413 - protein, 397 aa, Rhizobium leguminosarum bv. viciae 3841
MNIHEYQAKALLKGYGAPVAEGVAILKVEEAEAAAKSLPGPLYVVKSQIHAGGRGKGKFKELSPEAKGGVRLAKSIDEVVAHAKEMLGNTLVTAQTGEAGKQVNRLYIEDGADIARELYCSLLVDRSVGRVAFVVSTEGGMDIEAVAHDTPEKIQTIAIDPEAGVTAADVAAISKAFELEGAAAEDAKTLFPMLYKAFGEKDMALLEINPLIVMKDGHLRVLDAKMSFDGNALFRHDDVKVLRDETEEDAKEIEASKWDLAYVALDGNIGCMVNGAGLAMATMDIIKLYGKEPANFCDVGGGAGKEKVAAAFKIITADPKVEGILVNIFGGIMKCDVIAEGVIAAVKEVGLKVPLVVRLEGTNVELGKKILNESGLAITAADDLDDAAKKIVAAING

SEQ ID NO: 86414 - protein, 347 aa, Clostridium difficile 630
MKGKLILEDGTVFEGKAFGYLKEAIGEVVFNTSMAGYGELLTDATYYGQIVTMTYPLIGNYGINLEDVESNKVQVKGLIVREKSDNPNNFRCEMDIDTYLKQNKVIGLEGIDTRALTKIIRNNGTKRGIITLENVSLQDVQSKLEEHCNKDSVKNVTRKEIENIKGTGAKVVVIDFGVKNSVLESLKACNCDITIVPAMTTVEEILNINPDLILLSNGPGNPEDINDIVENIKKLIGKKPLTGIGLGHQILALALGGKTSKLVFGHRGANHPVKCLETGKVFITSQNHGYNVSEMPENTEVTHINLNDNTIEGMRHKELPIYSVQYIPEYTTKEDLDCIFNKFLALI

SEQ ID NO: 86415 - protein, 390 aa, Campylobacter upsaliensis RM3195
MLSKKSQVLEESITLAITALANELKAKGEDVLSFSAGEPDFDTPQTIKNAAIKAIENGCSKYTPVAGIKDVLNAVATKLKRDNDLSYETSEIITNVGAKHSLFQCLECLVDEGDEVIIPSPYWVSYPEMVKFAGGKCVFVDTKEENGFKITADELKGALSEKTKVFILNTPSNPVGCVYTKEELRALAKVLEGTRVVVLSDEMYEKLCYDGVKFHAFASVSEDAMKRTVTINGLSKCGAMPGWRFGYMASKIKGLVPAVKKLQGQSTSNICSISQHAAIPALLGECDEDIEMMRKAFERRRNVALEMLSKMENVSIYKPSGAFYLFINISKLEKDSMKFCQKLLEEKKVAVVPGIGFGMDGYLRLSYATSEENIIKGLERFGEFVENYKA

SEQ ID NO: 86416 - protein, 109 aa, Populus trichocarpa
MAMAAAAGGNQVHNVFVYGSLLADDVVRALLSRIPQSSPAILNGYHRFSIKGRVYPAILPVENKKVSGKVLHGITDPELYILDEYEDVEYERVTVDVSLMVAAIGIGLG

SEQ ID NO: 86417 - protein, 424 aa, Candida albicans SC5314
MNWKTPSKKIYDSADLKNFEKSIAFEKLQKTLQQIILSVENHKIPPGILNVDIVTRPGRIGSIPLPSLIEPTTTTTTRENKIGPSNGNVEILIELFQYLNKLIDETPPLKGPTRFGNFACRDWHDKIDIIPILKKFKFPQELSSSNNSSSKSNIDGFLLESSYYLLNSFGSKIRLDYGTGHELSFLAFIGSLIEFKILNHPTTTEEINGKEILIIFANYYDLVRRLILVYNLEPAGSHGVWGLDDHFHLIYILGASQFINDKLAPIVQRSLSSQVINSCKLTNFYINAIAFIFRLKTGPFNEHSPIIFDIHNKVFSWTKVRQGLIKMYMVEVFNKFPVLQHFWCGEVLYPWKDHQGNDLPVNEKEETELDKPPETTLNSTTTTTTTTKVSSSTSKIPFTPAPWANTTTTHAVPRNTRNTRNPRS

SEQ ID NO: 86418 - protein, 128 aa, Prunus persica
MLKFLWRVRIEFNALDPRTASCLEFLAQCNARKAKESNPSCAVQVKRRTDDEPPKITVTFVNGVEEVFDATATPAQDIRNMILEKGQSLETEQMFRDAGEPWPVIIPAEELHQPAPGTKPRKADEKKQ

SEQ ID NO: 86419 - protein, 515 aa, Prosthecochloris aestuarii DSM 271
MRCSDATVRALTIIFPIRSLQLFVMSSVATVLLLNPDCMAPAEREISNFTLVLFGANGDLALRKLFPSMYELARWGQMPDKYRIIGVGRSDIGHDGFRELVREAMVAHAPHIDTGSGHFSDFIQSLFYVQVDLTTVEGYHRLREEIRTGHGREGTCSNLLFYLSTPPSLAPFIVRFLDEAGLGGKSPSCQGWRKIIIEKPYGHDLQSARELNVIVGEVFHEEQIYRIDHYLGKEPVQNILVFRFSNGMFEPLWNRHYIDNVSITIAEDFGIRGRGSFYEEAGLLRDIIQNHGLQLLASVAMEPPVDLSADAVRDEKEKVFRSLRRFTVESAREHVVLGQYDGYRQENNVASDSLVETFASIRFFIDNWRWKGVPFYMKAGKNLARSLTEIVITFSCPPQNFFGPPESCSYTANQIVIQIQPEQTIAIRFGTKRPGEALVTDPVFMKFDYRASFEKEGMTPYHRLLVDAMAGDQMHFIRQDSVESSWSVIDSIKSSLQGSVPQPYAVHSWGPETGF

SEQ ID NO: 86420 - protein, 421 aa, Prunus persica
MGSVSLKIGDGTARFKRATLCSSAVNLLMLFSVITTNLFALYAFTSSPKDQQTYHLLHHTQKNISLISEQVSLILREIDSSQKKLAQMEKELLGYESIDLSRSNVAHELKLFLQHHQLPLGKDSRTGITEMVASVGHSCEKSADLLSQYMNYKVSGPCPDDWSLAQKLILRGCEPLPRRRCFAKTLPKVGLNPFPISLWKPVSDKIVTWSGLGCKSFECLNSKKLSRDCVGCFDLVNGFENQRFVKARGKNDFLIDDVLALGSGGIIIGFDIGGGSGTFAARMAERNMTVITNTLNIDAPFSEFIAARGLFPLFLSLDHRFPFYDNVFDLVHAASGLDVGGKPEKFEFVMFDIDRILRPGGLFWLDNFYCSNEEKKRDLTRLIERFGYKKLKWVVGDKVDAAASGKSEVYLSAVLQKPVRV

SEQ ID NO: 86421 - protein, 295 aa, Prosthecochloris aestuarii DSM 271
MKTGFVGLGKMGLNMVENLLDHGHDVVVYDLSSAQVLQAVQKGAVGASSLKDLADTGLIWMMVPAGAPVDATIDELLPILKAGDIIIDGGNSNYHDTVRRALRVQGAGMHYLDVGTSGGLEGARNGACMMIGGSSEIVDRLDELFRDMCVPGGYGYVGPNGAGHFAKMVHNGVEYGMMQAIGEGFDILESAPFTFDHHAVAGIWSNGSVIRGWLMDLVAAAFEKDGALDYLSGEIADSGEGRWTIDAALDQGVSIPVIANALFRRYRSRSHDNFSDKVVAALRHEFGGHGFTPKS

SEQ ID NO: 86422 - protein, 398 aa, Pyrococcus furiosus DSM 3638
MVARVIVDAQAARAIGKGAMIVFKKGVVRTEGEIKPGDIVEVYTRGGKFLGKGFANPNSNIMVRIVTRDKDVEINKELFKERIRKANEYRKKVLKYTNVYRMVYGESDYLPGLIVDRFNDIASLQISSAGMERFKLEVAEAIMEVEPEIETVFEKNTGRSRRREGLPEIERVLLGKEKYRTIIQEGRAKFIVDMRGQKTGFFLDQRENRLALEKWVEPGDRVLDVFTYTGGFAIHAAIAGAEEVIAIDKSPRAIETAKENAKLNGVEDRIKFIVGSAFEEMEKLQKKGEKFDIVILDPPAFVQHEKDLQAGMRAYFNVNFAGLNLVKDGGILVTCSCSQHVDLQMFKDMIIAAGAKAGKFLKMLEPYRTQAPDHPILMASKDTEYLKCLFLYVEDMKH

SEQ ID NO: 86423 - protein, 519 aa, Oryza sativa Indica Group
MAQRWRSRARRDPDVDEEEGSPPERRRRAARSGSDDEEAGNEDLSLEIVARAARRRRRQREASAGFAADAFSSGDEIDEDAVVELGEADPSSRKRRKEKEKKKRRKEKRKQRKGAPPEGSASTAAADKEESQVAGTQEAQTGTAESVLTEDGPDAPLSDNIVLRKLLRIPRYFDPGETLLETCFNCGEEGHVAVNCPMEKRKRPCFVCGLFGHNSKQCTQVGLPSSKALLLGDLDRFQTSSSLITHIYLPLPMLLACVAWPANFRNQTFVNHFCRVKTVSSAKKEVILRKTALKSTIGILNSLLFVYDVENQVMICLDVPMIIHAMMLRKVIYVALTSLIFVQKKLVVIIVPNLVILVCRKKGKGKKDFGTRSAPHDARKTSKRKSPLFEERRNSSHFKSKARGGWIADDADDQPYKKYKPNPTWATYCGARCCIEWLNDGSSSVAKNEGRGWLLSLVPDHPILCCGVASLRGLVGGLVDSMVLDFRRVHRCHLRTSAVLRDRRGEGEGGRRDKAEKMV

SEQ ID NO: 86424 - protein, 401 aa, Arabidopsis thaliana
MRGRSLTLSRVKLELARRSMSATSVPSMADFLTKKPYSPPSWASHLRPLPSHTFSLAHLPTPIHRWNLPGLPNGTELWIKRDDFTGMELSGNKVRKLEFLMAEAVDQHADTVITIGGIQSNHCRATATASNYLNLNSHLILRTSKLLADEDPGLVGNLLVERLVGANVHLISKEEYSSIGSEALTNALKEKLEKEGKKPYVIPVGGSNSLGTWGYIEAAREIEEQLNYRPDDLKFDDIVVACGSGGTIAGISLGSWLGALKAKVHAFSVCDDPDYFYDFVQGLLDGLHAGVNSRDIVNIHNAKGKGYAMNTSEELEFVKKVASSTGVILDPVYSGKAAYGLINEITKDPKCWEGRKILFIHTGGLLGLYDKVDQMASLMGNWSRMDVSESVPRKDGVGKMF

SEQ ID NO: 86425 - protein, 138 aa, Triticum aestivum
KDASAGVVDRFIDLCKSNHFKGMPFRHIIKNFVIQGGDFDFDGAAQEWITKAKASGKNDLSPKHEAFMIGTAKNPNNKGFDLFITTAPIPDLNDKLVVFGRVIKGEDIVQEIEEVDTDEHYQPKAAIGIINIMLKQEP

SEQ ID NO: 86426 - protein, 430 aa, Bacillus licheniformis ATCC 14580
MAFEFKLPDIGEGIHEGEIVKWFVKPNDEVNEDDVLAEVQNDKAVVEIPSPVKGKVLELKVEEGTVATVGQTIITFDAPGYEDLQFKGDESGEAKAEEAEKQETDAPAEAAEANEQADADPNKRVIAMPSVRKYAREKGVDIVNVSGSGKNGRVLKEDIDSFLNGGTAGDAKAAQAEEKAEPAAQQPAAAVQVPEGEFPETREKMSGIRKAIAKAMVNSKHTAPHVTLMDEVDVTNLVAHRKQFKQVAADQGIKLTYLPYVVKALTSALKKYPVLNTSIDDNTDEVIQKHYYNIGIAADTEKGLLVPVVKNADRKAIFEISNEINELATKAREGKLAPAEMKGASCTITNIGSAGGQWFTPVINHPEVAILGIGRIAEKAVVRDGEIVAAPVLALSLSFDHRMIDGATAQNALNHIKRLLNDPQLILMEA

SEQ ID NO: 86427 - protein, 470 aa, Bacillus licheniformis ATCC 14580
MVVGDFPIETDTLVIGAGPGGYVAAIRAAQLGQKVTIVEKGNLGGVCLNVGCIPSKALINAGHRYENAKHSEEMGITAENVKVDFTKVQEWKASVVNKLTGGVEGLLKGNKVDIVKGEAYFVDSNSVRVMDENSAQTYTFKNAIIATGSRPIELPNFKYSDRVLNSTGALALKEIPKKLVVIGGGYIGTELGTAYANFGTEVVILEGGEEILPGFEKQMSSLVKRNLKKKGNVEIHTKAMAKGVEEKADGVTVTFEVKGEEQTIDADYVLVTVGRVANTDELGLEQVGVEMTDRGIIKTDKQCRTNIPNIYAIGDIIEGPPLAHKASYEGKIAAEAIAGEAAEIDYLGIPAVVFSEPELASVGYTEAQAKEEGLSVTAAKFPFAANGRALSLNETDGFLKLVTRKEDGLVIGAQIAGASASDMISELSLAIEAGMTAEDIAMTIHAHPTLGEITMEAAEVAIGMPIHVVK

SEQ ID NO: 86428 - protein, 178 aa, Pyrococcus furiosus DSM 3638
MNPFHDLEPGPDVPEVVYAIIEIPKGSRNKYELDKKTGLLKLDRVLYSPFFYPVDYGIIPRTWYEDDDPFDIMVIMREPVYPLTIIEARPIGLFKMIDSGDKDYKVLAVPVEDPYFKDWKDIDDVPKAFLDEIAHFFKRYKELQGKEIIVEGWEGAEAAKREILRAIEMYKEKFGKKE

SEQ ID NO: 86429 - protein, 376 aa, Methanothermobacter thermautotrophicus str. Delta H
MAKRDYYEILGVDRGADKKEIKKAYRRLARKYHPDVSDDPDAAEKFKEISEAYAVLSDDEKRARYDRFGHAGMDGFSQEDIFNNINFEDIFSGLGFDIGNIFDMFGFGGGRRHGPQRGADISYTLDISLEDAYNGLETDIRVPHTKKCPVCHGSRAEPGTGTRTCQTCGGSGQVRQVRNTILGQMMNITTCPDCQGEGTVVEKPCSNCNGKGVVRKTSTIHVKVPAGVETGSRLRVPGEGEMGLRGGEPGDLYVVIKVKPHSIFRREGANLYTEKPISFVQAALGDTVEVPTLDRPVKLRIPAGTQSGTTFRVKGHGMPHLKWNGYGNLYVKVKVVTPRKLSPRQKELLREFASISGDEIHEDKGFFDKVKDAIIH

SEQ ID NO: 86430 - protein, 299 aa, Methanothermobacter thermautotrophicus str. Delta H
MIKMIESYLKAGKIVSKVRREAAGIIRDGLPIIELVNYVEDRIIEEGGRPAFPCNVSVNEVTAHYTSPPGDDSVIGDGDLVKLDLGAHVDGFIADTAITVPVGDVDDKCHQMMDAAREALENAISTIRAGVEVGEIGRVIEETIHSHGMNPVSNLTGHSMERWILHSGLSIPNINERNTHQLEEGDVLAIEPFATDGVGLVTDMPQTYIFRFLRERPLRLVHARRVLGKIREEYHALPFAQRWLEEYFDAKRLNASMRMLIQSRAIYPYHVLREKSGAMVAQWEHTVIVEEDGCTVITE

SEQ ID NO: 86431 - protein, 368 aa, Streptococcus pyogenes MGAS10394
MEHKWKLWLFIVGVVLLIGGASVLIQKGQAKAFSQGKPQIPAKKVKSTKVDPNAPVDQKVIYLAGGCFWGVEEYFSQVDGVLDAVSGYANGRGDTTNYQLIHQTGHAETVEVAYDANRISLKELLLHFFRIIDPTSLNKQGNDRGSQYRTGIYYTDKADLAIIDEVFKEKAKDYKKKIVVEKAPLKHFIKAEDYHQDYLKKNPNGYCHIDINQATYPVIDESKYPKPSATEIKEKLSADEYRVTQKNETEKAFSNRYWDSFDAGIYVDVVTGEPLFSSKDKFESGCGWPSFSRPISPDVVRYKEDKSFNMTRTEVRSRSGNSHLGHVFTDGPKDQGGLRYCINSLSITFIPKADMEAKGYGYLLSSVE

SEQ ID NO: 86432 - protein, 300 aa, Dechloromonas aromatica RCB
MNPSLAKHQSWFEATARKRVAGLLDAGSFNEILPPAASMPSPHLAQLDLPGAFDDGVVVGTGQLSGKPIYVIAQEGQFMGGAVGEIHGAKIVGLLRRAVAEKPAAVLFLIDSGGVRLHEANAGLIAISEIMRAVLDARAAGVPVIALVGGSCGAFGGMGIVAKLCSAILISEEGRLALSGPEVIETVAGVEEFDSKDRALVWRVTGGKHRYLMGDCAALVEDDIAAFRAGASEFVATWQEPLPSVANLRATQQRLENRLAAYATCRDGLQVWAALGVAQPEAVPLLDRDSLVALKEGLPT

SEQ ID NO: 86433 - protein, 831 aa, Oryza sativa Japonica Group
MPPLLYNLFVLIVVFLGGGAPACSAATDTVKPGHVVGGKDKVVSNNGKFALGFFKAPAPNQEKWFLGIWFNTVPNRTTVWVANGGEPIMDAADAGSPELTISGDDGDLVALHPTTKSIAWSTNVSAKNSTSNSNNTAAVLLNSGNLVLQDTSNMSQPRTLWQSVDHPTDTLLPGAKLGRDKLTGLNRRLVSKKSMAGPSPGAYCFEVDEDTPQLVLKLCNSSVTYWSSGPWNGQYFTGIPELIGNSPGFHLGFFDNSREEYLQFNVSNEAVVTRNFIDVDGRNKQQVWLDSSQSWLTLYSNPKVQCDVYGVCGAFSVCSFSLLPLCSCMKGFTVGSVKDWEQGDQTGGCVRKNQLDCVGSNTSSSDSTDKFYSMSDIILPDKAESMQDVDSSDECMKVCLNNCSCTAYSYGSKGCLVWHTELLNAKLQQQNSNGEIMYLRLSARDMQRSKKRRVIIGVVVGACAAGLAVLMFILMFIIRRNKDKNRSENYGSLVAFRYKDLRSATKNFSEKIGEGGFGSVFRGQLRDSTGIAVKRLDGRSQGDKQFRAEVRSIGTIQHINLVNLIGFCSDGDSRFLVYEHMPNRSLDTHLFQSNGKFLDWNTRYQIALGVARGLCYLHESCHDRIIHCDIKPQNILLDASFLPKVADFGMAKFVGRDFSRALTTMRGTIGYLAPEWISGTAITPKVDVYSYGMVLLELVSGRRNSARSEEECTTTTTTSTSTDTDGNYSVYFPVQASRKLLDGDVMSLLDQKLCGEADLKEVERVCKIGCWCIQEDEVDRPTMGQVVQILEGVLDCDMPPLPRLLQRIFERPSSVSTSTPVFLFVGSPERQ

SEQ ID NO: 86434 - protein, 208 aa, Oryza sativa Indica Group
MASYHQQQGGSTFMAIPTINFQMYSEIAGDDEWWEYIPCPFCYIEVEVPFLCDHLQEEHCFDMKNAVCPICADNLDKDTDEHFRVQHSHLLKRRKSSSFSCKPSSAAADKGSYEEDSYFEAPSHCMGRPAPDSSPDPLLSQFICCSLAPPVDSPRRSEADAEGHGSSSSDDQKRREQGVMDDASKEELEERLQRIEFVKQMLMTTIAY

SEQ ID NO: 86435 - protein, 260 aa, Aspergillus oryzae
MDLHSQLQAAWDHVRTTYKPGTIELTGVIVTQIVGFIIPATLYMLIDVLFPKFSQRHKIQNIRRQPTRQQILHCVQVTMLNHVWVVALYALLVYLTGLDYAFTNQDPVVPPWKTFIVDFTFGLLAREISFYYVHRALHHPSIYAYIHKMHHKYTAPVAFAAEYAHPVEHILANILPLTLPLYLKGAHFLSIVFFFVFELWEAAADHSGYDFLKLPPAELHDLHHEKFRVNYGTIGLMDWIHGTDVVGWDRPKARKVKIAE

SEQ ID NO: 86436 - protein, 476 aa, Physcomitrella patens subsp. patens
MPPSHRIKAASISAFQEFQNARANRYTQVKSSIMVLGLSIHTTPVEMREKLAIPEAEWPRAIDELSGQNHIEEAGVLSTCNRFEIYVVAVSWNRGVKEVTEWMSKTSGIPVENLMEHLFVLRDQDATQHLFRVSSGLDSLVLGEGQILAQVKQVLKVGQEVSGFGRNLTGLFKQAITAGKRVRTETNISAGAVSVSSAAVELAVMKLPVGGVSRVNVLIVGAGKMSKLLVKHLISKGCTRMVIVNRSEQRVLDLQTEFPDAKIVYEQLGEMLRCAGEADLVFTSTSSEVPLFMKENVEPLAPASQASGGVRHFIDISVPRNVAACLSDLPSTRVYNVDDLKEVVAANKEDRRRKAADAQVIIDDEIQNFEAWRDSLETVPTIKKLRSYAERIRQTELEKALSKMPEDLTTKQRRALEDLSRGIVNKLLHGPMQHLRSDGTDSKTVNETIENMHALERMFDLGSEVLLVEAKAKGKK

SEQ ID NO: 86437 - protein, 400 aa, Bacillus licheniformis ATCC 14580
MTVLSKSEKIMKQTAHFGANNYHPLPIVISEAEGAWVKDPEGNRYMDMLSAYSAVNQGHRHPKIIQALKDQADKITLTSRAFHNDQLGPFYEKVASLTGKDMVLPMNTGAEAVESAVKAARRWAYDVKGVPDNQAEIIACEGNFHGRTMLAVSLSSEEEYKRGFGPMLPGIKLIPYGDLEALKQAITPNTAAFLIEPIQGEAGIVIPPEGFLKQAAEVCKERNVLFIADEIQSGLARTGKMFASDWEDVTPDMYILGKALGGGVFPISCIAANRDVLGVFNPGSHGSTFGGNPLACAVSIAALEVLEDERLAERSLELGEYFKEKLSQIDNPKIKEVRGRGLFIGVELTEAARPYCERLKEEGLLCKETHETVIRFAPPLVISHEDLDWAIEKITRVLSK

SEQ ID NO: 86438 - protein, 481 aa, Bacillus licheniformis ATCC 14580
MNHENREQYTLKRTMKSRHLFMISLGGVIGTGFFLGTGYTINEAGPIGAILSYLAGGMIMYFTMLCLGELAVAMPVSGSFQTYATKFIGPATGFAVGWIYWLGWSVTVALEFLSAGQLMKRWFPDVGVWIWCLIFGLLLFSLNALSAKAFGESEFWLSGIKIIVILLFIILGGGAMFGLIDLKDGQAAPFFSNLIGDGIFPNGFGAIFITMITVNFAFQGTELIGIAAGESENPEKTVPRSIKQTVWRTLVFFGLSVFVLAGLIPWEKAGVVESPFVVVFEQIGIPYAADLMNFVILIALLSVANSGLYASTRMLYSLAKEGMAAQALSRVNKRGIPMNALWITLGFAGLSLISSVVAAETLYIWLLSLAGLSAQVGWITITVSQLLFRRRYVKEGGKVEDLKFKTPLYPYLPLTGFILNSAVLVSLAFDSEQRMALYCGILFMSACYFVYHVFVKKRQALDRQEAMIYQNKTNDEVVIDE

SEQ ID NO: 86439 - protein, 994 aa, Oryza sativa
MPPAGDAAHAPPPPHRRLVFAFYLTGHGFGHATRAIEVVRHLIAAGHEVHVATAVPEFVFTAELPRSPSSQGLLHIRRAILDCGAVQTDALTVDPLASLLKYHETAVVPRESILRTEAEWLTSINADLVISDVVPVACRVAADVGIPSVCIGNFSWDYIYAEYIVASGDHHRSIVWQIAEDYSHCDILLRLPGYCPMPAFRDVTDVPLVVRGLRKSRSEVRKELGIAENAKVVVFNFGGQPAGWNLKQEWLPDGWICLVCGASDSQEVPPNFIKLAKDAYTPDAMAASDCMLGKIGYGTASEALAYKLPFIFVRRDYFNEEPFLRNLLEHYQSSIEMTRRDFLHGHWKPYLLRALTLQPCYDGPTNGGEVAARILEDTAVGKKCISDKFNGARRLQDAIVLGYQLQRAPVRDVAIPDWYSLSETEVGACPISENIKTKESTESCFEDFEILHGDLQGLPDTMSFLKSLSEFNQSELKSNGKQPQERIAASVLFDWEEEMYIARAPGRLDVMGGIGDYSGSLVLQLPLREACHVAVQRNHPSNQKLWENTQARRLENGGMEPVVQIVSFGSELSNRSPTFDMKLSDLMDVDKPISYEKAREFFCRNPSQKWAAYVAGTILVLMTELDVKFTDSMSILVSSDVPEGKGVSSSASVEVATMAAIAAAYGLNIAPRDLALLCQKVENHVVGAPCGVMDQMTSACGEANKLLAMVCQPAEVKELVAIPNHMRFWGLDSGIRHSVGGGDYGSVRVGTYMGRKMIKCAASDLASESSVSDAPVQSNDYKQNAIELLKSEASLEYLCNIPPHRYEAIYAKDIPEVITGDAFLKKYGDHDDTVTAIDPKRSYNVKAPTRHPIYENFRVETFKALLEAANTDEQLSALGELMYQCHYSYNACGLGSDGTDLLVNLVQEMQHRNMSKGESPSLFGAKITGGGSGGSVCVMGKNCLKSSEEIIEIQQRYKAATGYLPILFDGSSPGAAKFGYLKIRRRPSSPIAAK

SEQ ID NO: 86440 - protein, 719 aa, Solanum lycopersicum
MALCAYAFPGILNRTGVVSDSSKATPLFSGWIHGTDLQFLFQHKLTHEVKKRSRVVQASLSESGEYYTQRPPTPILDTVNYPIHMKNLSLKELKQLADELRSDTIFNVSKTGGHLGSSLGVVELTVALHYVFNAPQDRILWDVGHQSYPHKILTGRRDKMSTLRQTDGLAGFTKRSESEYDCFGTGHSSTTISAGLGMAVGRDLKGRNNNVIAVIGDGAMTAGQAYEAMNNAGYLDSDMIVILNDNRQVSLPTATLDGPVAPVGALSSALSRLQSNRPLRELREVAKGVTKQIGGPMHELAAKVDEYARGMISGSGSTLFEELGLYYIGPVDGHNIDDLIAILKEVRSTKTTGPVLIHVVTEKGRGYPYAERAADKYHGVAKFDPATGKQFKASAKTQSYTTYFAEALIAEAEADKDIVAIHAAMGGGTGMNLFHRRFPTRCFDVGIAEQHAVTFAAGLACEGIKPFCAIYSSFMQRAYDQVVHDVDLQKLPVRFAMDRAGLVGADGPTHCGAFDVTYMACLPNMVVMAPSDEAELFHMVATAAAIDDRPSCFRYPRGNGIGVELPAGNKGIPLEVGKGRILIEGERVALLGYGSAVQNCLDAAIVLESRGLQVTVADARFCKPLDHALIRSLAKSHEVLITVEEGSIGGFGSHVVQFMALDGLLDGKLKWRPIVLPDRYIDHGSPVDQLAEAGLTPSHIAATVFNILGQTREALEVMT

SEQ ID NO: 86441 - protein, 302 aa, Mycobacterium avium subsp. paratuberculosis K-10
MSCPNVVVPRTAIVPAAGLGTRFLPATKTVPKELLPVVDTPGIELVAAEAAEAGAERLVIVTSEGKDGVVAHFVEDLVLESTLEERGKTAMLDKVRRAPRLIKVESVVQSEPLGLGHAIGCVEPRLADDEDAVAVLLPDDLVLPTGVLGTMSKVRAHYGGTVLCAIEVTPEEISAYGVFDVEPVPDDDPDVLRVKGMVEKPKAEDAPSMFAAAGRYVLDRAIFDALRRIDRGAGGEVQLTDGIALLISEGHPVHVVVHRGSRHDLGNPGGYLKAAVDFALDRDDYGPDLRQWLVARLGLSEQ

SEQ ID NO: 86442 - protein, 199 aa, Glycine max
MASHLDFRYLDEGLGGERGKRKRREEEADAADSMDLDADAPRPSKLRAVASQSDPSKPAAFGSPTYDGVIAGRVSGRTWKEPRTRRSSALMVSRKPVPLEQRARDKSLKKAYQARVAELKDEIRQNKVAKRKQKEEREKRKKENVLRTGSKLQKVTNPKTIQKIAKSKNRGQLRVVSDDIFGGKKSEAARRMQVPGLEN

SEQ ID NO: 86443 - protein, 186 aa, Carica papaya
FGSVYKGFIDDKLRPGLKAQPVAIKLLDLDGSQGHKEWLTEVIFLAQLRHPHLVKLIGYCCEEEHRLLVYEYMPRRSLENQLFRRYSVSLPWSTRMKIAHGAAKGLEFLHEAENLVIYRDFKASNILLDADYNPKLSDFGLAKDGPEGDDTHVSTRVMGTQGYAAPEYIMTGSHLTAKSDIYSFGI

SEQ ID NO: 86444 - protein, 150 aa, Brassica napus
MATATMIFAAAMTAMILVSLQQVEAQSATTCVNKLVPCFSALTTTTKPPKDCCDSIKEAVEDELPCLCTVYNTPGLLSQFNVSTAQALNLSRRCDVTTDLSACSGTGASSPKASLPPPAGKRGNDTAVGNKLTGYGVTTVILSLVSTIFF

SEQ ID NO: 86445 - protein, 486 aa, Xanthomonas oryzae pv. oryzicola
MPIWPWAPACANGIRACSRPICAISCAVCGASSAACWPHPRSPRMLAETPLLETALERELATLAFGRRYGKVVEVVGTMLKVAGVQVSLGEVCELRQRDGTLLQRAEVVGFSRDLALLAPFGELIGLSRETRVIGLGRPLAVPVGPALLGRVLDGLGEPSDGQGAIACDTWVPIQAQAPDPMRRRLIEHPMPTGVRIVDGLMTLGEGQRMGIFAAAGVGKSTLMGMFARGTQCDVNVIVLIGERGREVREFIELILGADGLARSVVVCATSDRSSIERAKAAYVGTAIAEYFRDRGLRVLLMMDSLTRFARAQREIGLAAGEPPTRRGFPPSVFAELPRLLERAGMGESGSITAFYTVLAEDDTGSDPIAEEVRGILDGHLILSREIAAKNQYPAIDVLASLSRVMSQIVPSYHSQAAGRLRRLLAKYNEVETLVQVGEYRQGSDAVADEAIDRIDAIRDFLSQPTDQLSDYESTLEQLASVTDNA

SEQ ID NO: 86446 - protein, 264 aa, Bacillus licheniformis ATCC 14580
MTNWKEIDRLAKSWVKEAGQRIKQSMKEKMTIETKSNPNDLVTNIDKETERFFIEKIQSVFPDHHILGEEGQGDKLTSLDGVVWIIDPIDGTMNFIHQKRNFAISIGIFENGKGKIGLIYDVTHDELYHAFQGEGAYMNNTKLGKMKEVPLEESILAINATWITENRRIDPSVLSPLVRRVRGTRSYGSAALELAYVAAGRMDVYVTMRLAPWDYAAGCILLDEVGGTYTTIDGKPLNFLENHSIVAGNPAAHRAIFDEYLPHE

SEQ ID NO: 86447 - protein, 267 aa, Bacillus cereus E33L
MLTKHRILFIGAGRMAEAIFSGLLKTSKEYIEEIIISNRSNVEKLDQLRARYNVSTTTDWKQHVTSVDTIVLAMPPSAHEELLAELSPLLSNQLVVTVAAGIGPSYLEERLPEGTPVAWIMPNTAAEIGKSISLYTMGQFVNETDQETLQLLLGGIGTSQLCTEEEVHQLTAVTGSAPAFLYYFAESLIEATKSYGVDEATAKHLVIQMISGSASMLEQTQDPANLREQVTTPGGSTAEGLKALYEYNFSEAIQKAVEATNKKARGK

SEQ ID NO: 86448 - protein, 277 aa, Bacillus cereus E33L
MSLTSLKDYTTLHNGVKMPWFGLGVFKVEDGSQVIDSVKAAIKNGYRSIDTAAIYQNEEGVGQAIRESGVSREELFITSKVWNSDQGYETTLQAFETTLEKLGLEYLDLYLVHWPVKGKYTESWKALEKLYKDGRVRAIGVSNFHIHHLQDIFEIAEIKPMVNQVEYHPRLAQEELHAFCKEHNIQLEAWSPLMQGQLLDNPTLQDIAKKYNKSTAQIILRWDLQNEVVTIPKSIKEHRIIENANIFDFELSADDTKAIQALNEDRRVGPDPDNFNF

SEQ ID NO: 86449 - protein, 107 aa, Synechococcus sp. CC9311
MSSATAVTDASFEQDVLQSDVPVLVDFWAPWCGPCRMVAPIVDEISKEFEGKIKVFKLNTDENPNVASQYGIRSIPTLMVFKGGQKVDTVVGAVPKATLSGTISKHL

SEQ ID NO: 86450 - protein, 501 aa, Pavlova lutheri
MAAPTSPYGAESPRAAYAYPERANVKMSEALRVLDEGVHPLVIHSSQILAAALLVTAAVNHFPKITVADLAEIWRSLQIDVAYAFALTAVAVLLLGYYALRHPRPVYLVDFATWQLRDDKDDGSLSATSDFFRSTITDCGNFCDESVDFQMKLFERNQISERCYFPPGIRAYRKGERDFDFSMAAARKEFETVVFTTVDELLAKTGVKPRDIDILVVNCSLFNPTPSLAAIVINHYQMKDSVQSYSLGGMGCSAGLISIHLAKDLLQVYPRKRALVISTENITQNFYQGNEKSMLISNTLFRMGGAAVLLSGRHADRRVAKYQLLHTVRTHKGADPDAYRCVFQEEDKAGHVGVRLSKDVMECAGAAMKTNISVLAPLILPVSEQVRFLANYVARKWLRMKGVKGYVPDFTTAVQHFCIHTGGRAVLDALQANLSLSDYYLEPSRYSLWRWGNVSSASVWYELDWLEKSGRIRRGDKVWQIGFGSGFKCNSAVWRACRAMP

SEQ ID NO: 86451 - protein, 152 aa, Streptomyces antibioticus
AGRIVFKLFDDVVPKTAQNFRELATGQHGFGYAGSPFHRVIPNFMLQGGDFQPRVNGTGGKSIYGEKFADENFKLKHDRPFLLSMANAGRNTNGSQFFITTVVTDWLDGKHVVFGEVVEGPGTWSRRSQSYGSSPAGTTSASIKVAESGALN

SEQ ID NO: 86452 - protein, 328 aa, Streptomyces ambofaciens
MTLRRTLTPSAMCDSLCYMTRQRWTAEQIPDQTGRVSVVTGANSGLGLATTKTLARKGAQVVLAVRDEEKGRRAADAIIAEQPGAHLEVRRLDLADPASVRAFAHQLHTDGYRVDVLVNNAGLMAPPRTLTLQGHELQFAANHLGHFALTGLLLDLMTDSDDPRVVTVTSANHRQARIAFDDLSGERKYSPMGHYNQSKLANAAFGWELHRRLSAAGSPVRSVLAHPGYTATNLQTSTPAGMVKLLFGRLLLPLAQSPDQGALPQLYAATAPEVQGGELFAPDGMGELRGAPKRAQLAPRATDPDTVSRLWQLSEQLTDVRYVLRAAT

SEQ ID NO: 86453 - protein, 463 aa, Ralstonia eutropha JMP134
MERVPRSRGKGGKPMRTRKADFVVIGGGSAGVACARRAASHGASVVLIERDEIGGTCVNRGCVPKKMLSYGATWAAILSGCLSHTGGHEDWRDAIVRVNAEVARLNVVYAQRLLEAGVDILRGDAVVTAPDEVRVGDEVIRAKRILIATGARPKTLDIPGGELASNSDDVFTWQTVPGSIAVIGGGYIGVEQASILSRYGVKVDLLVAGDRLLPHFDAEIAEALAGALETKGVRLHLNASVNLISQANGALEVCYRPGNKPGQTESIRAQAALVAVGRVSNVDGLGLDAIGVKLGDKGGIKVDRQFRSSVRSIHAIGDAIEGLHLTPVATSQGRWLADRLFGRRGERADFDFVPTAVFCEPAIGAVGLTEAQAIEEAGKPERIRTVVKRFVSLENRFGGNGMQSVFKLVLNARTGRVLGVHLMDNAAPEIVQAMAVALRLGVRESHLETTLQLHPTVAEELFG

SEQ ID NO: 86454 - protein, 388 aa, Xanthomonas campestris pv. vesicatoria str. 85-10
MIRTGTMPLTTKLPKVGTTIFTVMSQLAAEHGAVNLGQGFPDFAVPQRLVDELSKAMAAGHNQYPPMTGVAALRQAIAGKAQRCYGAQVDADTEITVTSGATEAIFNAIHAVVRAGEEVIVLDPAYDCYEPAIDLAGARAVHVALHPQTFAVDWAALRAAITPKTRLLMINSPHNPSGAMLSAEDMQTLTELLRGTDIFLLSDEVYEHIVFDGRRHESVLRWPELRERALVISSFGKTYHCTGWKIGYAIAPPALTAEFRKVHQYNTFTSFGPAQHAFAAMIRDEPEHDEQLGAFYQAKRDHFRERLLTTRLKPLPVPGGYFQLVDYSAISDLPDTEFVKWLTIEKGVAAIPLSPFYQNAPAGQRLARLCFAKNDATLDAAIERLRRL

SEQ ID NO: 86455 - protein, 257 aa, Burkholderia vietnamiensis G4
MTTPLKVFITGASSGLGLALADEYARQGATLALVARRTEALDAFARRFPKLSVSVYRADVRDADALATAAASFIAAHGCPDVVIANAGISQGAVTGQGDLAAFRDVMDINYYGMVATFEPFVGPMTAARHGTLVGVASVAGVRGLPGSGAYSASKSAAIKYLEALRVELRPAGVGVVTIAPGYIRTPMTAHNPYRMPFLMDADRFAARAARAIARQHAFRVIPWQMGVVAKVLHVLPRWLYDRLFEKAPRKPKAGAH

SEQ ID NO: 86456 - protein, 284 aa, Bacteroides fragilis YCH46
MKKFIKGVRFTPSNYPDEIEDKIQKYRKQGYKLPPRKVLRTPEQIEGIRESAKINTALLNHIAENIREGMSTEEIDRLVYDFTTSHGAIPAPLNYEGFPKSVCTSINDVVCHGIPSSTEILKSGDIINVDVSTIYNGYFSDASRMFMIGEVSPEKQRLVQVTKECMEIGIAAAQPWARLGDVGAAIQEHAEKNGYSVVRDLCGHGVGIKFHEEPDVEHFGRRGTGMLILPGMTFTIEPMINMGTYEVFVNSADDWTVCTDDGLPSAQWENMILITETGNEILTY

SEQ ID NO: 86457 - protein, 279 aa, Triticum aestivum
  misc_feature (202)..(202): Xaa can be any naturally occurring amino acid
  misc_feature (225)..(225): Xaa can be any naturally occurring amino acid
  misc_feature (246)..(246): Xaa can be any naturally occurring amino acid
AYLGDTIEQVCTKKQAGTGPEFPGYRRPTRPIVYRPLTEMYEAAADANVVFTSTASESLLFTKEHAEALPPISLAMGGVRLFVDISVPRNVGACLSEVEHARVYNVDDLKEVVEANKEDRVRKAMEAQAIITQELKRFEAWRDSLETVPTIKKLRSYADRIRASELEKCLQKIGEDNLNKKMRRSIEELSTGIVNKLLHGPXLQHLRCDGSDSRTLNETLENMQXALKGCSTFDTEKGGSSSQKIXAKGREKPQAEDPGTGCQSCIPGLSTPLTECLYL

SEQ ID NO: 86458 - protein, 277 aa, Oryza sativa
  misc_feature (188)..(188): Xaa can be any naturally occurring amino acid
MAERGGGGERGGERGGFGRGFGRGGRGDRGRGGRGGRRGPRQEEEKWVPVTKLGRLVKENKIHKIEEIYLHSLPVKEHQIVEQLVPGLKDEVMKITPVQKQTRAGQRTRFKAFVVVGDGDGHVGLGVKCAKEVATAIRGAIILAKLSVVPVRRGYWGNKIGKPHTVPCKVTGKCGSVTVRMVPAPRGXSGIVAAHVPKKVLQFAGIEDVFTSSRGSTKTLGNFVKATFDCLMKTYGFLTPDFWRETRFIKTPFQEYTDLLARPKGLVIEAPAEKIEA

SEQ ID NO: 86459 - protein, 475 aa, Prosthecochloris aestuarii DSM 271
MKNHTVCNSGAAVQTEAEIAELCVHLRSVFQERRTSGYAWRKEQLMQLQRFLEEREEDILQALHEDFRKPQTETWFTEIHYLLTEITVALRHLRRWMKPVTVHTPLRYQPGRSYYICEPCGVVLNIAAWNYPLQLSLAPAVAAIAAGNCLVIKPSEMAPATAALLSDGLKDYLDSDAIRVVQGGAEVTASLLTHRFDHVFFTGSQQVGRLVLSAASRHLTPVTLELGGKSPCIVDKGTNIDVAARRIVWAKYINAGQTCISPDYVLVQSAIRQDLLDALQRAIDAMYGPGSRERGAYAGIISEGHVRRLQELMKGGSIVCGGGSDAQSRYVEPTILTDVSLSSPLMQEEIFGPLLPVIAYDTPEEAVAVVRSAGDPLALYIFSPQRHVYEYFMGHIHSGGVCINDLLFQAAIPALPFGGRGTSGIGRYHGRSGFETFSRLRSVHRKGTFPENALRYPPFGSLKFKLLQQLFKRFH

SEQ ID NO: 86460 - protein, 459 aa, Pneumocystis carinii
MNAARRVTRQTATFNLNDENKLHGQISRVKQVSTQGLEGVNKPWTAATRKRAALGDVSNVHNKENQTAKTKTQPLSTKARVVTKTGVQSHQSKESVHTVPTGELRGEETTRKRRTSKVLTEQEVIIEVEQTQASKKVRTDGLLNGSVQEHPASQDWDDLDADDAHDPLMVSEYVEEIMGYMRELEVLTLPLPDYMDRQKELQWKMRGILVDWLIEVHAKFRLLPETLFLSVNIIDRFLSLRVCSLPKLQLVGITALFIAAKYEEVMCPSIQNFMYMADGGYTNEEILKAEQYVLQVLGYDMSYPNPINFLRRVSKADNYDIQTRTVAKYLMEISLLDHRFLPFVPSNIAASGIYLARIMVTGGNWNANLIHYSGYKESDLVPCSKMMLDYLSRSVIKHEAFFKKYASKKFMKASLFVRDWVKKHYDLEANVRLNTISFDYDNHESNEIHQDLEEEEGSL

SEQ ID NO: 86461 - protein, 599 aa, Campylobacter upsaliensis RM3195
MSKNKILSLLFCLAVLGVFYLTPIPMGLEANSWHFLGLFVAVILAVILQVMPLGAVCLIAIAIVALSGITTPQSQIRAVHIKSLQGIVMSDNANSQKIAMDKATEEAILNALLNTSKMPKEKLDELLSIKDKNRQIDLLAKFYAKQTSQVQKNKLIDESKIFALNTLALQNMSQKDIDERVNKAISSLKSKTGINDALSGFSNSLIWLIVVSIIIARGVIKTGLGKRLAYYFISIFGKRTLGIAYSIVASETILAPVTPSNTARAGAIINPIVQAISRSFKSSPEDNTQSKIGTYLSLVNYQANPISSAMFITATAPNPLVVDLVAQATNMDISLTWTQWALGMFLPGICAMFIMPLVIYFLSPPEIRQTPNASKFAKERLAELGAMKRAEKIMLGVFLLLLALWAGALGLFFGISLNATTVALLGLSLVLVSGVLSFDDVLKEKTAWNTLVWFSALVMMATMLGKLGVTQFLAEALGGLASSMGLGEISVMIFLSLAFLYAHYFFASTTAHISAMFFVFYSAGLALGAPPLLYAFIMITSSNIMMALTHYATGTAPVIFGTNYVTLKRWWGVGFVISVVDMLVMISVGLVWWKFLGFY

SEQ ID NO: 86462 - protein, 441 aa, Azospirillum brasilense
MRIAMIGTGYVGLVSGACFSEFGVHVTCVDKDASKIERLKRGEIPIYEPGLDELVARNVAAGRLSFTLDLKEAMAGADAVFIAVGTPTRRGDGHADLSYVYAAAEEIAANLDHYTVVVNKSTVPVGTGREVKAIISRTNPNADFDVASNPEFLREGSAIGDFMRPDRVVIGTSSERAAEVMRRLYRPLYLIETPIVLTSLETAELTKYAANTFLAAKITFINEIADLCEKVGANVHDVARGIGLDGRIGKKFLHPGPGYGGSCFPKDTLALVRTAQQVGSPLRIIETVVDINDKRKKQMAERIVAACGGSVSGKTVGVLGVTFKPNTDDMRDAPSLDIVPALQAAGATVRAFDPAGMHEAEKLLPGVVWAKDAYGALDGADCVAILTEWNEFRALDLKRVKTLLKEPVMIDLRNVYNPGDMAAAGFAYSSIGRPTAPSQNV

SEQ ID NO: 86463 - protein, 252 aa, Campylobacter upsaliensis RM3195
MIELRKPTEIQKLREANKIVAKTLDFLEREVKAGMSLRQISEMAEEFILSSGAKPSFKNLYDFPSAICTSLNEVCIHGIADDKVLKDGDILGIDVGTLLDGYYGDAARTLAIGKISKKDEELIACAKDALYFAIDSIREGMRFKELSALLGEFIASHGFVPLQGYCGHGIGTKPHCEPEILNYLEKGSNAKSGPKIKNGMVFCIEPMICQKDGTPKHYNGRWDAGSVDGLNTAHYEHCVAIIKGRAEILSQI

SEQ ID NO: 86464 - protein, 377 aa, Pyrococcus furiosus DSM 3638
MCLEVLLLLSLMLAVAKIMGYIFERLGQPAVLGQIFGGLLLGLFIETNPVISEFANLGVLLLLFIAGLESELEEFKKVGKRSVIVAVFGVVVAFLFGFLVALPFTSFERAIIYGALMTPTSVSITVKVLMEMRKLNTIEGTTILAAAVVDDILGIIVLTFAISIARRVSIEYLKVMEVLVSVSALIFFFLYFGPRLAETFFRRLRIIDLPEVETAFAIVFLVLFSYLAEHLNLASILGAYLVGLAIGQTSQKKVILDHVNILGYSLFIPVFFVEVGMKMKAHHLLHVSSFAILYTLMAIVSKIVGCGIGAKLSGFNWRSSLKIGVGMIPRMGVELAMLSIAISAGVMDLASLTVIVVMVFVTTLITPPLLKVVYMKT

SEQ ID NO: 86465 - protein, 289 aa, Saccharomyces chevalieri
MSNESNDLEKNISHLDPTGVDNAYIPPEQPETKHSRFNIDRDTLRNHFIAAVGEFCGTFMFLWCAYVICNVANHDVALTTEPEGSHPGQLIMIALGFGFSVMFSIWCFAGVSGGALNPAVSLSLCLARAISPARCVVMWFSQIIAGMAAGGAASAMTPGKVLFTNALGLGCSRSRGLFLEMFGTAVLCLTVLMTAVEKRETNFMAALPIGISLFMAHMALTGYTGTGVNPARSLGAAVAARYFPHYHWIYWIGPLLGAFLAWSVWQLLQILDYTTYVNAEKAAGQKKED

SEQ ID NO: 86466 - protein, 131 aa, Streptomyces antibioticus
SAGRIVFKLFDDVVPKTAMNFRELATGQHGFGYAGSPFHRVIPNFMLQGGDFTQGNGTGGKSIYGEKFADENFKLKHDRPFLLSMANAGRNTNGSQFFITTVVTDWLDGKHVVFGEVRRGARDLVKKVEST

SEQ ID NO: 86467 - protein, 330 aa, Oryza sativa
  misc_feature (85)..(85): Xaa can be any naturally occurring amino acid
HFLSLLCLQDLGAGTLSLISPTDIRPGFLPVFRSGSCADIGTKSYMEDEHVCVDNLIEHLGVRTPVIPAPGAFYGVFDGHGGTDXAACFVRKNLLRFIIEDGHFPSSIEKAIRSAFVRADHAIADSHSLDRNSGTTALTALIFGRTLLVANAGDCRAVLGKRGRAVELSRDHKPSCRSEKIRIENLGGTVFDGYLNGQLSVARAIGDWHVKGSKGSISPLTAEPEFQEVRLTEEDEFLIIGCDGLWDVMTSQCAVTMVRKELMTHNDPERCSQELVQEALRRNSCDNLTVVVVCFSSDPPPQIEVPRFRVRRSISMEGLHMLKGALDSNA

SEQ ID NO: 86468 - protein, 379 aa, Pyrococcus furiosus DSM 3638
MDVFLELALILIMAKIFGYISVRFGFPAALGQLIGGIIIGPSLLNIVPYSEEVRLLAELGVVILLFLAGLETDVEEFKKVGFPAFIVAILGVFVPFVLGYASALAFGYPNMQALFLGGVLTATSVGLTTSILMEMKKLRTKVGTTILAAAVIDDVLGIIVLTILVAISTRGSVNLFDLGIIFLEVVVFFTLGLLLGNPAVKEMLKLSERITLPETVTAFAISIMLLFAYIAEKFQLAGITGSYLAGILVAMTEEAREITNKIMTIGYSLFIPIFLVSIGIESDLHVLLHASLFAIVYAVVGIVGKVVGCSLGALLVKFKPKEALQVGVGMIPRMEVALIMANIGLREGVFTRDVFSIPVVMVVVTTLVTPFLLKLAFSK

SEQ ID NO: 86469 - protein, 309 aa, Bacillus licheniformis ATCC 14580
MNCRHNKELEYFVTEAKKVTDKGKVASYIPALAELSEDDLSAAVYFTDGTCISAGDVEKAFTLQSISKVLSLALVLIDHGPEKVFHYVGQEPTGDPFNSIIKLETVNPGKPLNPMINAGALVVTSMIKGETNADKIGRLLDFIKKLANNRSITVCGKVAESEFETSMVNRAMCYYMKEHGIFQAEVEDVMDVYTKQCAIEMNSLDLAKIGSVFALNGKHPETGEQIIPKDIARICKTFMVTCGMYNASGEFAIKIGIPAKSGVSGGIMGLSPYRFGIGIFGPSLDEKGNSIAGIRLLELLSANYSLSIF

SEQ ID NO: 86470 - protein, 113 aa, Bacillus sp. SG-1
YGGAYVALNSKSIGADLVYSWPNAEIAVMGPQGAANIIFAREIQNSDNPEEVREQKIEEYREKFANPYVAAARGMVDDVIDPRETRIKLIQGLEMMRNKKEERPKKKHGNIPL

SEQ ID NO: 86471 - protein, 211 aa, Zea mays
MTSVWKTKVLPGLNKIFDKDGKKAAAAGFLKSFNKEEIDKEIEDKKTELEPKVVEAYEASPPEVKALFKDKKPVKVSKKNSAAVTKFLDELAKIDFPGAKVVSEAVAKSGTSPLLPAITFILDKVAPFIPKEEPKAEPAAEATSREVAVEEKKEEAEPAAATEAAPAPAETPSEAAVVEEKKEEEKKEEEDKPAAEEAAPPAEAAAAAEEK

SEQ ID NO: 86472 - protein, 499 aa, Dechloromonas aromatica RCB
MNAPESLPVEFPVFDNSFAALPEAFYTRLEPHPLPEPYVVGVSTEVADLLGLPAELMNSPQFAEIFAGNRLLPGSEPLAAVYSGHQFGVWAGQLGDGRAHLLGGLRNDQGHWEIQLKGAGRTPYSRGADGRAVLRSSIREFLCSEAMAGLGVPTTRALCVIGADQPVRREEIETAALVARVAPGFVRFGSFEHWASRDRSRELQQLADYVIDTFRPACRDAENPYDALLRDISRRTGELIAHWMAVGFMHGVMNTDNMSILGLTLDYGPFGFMEAFDAGHICNHSDHQGRYTYRNQPHVAQWNLYCLADAFLPLLKHPDISRVAVDETYGDAFAQTFERLMCAKLGLRHALPDDENFIGETFGFLQQHRPDFTLFFRRLSRLSGGLDGEAMAKADAPLRDLFVDRAACDAWLANWRARLAQTPWDDGERQASMLAANPKYVLRNWLAEAAIRKAKLKDYSDVQRLLTCLRRPYDEQPEFDDLAALPPDWASGLEVSCSS

SEQ ID NO: 86473 - protein, 481 aa, Salmonella typhimurium LT2
MTIWENAMQYQLLINGVLVDGEGERQSVYNPATGEVILEIAEASPAQVDAAVQAADNAFAEWGQTTPKARAECLLKLADSIEQNALEFARLESQNCGKPLHCVINDEIPAIVDVFRFFAGAARCLSGLAAGEYLEGHTSMIRRDPIGVVASIAPWNYPLMMAAWKLAPALAAGNCVVIKPSEITPLTALKLAVLAKDIFPPGVLNVLFGRGQTVGDVLTGHEKVRMVSLTGSIATGEHILRHTAPAIKRTHMELGGKAPVIVFDDADLDAVAQGVRTFGFYNAGQDCTAACRIYAQRGIYDALVEKLGNAVSSLKMGAPEDESTELGPLSSLAHLKRVTAAVEEAKALSHIRVITGGSQTEGKGYYFAPTLLADAKQEDAIVQREVFGPVVSITVFDDEDQVLRWANDSRYGLASSVWTQDVGRAHRLSARLQYGCTWINTHFMLVSEMPHGGQKQSGYGKDMSLYGLEDYTLVRHIMVKH

SEQ ID NO: 86474 - protein, 448 aa, Burkholderia vietnamiensis G4
MSTPATDDWVARSLRAVWHPCTQMKHHERLPLVPVARGAGVWLYDRDGRRYFDAISSWWVNLFGHANPHINAALKDQLDTLEHAMLAGCTHEPAIELAERLHALTARTLGHAFFASDGASAVEIALKMSFHAWRNRGQGDKREFVCVANSYHGETIGALGVTDVALFKDAYDPLIRNAHVVASPDARGAQPGETAADVAQRALGDVRRLFAERAGQIAALLVEPLVQCAAGMAMHDPSYVRGLRALCDEFGVHLIADEIAVGCGRTGTFFACEQAGVWPDFLCLSKGISGGYLPLSLVLTRDDVYAAFYDDDTTRGFLHSHSYTGNPLACRAAVATLELFARDDVLAANARKSAALRAALAPLDAHPQVRHLRERGTLFAFDVALDGDAARGFSRRFFERALERELLLRPIGTTVYLMPPYVMTDDDIAWLAQRTRDTLDATLAEAAR

SEQ ID NO: 86475 - protein, 315 aa, Zea mays
  misc_feature (26)..(26): Xaa can be any naturally occurring amino acid
  misc_feature (85)..(85): Xaa can be any naturally occurring amino acid
MAACVDKWHPTHAGRLTGAIYRYLPXGATDRAVAAAAAAPASASGGDDDDVWDELRAEAQADADAEPLLRKYYADLVLSRPSLEXAALAAHLSAKLCVPGALPQDALRDLLAAALAARPESGRAARADLRAARDRDAACGRMVHCFLYYKGFLALQAHRAAHGLWCEGRSAPAFLLQSRASEVFGVDIHPGARIGSGILFDHATGIVIGETAVVGNDVSILHGVTLGGTGKESGDRHPKVGDGVLIGAGASVLGNVRVGAGAKIGAGAVVLRDVPEGTTAVGNPAKAVGKKAAPQRRPEEQPGVTMEQGWSDYVI

SEQ ID NO: 86476 - protein, 417 aa, Bacteroides fragilis YCH46
MKNIFKDLKSKDHKRYLGGLDVFRYIGPGLLVTVGFIDPGNWASNFAAGSEFGYSLLWVVTLSTIMLIILQHNVAHLGIVTGLCLSEAATQYTPKWVSRPILGTAVLASISTSLAEILGGAIALEMLLDIPIVWGAVLTTVFVSIMLFTNSYKKIERSIIAFVSVIGLSFIYELFLVDIDWPMAVEGWVTPAIPKGSMLIIMSVLGAVVMPHNLFLHSEVIQSHEYNKQDTASIKKVLKYELFDTLFSMIIGWAINSAMILLAAATFFKSGIQVEELQQAKSLLEPLLGSNAAIVFALALLMAGISSTITSGMAAGSIFAGIFGESYHIKDSHSQVGVILSLGIALLLIFFIGDPFKGLIISQMVLSIQLPFTVFLQVGLTSSRKVMGDYVNSKWSTFVLYTIAVIVTVLNIMLLFS

SEQ ID NO: 86477 - protein, 467 aa, Sinorhizobium meliloti 1021
MAREAAEKTATSTSLAALAGLVERYANPDFAIAPGGHVQTISPGHYTVSGLSRHVRLGDFVAHKSTTGTHLGEVVRVEPERVVVCPIEPGDPIGIHDVVIRKGAFRIAPTDNWCGRTINALAEPIDGLGALLQGDIRRSIANTAPPSMTRKRVEQGFRTGVRAIDIFSPLCLGQRLGIFAGSGVGKSTLLSMLARADAFDKVVIALVGERGREVREFIEDTLGDNLSKSVAVVATSDESPMLRKMAPLTAVTIAEHYRDKGDNVLLIVDSVTRFAHAIREVATAAGEPPIARGYPASVFTELPRLLERAGPGAEGAGTITAIISILVDGDNHNDPVADSARGILDGHIVLDRSLAEEGRYPPVNPLASISRLARKAWTPDQEKLVARLKSLIHRFEETRDLRLIGGYRPGGDADLDMAIKQVPVIYDVLKQMPGERPAFDAFTDLANALKAAAMGNQPGAAGLRGRG

SEQ ID NO: 86478 - protein, 487 aa, Riemerella anatipestifer
MQRARRARIVATLGPASRAPGTVKALAQAGVDVFRLNFSHGSHDDHAAALKAVRGAEMALKRPLGVLADLQGPKLRLGRFADVEIEVKPGHQMRFDLNPALGDETRVQMPHPEIFKALRPGMLLLLDDGRVRLRVGERTDEWCDVTVESGSKLSDRKGVAVPEAVIPVSALTPKDREDLAFALRLGVDWVALSFVQKAEDMAELKSIVNGQAACLAKIEKPQALNDLESILDYCDGVMVARGDLGVEMDPEEVPVAQKKILRAARQRGVPAIVATQMLESMTSAPAPTRAEASDVANAVYEGADALMLSAETAAGDYPLEAVAIMNRIMERVERDPLWPGLMDAEHAGMDIDDVDALVAAARKAAEASSTACMVVFTTLGGTARRMSRERPLQPVLALTPKPETARRLALVWGLEPRLGEQPTSLEGLTDDAVEAAMLYGLAEPGQRILILAGTPFGAPGAANLLRLAHAPAHAAPRQHGAKRARKT

SEQ ID NO: 86479 - protein, 326 aa, Streptomyces ambofaciens
MRAVVLHEFGPAANLRYETVPDPVPGPGEVRLLVKAAGVHQIETAMREGLEIGPPLPVLPAIFGAEVAGVVEAVGPAVDDAWIGADVVTAHGRPGGYAELAVADVSSLHRIPAGLGHDAAVTMVVTGATTMGLLDIAELTSDDVVLVTSAAGGIGRLVVQFAGRLGATVIGAAGGPAKTAAVRELGADVAVDYNLPDWAGAVRDALGGRGVTVVLDGVEGDKGRAAFGLLAQGGRYITIGAASREEFRPDEAELKERGVHFTDALAILLEGQDAAADEARALTAAADGNLVPAFQAFPLSQAAEAHAALEARATTGKVILVPDAHE

SEQ ID NO: 86480 - protein, 472 aa, Clostridium difficile 630
MTELMIISGLVLLICITSSKVLYKFGVPILLIFILLGMLFGSDGMVGIYFDNYELTKQLCSIGLIFIMFFGGFGTNWNMAKPVAIPSILMSSLGVIITAGVTGMFCHMVIGTSLLEGLLIGAIAASTDAASVFAVLRSQKLNLKGSLASLLEVESGSNDPIAYMLTLILLTLMNNSGVELIAPMVIKQIAFGLAIGFILAKLSVYILRHSNFEIEGFYTIFITAIAILSYAFSEYLGGNGYLSVYISGIIIGNSRIPLKKSLVHFFDGISWIMQIMLFFMLGLLSFPSKLPNVFGIAMAISIFMIVIARPLATFIVLAKFKFSNKEKLFISWVGLRGAASVVFAIYAVTQGVAIENDIFHIIFFIALLSVGIQGSLIPTVARKLDLVDDNTPVLKTFNDYDGEISSKLIEVNVDEGNKWANKSIIDSNIPDDILIVMIKRKEQVLIPKGSTIIKTGDILVLSGDRIEELIQL

SEQ ID NO: 86481 - protein, 377 aa, Picea sitchensis
MSSLVVNNGCEICTDGFFESEEEELLGQIHAWNCTFAFVESLAVKCAILLEIPDMIAREGPRATLSLNEIAARLPRESPDVSCVFRIMRFLVAKGVFRASVVKSSEDGGSYETRYGLTPVSKWFVKEREQSMVPMLLLQNDERIVAPWHCFNECVLDGGLPFQRTNGGDMWSYTSAHPDFNHLFNNAMACDTGIVMKALLSKYRGFHALNSLVDVGGGTGTATAEIVRTYPSIKAINYDLAHVVATARQLPGVEHVGGDMFETVPSGDAIFMKWIMHNWSDEDCIKILKNCRKAIPETGKVIIVDMVVDSQHNNKNERAALDPNLCLVFDLLMATHCTGGKERTEEEWKKILWEGGFGDYNIIAIPAVQSVIEAFPR

SEQ ID NO: 86482 - protein, 265 aa, Campylobacter upsaliensis RM3195
MMRIKFNGVWIECAFKTSIDFFKSMSQNESDVWIINGFATKEKLELSENDELFCIAKNTMPPRDALDAMMRARHTPKLHDKLKQAKVAVCGLGGLGSHIAIMLARSGIGGLKLIDFDVVEPSNLNRQAYYVSDLGKFKTEALKEQISHINPYTAVEIHTLKIDENNIKELFKDTKIVCEAFDRAEAKAMLAQNFHKYFENQILICASGLAGYGESNAIQTRKIAKNFYVCGDLVNGAKVGNGLMAPRVNICAAHQANLVLELLAN

SEQ ID NO: 86483 - protein, 502 aa, Arabidopsis thaliana
MTILLCFFLVSLLTIVSSIFLKQNKTSKFNLPPSPSSLPIIGNLHHLAGLPHRCFHKLSIKYGPLVFLRLGSVPVVVISSSEAAEAVLKTNDLECCSRPKTVGSGKLSYGFKDITFAPYGEYWREVRKLAVIELFSSKKVQSFRYIREEEVDFVVKKVSESALKQSPVDLSKTFFSLTASIICRVALGQNFNESGFVIDQDRIEELVTESAEALGTFTFSDFFPGGLGRFVDWLFQRHKKINKVFKELDAFYQHVIDDHLKPEGRKNQDIVTLILDMIDKQEDSDSFKLNMDNLKAIVMDVFLAGIDTSAVTMIWAMTELIRNPRVMKKAQESIRTTLGLKKERITEEDLGKVEYLNHILKETFRLHPALPFVVPRETMSHIKIQGYDIPPKTQIQLNVWTIGRDPKRWNDPEEFNPERFANSSVDFRGQHFDLLPFGSGRRICPGMPMAIASVELALMNLLYYFDWSMPDGTKGEDIDMEEAGNISIVKKIPLQLVPVQRY

SEQ ID NO: 86484 - protein, 282 aa, Picea sitchensis
MTKEERRESEQQGFAPKDYTDPPPAALIETSEFKLWSFYRALIAEFVATLLFLYITIATVIGHSRTSTNCGSVGVLGIAWSFGGMIFVLVYCTAGISGGHINPAVTFGLFLARKVSLPRAILYMIAQCLGAICGTGLVKAFQKSFYDRYGGGANYVHHGYTKGVGLAAEIIGTFVLVYTVFSATDPKRSARDSHVPVLAPLPIGFAVFMVHLATIPITGTGINPARSFGAAVIYGHKQSWDDHWIFWVGPFAGAALAAAYHQYILRAAAIKALGSFRSNANV

SEQ ID NO: 86485 - protein, 399 aa, Helicobacter hepaticus ATCC 51449
MDFTHTQALDEEFVLHTYARANVAFVRGENARIFDTQGNDYIDFGAGIGVCSVGHANAKLAQTIYKQAQTLLHTSNLYYIQPQARLAQEIITLYRYNTPYTAPMRAFFCNSGAEANECAIKIARKYGKPRNAYKIITLDSSFHGRTIASLKATAQEKMHQHFGPFPDGFVYAKNLDDVIAKIDDSTCAVLLELVQGEGGVLPMDKEKINTLSTILKQKQILLMVDEVQSGVFRSGEIFASKVYEIDPDVITTAKGLAGGVPIGAVLTKLTDIFEYGDHGSTFGGNFLSCAAGLETLAILNELYNNGTLQRTITLFHAELDALVVDFADIFSHKVGLGLMCGLYTRNPDMQQEIIAQALKHYVIVLKSGKGVVRFLPPLTITQEEIKEGFARVRNALKTL

SEQ ID NO: 86486 - protein, 409 aa, Chlamydomonas reinhardtii
MEDLLHWAISHSDPAKLAAAAEEAQRVQVVKDLKEQRRRVKEPTEADMMREGIDILRRAGASDTELLAALQALQVLVEPIDNANDLHPLGGLSPVVAQLARLAEAPALATAAAHVIGTAASNNPTFQRALLSQHPEVVGTLLQRKSLSLFMDLVDTQPAAAAAAAEAGAAAGAAGGAGGGGDVEAGAAADGGEGLEGAGGGKQEVIRRLQREADQRQQQQHGDAHEDAHAGYGPQALAAAAISTGLPEAVVALLAQPDPDMQEKALLVLQRLAGDGVARQVLRANGADEALVQLRAQLRADAPGPGDEADPYHDYLTDLAAQVAAAMAAPGPQAPAGSGGGAAATAAGAGAGAAAAAGRSGAAGAAEAGKGGSGIGRGGLKGEVEGVEVQQPVLALGGPSRTKKNVLDW

SEQ ID NO: 86487 - protein, 480 aa, Azospirillum brasilense
MTNASQNSRIHPVILSGGAGVRLWPMSREQYPKQFLPLCSERSMLQDTAGRVSDAARFADPLIVCNQEHRFVIAEQMRQTGRGTARIVLEPVGRNTAPAAAVAALIVAEQDPDGQILLLPADHAIQDQDAFLQAVATAAAAAASGHLATFGIVPTAPETGYGYIRRGGAVEGHGGAFRVAAFVEKPPREQAERYLAEKDFFWNSGMFLLPVRQYLAELERWAPAVLEACRTALARGRSDLDFFRLDEEAFAASPNISIDYAVMERTEAAAVVPCSIGWTDVGAWSALWEIGVKDQGGNVCHGDAVAWDSRGCYVRSEDGALVALLGMEDTVVVATEDAILVAAKDRAQDIKPLVEHLKTQGRSEPLLHRRVHRPWGFYQSLHAGDRFQVKRLTVSPGARLSLQKHYHRAEHWVVVNGTALVTRGDEQILLRENESVYIPLGTPHRLENPGKVPLNLIEVQSGSYLGEDDIVRFDDHYGRS

SEQ ID NO: 86488 - protein, 686 aa, Arabidopsis thaliana
MEKVVLRVHDHPLLPFERFYFGRCSGCSREGYFYGGYRCNELACFAVFHKECAESKPEISHHAHPKHLLKLGNRRQRCHLCERPVGIGYFCSICDFGMHLVCAKSPPLSLQPQLSSIENYKVHEHPLKPFKTAWLAETGNCKGCNYIIGNGDSAPFYECRRCKLYIHVTCLELFFTTDARHNSHLEHPLKYLKNGPPSYADHKCLLCGREFEDQQGQKYELYHCDVCNFSICISCQGNPPPLVVVTPKTHEHQLHLIPRLLDFTCNACGTQGDRSPYFCLQCNFMIHRGCIDLPRIININRHDHRISYICHLGQGNLKCGVCRKTVDGFYGAYSCSKCSSYVVHSLCATRKDVWDMVELEGTPEEEEIAPFEVVDENTIKHMSHDHDLIFNNDGINLHESKLCEACVSQINTDPFYSCELCGFILHQTCANMPRKKRHVLCNIPFSLQTDDSKDSSRLRRKCSLCLQHFTGFAYNLHIAYNSRTEVMDIRCGSIFEPFVHERHPHPLYYKFFTFSAVAKCDICHITRRHLLCCEECDFRLDFRCATLPKKVMKQRYDDHPLFLSYGENNVDGEYWCDVCEKRVDAKTWFYTCDACGVTLHVSCVVGDFSYHMPGPLSTVVSEYKMVPPAVVSLYKVVPNTSICRPLCSRCHTRCKLPCILETSEDGVNVYFCSNDCHKNPWESSYY

SEQ ID NO: 86489 - protein, 215 aa, Zea mays
MAEPRLEDSQPVDLSKHPSGIVPTLQNIVSTVNLDCKLDLKAIALQARNAEYNPKRFAAVIMRIREPKTTALIFASGKMVCTGAKSEQQSKLAARKYARIIQKLGFPAKFKDFKIQNIVGSCDVKFPIRLEGLAYSHGAFSSYEPELFPGLIYRMKQPKIVLLIFVSGKIVLTGAKVREETYTAFENIYPVLAEFRKVQQWYVVLFYHVSIIVRS

SEQ ID NO: 86490 - protein, 240 aa, Zea mays
MMEGGSRADGRNPNQLRPFTCTGNPLHRAHGSARWAQGDTVVLAAVYGPKPGTRKGENPEKASIEVVWKPKTGQIGRQEREYEMTLKRTLQSICLLTVHPNTTTSVVLQVVGDDGSLMSCAINASCAALAFAGIPMKHLAVAISCGVMDNGVVILDTSRAEEQQARSFAHLVFPNSRKSVESKDTTQRDEESERGLITCITHGAMSEDDYFNCIERGVMASSRISDFMRKTLQKEASRDA

SEQ ID NO: 86491 - protein, 579 aa, Candida glabrata CBS 138
MADITEKTAEQLENLSLQDKQEGTNEENQSETVSASLYVGDLDPSVSEAHLYDIFSPIGAVSSIRVCRDAITKTSLGYAYVNFNDHDAAKTAIEKLNFTPIKGKLCRIMWSQRDPSLRKKGAGNIFIKNLHPDIDNKALYDTFSVFGNILSSKVATDETGKSKGFGYVHFEEDESASEAIDALNGMLLNGQEIYVGPHLSKKERESKFEEMKANFTNVYIKNINTETTDKEFEELVAKFGKTDSVVLERTPEGENKGFGFVNFVNHEDAVKCVEELNNTEFKGQPLYVNRAQKKYERQQELKKQYEATRMEKMAKYQGINLFIKNLDDSIDDKKLEEEFAPYGTITSAKVMTTENGKSKGFGFVCFSTPEEATKAITEKNQQIVAGKPLYVAIAQRKDVRRSQLAQQIQARNQMRFQQASAAAAAAAAAGMPGQFMPPMFYGVMPPRGVPFNGPNPQMANMGAMPKNGMPPHQFRNGPVYGVPPQGGFARNGPAANQFYQQKQRQALGEELYKRIFSRTNDEEAAGKITGMILDLPPQEVVPLLENDELFEQHFKEASAAYESFKQEQQQPQGEEAQQA

SEQ ID NO: 86492 - protein, 292 aa, Zea mays
  misc_feature (201)..(201): Xaa can be any naturally occurring amino acid
  misc_feature (260)..(260): Xaa can be any naturally occurring amino acid
MGKDDVIESGAGGGEFAAKDYTDPPPAPLIDAAELGSWSLYRAVIAEFIATLLFLYITVATVIGYKHQTDASASGADAACGGVGVLGIAWAFGGMIFVLVYCTAGISGGHINPAVTFGLFLARKVSLVRALLYIVAQCLGAICGVGLVKAFQSAYFDRYGGGANSLASGYSRGTGLGAEIIGTFVLVYTVFSATDPKRNAXRDSHVPVLAPLPIGFAVFMVHLATIPVTGTGINPARSLGAAVIYNKDKPWDDHWIFWVXGPLVGAAIAAFYHQYILRAGAIKALGSFRSNA

SEQ ID NO: 86493 - protein, 547 aa, Vitis vinifera
MKISDRTCTGVLCSHPLSRDIRIESLSVTFHGHDLIVDTELELNYGRRYGLLGLNGCGKSTLLTAIGCRELPIPEHMDIHHLTREIEASDMSALEAVISCDEERLKLEKEAEVLAAQDDGGGEALDRVYERLEAMDASTAEKRAAEILFGLGFNKTMQAKKTQDFSGGWRMRIALARALFMNPTILLLDEPTNHLDLEACVWLEETLKNFDRILVVVSHSQDFLNGVCTNIIHMQNRKLKLYTGNYDQYVQTRAELEENQMKQYKWEQDQIASMKEYIARFGHGSAKLARQAQSKEKTLAKMERGGLTEKVVRDKILVFRFTDVGKLPPPVLQFVEVTFGYTPDNLIYKNIDFGVDLDSRIALVGPNGAGKSTLLKLMTGDLFPIDGMVRRHNHLRIAQFHQHLTEKLDLEMSALLYMMREYPGNEEEKMRAAIGKFGLTGKAQVMPMKNLSDGQRSRVIFAWLAYRQPHMLLLDEPTNHLDIETIDSLAEALNEWDGGLVLVSHDFRLINQVAQEIWVCENQKVTRWEGDIMDFKEHLKSKAGLSG

SEQ ID NO: 86494 - protein, 324 aa, Streptomyces avermitilis MA-4680
MTGIKTTGEKKMMFFSGRAHPELAEEVAHKLGVGVVPTKAFDFANGEIYVRYQESARGADCFLIQSHTAPINKWIMEQLIMIDALKRASARSITVIVPFYGYARQDKKHRGREPISARLIADLMKTAGADRILTVDLHTDQIQGFFDGPVDHLFALPILADYVGAKVDRSKLTVVSPDAGRVRVADRWCDRLDAPLAIVHKRRDKDVANQVTVHEVVGDVKGRVCVLVDDMIDTGGTICAAADALFAHGAEDVIVTATHGVLSGPAADRLKNSKVSEFVFTDTLPTPGELELDKITVLSIAPTIANAVREVFEDGSVTSLFDEQ

SEQ ID NO: 86495 - protein, 148 aa, Bacillus licheniformis ATCC 14580
MTRVKDIMTKETLYCTVLDNVYEAAVKMKDGDVGAIPVVLDDGLELVGIVTDRDLVLRGIAAKKPNSQKITNVMTTDLITVSEDDSIEKAVDLMGDYQIRRVPVTRGKTLAGIITLGDVSTHNKSNRQAGDALTFISENEERPGDFLH

SEQ ID NO: 86496 - protein, 118 aa, Candidatus Phytoplasma solani
MSTNPFRSLFPLLVTNPKLVYFDNAATSLKPKKVIDELTSFYNDNGMSNKSFQNTLLLDETRKKTAKFLNSSSEEIIFTKGTTDALNLLAQSLGETLQEGDEIITSELEHNSSILPWV

SEQ ID NO: 86497 - protein, 359 aa, Vitis vinifera
MHSITIETLKIFRGDTILIKGKKRKDTVCIAITDDTCEPAKIRMNKIVRSNLRVKLGDVVSVHDCMDIMYGERVHILPMDDTIEGVTGNLYDAYLKPYFSDNFRPVRKGDLFLVRGGMRSVEFKVVETHPGEYCVVDPDTEIFFEGKPVRREDEERLDEVGYDDVGGFRKQMAQIRELVELPLRHPQLFKSIGVKPPKGILLYGPPGSGKTLIAKAVANETGAFFFCINGPEIMSKLAGESEGNLRKAFEEAEKNAPSIVFIDEIDSIAPKREKTHGQVEKRIVSQLLTLMDGLKSRAHVIVIGATNRPNSIDPALRRFGRFDREIDIGVPDEVGRLEVLRIHTKNMKLSDDAKKGIIF

SEQ ID NO: 86498 - protein, 244 aa, Salinibacter ruber DSM 13855
MPDPSHPPIGEADGKAEAVESMFDAVAPRYDLLNRVLSAGIDRYWRSRAVRTLRAEQPRRVLDVATGTADLALKAQRTLHPRETIGIDLSAEMLDRGREKIERANLASRIVLQKADAADLPFDDGTFDAAFVAFGVRNFEDLDAGLDDIRRVLRPGGALVVLEFSTPRTTPIKQLYAWYSRHVLPRIGGLLSPDQGAYEYLPSSVAAFPDGVDFLRRMEGTGFVDLTWTPLTFGIASLYTGRVR

SEQ ID NO: 86499 - protein, 185 aa, Burkholderia vietnamiensis G4
MAHDDRTTVISRRTPESAAMRAELARAMAITARLNRLTFADADEVRSLFGELTGKPIDDGFLLIPPFYATGGAATRIGRNVFVNQNCTFYDLGGLDIGDDVMIGPNVSLITSGHPLEPSRRRDAVVARPISIGNNVWIGAGATILGGVTVGENAVVGAGSVVTRDVPPDTLVAGNPARIVRSIAE

SEQ ID NO: 86500 - protein, 168 aa, Legionella pneumophila subsp. pneumophila str. Philadelphia 1
MSFDELPKSDGYQEKLVSVTRTAKVVKGGRVFGFAVLVVVGDGKGKVGFGRGKAREVPIAIQKAMDQAKKNMVYIPLSGTTIFHEITWNYGASKVFMKPASEGTGIIAGGAMRAVLEVLGVQNILAKSIGSTNPSNIVRATIGALTHIGTPDYVAAKRGKTVEEVMAG

SEQ ID NO: 86501 - protein, 443 aa, Pseudomonas putida GB-1
MNFAKLGLIEPLLRTLQQLDYTTPTPVQAKAIPAVLAGRDLMAAAQTGTGKTAGFALPVLQRLALEGEKVASNSIRALVLVPTRELAEQVHNNVREYAENLPLSTYAVYGGVSINPQMMRLRRGVDLLVATPGRLLDLFRQNAVKFNQVQTLVLDEADRMLDLGFAEELQSVYAALPRKRQTLLFSATFSDQIRVLAGLALNDPLSIEVSPRNATATSVKQWLVPVDKKRKEDLFCHLLRKQRWTQVLVFAKTRNGVDQLVQRLLAEGVNADGIHGDRPQATRQRALDSFKAREVQVLVATDVAARGLDIDDLPLVVNLDLPIVAEDYVHRIGRTGRAGNKGEAISLVCADEVQLLAAIEVLTRQTLPRHEEPDFIPDHRVPLTDASGQVIKKPKKPKKPKENSAKRGLGRWMDSSEAGNSEPAVKAVRKVPSFNGGPRKRKP

SEQ ID NO: 86502 - protein, 637 aa, Shigella flexneri 2a str. 301
MIVFSSLQIRRGVRVLLDNATATINPGQKVGLVGKNGCGKSTLLALLKNEISADGGSYTFPGSWQLAWVNQETPALPQAALEYVIDGDREYRQLEAQLHDANERNDGHAIATIHSKLDAIDAWSIRSRAASLLHGLGFSNEQLERPVSDFSGGWRMRLNLAQALICRSDLLLLDEPTNHLDLDAVIWLEKWLKSYQGTLILISHDRDFLDPIVDKIIHIEQQSMFEYTGNYSSFEVQRATRLAQQQAMYESQQERVAHLQSYIDRFRAKATKAKQAQSRIKMLERMELIAPAHVDNPFRFSFRAPESLPNPLLKMEKVSAGYGDRIILDSIKLNLVPGSRIGLLGRNGAGKSTLIKLLAGELAPVSGEIGLAKGIKLGYFAQHQLEYLRADESPIQHLARLAPQELEQKLRDYLGGFGFLGDKVTEETRRFSGGEKARLVLALIVWQRPNLLLLDEPTNHLDLDMRQALTEALIEFEGALVVVSHDRHLLRSTTDDLYLVHDRKVEPFDGDLEDYQQWLSDVQKQENQTDEAPKENANSAQARKDQKRREAELRAQTQPLRKEIARLEKEMEKLNAQLAQAEEKLGDSELYDQSRKAELTACLQQQASAKSGLEECEMAWLEAQEQLEQMLLEGQSN

SEQ ID NO: 86503 - protein, 374 aa, Nicotiana tabacum
MSNTKDNFNVADLTAALGAGDREDLVNALKNKLQDITGKPTNVLECLSPNVRKRVEVLKEIQSQHDELEAKFYEERAVLEAKYQKLYQPLYTKRFDIVNGVVEVNTSETEAAAMDQDEDEDAVGKGVPDFWLIAMKNNDVLSEEITERDEGALKFLKDIKWAKIDNPKGFKLEFFFDTNPYFTNTVLTKTYHMIDEDEPILEKALGTEIEWYPGKCLTQKILKKKPKKGSKNAKPITKTEQCESFFNFFSPPQVPEDEEDIDEDAAEELQSLMEQDYDIGSTIRDKIISHAVSWFTGEAAEDDFADLEDDDDDDEEDDDDEDEEEEDDEDDEDEEDEDDTNTKKKSSAVRKRGVRAHAPAGGQAGERPPECKQQ

SEQ ID NO: 86504 - protein, 377 aa, Nicotiana tabacum
MSNTKDNFNVADLTAALNAGDRADLVNVLKNKLHDLTGKHSNVTESLSPNVRKRVEALREIQTEHDELEAKFFEERAALEAKYQKLYQPLYTKRFEIVNGVVEVDGATTEAAAADKQEDKDAVEKGVPDFWLTAMKNNEVLAEEITERDEEALKFLRDIKWSRIDDPKGFKLDFFFETNPYFKNSVLTKTYHMIDEDEPILEKAIATEIEWYPGKCLTQKILKKKPKKGSKNAKPITKTEQCESFFNFFSPPQVPEDEEDIDEDAAEELQNLMEQDYDIGSTIRDKIIPHAVSWFTGEAAEDDYAELEDDEDEDDDEEDDEDEDEEEEDEEDDEDEEEDEDETKTKKKTSAVPKKSGRVPAAADGQSGERPPECKQQ

SEQ ID NO: 86505 - protein, 329 aa, Helicobacter hepaticus ATCC 51449
MKHFLTLNDFNRDEILAMVDVALELKYESLHIGNKPYLKGKVLAMIFEKSSTRTRVSFESGIFQLGGQGIFLSHKDIQLGRGEPIKDTARVISSMVDMIMMRTSEHSRLEEFASYSSVPVINGLSDDFHPVQLIADYLTMIECGIYLTHHNPLYPTKGKGGRNPIVAYIGDGNNMAHSWINLAGILGFELRIASPIGYAPKADIITKAQDMCIQSGGKIKILNDAKEAVSNANVVVTDTWASMGQEEQKEQRKCAFANFCVDEAMMSYAQKDAIFLHCLPAYRGQEVSEGVLEGAQSKVFQEAQNRLHAQKGIMLYLARINKIPLVSVE

SEQ ID NO: 86506 - protein, 957 aa, Burkholderia xenovorans LB400
MTYQVLARKWRPKDFASLVGQEHVVRALTHALDGGRLHHAYLFTGTRGVGKTTLSRIFAKALNCETGVTSTPCGVCRACREIDEGRFVDYVEMDAASNRGVDEMAALLERAVYAPVDARFKVYMIDEVHMLTNHAFNAMLKTLEEPPAHVKFILATTDPQKIPVTVLSRCLQFNLKQMPAGHIVSHLEHILGEEKVPYDVQALRLLARAADGSMRDALSLTDQAIAYSANQVNEEAVRGMLGALDQSYLIRLLDALADGDGAAVLSVADEMALRSLSFSTALQDLASLLHRIAWAQFAPSSVLDEWPEAGDLRRFAEALSAEQVQLFYQIATIGRSELGLAPDEYAGFTMTLLRMLAFEPAPTGGGGAVGAARAPGQSGAGGARRTGAPAVAAQQGASGSPVSQARAVAASGAVPGTSFEAQVSAAAPGRETQPGNVVVADKGAVVGAVSVEPATRAVAQAGSTVEVPPAVGDVQAAAADSAQGAVAGQSPAAEPATVAGPAPVIDELNPAPASAAPAAPAPALAPWDDAPANPAAREASTTAGLDDPAAGEVSAAAGDNGSAASEASTTAGLDDPASNHVSVTAGLSDAASNEVSAAGLNGAAPNEALTAAALEDEAPANEAPASSLSAPAAAAFARTEQAAAAATSQELPPAAATEPRRAGGASAALDVLRSAGLKVSSDRGRASAAAAAKPATPKPATPRVVVPVPTPGAPRRAPQQDAAPAAPAARAAASASSSPGQRNGAEQNGASVPPWDDMPPPDEYMPLTAADEGYYGLPDEGYMPVFDSGPDDVRVSAAPASTAAPVIDQRPLPPAVPLDPLGFKGDWPALAVDLPLKGISYQLAFNSELMALEGNTLKLNVPVPQYAEASQVAKLKTALADRLGHTVEVLVEVGPARRTAAAHDAAMRAQRQQEAEREIGADPFVQSLIREFGASIVPGSIRPITPDAGSNGAPSVH

SEQ ID NO: 86507 - protein, 377 aa, Nicotiana tabacum
MSNAKDNFNVADLTAALNAEDRDDLVNVLKNKLQGLTGKHSNVLENLSPNVRKRVEVLREIQTQHDELEAKFFEERAALEAKYQKQYQPLYAKRSEIVNGVVEVDGEATQTAAADEEEDKDSVEKGVPDFWVTAMKNNEVLAEEITERDEGALKFLKDIKWSRIENPKGFKLEFFFETNPYFTNTVLTKTYHMIDEDEPILEKAIGTEIEWHPGKCLTQKILKKKPKKGSKNSKPITKIEQCESFFNFFSPPQVPDDEEDIDEDAAEELQNLMEQDYDIGSTIRDKIIPHAVSWFTGEAAQDEDYIDLEDDEDEEDDEDEDEDEEDEEEEDEDEDDDDEDEHVTKTKKKSSAGRKRSGGAPAADGQPGERPPECKQQ

SEQ ID NO: 86508 - protein, 275 aa, Streptomyces avermitilis MA-4680
MKRREKCRRLTRRNNRRRRSREGTQTVASLEGKTALVTGGRTGLGFGIATALVERGANVVITSRTEDELRKAAAALGEERALGVAGDARDPEHQRIAVETAVDRFGSLDLLVNNVGGTERTARRLVDVDLASYRRTVEINLMSALTWVQTAWHGWLGEHGGAIVNISSIAGELAVPDGTAYGTAKAALNHFTRQMANELAPAVRVNGVASGTVLTDFTRANVEGREDKVIGSIPLRRLGEPADVGAAVAFLLSDEASWITGHTLVVDGGRLLHNR

SEQ ID NO: 86509 - protein, 306 aa, Populus tremula x Populus tremuloides
MVSAMDLFEKLEKVGEGTYGKVYRAREKATGKIVALKKTRLHEDDEGVPPTTLREVSILRMLSRDPHIVRLLDVKQGQNKEGKTVLYLVFEYMDTDLKKFIRSFRQTGENIPIKNVKSLMYQLCKGVAFCHGHGVLHRDLKPHNLLMDRKTMMLKIADLGLARAFTLPIKKYTHEILTLWYRSPEVLLGATHYSTAVDVWSVGCIFAELATKQALFPGDSELQQLLHIFRLLGTPNEEMWPGVSNLMNWHEYPQWKPQSLSSAVTNLDKDGLDLLSQMLQYDPSKRISAKKAMEHPYFDDLEKDHL

SEQ ID NO: 86510 - protein, 237 aa, Caulobacter crescentus CB15
MPTLVLLRHGQSQWNLENRFTGWVDVDLTAEGEAQARKGGELIAAAGIEIDRLFTSVQTRAIRTGNLALDAAKQSFVPVTKDWRLNERHYGGLTGLNKAETAEKHGVEQVTIWRRSYDIPPPELAPGGEYDFSKDRRYKGASLPSTESLATTLVRVLPYWESDIAPHLKAGETVLIAAHGNSLRAIVKHLFNVPDDQIVGVEIPTGNPLVIDLDAALKPTGARYLDDSRAEALPKVG

SEQ ID NO: 86511 - protein, 173 aa, Flaveria bidentis
MASIPATFATVAQANMVAPFTGLKANAAFPVTKKVNGFSTLPSNGGRVQCMKVWPPVGKKKYETLSYLPELTEAQLAKEIDYLIRNKWVPCLEFELEHGFVYRENARSPGYYDGRYWTMWKLPMFGCTDSAQVMKELQECKKEYPQAWIRIIGFDNVRQVQCVSFIASKPTGF

SEQ ID NO: 86512 - protein, 173 aa, Flaveria bidentis
MASIPATVAAVPQTNMVAPFTGLKANAAFPVTKKVNGFSTLPSNGGRVQCMKVWPPVGKKKYETLSYLPELTEAQLAKEVDYLIRNKWVPCLEFELEHGFVYRENASSPGYYDGRYWTMWKLPMFGCTDSAQVMKELQECKKEYPQAWIRIIGFDNVRQVQCVSFIASKPTGF

SEQ ID NO: 86513 - protein, 713 aa, Sorangium cellulosum
MHGLTERQVLLSLVTLALILVTARASGELARRLRQPEVLGELFGGVVLGPSVVGALAPGFHRALFQEPAVGVVLSGISWIGALLLLLMAGIEVDVGILRKEARPGALSALGAIAPPLAAGAAFSALVLDRPLPSGLFLGIVLSVTAVSVIAKVLIERESMRRSYAQVTLAAGVVSEVAAWVLVAMTSSSYGASPALAVARSALLASGFLLFMVLVGRRLTHLAMRWVADATRVSKGQVSLVLVLTFLAAALTQRLGLHPLLGAFALGVLLNSAPRTNRPLLDGVQTLVAGLFAPVFFVLAGMRVDVSQLRTPAAWGTVALLLATATAAKVVPAALGARLGGLRGSEAALVAVGLNMKGGTDLIVAIVGVELGLLSNEAYTMYAVVALVTVTASPALLIWLEKRAPPTQEESARLEREEAARRAYIPGVERILVPIVAHALPGFATDIVESIVASKRKLGETVDITELSVEQQAPGPSRAAGEASRGLARLGARLRVGIWRQRRELRGSIQAILRASRDHDLLVIGARSPARARGMSFGRLQDAIVQRAESNVLVVVGDPPAAERASARRILVPIIGLEYSFAAADLAAHVALAWDAELVLLSSAQTDPGAVVWRDREPSRVRAVARSVVDEAVFRGRRLGVRVSSRVHVGAHPSDEITRELARAPYDLLVLGCYDHGPLGRLYLGSTVESVVVRSRVPVALLVAHGGTREQVR

SEQ ID NO: 86514 - protein, 256 aa, Coccidioides immitis RS
MADAPRGGARGGFGSRGDRGRGRGRRGRRGPKSEEKEWQPVTKLGRLVKAGKITSMEQIYLHSLPIKEYQIVDFFLPKLKDEVMKIKPVQKQTRAGQRTRFKAIVVIGDSEGHVGLGIKTSKEVATAIRAAIIIAKLSVLPVRRGYWGSNLGDPHSLPTKESGKCGSVTVRLIPAPRGTGLVASPAVKRLLQLAGVQDIYTSSSGSTKTLENTLKATFVAVANTYGFLTPNLWKETKLIRSPLEEFGDVLREGKRY

SEQ ID NO: 86515 - protein, 384 aa, Rhodobacter capsulatus
MTQPAIYLDNNATTRVFPEVVAAMLPYFTEHFGNASSGHGFGAQAGLGLRKARLAVAALIGAASEQEILFTSGGTEANTTAIRSALAVQDGRREIIISAVEHPAILMLAADLEKTEGVRVHRIPVDHLGRLDLAAYRAALSDRVAVASIMWANNRYDLPVPQLAAEAHAAGALFHTDAVQAVGKLPMSLADTEIDMLSLSGHKFHGPKGVGALYLRKGVAFRPLLRGGKQERGRRAGTENVPALVGMGLAAEIVAARMAADLSRIATLRDWLESGILALGGCQRLGDPANRLANTCTLAFDRIDSEAVLTKLARAGIAISTGSACASGAMEPSHVTRAMAVPFTAAHGVVRFSLSADTTAAELSRVLAILPEILAELRPVPVTA

SEQ ID NO: 86516 - protein, 650 aa, Listeria monocytogenes str. 4b F2365
MILLQVQQISKFFGAEVILDNIKLEVKTGDRIALVGRNGAGKSTLLKIIAGKMSYDGGTISKPKSVEIGYLAQNTGLESSKTIWDEMLSVFDSLRRMEADLRKMELRLGEPELYNDPEKYQALMTDYDTLQHTFKESGGYTYEAEIRSVLNGLRFYPEDYEVEIASLSGGQKTRLALAKLLLAKQDILVLDEPTNHLDIETLAWLETYLQNYHGSLLIVSHDRYFLDKVVNQVYEISRTKIDHYKGNYSSFVNQKQAKLEQMWKEFDKQQKQIAKLEDFVARNIVRASTTKRAQSRRKQLEKMDVLGRPQGDEKAAHFGFQFEKQTGKDVLMVDQLSIGYAKDKRIASNLTFEMKRQDSLALVGPNGIGKSTLLKTLIRDIPALSGEFHFGAGVKIGYYDQEQAKLTSNKTVLMELWDDYPELNEVNVRTTLGNFLFSDDDVLKNVQSLSGGEKARLALAKLTLLEANVLILDEPTNHLDIESKEVLEAALIDFEGTILFVSHDRYFINRIASKIVELAPEKATVFLGDYDYYQEKLAEEKELARLDAEDRRKKGEQVEATSSVRKLNYQEEKEQQKLLRQRKRKLEEVEKSMEATDKKIAELELQLTNPEVFQDHEKALEITQELDAVKADGEKLMEEWEQISEELESM

SEQ ID NO: 86517 - protein, 266 aa, Pyrococcus furiosus DSM 3638
MKIYYLGPEGSYTEKAALKFAELTNLKITPAESIYSVFREVERGNYGVVPTENSIEGSVTLTLDLLLRFPVKIFGETSLEIKHALLGYDLSKIRVVLSHPQALAQCREFIQRMRWGVRETNSTAEAVKIVAESNDPTLAAIGSREAAEIYGLKVLAEDIQDYPNNKTRFILIGREDMENPLGDKTPQKGAIFLELENVPGALYRALGVFAKRGVNLTRIESRPSLKDLGYYIFYIDYEYTQEEDEILEELKQVSKFLKHLGKYYVV

SEQ ID NO: 86518 - protein, 547 aa, Glycine max
MGDKHQQHHQDDSSDFTSEDEGTEDYRRGGYHAVRIGDAFSAGRYVVQSKLGWGHFSTVWLAWDTKHSRYVALKVQKSAQHYTEAAMDEITILQQIAEGDPDDKKCVVKLLDHFKHSGPNGQHVCMVFEYLGDNLLTLIKYSDYRGLPIAMVKEICFHILAGLDYLHQQLSIIHTDLKPENILLLSTIDPSKDPRKSGAPLILPNSKDKMAMESAGMKDTKMLNGDLVKNHKKKIKRKAKQAAHGCVEKEASEGVEGNAETSGAVESSPNASSAREQTSSSAGTSQLSDADGTKLKEQGNKRGSRSMRQKLLASVDLKCKLVDFGNACWTYKQFTNDIQTRQYRCPEVILGSKYSTSADLWSFACICFELATGDVLFDPHSGDNFDRDEDHLALMMELLGMMPRKIALGGRYSRDFFNRYGDLRHIRRLRFWPLNKVLLEKYDLSEKDANDMTDFLVPILDFVPEKRPTAGQCLLHPWMNAGPRLLEPSVPSNHNPAAETSVSDQKRKDKDEREAMETGMGNIVINSDFKPLMHSPSKKVFQGRSQK

SEQ ID NO: 86519 - protein, 469 aa, Bacillus cereus E33L
MEKLQIGVVGVGVMGKSLALNFESKGYSVALYDISKEKVDETIEENRGKNLVGTHIVEEFVNSLESPRKILLMVNAGEITDKAIDSLVPHLDKGDILIDGGNTYFVDTIRRNKRLAEEGINFIGAGVSGGEEGALKGPSIMPGGQKDAYEKVKDMLENISAKVNNEPCCSYIGPNGAGHYVKMVHNGIEYGDMQLICEAYFFLKQTLDLTAEEFHEIFAEWNKGELNSYLIEITADIFKKKDEETGKPLVDVILDTAGQKGTGKWTSQSALDLGISLPIITESVFARCISALKEERVNASKVLSGPKNKTAIGVEKAELIEAVRQALYMSKICSYAQGFTQLKAASEEYDWNLDFGSISMLWRGGCIIRAAFLQNIKEAYETNTDLPNLLLDPYFKEIVESYQGGLRQIISMAVQQGIPIPAFSAAISYYDSYRTAKLPANLLQAQRDYFGAHTYKRVDKEGTFHTKWI

SEQ ID NO: 86520 - protein, 392 aa, Salinibacter ruber DSM 13855
MKLHEYQAKGLFRDYGVSVPDGIVAETVDAAVDAARRLEEENDATLFIVKAQIHAGGRGKGGGVKLAHSVEEVREHADNILGMDLVTHQTGPEGQTVRKILVTEGVDIDQEYYLGVTLDRETSMNAIMVSTEGGVDIETVAEESPEKIQRVWVDPSIGLRPFQTRQLAFAMGLEGDAFKQAVASIQGLYEAFEENDCTLAEINPLVQTPGGDIEAVDAKVNLDDNALFRHPDLEEMRDLHEEDPTEVKAGEHGLSYITLDGNVGCMVNGAGLAMATMDIIKLAGGEPANFLDVGGAASAETVEAGFRIILEDPNVEALLLNIFGGIVRCDRVAQGVIEAAKNIDIDVPLIVRLQGTNAEEGKRLLDESDLSLRSAVLLKEAADEVTAALGED

SEQ ID NO: 86521 - protein, 443 aa, Erythrobacter sp. SD-21
MQQLIDQTLAAIGSLSLELAPRRFGRVVACDGGLIEVSGLGVPIGTICTIAQGASLRHRAETIGFRNGHTMMMMLGDTVLLRPGAEVRAEGKPGMLHVGSEFLGRAVDGAGEPIDGGGPVLATTTWPAGGHRVGALDRSRVTQMFDCGIRSLNALTTFGVGQRIGIMAGSGVGKSVLMDMIVDNAEADAVVVGLIGERAREVSDFVSRHMAGERAANTAIVAVPADHAANLRLRGAMLATSIAEHLRSQGKRVLLILDSLTRVAHAAREIGILLGEPGAARGYPPSALSTITKMIERAGNSKETGGAITGIYTVLADGDDHNDPVVDTARAILDGHIVLSREIAQRGQYPAVDVGASLSRVMNDIVSVEHVENARKFRALSASFEENRDLIMMGAYRQGTDSLLDEAIIRQPRMSDFLAQGTGERVDMTSATMQLSHLFSDGH

SEQ ID NO: 86522 - protein, 530 aa, Vitis vinifera
MSNIEGSPGSSMHGVTGREQTFAFSVASPIVPTDTSANFALPVDSEHKAKVFKILSFANPHMRTFHLSWISFFTCFVSTFAAAPLVPIIRDNLNLTKGDVGNAGVASVSGSIFSRLVMGAVCDLLGPRYGCAFLVMLSAPTVFCMSFVSSAGGYIAVRFMIGFSLATFVSCQYWMSTMFNGKIIGLVNGTAAGWGNMGGGATQLIMPILYEVICRVGSTPFTAWRIAFFIPGWLHVIMGILVLTLGQDLPDGNLSTLQKKGDVSRDKFSRVFWYAITNYRTWIFVLLYGYSMGVELSIDNVIAEYFYDRFNLKLHTAGIIAATFGMANLVARPFGGYSSDLAGRRFGMRGRLWTLWILQTLGGVFCIWLGRANSLSIAVLAMMLFSVGAQAACGATFGIVPFISRRSLGIISGLTGAGGNFGSGLTQLVFFSSSKFSTATGLSLMGAMIVACTLPVTLVHFPQWGSMFLPPSKDVVKGTEEHYYESEWNEEEKQKGMHQGSLKFAENSRSERGQRVASAPTPPNSTPSHV

SEQ ID NO: 86523 - protein, 525 aa, Vitis vinifera
  misc_feature (60)..(93): Xaa can be any naturally occurring amino acid
MSDIEGSPGSSMHGVTGREQTFAFSVASPIVPTDTSANFALPVDSEHKAKVFKILSFANXXXXXXXXXXXXXXXXXXXXXXXXXXXXXXXXXXDVGNAGVASVSGSIFSRLVMGAVCDLLGPRYGCAFLIMLSAPTVFCMSFVSSAGGYIAVRFMIGFSLATFVSCQYWMSTMFNGKIIGLVNGTAAGWGNMGGGATQLIMPILYEVICRVGSTPFTAWRIAFFIPGWLHVIMGILVLTLGQDLPDGNLSTLQKKGDVSRDKFSRVFWYAITNYRTWIFVLLYGYSMGVELSIDNVIAEYFYDRFNLKLHTAGIIAATFGMANLVARPFGGYSSDLAGRRFGMRGRLWTLWILQTLGGVFCIWLGRANSLSIAVLAMMLFSVGAQAACGATFGIVPFISRRSLGIISGLTGAGGNFGSGLTQLVFFSSSKFSTATGLSLMGAMIVACTLPVTLVHFPQWGSMFLPPSKDVIKGTEEHYYESEWNEEEKQKGMHQGSLKFAENSRSERGKRVASAPTPPNSTPSHV

SEQ ID NO: 86524 - protein, 670 aa, Oryza sativa Indica Group
MVSGGGVAAENGEMVGNGEGRKGAGASVLVTGGAGYIGTHTVLRLLEKGFAVTVVDNFHNSVPEALDRVRLIAGAALSARLDFIAVRDSPKQHACSSSCTVELNRAGEVEIEIHVCVRFQGDLKSKDDMEKVFAAKRYDAVIHFAGLKAVGESVAHPQMYYENNVAGTMNLYSAMTKYGCKKIVFSSSATVYGQPEKTPCVEDSKLSALNPYGTTKLVLENYFRQVQAADPEMRVILLRYFNPIGAHRSGDIGEDPRGIPNNLLPYIQQVAVGRRPELNVYGVDYPTRDGTAIRDYIHVVDLADGHIAALEKLFATPDIGCVAYNLGTGCGTTVLEVVKAFEEASGKKIPIKICPRRPGDCTEVYASTDKAKKELGWSARFGIEDMCRDQWNWAKKNPYDAVIHFAGLKAVGESVAHPQMYYENNVAGTMNLYSAMTSTAARRSIVFSSSATVYGQPEKTPCVEDSKLSALNPYGTTKLVLENYFRQVQAADPEMRVILLRYFNPIGAHRSGDIGEDPRGIPNNLLPYIQQVAVGRRPELNVYGVDYPTRDGTAIRDYIHVVDLADGHIAALEKLFATPDIGCVAYNLGTGCGTTVLEVVKAFEEASGKKIPIKICPRRPGDCTEVYASTDKAKKELGWSARFGIEDMCRDQWNWAKKNPYGYSANAEQN

SEQ ID NO: 86525 - protein, 570 aa, Oryza sativa
  misc_feature (393)..(393): Xaa can be any naturally occurring amino acid
MEASDEDRPLIHHLPPQEQCSKYTCDGTVNIDSKPALKQSTGNWRACFFILGVEFTECICFYGVSKNLVTYLTSVLHESNVNAAQSVSIWIGSCFFTPLIGAFLADTYWGRYWTVVMSILVIILGMIVLTVSASPLFLNASFYNGGISRLTVYLGLYLFALGTGGIKPNIPAFGADQFDGADPVERVTKGSFFNWYYFSINVGSLLSSTVVVWVQDNIGWSVGFAGPMLLLGFGLAMFIAGRRAYRYKKLGGSPLTRVFQVLVAAVRNHRLNLPDDSSLLHELPGVTEGDYRTQHTYQFRFLDKAAILSDKNCAPAAPSSPWRLCTVSQVEELKMLLRTFPVWASLVGFFMVTAQMTSTLIEQGVAMDGRVGRFTVPPASLATFDVHEGLALXPVYDAALVPLARRVTGRDRGVSHMQRIGVGLALSAVAMAYSALVEARRLAMAAAAAGTRMSIAWQVPSFFVLGAGEVFAVIGMLEFCYEQSPASMKSLGTALVQLAVAVANYLNSGMLRVVAAATARGGGAGWIPDKLDEGHLDYFFWMMAALSVLNLLQFLHCSIRFRGNNTLSSS

SEQ ID NO: 86526 - protein, 355 aa, Neurospora crassa
MCFGGRGKDDEAEASRSRDVDKQIRADEKRLSKEVKLLLLGAGESGKSTILKQMKLIYAQGFSKNEKLEWRPVIFANILQSFRLIFDAMNEFNIKLEDEDNEKNMVQMMVDYEMRGDEPLPLEYFEPAKKLWQDSGVRQAIEKGNEFALHDNLQYFCSDLDRLWDRNYVPSDQDLLRSRLRTTGITETVFDLGQLTYRMFDVGGQRSERKKWIHCFENVNCLLFLVAISGYDQCLVEDKDGNQMNEALMLWESIANSHWFTKSALILFLNKIDLFKEKLPRSPITNHGFTDYHGPPDDSKQASKYFMDKFRALNRNPDKEIYGHFTNATDTNLLKITMGSVQDMIIQRNLKQLIL

SEQ ID NO: 86527 - protein, 319 aa, Streptomyces avermitilis MA-4680
MSGKYLVTGGAGYVGSVVAQHLIEAGHEVVVLDNLSTGFREGVPAGASFVEGDIRDAAKWLDSSFDAVLHFAAFSQVGESVVKPEKYWDNNVGGTLALLAAMREAGVRKLVFSSTAATYGEPEEVPIVETAPTRPTNPYGASKLAVDHMITGEAGAHGLAAVSLRYFNVAGAYGSCGERHDPESHLIPLVLQVAQGRRDAISVYGDDYPTPDGTCVRDYIHVADLAEAHLLALDAATPGEHLVCNLGNGNGFSVREVIETVRQVTGHPIPEIVAPRRAGDPAVLVASAATARERLGWNPARADLAGIVADAWAFAQHKE

SEQ ID NO: 86528 - protein, 338 aa, Haemophilus somnus 129PT
MAILVTGGAGYIGSHTVVELLNHHVEIVVLDNLSNSSEVSLQRVQQITGKNITFYQGDILDRKILQRIFSQHNIKAVIHFAGLKAVGESVKKPLRYYQNNVIGSLTLLEEMLKAGIYNLVFSSSATVYGDPEIIPITETCKVGGTTNPYGTSKFMVERILQDAVSANPHLSVVILRYFNPVGAHESGLIGEDPNGIPNNLLPYISQVAVGKLPQLSVFGSDYDTHDGTGVRDYIHVVDLAIGHLKALEKHQNDPGCHIYNLGTGIGYSVLDMVKAFEKANDIQIPYKLVERRPGDIATCYSNPQKALEKLGWKTERDLTQMMKDTWNWQKNNPNGYKS

SEQ ID NO: 86529 - protein, 248 aa, Bacillus subtilis subsp. subtilis str. 168
MIICKTPRELGIMREAGRIVALTHEELKKHIKPGISTKELDQIAERFIKKQGAIPSFKGYNGFRGSICVSVNEELVHGIPGSRVLKDGDIISIDIGAKLNGYHGDSAWTYPVGNISDDDKKLLEVTEESLYKGLQEAKPGERLSNISHAIQTYVENEQFSVVREYVGHGVGQDLHEDPQIPHYGPPNKGPRLKPGMVLAIEPMVNAGSRYVKTLADNWTVVTVDGKKCAHFEHTIAITETGFDILTRV

SEQ ID NO: 86530 - protein, 563 aa, Oryza sativa Japonica Group
MASAAVIPSSAPGAAAAGAAAVESAGWVVDERDGFISWLRGEFAAANAIIDLLLLHLRSVGEPGEFEHVAAAVQQRRHHWAPVIHMQQFFPVGDVAYALQQAGWRRRAPPHHQQQGPGASPSPPPPPPRGRPSFSASHSHHRHGGHHHRSDSVRGGGTGATAGSDKDGREVHNKEEKGMKEAENVVEAKSSQLESLVSHEGEKTPRPQAVAEGSSKVVPTPVEYTVNDIIDGKTVNAVEGLKVYEGLVNENEKNKILSLLNETKASFRRGGLEAGQTVIIGKRPMKGHGREIIQLGIPIVEGPPEDDYPRETKVEAVPGLLHDLFDRLCQKEIIPTKPDYCVIDYYNEGDYSHPHQSPPWYGRPFCTFCLTDCDMVFGRVISGERGDHRGPLKLSLSTGSLLVLHGKSADVAKRAIPAACKQRILLSFGKSLSRKQVPSESVSRFTTPLTPPPMPWGPPRPANMARHSSSPKHFGYAPNSGVLPAPAIGAHHIPPSDGMQPLFVAPAPVAAAAMPFPSPVPLPNSTTAWMAEAAPRSAPQRLPVPGTGVFLPPGSGHALPHQM

SEQ ID NO: 86531 - protein, 123 aa, Mycobacterium sp. JLS
MSDRIELRGLTVRGNHGVFDHERRDGQDFVIDLTVWLDLAPAAASDDLADTVDYGGLAQRAAGIVAGPPRDLIETVAAEIADDVMKDQRIEAVEVVVHKPEAPIPLTFADVAVVARRTREEHR

SEQ ID NO: 86532 - protein, 187 aa, Shigella flexneri 2a str. 301
MILLIDNYDSFTWNLYQYFCELGADVLVKRNDALTLADIDALKPQKIVISPGPCTPDEAGISLDVIRHYAGRLPILGVCLGHQAMAQAFGGKVVRAAKVMHGKTSPITHSGEGVFRGLANPLTVTRYHSLVVEPDSLPACFDVTAWSETREIMGIRHRQWDLEGVQFHPESILSEQGHQLLANFLHL

SEQ ID NO: 86533 - protein, 725 aa, Chlamydomonas reinhardtii
MKKGPIKIEPFRHPVTVDPQYADKTWKVLEDAIREIHNQNASGLSFEELYRNAYNMVLHKYGPRLYEGLIRTLTAHLTEVAKKIEEKEGAPFLRELKKRWDEHTKSSQMIRDILMYMDRTFVVQQQKTPVFTLGLELWRDVVVRNRAISERLLAIVSSLIMKERQGEVIERGLIKSVTQMLGELGHAVYVEDFEKPFLAAAAEFYRKEAQEYITSSDCPEYLRKAEARLGEEAERCGAYLDANSTEPKITRVVETELLKAQAARTTLAITSNAPFLVHPVPPLLLPMPPQVRHMLCEHVKEVGRALVSDPERSKDPVEYVQALLDMRDKYERIITQAFADDKTFRNALNQAFEHFVNLNVRSPEFISLFIDDKLRRGIKGLSDTDVEGVLDKVMALFRYLQEKDVFEKYYKQHLAKRLLSGRTTSDDAERNLLVKLKTECGYQFTSKLESMFTDIKTSRDTMNEFRTRLVETGKLEAELGGIDLQVQVLTTGSWPTQAPSKCNLPRELEAACESFRNFYLSTHSGRRLTFQPNMGTADLRAVFGAGRRHELNVSTYQMCVLLLFNEADSLSYRDIAQATEIPAPDLKRALQSLACVKGRNVLRKEPAGKDVADSDVFFYNDKFTSKLIKVKISTVAATKEGESEKAETRQKVEEDRKPQIEAAIVRIMKARQRLDHNTIITEVTRQLQARFVPNPATIKKRIESLIEREFLARDEADRKFYTYVA

SEQ ID NO: 86534 - protein, 159 aa, Bacillus clausii KSM-K16
MIRIGQGFDVHQLTEGRPLLLGGVHIPHPKGLLGHSDADVLLHTITDAALGAIGAGDLGKHFPDTDEAFKDADSKHLLSQAWQLVKNAGYTLGNVDCTVMAQKPKLAPYIEAMRKQIAELLETDVANVSVKATTTETLGFVGREEGIAAQAVILLQKAE

SEQ ID NO: 86535 - protein, 583 aa, Betula pendula
MSSLSVRFLSPPLFSSTPAWPRTGLAATQAVPPVVAEVDAGRLEPRVEEREGYWVLKEKFREGINPQEKLKLEREPMKLFMEGGIEDLAKMSLEEIDKDKISKSDIDVRLKWLGLFHRRKHHYGRFMMRLKLPNGVTTSAQTRYLASVIRKYGKDGCADVTTRQNWQIRGVVLSDVPEILKGLDEVGLTSLQSGMDNVRNPVGNPLAGIDIHEIVATRPYNNLLSQFITANSRGNLAFTNLPRKWNVCVVGSHDLFEHPHINDLAYMPAIKDGRFGFNLLVGGFFSPRRCAEAVPLDAWVSADDIILVCKAILEAYRDLGTRGNRQKTRMMWLIDELGIEGFRSEVVKRMPNQELERAAPEDLIEKQWERRELIGVHPQKQEGLSYVGLHIPVGRVQADDMDELARLADTYGCGELRLTVEQNIIIPNIENSKLEALLGEPLLKDRFSPEPPILMKGLVACTGNQFCGQAIIETKARALKVTEEVQRQVAVTRPVRMHWTGCPNSCGQVQVADIGFMGCMARDENGKPCEGAAVFLGGRIGSDSHLGNLYKKGVPCKNLVPLVVDILVKHFGAVPREREESED

SEQ ID NO: 86536 - protein, 284 aa, Zea mays
AREVVVGSSLDSIFMVMEYMEHDLKGVMETMKQPYTQSEVKCLMLQLLEGVKYLHDNWVLHRDLKTSNLLLNNRGELKICDFGLSRQYGSPLKPYTQLVVTLWYRAPELLLGTKEYSTAIDMWSVGCIMAELLAKEPLFNGKTEFEQLDKIFRTLGTPNEKIWPGYAKLPGVKVNFVKQPYNRLRDKFPAASFSGRPILSEAGFDLLNRLLTYDPDKRISADDALKHKWFSEVPLPKSKDFMPTFPALNELDRRSRRYLKSPDPLEEQRLKELQGNIGNHGLFG

SEQ ID NO: 86537 - protein, 498 aa, Caulobacter crescentus CB15
MRDIAHFVKGQTLVGASGRFGDVFNPNTGEVQARVQFATDAELDAAVQVAAKAQVGWAQTNPQRRARVMFEFKRLIERDMNTLAEILSSEHGKVIADSKGDIQRGLEVIEFACGIPHILKGEYTEGAGPGIDVYSMRQPLGVCAGITPFNFPAMIPMWMFGISIAVGNSFILKPSEKDPTVPVKLAELMMEAGAPAGVLNVVHGDKSAVDAILTHPLIRAVSFVGSSDIAHYVYQTGTAHGKRVQAMGGAKNHGIVLPDADMDQVVKDLSGAAFGSAGERCMALPVVVPVGQKTADELRERMVAEIASLKVGVSTDPDAHYGPVVSAQHRDKIADYIRIGQEEGAELVVDGRDFQLQGFEKGFFIGPSLFDGVKKGMKTYHEEIFGPVLQIVRAETLEEAIALPSEHQYGNGVAIFTRNGRAAREFAANVNVGMVGINVPIPVPVAYHTFGGWKRSAFGDTNQHGVEGVKFYTKVKTVTARWPEGEVADSSFVIPTMK

SEQ ID NO: 86538 - protein, 293 aa, Candida glabrata CBS 138
MSAFSDTDFDSNRYSKSRPSYPQSFYEALSRYHKGNRNILIDVGCGPGTATFQLQEYLPFDQYVGCDMSQPMIDTANGRAQSQNLKNIHFHQGPYQDLSFLKQIGDGKCDMATCVEAVHWFDLKEFQQVVHDSLNENGTLAIWGYIDAVLVDYPEFDQYFQDLTYGDSKMGPYWDQPGKTILRNKYEAVQIDTGLFKDVERHVLTPTDIRKPGFEISKEYLPICTTMPLSGLMDYIRTWSGYHNWKHDPANADKMDLVEETLQHIIDSDNDIDSESKLVKVAWSSFYIFARKI

SEQ ID NO: 86539 - protein, 1421 aa, Sorangium cellulosum
MADRPIERAAEDPIAIVGASCRLPGGVIDLSGFWTLLEGSRDTVGRVPAERWDAAAWFDPDPDAPGKTPVTRASFLSDVACFDASFFGISPREALRMDPAHRLLLEVCWEALENAAIAPSALVGTETGVFIGIGPSEYEAALPQATASAEIDAHGGLGTMPSVGAGRISYALGLRGPCVAVDTAYSSSLVAVHLACQSLRSGECSTALAGGVSLMLSPSTLVWLSKTRALARDGRCKAFSAEADGFGRGEGCAVVVLKRLSGARADGDRILAVIRGSAINHDGASSGLTVPNGSSQEIVLKRALADAGCAASSVGYVEAHGTGTTLGDPIEIQALNAVYGLGRDVATPLLIGSVKTNLGHPEYASGITGLLKVVLSLQHGQIPAHLHAQALNPRISWGDLRLTVTRARTPWPDWNTPRRAGVSSFGMSGTNAHVVLEEAPAATCTPPAPERPAELLVLSARTASALDAQAARLRDHLETYPSQCLGDVAFSLATTRSAMEHRLAVAATSREGLRAALDAAAQGQTSPGAVRSIADSSRGKLAFLFTGQGAQTLGMGRGLYDVWSAFREAFDLCVRLFNQELDRPLREVMWAEPASVDAALLDQTAFTQPALFTFEYALAALWRSWGVEPELVAGHSIGELVAACVAGVFSLEDAVFLVAARGRLMQALPAGGAMVSIEAPEADVAAAVAPHAASVSIAAVNAPDQVVIAGAGQPVHAIAAAMAARGARTKALHVSHAFHSPLMAPMLEAFGRVAESVSYRRPSIVLVSNLSGKACTDEVSSPGYWVRHAREVVRFADGVKALHAAGAGTFVEVGPKSTLLGLVPACMPDARPALLASSRAGRDEPATVLEALGGLWAVGGLVSWAGLFPSGGRRVPLPTYPWQRERYWIDTKADDAARGDRRAPGAGHDEVEEGGAVRGGDRRSARLDHPPPESGRREKVEAAGDRPFRLEIDEPGVLDHLVLRVTERRAPGLGEVEIAVDAAGLSFNDVQLALGMVPDDLPGKPNPPLLLGGECAGRIVAVGEGVNGLVVGQPVIALSAGAFATHVTTSAALVLPRPQALSAIEAAAMPVAYLTAWYALDRIARLQPGERVLIHAATGGVGLAAVQWAQHVGAEVHATAGTPEKRAYLESLGVRYVSDSRSDRFVADVRAWTGGEGVDVVLNSLSGELIDKSFNLLRSHGRFVELGKRDCYADNQLGLRPFLRNLSFSLVDLRGMMLERPARVRALLEELLGLIAAGVFTPPPIATLPIARVADAFRSMAQAQHLGKLVLTLGDPEVQIRIPTHAGAGPSTGDRDLLDRLASAAPAARAAALEAFLRTQVSQVLRTPEIKVGAEALFTRLGMDSLMAVELRNRIEASLKLKLSTTFLSTSPNIALLAQNLLDALATALSLERVAAENLRAGVQNDFVSSGADQDWEIIAL

SEQ ID NO: 86540 - protein, 556 aa, Oryza sativa Indica Group
MESEILEQIDRDVKRTHPEMPFFSAKANQESLRRVLIIFSKLNPTIRYVQGMNEVLAPLFYVFKNDPDTSNSASAEADTFFCFVELLSGFKDNYCKHLDNSQVGIRSTLSKLSQLLKRHDEELWRHMEITTKVYLLNKILILIACYIVFVGKFSHSGMSPTIVDSHAWILKIQLSKKVVNMGELRRLACLGVPDGGAAVRPLVWKLLLGYLPTERAFWPHELEKKRSQYSAYKDEFLLNPSEKIRRFEESKLLRKKELNSDKIGLLPRAKVTNEEHPLSFGKSSLWNQYFQESEILEQIDRDVKRTHPEMPFFSAKANQESLRRILIVFSKLNPTIRYVQGMNEVLAPLFYVFKNDPDTSNSASAEADTFFCFVELLSGFKDNYCKHLDNSQVGIRSTLSKLSQLLKRHDEELWRHMEITTKVYLLNKILILIACYIVFVGKFSHSGMSPIIVDSHAWILKIQVYPQYYAFRWITLLLTMEFSFNVCIHIWDAILGDPEGPPDTLLRICCAMLILVRRRLLAGDFTANIQLLQHYPPTNIDHLLHIANRLRGSVAS

SEQ ID NO: 86541 - protein, 355 aa, Bacillus cereus E33L
MVTKEQVVEALEGIVDPFLHKTLKETGAIKEVTVKPEKEHVSVKIAIVKTGTAEQMQLQSGIVKLVKELGAATVGLRFAEFTEEELSQFAPEQEEEQTESLLSPNSKTTFLAVASGKGGVGKSTVSVNLAIALARLGKKVGIIDADIYGFSVPDMMGIEKRPVVRGDKIIPVERLGVKVISMGFFVEDNAPVIWRGPMLGKMLNHFFTEVEWGDLDYLVLDLPPGTGDVALDLHSMLPACKEIIVTTPHPTAAFVAARAGAMALRTEHSILGVVENMAYFESKTTGEKEYVFGRGGGDKLATELQTEVLGRIPLQQPDWNKEDFAPSVYEDTHTTGLIYRTIAETVIDKTAVAQK

SEQ ID NO: 86542 - protein, 7257 aa, Sorangium cellulosum
MTTRGPTAQQNPLKQAAIIIQRLEERLAGLAQAELERTEPIAIVGIGCRFPGGADAPEAFWELLDAERDAVQPLDMRWALVGVAPVEAVPHWAGLLTEPIDCFDAAFFGISPREARSLDPQHRLLLEVAWEGLEDAGIPPRSIDGSRTGVFVGAFTADYARTVARLPREERDAYSATGNMLSIAAGRLSYTLGLQGPCLTVDTACSSSLVAIHLACRSLRAGESDLALAGGVSALLSPDMMEAAARTQALSPDGRCRTFDASANGFVRGEGCGLVVLKRLSDAQRDGDRIWALIRGSAINHDGRSTGLTAPNVLAQETVLREALRSAHVEAGAVDYVETHGTGTSLGDPIEVEALRATVGPARSDGTRCVLGAVKTNIGHLEAAAGVAGLIKAALSLTHERIPRNLNFRTLNPRIRLEGSALALATEPVPWPRTDRPRFAGVSSFGMSGTNAHVVLEEAPAVELWPAAPERSAELLVLSGKSEGALDAQAARLREHLDMHPELGLGDVAFSLATTRSAMSHRLAVAVTSREGLLAALSAVAQGQTPAGAARCIASSSRGKLAFLFTGQGAQTPGMGRGLCAAWPAFREAFDRCVALFDRELDRPLREVMWAEAGSAESLLLDQTAFTQPALFAVEYALTALWRSWGVEPELLVGHSIGELVAACVAGVFSLEDGVRLVAARGRLMQGLSAGGAMVSLGAPEAEVAAAVAPHAASVSIAAVNGPEQVVIAGVEQAVQAIAAGFAARGARTKRLHVSHAFHSPLMEPMLEEFGRVAASVTYRRPSVSLVSNLSGKVVTDELSAPGYWVRHVREAVRFADGVKALHEAGAGTFVEVGPKPTLLGLLPACLPEAEPTLLASLRAGREEAAGVLEALGRLWAAGGSVSWPGVFPTAGRRVPLPTYPWQRQRYWIEAPAEGLGATAADALAQWFYRVDWPEMPRSSVDSRRARSGGWLVLADRGGVGEAAAAALSSQGCSCAVLHAPAEASAVAEQVTQALGGRNDWQGVLYLWGLDAVVEAGASAEEVAKVTHLAAAPVLALIQALGTGPRSPRLWIVTRGACTVGGEPDAAPCQAALWGMGRVAALEHPGSWGGLVDLDPEESPTEVEALVAELLSPDAEDQLAFRQGRRRAARLVAAPPEGNAAPVSLSAEGSYLVTGGLGALGLLVARWLVERGAGHLVLISRHGLPDREEWGRDQPPEVRARIAAIEALEAQGARVTVAAVDVADAEGMAALLAAVEPPLRGVVHAAGLLDDGLLAHQDAGRLARVLRPKVEGAWVLHTLTREQPLDLFVLFSSASGVFGSIGQGSYAAGNAFLDALADLRRTQGLAALSIAWGLWAEGGMGSQAQRREHEASGIWAMPTSRALAAMEWLLGTRATQRVVIQMDWAHAGAAPRDASRGRFWDRLVTATKEASSSAVPAVERWRNASVVETRSALYELVRGVVAGVMGFTDQGTLDVRRGFAEQGLDSLMAVEIRKRLQGELGMPLSATLAFDHPTVERLVEYLLSQALELQDRTDVRSVRLPATEDPIAIVGAACRFPGGVEDLESYWQLLTEGVVVSTEVPADRWNGADGRVPGSGEAQRQTYVPRGGFLREVETFDAAFFHISPREAMSLDPQQRLLLEVSWEAIERAGQDPSALRESPTGVFVGAGPNEYAERVQELADEAAGLYSGTGNMLSVAAGRLSFFLGLHGPTLAVDTACSSSLVALHLGCQSLRRGECDQALVGGVNMLLSPKTFALLSRMHALSPGGRCKTFSADADGYARAEGCAVVVLKRLSDAQRDRDPILAVIRGTAINHDGPSSGLTVPSGPAQEALLRQALAHAGVVPADVDFVECHGTGTALGDPIEVRALSDVYGQARPADRPLILGAAKANLGHMEPAAGLAGLLKAVLALGQEQIPAQPELGELNPLLPWEALPVAVARAAVPWPRTDRPRFAGVSSFGMSGTNAHVVLEEAPAVELWPAAPERSAELLVLSGKSEGALDAQAARLREHLDMHPELGLGDVAFSLATTRSAMNHRLAVAVTSREGLLAALSAVAQGQTPPGAARCIASSSRGKLAFLFTGQGAQTPGMGRGLCAAWPAFREAFDRCVALFDRELDRPLREVMWAEPGSAESLLLDQTAFTQPALFTVEYALTALWRSWGVEPELVAGHSAGELVAACVAGVFSLEDGVRLVAARGRLMQGLSAGGAMVSLGAPEAEVAAAVAPHAASVSIAAVNGPEQVVIAGVEQAVQAIAAGFAARGARTKRLHVSHASHSPLMEPMLEEFGRVAASVTYRRPSVSLVSNLSGKVVADELSAPGYWVRHVREAVRFADGVKALHEAGAGTFVEVGPKPTLLGLLPACLPEAEPTLLASLRAGREEAAGVLEALGRLWAAGGSVSWPGVFPTAGRRVPLPTYPWQRQRYWPDIEPDSRRHAAADPTQGWFYRVDWPEIPRSLQKSEEASRGSWLVLADKGGVGEAVAAALSTRGLPCVVLHAPAETSATAELVTEAAGGRSDWQVVLYLWGLDAVVGAEASIDEIGDATRRATAPVLGLARFLSTVSCSPRLWVVTRGACIVGDEPAIAPCQAALWGMGRVAALEHPGAWGGLVDLDPRASPPQASPIDGEMLVTELLSQETEDQLAFRHGRRHAARLVAAPPQGQAAPVSLSAEASYLVTGGLGGLGLIVAQWLVELGARHLVLTSRRGLPDRQAWCEQQPPEIRARIAAVEALEARGARVTVAAVDVADVEPMTALVSSVEPPLRGVVHAAGVSVMRPLAETDETLLESVLRPKVAGSWLLHRLLHGRPLDLFVLFSSGAAVWGSHSQGAYAAANAFLDGLAHLRRSQSLPALSVAWGLWAEGGMADAEAHARLSDIGVLPMSTSAALSALQRLVETGAAQRTVTRMDWARFAPVYTARGRRNLLSALVAGRDIIAPSPPAAATRNWRGLSVAEARVALHEIVHGAVARVLGFLDPSALDPGMGFNEQGLDSLMAVEIRNLLQAELDVRLSTTLAFDHPTVQRLVEHLLVDVLKLEDRSDTQHVRSLASDEPIAIVGAACRFPGGVEDLESYWQLLAEGVVVSAEVPADRWDAADWYDPDPEIPGRTYVTKGAFLRDLQRLDATFFRISPREAMSLDPQQRLLLEVSWEALESAGIAPDTLRDSPTGVFVGAGPNEYYTQRLRGFTDGAAGLYGGTGNMLSVTAGRLSFFLGLHGPTLAMDTACSSSLVALHLACQSLRLGECDQALVGGVNVLLAPETFVLLSRMRALSPDGRCKTFSADADGYARGEGCAVVVLKRLRDAQRAGDSILALIRGSAVNHDGPSSGLTVPNGPAQQALLRQALSQAGVSPVDVDFVECHGTGTALGDPIEVQALSEVYGPGRSGDRPLVLGAAKANVAHLEAASGLASLLKAVLALRHEQIPAQPELGELNPHLPWNTLPVAVPRKAVPWGRGARPRRAGVSAFGLSGTNVHVVLEEAPEVEPAPAAPARPVELVVLSAKSAAALDAAAARLSAHLSAHPELSLGDVAFSLATTRSPMEHRLAIATTSREALRGALDAAAQQKTPQGAVRGKAVSSRGKLAFLFTGQGAQMPGMGRGLYETWPAFREAFDRCVALFDREIDQPLREVMWAAPGLAQAARLDQTAYAQPALFALEYALAALWRSWGVEPHVLLGHSIGELVAACVAGVFSLEDAVRLVAARGRLMQALPAGGAMVAIAASEAEVAASVAPHAATVSIAAVNGPDAVVIAGAEVQVLALGATFAARGIRTKRLAVSHAFHSPLMDPMLEDFQRVAATIAYRAPDRPVVSNVTGHVAGPEIATPEYWVRHVRSAVRFGDGAKALHAAGAATFVEVGPKPVLLGLLPACLGEADAVLVPSLRADRSECEVVLAALGAWYAWGGALDWKGVFPDGARRVALPMYPWQRERHWMDLTPRSAAPAGIAGRWPLAGVGLCMPGAVLHHVLSIGPRHQPFLGDHLVFGKVVVPGAFHVAVILSIAAERWPERAIELTGVEFLKAIAMEPDQEVELHAVLTPEAAGDGYLFELATLAAPETERRWTTHARGRVQPTDGAPGALPRLEVLEDRAIQPLDFAGFLDRLSAVRIGWGPLWRWLQDGRVGDEASLATLVPTYPNAHDVAPLHPILLDNGFAVSLLSTRSEPEDDGTPPLPFAVERVRWWRAPVGRVRCGGVPRSQAFGVSSFVLVDETGEVVAEVEGFVCRRAPREVFLRQESGASTAALYRLDWPEAPLPDAPAERIEESWVVVAAPGSEMAAALATRLNRCVLAEPKGLEAALAGVSPAGVICLWEAGAHEEAPAAAQRVATEGLSVVQALRDRAVRLWWVTMGAVAVEAGERVQVATAPVWGLGRTVMQERPELSCTLVDLEPEADAARSADVLLRELGRADDETQVAFRSGKRRVARLVKATTPEGLLVPDAESYRLEAGQKGTLDQLRLAPAQRRAPGPGEVEIKVTASGLNFRTVLAVLGMYPGDAGPMGGDCAGVATAVGQGVRHVAVGDAVMTLGTLHRFVTVDARLVVRQPAGLTPAQAATVPVAFLTAWLALHDLGNLRRGERVLIHAAAGGVGMAAVQIARWIGAEVFATASPSKWAAVQAMGVPRTHIASSRTLEFAETFRQVTGGRGVDVVLNALAGEFVDASLSLLSTGGRFLEMGKTDIRDRAAVAAAHPGVRYRVFDILELAPDRTREILERVVEGFAAGHLRALPVHAFAITKAEAAFRFMAQARHQGKVVLLPAPSAAPLAPTGTVLLTGGLGALGLHVARWLAQQGVPHMVLTGRRGLDTPGAAKAVAEIEALGARVTIAASDVADRNALEAVLQAIPAEWPLQGVIHAAGALDDGVLDEQTTDRFSRVLAPKVTGAWNLHELTAGNDLAFFVLFSSMSGLLGSAGQSNYAAANTFLDALAAHRRAEGLAAQSLAWGPWSDGGMAAGLSAALQARLARHGMGALSPAQGTALLGQALARPETQLGAMSLDVRAASQASGAAVPPVWRALVRAEARHTAAGAQGALAARLGALPEARRADEVRKVVQAEIARVLSWSAASAVPVDRPLSDLGLDSLTAVELRNVLGQRVGATLPATLAFDHPTVDALTRWLLDKVLAVAEPSVSSAKSSPQVALDEPIAIIGIGCRFPGGVADPESFWRLLEEGSDAVVEVPHERWDIDAFYDPDPDVRGKMTTRFGGFLSDIDRFDPAFFGISPREATTMDPQQRLLLETSWEAFERAGILPERLMGSDTGVFVGLFYQEYAALAGGIEAFDGYLGTGTTASVASGRISYVLGLKGPSLTVDTACSSSLVAVHLACQALRRGECSVALAGGVALMLTPATFVEFSRLRGLAPDGRCKSFSAAADGVGWSEGCAMLLLKPLRDAQRDGDPILAVIRGTAVNQDGRSNGLTAPNGSSQQEVIRRALEQAGLAPADVSYVECHGTGTTLGDPIEVQALGAVLAQGRPSDRPLVIGSVKSNIGHTQAAAGVAGVIKVALALERGLIPRSLHFDAPNPHIPWSELAVQVAAKPVEWTRNGVPRRAGVSSFGVSGTNAHVVLEEAPAAAFAPAAARSAELFVLSAKSAAALDAQAARLSAHVVAHPELGLGDLAFSLATTRSPMTYRLAVAATSREALSAALDTAAQGQAPPAAARGHASTGSAPKVVFVFPGQGSQWLGMGQKLLSEEPVFRDALSACDRAIQAEAGWSLLAELAADETTSQLGRIDVVQPALFAIEVALSALWRSWGVEPDAVVGHSMGEVAAAHVAGALSLEDAVAIICRRSLLLRRISGQGEMAVVELSLAEAEAALLGYEDRLSVAVSNSPRSTVLAGEPAALAEVLAILAAKGVFCRRVKVDVASHSPQIDPLRDELLAALGELEPRQATVSMRSTVTSTIMAGPELVASYWADNVRQPVRFAEAVQSLMEDGHGLFVEMSPHPILTTSVEEIRRATKREGVAVGSLRRGQDERLSMLEALGALWVHGQAVGWERLFSAGGAGLRRVPLPTYPWQRERYWVDAPTGGAAGGSRFAHAGSHPLLGEMQTLSTQRSTRVWETTLDLKRLPWLGDHRVQGAVVFPGAAYLEMALSSGAEALGDGPLQVSDVVLAEALAFADDTPAAVQVMATEERPGRLQFHVASRVPGHGGAAFRSHARGVLRQIERAEVPARLDLAALRARLQASAPAAATYAALAEMGLEYGPAFQGLVELWRGEGEALGRVRLPEAAGSPAACRLHPALLDACFHVSSAFADRGEATPWVPVEIGSLRWFQRPSGELWCHARSVSHGKPTPDRRSTDFWVVDSTGAIVAEISGLVAQRLAGGVRRREEDDWFMEPAWEPTAVPGSEVMAGRWLLIGSGGGLGAALHSALTEAGHSVVHATGRGTSAAGLQALLTASFDGQAPTSVVHLGSLDERGVLDADAPFDADALEESLVRGCDSVLWTVQAVAGAGFRDPPRLWLVTRGAQAIGAGDVSVAQAPLLGLGRVIALEHAELRCARIDLDPARRDGEVDELLAELLADDAEEEVAFRGGERRVARLVRRLPETDCREKIEPAEGRPFRLEIDGSGVLDDLVLRATERRPPGPGEVEIAVEAAGLNFLDVMRAMGIYPGPGDGPVALGAECSGRIVAMGEGVESLRIGQDVVAVAPFSFGTHVTIDARMLAPRPAALTAAQAAALPVAFMTAWYGLVHLGRLRAGERVLIHSATGGTGLAAVQIARHLGAEIFATAGTPEKRAWLREQGIAHVMDSRSLDFAEQVLAATKGEGVDVVLNSLSGAAIDASLSTLVPDGRFIELGKTDIYADRSLGLAHFRKSLSYSAVDLAGLAVRRPERVAALLAEVVDLLARGALQPLPVEIFPLSRAADAFRKMAQAQHLGKLVLALEDPDVRIRVPGESGVAIRADGAYLVTGGLGGLGLSVAGWLAEQGAGHLVLVGRSGAVSAEQQTAVAALEAHGARVTVARADVADRAQMERILREVTASGMPLRGVVHAAGILDDGLLMQQTPARFRAVMAPKVRGALHLHALTREAPLSFFVLYASGAGLLGSPGQGNYAAANTFLDALAHHRRAQGLPALSIDWGLFADVGLAAGQQNRGARLVTRGTRSLTPDEGLWALERLLDGDRTQAGVMPFDVRQWVEFYPAAASSRRLSRLMTARRVASGRLAGDRDLLERLATAEAGARAGMLQEVVRAQVSQVLRLSEGKLDVDAPLTSLGMDSLMGLELRNRIEAVLGITMPATLLWTYPTVAALSAHLASHVVSTGDGESARPPDTGSVAPTTHEVASLDEDGLFALIDESLARAGKR

SEQ ID NO: 86543 - protein, 2439 aa, Sorangium cellulosum
MATTNAGKLEHALLLMDKLAKKNASLEQERTEPIAIVGIGCRFPGGADTPEAFWELLDSGRDAVQPLDRRWALVGVHPSEEVPRWAGLLTEAVDGFDAAFFGTSPREARSLDPQQRLLLEVTWEGLEDAGIAPQSLDGSRTGVFLGACSSDYSHTVAQQRREEQDAYDITGNTLSVAAGRLSYTLGLQGPCLTVDTACSSSLVAIHLACRSLRARESDLALAGGVNMLLSSKTMIMLGRIQALSPDGHCRTFDASANGFVRGEGCGMVVLKRLSDAQRHGDRIWALIRGSAMNQDGRSTGLMAPNVLAQEALLREALQSARVDAGAIGYVETHGTGTSLGDPIEVEALRAVLGPARADGSRCVLGAVKTNLGHLEGAAGVAGLIKAALALHHELIPRNLHFHTLNPRIRIEGTALALATEPVPWPRAGRPRFAGVSAFGLSGTNVHVVLEEAPATVLAPATPGRSAELLVLSAKSAAALDAQAARLSAHIAAYPEQGLGDVAFSLVSTRSPMEHRLAVAATSREALRSALEVAAQGQTPAGAARGRAASSPGKLAFLFAGQGAQVPGMGRGLWEAWPAFRETFDRCVTLFDRELHQPLCEVMWAEPGSSRSSLLDQTAFTQPALFALEYALAALFRSWGVEPELVAGHSLGELVAACVAGVFSLEDAVRLVVARGRLMQALPAGGAMVSIAAPEADVAAAVAPHAALVSIAAVNGPEQVVIAGAEKFVQQIAAAFAARGARTKPLHVSHAFHSPLMDPMLEAFRRVTESVTYRRPSIALVSNLSGKPCTDEVSAPGYWVRHAREAVRFADGVKALHAAGAGLFVEVGPKPTLLGLVPACLPDARPVLLPASRAGRDEAASALEALGGFWVVGGSVTWSGVFPSGGRRVPLPTYPWQRERYWIEAPVDREADGTGRARAGGHPLLGEVFSVSTHAGLRLWETTLDRKRLPWLGEHRAQGEVVFPGAGYLEMALSSGAEILGDGPIQVTDVVLIETLTFAGDTAVPVQVVTTEERPGRLRFQVASREPGERRAPFRIHARGVLRRIGRVETPARSNLAALRARLHAAVPAAAIYGALAEMGLQYGPALRGLAELWRGEGEALGRVRLPEAAGSATAYQLHPVLLDACVQMIVGAFADRDEATPWAPVEVGSVRLFQRSPGELWCHARVVSDGQQASSRWSADFELMDGTGAVVAEISRLVVERLASGVRRRDADDWFLELDWEPAALGGPKITAGRWLLLGEGGGLGRSLCSALKAAGHVVVHAAGDDTSTAGMRALLANAFDGQAPTAVVHLSSLDGGGQLGPGLGAQGALDAPRSPDVDADALESALMRGCDSVLSLVQALVGMDLRNAPRLWLLTRGAQAAAAGDVSVVQAPLLGLGRTIALEHAELRCISVDLDPAEPEGEADALLAELLADDAEEEVALRGGDRLVARLVHRLPDAQRREKVEPAGDRPFRLEIDEPGALDQLVLRATGRRAPGPGEVEISVEAAGLDSIDIQLALGVAPNDLPGEEIEPLVLGSECAGRIVAVGEGVNGLVVGQPVIALAAGVFATHVTTSATLVLPRPLGLSATEAAAMPLAYLTAWYALDKVAHLQAGERVLIHAEAGGVGLCAVRWAQRVGAEVYATADTPENRAYLESLGVRYVSDSRSGRFVTDVHAWTDGEGVDVVLDSLSGERIDKSLMVLRACGRLVKLGRRDDCADTQPGLPPLLRNFSFSQVDLRGMMLDQPARIRALLDELFGLVAAGAISPLGSGLRVGGSLTPPPVETFPISRAAEAFRRMAQGQHLGKLVLTLDDPEVRIRAPAESSVAVRADGTYLVTGGLGGLGLRVAGWLAERGAGQLVLVGRSGAASAEQRAAVAALEAHGARVTVAKADVADRSQIERVLREVTASGMPLRGVVHAAGLVDDGLLMQQTPARFRTVMGPKVQGALHLHTLTREAPLSFFVLYASAAGLFGSPGQGNYAAANAFLDALSHHRRAQGLPALSIDWGMFTEVGMAVAQENRGARQISRGMRGITPDEGLSALARLLEGDRVQTGVIPITPRQWVEFYPATAASRRLSRLVTTQRAVADRTAGDRDLLEQLASAEPSARAGLLQDVVRVQVSHVLRLPEDKIEVDAPLSSMGMDSLMSLELRNRIEAALGVAAPAALGWTYPTVAAITRWLLDDALVVRLGGGSDTDESTASAGSFVHVLRFRPVVKPRARLFCFHGSGGSPEGFRSWSEKSEWSDLEIVAMWHDRSLASEDAPGKKYVQEAASLIQHYADAPFALVGFSLGVRFVMGTAVELASRSGAPAPLAVFTLGGSLISSSEITPEMETDIIAKLFFRNAAGFVRSTQQVQADARADKVITDTMVAPAPGDSKEPPVKIAVPIVAIAGSDDVIVPPSDVQDLQSRTTERFYMHLLPGDHEFLVDRGREIMHIVDSHLNPLLAARTTSSGPAFEAK

SEQ ID NO: 86544 - protein, 387 aa, Photorhabdus luminescens subsp. laumondii TTO1
MIKSAILVLEDGTQFHGRAIGAEGAAVGEVVFNTSMTGYQEILTDPSYSRQIVTLTYPHIGNVGVNSVDKESLKVQAQGLVIRDLPLLTSNFRCEETLSDYLKRHNIVAIADIDTRKLTRLLREKGSQNGCIIAGKQIDAQVALEKAQAFPGLEGMDLAKEVTTKQIYPWLQGSWKLAGGLPEDKQEQDLPYHVVAYDFGAKRNILRMLVDRGCRLTVVPAQTSAEDVLKLNPDGIFLSNGPGDPAPCGYAIDAVKTLLETEIPIFGICLGHQLLALASGAETMKMKFGHHGGNHPVKDLECNVVMITAQNHGFAVDEKSLPSNLRVTHKSLFDGTLQGIHRTDKPAFSFQGHPEASPGPHETASLFDHFIELIEQYCQKNNRHNTK

SEQ ID NO: 86545 - protein, 278 aa, Cladonia rangiferina
VEHGAVKVVAVNDPFIEPHYAAYMLKYDSQHGQFKGTIEVEGSDLIVNGQKVKFYTEKDPGAIPWKDTGAYYIVESTGVFTTTEKAKAHLKGGAKKVVISAPSADAPMFVMGVNNETYKSDLEVISNASCTTNCLAPLAKVMHDEFTIIEGLMTTIHSYTATQKTVDGPSAKDWRGGRTAAQNIIPSSTGAAKAVGKVIPSLNGKLTGMSMRVPTSNVSVVDLTCRLEKSVTYDEIKEAMKKASDGELKGIMAYSEDDLVSTDLNGDNHSCIFDAKAG

SEQ ID NO: 86546 - protein, 278 aa, Cladonia subtenuis
VEHGAVKVVAVNDPFIEPHYAAYMLKYDSQHGQFKGTIEVEGSDLIVNGQKVKFYTEKDPGAIPWKDTGAYYIVESTGVFTTTEKAKAHLKGGAKKVVISAPSADAPMFVMGVNNETYKSDLEVISNASCTTNCLAPLAKVMHDEFTIIEGLMTTIHSYTATQKTVDGPSAKDWRGGRTAAQNIIPSSTGAAKAVGKVIPSLNGKLTGMSMRVPTSNVSVVDLTCRLEKSVTYDEIKEAMKKASNGELKGIMAYSEDDLVSTDLNGDNHSCIFDAKAG

SEQ ID NO: 86547 - protein, 353 aa, Spinacia oleracea
MMVSFKIIPLMLVVAISCLVGISKSQSTVPVVNGLSYSYYSRSCPDLDFIIRDHLFDVFERDITQAAGLLRLHFHDCFVKGCDGSVFLVGSSSTPSEKDAPPNLTLRHEAFKIINDLRAHVHYHCGRVVSCADIATLAARESVYQSGGPFYHVPLGRRDGLSFATQSETLANLPPPFFNTTQLLNAFATKNLNATDLVALSGGHTIGISHCTSFTNRLYPTQDPSMDQTLANNLKLTCPTATTNSTTNLDLRTPNVFDNKYFVDLMNHQGLFTSDQTLYTDSRTKAIVTSFATNQNLFFEKFIDAMVKMSQLSVLTGTQGEIRTNCSARNVIRHVNLKSVAQVDHEKERLSQY

SEQ ID NO: 86548 - protein, 626 aa, Pseudomonas putida GB-1
MSFASLGLSEALVRAIEAAGYTQPTPVQQRAIPAVLQGRDLMVAAQTGTGKTGGFALPILERLFPAGHPDKSQRHGPRQPRVLVLTPTRELAAQVHDSFKVYARDLPLVSACIFGGVGMNPQIQAIAKGVDVLVACPGRLLDLAGQGKVDLAHVEILVLDEADRMLDMGFIHDVKKVLARLPAKRQNLLFSATFSKDITDLADKLLHNPERIEVTPPNTTVERIEQRVYRLPASHKRALLAHLITQGAWEQVLVFTRTKHGANRLAEYLEKHGLTAAAIHGNKSQNARTKALADFKANSVRVLVATDIAARGLDIDQLPHVVNFELPNVEEDYVHRIGRTGRAGRSGEAISMVAPDEEKLLKSIERVTKQRIQDGDLMGFDASQVEAEKPEVRERPQNSGRGGRNQQGRGEGGKDANGGRKDKGKAKQQAAEKPADKENSGDKQQQPRKPRDKKPRQQQQASSNSVPKVPADRDPEEFLDDDVDNFGNRADYVSPYQGKNQGRNRRPGGGAGQGQNSGQRSNAGGQGQARSGGQQRSGGSGGGGEKRPARANNGGGARRDGGGRGRPARDDAARQEPAVRNPRQPEKQPVIIRKESKLDRYPTPEQLDDVPTRPRGERPALLTRKG

SEQ ID NO: 86549 - protein, 123 aa, Triticum aestivum
  misc_feature (107)..(107): Xaa can be any naturally occurring amino acid
MAARLAQLRAQAVQAAEFASKHGGSYYKELMEKNKQYVVQPPTIEKCQELSKQLFYTRLASLPGRYESFWKELDGVKQVWKNRKDLKVEDLGIATLFGVELYAWFCXGEIVGRGFTLTGYKAN

SEQ ID NO: 86550 - protein, 712 aa, Haemophilus somnus 129PT
MSRTIILIPISTGVGLTSVSLGLIHALEQKGAKIGFMKPISQPSTDEDKLDRTTSIVRTSTTLETAEPFMLSVAENLIGQNQSDVLLEKIVENHQQLAKNNELIIVEGLVPTRKHGYANSINYEIAKALDAEIVLVAAPATETPAELKERIEAAASQFGGKNNPNLLGVIINKFNAPIDESGRTRPDLSEIFDAYQHKQNNLNEVYKLFEKSPIKVLACVPWNAELIATRAIDLVNHLGASILHEGDIKTRRIRSITFCARSLQNMVEHFKTGSLLVTSADRPDVLTASALAATNGIELGGILLTGGYKIDNQIKKLCQPVFENTGLPIFRIEGNTWQSALALQSFNLEVPVDDKERIENIKQYTSQQFKSSFIENLVAASTRPRRLSPPAFRFQLTELARAAKKRIVLPEGDEPRTVKAASLCAERGIAECILLANPDDVKRVADAQGVVLGKGITIIDPVSVRENYVDRLVELRKAKGMTETSAREQLEDTVVLGTMMLEANEVDGLVSGAIHTTANTIRPPMQIIKTAPGNSIVSSIFFMLLPDQVLVYGDCAVNPDPTAEQLAEIAIQSADSAKAFGIDPKVAMISYSTGTSGSGADVEKVKEATRIAQEKRPDLLIDGPLQYDAAVMEDVAKSKAPNSPVAGKATVFVFPDLNTGNTTYKAVQRSADLVSIGPMLQGMRKPVNDLSRGALVDDIVYTIALTAIQATQ

SEQ ID NO: 86551 - protein, 351 aa, Spinacia oleracea
MAATKGFPLILVLSSLIIGLSQGQSTIPVVPGLSYTFYSSSCPGLDFIIRGHLWQIFQSDLTQAAGLLRLHFHDCFVQGCDGSVLLDGSASGPSEKEAPPNLTLRAQAFKIINDLRALVHQQCGRVVSCADITALAARESVFLAGGPFYWVPLGRRDGLNFATLSDTLANLPPPSFNTGQLLDSLANKKLNATDLVALSGGHTIGISHCTSFTDRLYPTQDPTMAQTFANNLKVTCPTATTNATTNLDIRTPNVFDNKYYIDLMNRQGLFTSDQDLYTDSRTKDIVTSFALNQNLFFQKFIDAMVKMGQLNVLTGTQGEIRANCSVRNANSNLHLKSVVEIDQEQQTLSQF

SEQ ID NO: 86552 - protein, 105 aa, Triticum aestivum
  misc_feature (37)..(37): Xaa can be any naturally occurring amino acid
YPLFLTWAQTNCDVLRFVRSLTIIYLVVRVTDVGCSXIAQGCRSLELLSLFGMPRGTDACLEALSKSCSNSLTTLDVNGCTGIKRRSRDELIQLFPRLSCFKVHS

SEQ ID NO: 86553 - protein, 344 aa, Bacteroides fragilis YCH46
MKERILVTGGTGYIGSHTVVELQNSGYEVIIIDNLSNSNADVVDNIEKVSGIRPVFEKLDCLDFDGLDAVFNKYKGIKAIIHFAASKAVGESVEKPLLYYRNNLVSLINLLELMPKHGIEGIVFSSSCTVYGEPDELPVTENAPIKKATSPYGNTKQINEEIVRDTVASGAPINAILLRYFNPIGAHPTALLGELPNGVPQNLIPYLTQTAIGIREKLSVFGDDYDTPDGSCIRDFINVVDLAKAHVIAIARILEKKQKDKVETFNIGTGRGVSVLELINGFEKATGVKLNYQIVGRRAGDIEKVWANPDYANNELGWKAQETLEDTLRSAWAWQLKLRERGIQ

SEQ ID NO: 86554 - protein, 273 aa, Aspergillus oryzae
MANFPKYPDLQGKVALIMGAGQTHVPGSEARGNGAAIAQCLAQNGVQVFGCDVNLQAAELTASRIQAEGGKCDIAQADVTSEKDVRRVVDAVMSKYGRIDILINNVGATVAGDPASMPSDVWDKQIDLNLKSVYLACHVVLPIMEKQGSGCVVNNASIAGLRYIGKPQVAYSAAKAAVIQFTKVTAVMYAPKGVRLNTVVPGFIHTPLVDNFKFNGQKEVYDKITRQPVPLGRMGDAFDVANSTVFLASDAAKYITGQILVVDGGFTSSAASL

SEQ ID NO: 86555 - protein, 162 aa, Mycobacterium sp. JLS
MEFEVVIEIPKGSRNKYEVDHETGRLKLDRYLYTSMAYPTDYGFIENSLGEDGDPLDALVLLPESVFPGCIVDARPVAMFQMTDEAGGDDKVLCVPAGDKRWDHIQDLADVPEQVLEEVKHFFVHYKDLEPNKYVKAADWTGREAAEAEVQRSFERFKAEGH

SEQ ID NO: 86556 - protein, 128 aa, Brassica napus
  misc_feature (104)..(104): Xaa can be any naturally occurring amino acid
MKRSHISSPRSCSFSRPAISLLFVILLFLLGLTLTSRKPSGSPPNRILTGKPNIPKLAYLVTGTKGDAKRVKRLLGAIHHPRNYYLLHLDLQASDEERMDLAKXYVRSEKEKMKNVMVMGGGYPGPRT

SEQ ID NO: 86557 - protein, 221 aa, Bacillus clausii KSM-K16
MGLARTLLNDIDVVFEQDPAARSRLEVIFTYSGVHAVWGHRIAHGLWKRKWYFLARLLSQIVRFMTGIEIHPGAKIGQRLFIDHGMGVVIGETCEIGDNVTIFQGVTLGGTGKEKGKRHPTVKDGVLIASGAKVLGSFTIGEGARIGAGSVVLNEVPPHSTVVGIPGKIVVQNGIKVSSARSLDHHALPDPVADKIAELEREIARLKAEYSKLADKQSTLD

SEQ ID NO: 86558 - protein, 159 aa, Clostridium difficile 630
MNISIVVVGKIKEKYLKLGIDEFKKRLSKYCKLEIIELDDEKAPENLSVKEMEIIKDKEGKKILGKIKHNSYVIALAIDGKGLSSEELAKTMSDLAVRGNSSLCFIIGGSLGLSDEVLGRADYRLSFSRMTFPHQMMRLILLEQIYRAYRINNGEPYHK

SEQ ID NO: 86559 - protein, 436 aa, Geobacillus kaustophilus HTA426
MVVEVTLPKLSDSHDESFITFWHVSEGDAVEKGATLVEVQTEKAVSEIHAPESGTVKEIKKKRGDTAKVGEVLAVIAVETFAPDGGDPQTEIKITPRVKKLAKELGVDWSTVTPTGANGKITEDDIRRAASAGKQRTPQKTFVAAPSVRKFAREQNVSLEEITPSGKNGRILKSDIEAALSVRQQKATDEAAASVEIVKKQESREKVRRVPLTGIRKAIAQAMVRSTRTIPQVTHFGEADATRLVQHRRRIQPLAEQQGVKLTYLAYVVKALAAVLKKYPMLNASLDEEREEIVIHEFIHIGFAVDTDRGLLVPVIRDADQKSLFQIAKEIEELTAKARAGTIQAVEMSGGTCTVSNIGSANGSWFTPIIHYPQSCLLGIGKVEKKPVVVDDSIEIASVMPLSLTYDHRLIDGMMAQHALNECQTYLSEPDWLLVM

SEQ ID NO: 86560 - protein, 541 aa, Caulobacter crescentus CB15
MHFTLRVASARAQMPPAKRDEKFCEPAGSTGGRSGGGSMARQRLSFLQIWNMCFGFFGIQIGFGLQNANTSRIFQSLGVDVNHLAILWIAAPATGLLVQPIIGHFSDKTWGRFGRRRPYFFWGAILTTLALLVMPNSPTLWVAAAALWIMDASINITMEPFRAFVGDNLPDEQRATGYAMQSFFIGLGAVFASALPWMLTNWFDVANTAPAGQVPDSVRIAFYTGGAGLLLAVLWTVFTTREYSPEQLTAFEKAEREIAGLGLHEEPEPSVNAYIALGVGGVLLGAALALIVWGAGLEKELYVLAGLLFAFGLAGVAGARFKRIGRTDNGFSEVLADVFRMPKTMRQLAVVQFFSWFGLFAMWIYTTPAVATVHFGAVDASSKAYNEGADWVGVLFAVYNGVAALAALVIPLMVKVTSRRVSHAVCLGLGALGLLSFLVIRDPGLLWIGMVGVGFAWSSILSTPYSILAGALPARKMGVYMGIFNVFIVVPQLLAATLLGLMLKTFFGNQSIFALVLGALSFALAAAATFLVRDRVAGAPA

SEQ ID NO: 86561 - protein, 471 aa, Acidobacteria bacterium Ellin345
MPDTIYDVVIIGSGPAGYTAAIRAGQFGLKTALIEKDAKLGGTCLHVGCIPTKSLLFNAEIYDHIKEAEEFGIEGLGTPKLNWSKVQERKQAIIDKHAKGLQFLMKKNKVTVIPGFGRLTGPAKGGIHSVEVEADGKKQNVQAKNVLLSTGSVARMLPGLQADDRILTNIEILSLKEIPKSLVVIGSGAVGVEFASIYKSFGTDCTIIEMLPRLVPVEDEEVSKELLRNYKKRGINCHVNAKTDKFEKTKTGVKVTFTVDGKQESIEAEKCLVAIGRAPRTEGVGIEKTNIKLERGFVPVNEWMQTTEPGVYAIGDIVLGLQQLAHAGAMEGMVAVAHIAGKPTKPVRKDRVPGATYCHPEIGSVGLTEAQAKEAGHEVKIGKFPFTANSRASIVNQHEGFVKVVADAKHGEILGVHIIGPQATELVAEAVAMLELEATADFMMTVIHAHPTLAEAMLDAVSAVYGMAINA

SEQ ID NO: 86562 - protein, 347 aa, Listeria monocytogenes str. 4b F2365
MKNTIKWIAIGFAGIILLPLLIVFFIYKKAVGKKEYNPEVLENLDEASQEFVKNTSPLSDVDSRYKYMRLATKALPSAKDIEIGDVENKKIDGPAGKIPIRIYTPQEDGPFEIIVYYHGGGFVLGGLQTHDAIARKLVQTTGARVVTVDYRLAPENPFPAAVEDAYAALLWVQNHRTSLRAKSSDIIVAGDSVGGNLATVVTQIAKSKGKPNITAQILLYPATDIFSRDASVLYPSMDEFAEGYVLTKESLDKFFKLYIANASDRKYDPLVAPIRSKDLVGLPKTFIATAEFDPLRDQGEAYAKKLKDAGVEVFAKRFEKVPHGFMTTNSEATDETYELISEFLEEK

SEQ ID NO: 86563 - protein, 310 aa, Glycine max
  misc_feature (140)..(140): Xaa can be any naturally occurring amino acid
  misc_feature (227)..(227): Xaa can be any naturally occurring amino acid
LVPREREREREREREREREREREREREREREREREREREREREREREREREREREREREREREREQRETGKNWFQGTADAVRLFTWVFEDAKHTHIENVLILAGDHLYRMDYMDLVQSHVDRNADITVSCAAVGESRASXYGLVKADGRGRIIQFSEKPKGADLKAMQADTSLLGLPPHDALGSPYIASMGVYVFNTDVLLNLLKWRYPTSNDFGSEIIPAASYFFXDYWEDIGTIKSFYDANLALTEENPMFKFYDPKTPIYTSPRFLPPTKIDKCRIVDAIISHGCFLRECTVQHSKFLGTPNFGLWC

SEQ ID NO: 86564 - protein, 257 aa, Acidobacteria bacterium Ellin345
MADLFNLSGKVAVVVGGTTGIGRAISFGLADAGADVVSTARREEQVNAAADEIERRGRQTLRVCSDVTSRASIQSLCNAVLAKFQKVDILVNCAGTTKRTPTLTVSEDEWNKILDTNLTGALRACQVFGKHMIERGYGRIINIASLSSFVALHEVAAYSASKAALLSLTRSLAVEWSKKGVTVNAIAPGVFRTALNTELLDNTPRGQEFLMRTPMQRFGNTEELVGAAVYLASDAASFVTGQAITVDGGFLASGVNQ

SEQ ID NO: 86565 - protein, 499 aa, Hordeum vulgare
MIGTRVLAHSRVDPAIRWGVAARGRVVFAAIRWGAAARGRVVFAAVRWGAAARGTKREAGQETSTSETKKTKRKWGRGFCGMASHEVEEPLTSETKKTKRKWGRGFCGMASHEAEEPLTSETKKKRKNVAASSEPDKKRWFKNKIWKKKKAKNEQLATLVKEISLATKLNSAMHVNINLSMNICPTQTYEEHSGTYLRNLAVIAVKQLDKDGLQGNREFLVEVLMLSLLHHPNLVTLLGYCTECDQKILVYEYMPLGSLQDHLLDLTPKSQPLSWHTRMKIAVDAARGLEYLHEVANPPVVYRDLKASNILLDGNFSAKLADFGLAKLGPVGDKTHVTTRVMGTYGYCAPEYAMSGKLTKMSDIYCFGVVLLELITGRRAIDTTKPTREQILVHWAAPLFKDKKKFTKMADPLLDSKYPLKGLYQALAISSMCLQEEAISRPLISDVVTALTFLADPNYDPPDDIEPLPISVPNYDKGISLREAEISLSGFEEKQVEDS

SEQ ID NO: 86566 - protein, 278 aa, Cladonia arbuscula
  misc_feature (2)..(2): Xaa can be any naturally occurring amino acid
VXHGAVKVVAVNDPFIEPHYAAYMLKYDSQHGQFKGTIEVEGSDLIVNGQKVKFYTEKDPGAIPWKDTGAYYIVESTGVFTTTEKAKAHLKGGAKKVVISAPSADAPMFVMGVNEETYKSDIEVISNASCTTNCLAPLAKVMHDNFTIIEGLMTTIHSYTATQKTVDGPSAKDWRGGRTAAQNIIPSSTGAAKAVGKVIPSLNGKLTGMSMRVPTSNVSVVDLTCRLEKSVTYDEIKEAMKKASDGELKGIMAYSEDDLVSTDLNGDNHSCIFDAKAG

SEQ ID NO: 86567 - protein, 278 aa, Cladonia arbuscula
  misc_feature (274)..(274): Xaa can be any naturally occurring amino acid
VEHGAVKVVAVNDPFIEPHYAAYMLKYDSQHGQFKGTIEVEGSDLIVNGQKVKFYTEKDPGAIPWKDTGAYYIVESTGVFTTTEKAKAHLKGGAKKVVISAPSADAPMFVMGVNEETYKSDIEVISNASCTTNCLAPLAKVMHDNFTIIEGLMTTIHSYTATQKTVDGPSAKDWRGGRTAAQNIIPSSTGAAKAVGKVIPSLNGKLTGMSMRVPTSNVSVVDLTCRLEKSVTYDEIKEAMKKASDGELKGIMAYSEDDLVSTDLNGDNHSCIFXAKAG

SEQ ID NO: 86568 - protein, 153 aa, Streptococcus pneumoniae
EHFIRGQYRSGKIDGMKYISYRGEPNVNPESTTETFTSGAFFVDSDRFRGVPFFFRTGKRLTEKGTHVNIVFKQMDSIFGEPLAPNILTIYIQPTEGFSLSLNGKQVGEEFNLAPNSLDYRTDATATGASPEPYEKLIYDVLNNNSTNFSHWD

SEQ ID NO: 86569 - protein, 278 aa, Cladonia arbuscula
VEHGAVKVVAVNDPFIEPHYAAYMLKYDSQHGQFKGTIEVEGSDLIVNGQKVKFYTEKDPGAIPWKDTGAYYIVESTGVFTTTEKAKAHLKGGAKKVVISAPSADAPMFVMGVNEETYKSDIEVISNASCTTNCLAPLAKVMHDNFTIIEGLMTTIHSYTATQKTVDGPSAKDWRGGRTAAQNIIPSSTGAAKAVGKVIPSLNGKLTGMSMRVPTSNVSVVDLTCRLEKSVTYDEIKEAMKKASDGELKGIMAYSEDDLVSTDLNGDNHSCIFDAKAG

SEQ ID NO: 86570 - protein, 485 aa, Pseudomonas putida GB-1
MQQGGDQHQGCCQHAFLSLCGVQGLNIWHSRGPLHGNDYRDSGQTLCPEPRARSSKSCPSHSGYDLEATVTGFGMLELVAAFICLTTLLTYVNYRFIGLPPAIGVMVTALLFSLMLQGLSLIGFPGLEERVEGLMNQIDFNDLLMHWMLAFLLFAGALHVNLSDLRSYRWPIGLLATLGVLIATVVIGYLSHWVFALFGWQVPLIYCLLFGALISPTDPIAVLGALRTANASKPLKTTIVGESLFNDGTAVVVFTVLLGIIQLGETPSLTDTAILFAREAIGGVVFGGLIGYATYRMIKSIEQYQVEVMLTLALVIGGSAMCYELHVSAPIAMVVAGLIIGNLGRNLAMNDMTRRYMDGFWELIDDMLNALLFALIGLELLLLPFNWMHLAAGGVLALAVLLSRLLTVAPAIVLLRRWRPVPKGTVRVLTWGGLRGGVSVALALSLPLGEERDLLLSITYIVVLSSILVQGLSIGRVVRKVSAQP

SEQ ID NO: 86571 - protein, 352 aa, Bacillus subtilis subsp. subtilis str. 168
MIREDEVRKLVGEMREPFLQRPLGELDAVKEIKIKPEKRHISVKVALAKTGTAEQMQIQQEIVNVLKGAGAETVGLRFEELPEETVAKFRAPSAEKKTLLNMDNPPVFLAVASGKGGVGKSTVSVNLAISLARLGKKVGLIDADIYGFSVPDMMGITVRPTIEGEKLLPVERFGVKVMSMGFFVEENAPVVWRGPMLGKMLNNFFHEVEWGEVDYIVLDLPPGTGDVALDVHTMLPSCKEIIVSTPHPTAAFVAARAGSMAIKTDHEVVGVIENMAYYESAKTGEREYVFGKGGGDKLAEELNVPLLGRIPLKQPDWDKDQFAPSVYDENHPIGEIYQDIAKKIDAKMSVQV

SEQ ID NO: 86572 - protein, 115 aa, Dechloromonas aromatica RCB
MIYKGSCHCGQIAFEVEGELSKVMDCNCSICSRMGSLHWFVPRDKLRLLTPESNLATYTFGKQSIKHHFCPKCGIHPFGEGTDPAGNRMAAINARCLEGVELSSLAVTHIDGRSR

SEQ ID NO: 86573 - protein, 257 aa, Cladonia arbuscula
AYMLKYDSQHGQFKGTIEVEGSDLIVNGQKVKFYTEKDPGAIPWKDTGAYYIVESTGVFTTTEKAKAHLKGGAKKVVISAPSADAPMFVMGVNEETYKSDIEVISNASCTTNCLAPLAKVMHDNFTIIEGLMTTIHSYTATQKTVDGPSAKDWRGGRTAAQNIIPSSTGAAKAVGKVIPSLNGKLTGMSMRVPTSNVSVVDLTCRLEKSVTYDEIKEAMKKASDGELKGIMAYSEDDLVSTDLNGDNHSCIFDAKAG

SEQ ID NO: 86574 - protein, 302 aa, Burkholderia vietnamiensis G4
MSGGTFPAFVSAGDILTDMVRAGDAQWTSVPGGAGWNVARAVARLGLPSALAGAIGEDCFSDVLWRASEAAGLDLRFLQRVPRAPLLAIVHETRPPAYFFIGDASADLAFDPARLPQGWAEHVKWAHFGCISLVREPLASTLVALAAQLHARGVKISFDPNYRNLMTAAYRPTLEKMAGLADLIKVSDEDLRHLFGGDGPDAVAAVRALNPRAAVFVTRGAQAATLYAGDDVLEASPPRVEVVDTVGAGDASIGGMLFSLMAAPQRSWREHLAFALAAGAAACRHTGAHAPTLDEVVALLER

SEQ ID NO: 86575 - protein, 145 aa, Glycine max
MEHYDLQRQRREMKNKGRNVVWSIAMDKCLIEALAAQAKRGNKIDKCFNENAYTAACVAVNTCFSLNLNNQKVINRLKTIKKRYRVIKDILSQDGFWWNPNTKMIECDSDELWKNYVAAHPNARGLRGKQIEMYDELYLLWCSLI

SEQ ID NO: 86576 - protein, 459 aa, Haemophilus somnus 129PT
MLNVGQFIRIATFFYFYYEFSNNKLFMTILVLGINHKTASVALREKVAFSDEKRLLALKQIKQTQLAESAVILSTCNRTEVYLHNKNVGPQNDEVWLDSCVQWFADIHQVDLEELKSCLYSQQNLQASRHLMRVASGLDSLILGEPQILGQVKQAYQMSEEYYSLHSDIGMMSTELSRLFQKTFATAKRVRTETHIGESAVSVAYAACSLARQIFDSLRNLNILLVGAGETIELVSRHLLRHGVNGLAIANRTLSRAEKLVEKLETTQKIDIFSLDRLSEGLKRADIVITSTGSPHVLISRNLIEQAQQMRHYKPMLIVDIAVPRDVEESAGEIESVYHYTVDDLHNIIQYNINQREQASQQAEHIIQQESADFFEWLKVHQFSNLIRNYRESAEIIRQDLLEKALQALQNGENTEQVLQELSHKLTKKLIHQPTQAMQTMVKAGNTEGLQAFSHAVKF

SEQ ID NO: 86577 - protein, 478 aa, Bacillus subtilis subsp. subtilis str. 168
MNNSFTLKQQWFGNIRKDILAGILVALALIPEAIGFSIIAGVDPMVGLYASFCIAIIISIFGGRPGMISAATGSMAVVMVSLVADHGLQYLFAATILTGIIQVILGISKIARLMKFIPRSVMIGFVNALAILIFSAQLPQFEGASWSMYAMLAGSLVIIYVLPRFTTAVPSPLVAIIVMTIIAVTFHVDVRTVGDMGNISSSLPHFLIPDVPFTFETLQIIFPYSIALAFVGLLESLLTAQIIDEMTDTDSDKNKESRGQGIANIVTGFFGGMAGCAMIGQSVINTKAGGRGRLSAFVAGAFLMFLIAVLSHVVVKIPMAALVAVMVMVSVGTFDWSSLKGLKKAPLTDSIVMVVTVVTVVVTDDLSKGVFVGVLLSAVFFVAKISKLKIVSHAEDQKLRTYQVKGQIFFASVTDLTNAFIYQEDIERVVIDLTEAHVWDDSGAAALDKIVAKFKEQGIEAELKGLNKASKSLMKQMA

SEQ ID NO: 86578 - protein, 283 aa, Bacillus subtilis subsp. subtilis str. 168
MGCAWIFAFITFAGSLSANFQSLRHALSHPLPMILALFVLHIFMPLFAWGSGHLIFKGDPLTITGLTLAVVIPTGITSLIWAAMYKGNVGLTLSIILVDTVLSPLIVPLSLSLLAGAQVHMDVWGMMKGLIVMVVIPSFLGMLFNQMSSPERTAFVSSALSPFSKLCLMAVIAINSSAIAPYFKSIDLRFAGIAVTVFFIALTGYAAAWLIGKMMKRRQEEIVSLIFTGGMRNISAGAVLAVTFFPSQVAVPVVIGMLFQQILAALFGYMLNRFELKPMLQKA

SEQ ID NO: 86579 - protein, 132 aa, Oryza sativa Japonica Group
MSRSLGIPVKLLHEAAGHVVTVELKTGEVYRGAMVECEDNWNCQLDNITFTAKDGKVSQLEHVFIRGSRVRFMIIPDMLKNAPMFKRLEARIRGKGSAIGVGRGRAVAMRARAAAGRGGGPVGRGGAPPVRR

SEQ ID NO: 86580 - protein, 308 aa, Spinacia oleracea
ILGLFPCSNLGFELEFYALSCPGVEFVVRDVVRSASSSDPSIPGKLLRLLFHDCFVYGCDASVLVEGDGTERADPANKSLGGFEVIEAAKRELELFCPQTVSCADILALAARDAVVMAGGPDIQMPTGRRDGLVSAISNVRPNIVDTSFTVDDMIRIFGAKGLTLNDLVILSGAHTIGLAHCNAFSDRFQVSSKGNLTFVDSSLDKDYAGKLAKKCAASTSATVNIDPKTAFSFDNQYYNNLIAKKGLLQTDSILFNDPRTKNLVLQLASDLNGFYEGWSTSFLKLSSIGVKGDGEGEVRQICSRING

SEQ ID NO: 86581 - protein, 206 aa, Thermobifida fusca YX
MKRFTPTVTALVLSSVLLATATACQSDSDSGTDSASDVTGATLHTSLGDIEVVLFPDKAPETVANFVGLAEGDKATNPTTGDDRFYDGTIFHRVIKDFMIQGGDPEGTGRGGPGYTFDDEIHPDLIFDEPGKLAMANSGPNTNGSQFFITTVPTPWLDGMHTIFGEVADEESLEVAVAISQVPTDANDRPTEDVVLESVTIHRDNE

SEQ ID NO: 86582 - protein, 329 aa, Mycobacterium sp. JLS
MTWLVTGGAGYIGSHVVRALTEADLPVVVIDDLSTGLEQFVPESVPFVRGTLLDGALVEQALREHEVTGVIHIAGFKYAGVSVQRPLHTYEQNVSAMVTLLQAMETVGVDKIVFSSSAATFGTPDVDQVDESTPTAPESPYGETKLIGEWLLRDAGRASGLRHTSLRYFNVVGSGSTALFDTSPHNLFPLVFDMLYRGDTPRINGDDYPTPDGTCVRDYVDVGDVALAHVAAARRLTRSEPVEPVYNLGSGAGTSVREIMTAIRTVTGVDFEPQIMPRRPGDPARIVANGDLAARDLDWKMRHSLEDMVASAWAARQAAGAAYPGAGQS

SEQ ID NO: 86583 - protein, 316 aa, Burkholderia xenovorans LB400
MAASMSATPEVQRPDILALGEAMIEFNQSVKDEPNYLQGFGGDTSNFCIAAARQGARTGFVSAVGADHFGRLLVDLWEREQVDTSLVRVDPHASTGVYFVSHGPEGHAFDYLRAGSAASRYAPQDLPLEAIAAARVIHLSGISLAISLSACDAALAAIAHARANGVRVSFDTNLRLKLWPLARARAVMLEAIRQTDICLPSWDDVTELTGLTGRDEIVDFLLSHGPGVVALKLGKQGSYIATPNERRVVPGQLVDAVDATGAGDCFGGAFIARIVAGDDPFAAARYANVAAALSTQGYGAVAPIPSRETVEQLLAD

SEQ ID NO: 86584 - protein, 128 aa, Oryza sativa Japonica Group
MSQEVVNPKAYPLADAQLTMTILDLVQQASNYKQLKKGANEATKTLNRGISEFVVMAADTEPLEILLHLPLLAEDKNVPYVFVPSKQALGRACGVTRPVIACSVTSNEGSQLKTPIQNLKDAIEKLLI

SEQ ID NO: 86585 - protein, 491 aa, Sinorhizobium meliloti 1021
MSSQIIPVEPFDYVVFGGTGDLAERKLLPALYHRQMEGQFTEPTRIIGASRASLSHDEYRRFASDALKEHLKSGEFNEAEVEKFTSRLYYVSVDAKSEQGWDDLKKLLEEGKDRTRAFYLAVGPAIFSDISEKIRDHKLITRNTRIVVEKPIGRDLASATELNDTIGKVFREEQIFRIDHYLGKETVQNLMALRFANALYEPLWNSAHIDHVQITVSEAVGLENRAGYYDKAGALRDMVQNHILQLLCFVAMEAPTSMDAEAVRDEKLKVLRALKPITASNVEQVTVRGQYRAGASSGGPVKGYLEELEGGVSNTETFVAIKAEISNWRWAGVPFYLRTGKRMAGRMSEIVITFKQIPHSIFDQSAGRISANQLMIRLQPNEGVKQSLMIKDPGPGGMRLRNVPLDMSFAEAFAVRNADAYERLLLDVIRNNQTLFVRRDEVEAAWQWIDPILKAWEATGQQVQGYTAGTWGPSQSIALIERDGRTWNDAI

SEQ ID NO: 86586 - protein, 635 aa, Trichodesmium erythraeum IMS101
MHLSEITHPKQLHNLSIHQLEEIARQIREKHLETVATSGGHLGPGLGVVELTLGLYQTLNLDRDKVIWDVGHQAYPHKIITGRYHNFHTLRQKDGIAGYLKRCESKFDHFGAGHASTSISAGLGMALARDMKGDNFKVVSIIGDGALTGGMALEAINHAGHLPKTNILVVLNDNEMSISPNVGAISRYLNKMRLSPPIQFLQDNLEEQFKQIPFVGETFTPEMEGLKGGMKRLAVSKVGAVIEELGFTYMGPVDGHNLEELITTFNQAHQIPGPVLVHVATTKGKGYPVAEEDKVSYHAQNPFNLATGKALPASKPKPPKYSKVFAHTLVKLAENNPKIIGITAAMATGTGLDKLHGKLPKQYIDVGIAEQHAVTLAAGLASEGMRPVVCIYSTFLQRAYDQIIHDVCIQKLPVFFCLDRAGIVGADGPTHQGMYDIAYLRCIPNMVVMAPKDEGELQRMVLTGIKHTDGAIAMRYPRGNGYGVPLMEEGWEAITIGKGEILRNGDDVLILGYGSMVYSAMQTAEILSEHGVAATVVNARFVKPLDTELILPLAQRIGQVVTMEEGCLMGGFGSAVTEALMDNNVLVPVLRLGVPDKLVDHAKPDESKADLGLTPSQMAERILQSFKPRLSTINV

SEQ ID NO: 86587 - protein, 326 aa, Mycobacterium avium subsp. paratuberculosis K-10
MSHDWTDNRKNLMLFSGRAHPELAEQVAKELDVHVTAQTAREFANGEIFVRFHESVRGCDAFVLQSAPAPVNSWLMEQLIMIDALKRGSAKRITAVMPFYPYARQDKKHRGREPISARLVADLLKTAGADRIVTVDLHTDQIQGFFDGPVDHMRGQNLLTGYIRDNYPDGNMVVVSPDSGRVRIAEKWADALGGVPLAFIHKTRDPRVPNQVVSNRVVGEVAGRTCVLIDDMIDTGGTIAGAVKLLRDEGAGDVIIAATHGVLSDPAAERLASCGAREVIVTNTLPIGEEKRFPQLTVLSIAPLLASTIRAVFENGSVTGLFDGDA

SEQ ID NO: 86588 - protein, 355 aa, Verticillium dahliae
MSRSNAPNPSGSRKISFNVSEQYDIQDVVGEGAYGVVCSAIHKPSGQKVAIKKITPFDHSMFCLRTLREMKLLRYFNHENIISILDIQKPRGYDTFNEVYLIQELMETDMHRVIRTQDLSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKCRRAREYIRSLPFKKKVPFRTLFPKTSDLALDLLEKLLAFNPVKRITVEEALKHPYLEPYHDPDDEPTAPPIPEEFFDFDKHKDTLSKEQLKQLIYQEIMR

SEQ ID NO: 86589 - protein, 539 aa, Aspergillus oryzae
MAGNCLGINHYKKTKKYLLSSSLIVRSRKEDSDNDNLKSQDSLHVIESHVLQERKIGTFGAISLVVNKIVGAGIFSTPATIYKLSGSVGMALMLWVIAGMISTCGALVMLEFGSGIPRSGGIKVYLERSFSPRLLQTCIYLFYCVFLQVSASNAITSSSYLLLAGGVESTTWKLRGVAIAAAGFAVGLHTIAPRAGRGLQDLLSAVKLFTLLFIVCTGFAALAGHRRVPDPHNFDIHTSFKGTSNSGYNIGTALLDAIFSFQGYDNVNAVLSEVKNPQKTLRIALPSAMGIITVLYLLANVAYFAAVPTEEFTNSNITIAASLFRNVFGDSAATKALPALVAISAVGHLLGIAYTVPRVLQELAKDGITPFPNIMMQNRPFKTPIVALAVHLGVTILFICAPPAGDAFNFIVSLSSYPTTFLLTAITVGLVKLRLTKDEGWASAFTAPWAMIAFYLVGNIFLLIMPFIPPPNGKGSTNLPYWLSPVVALAILSLGIVYYLLRFILFPWVFGYTLQPVAVELSDGSQVTRYRIQKIGETR

SEQ ID NO: 86590 - protein, 456 aa, Desulfovibrio vulgaris subsp. vulgaris str. Hildenborough
MTYDVVILGAGPGGSRAALEAAAAGLRVAIVDKGSFGGTCLNWGCIPTKLLLGGTAAHPLLEVQKKLKTAQGTIDFDLTALQARKTRFINGTRQALEKQLRQAGIEVITGTARLAGPGHVEVVDGEGTRELAARNVIVATGSVPASFPGLAPDGEAVLDSTALLDVTEVPDSLIIVGGGAIGLEMGDFFSRLGTAITIVEGLDRLAPTEDPEIGQTLGKLLKREGWAIHTGRRVASLSTVEGKAQLRFEDGTELVADKALMAVGRRPATAGLGLETAGATLLGAGWVETNDHLLAAPGLYAIGDVNGRTLLAHAADHQARFVISHIASGSASSASGYPAPVMPSCIYGHTEVMRAGATVAELVASGHDVHVSTSQLIANPIAQAYGTTGGFIRVLWVEGQVRGISAVGHGVSHLVTLATVIVSQRWRWEDVHGIIFAHPTLDEALEAALLAPSQKV

SEQ ID NO: 86591 - protein, 537 aa, Oryza sativa Indica Group
MMASTTSATAAGGAFAAAKTRAGSSAAGGGACARVAAGGRRRSGVVVRCDAGVEAQAQAQAVAKAASVAALEQFKISADRYMKERSSIAVIGLSVHTAPVEMREKLAVAEELWPRAISELTSLNHIEEAAVLSTCNRMEIYVVALSWNRGIREVVDWMSKKSGIPASELREHLFMLRDSDATRHLFEVSAGLDSLVLGEGQILAQVKQVVRSGQNSGGLGKNIDRMFKDAITAGKRVRCETNISSGAVSVSSAAVELALMKLPKSECLSARMLLIGAGKMGKLVVKHLIAKGCKKVVVVNRSVERVDAIREEMKDIEIVYRPLTEMYEAAAEADVVFTSTASETPLFTKEHAEALPAISDAMGGVRLFVDISVPRNVSACVSEVGHARVYNVDDLKEVVEANKEDRLRKAMEAQTIITQELKRFEAWRDSLETVPTIKKLRSYADRIRASELEKCLQKIGEDSLTKKMRRSIEELSTGIVNKLLHGPLQHLRCDGSDSRTLDETLENMHALNRMFSLDTEKAIIEQKIKAKVEKSQN

SEQ ID NO: 86592 - protein, 429 aa, Mycobacterium avium subsp. paratuberculosis K-10
MPIIEQVGAREILDSRGNPTVEVEIALTDGTFARAAVPSGASTGEHEAVELRDGGERYGGKGVQKAVQAVLDEIGPAVIGLNADDQRLVDQALVDLDGTPDKSRLGGNAILGVSLAVAKAAADSAELPLFRYLGGPNAHILPVPMMNILNGGAHADTAVDIQEFMVAPIGAPSFAEALRWGAEVYHSLKSVLKKEGLSTGLGDEGGFAPDVAGTTAALDLIGRAIESAGFKLGTDVALALDAAATEFYSDGTGYKFEGSTRTAEQMAEFYAGLLGAYPLVSIEDPLSEDDWDGWAALTASIGDRVQLVGDDVFVTNPERLEEGIEKGVANALLVKVNQIGTLTETLDAVALAHHSGYRTMMSHRSGETEDTTIADLAVAVGSGQIKTGAPARSERVAKYNQLLRIEEALGDAARYAGDLAFPRFALETR

SEQ ID NO: 86593 - protein, 272 aa, Streptomyces avermitilis MA-4680
MTDQSEHLDHLKAELLEIALDAAARAGAFLRDGRPDDLGVAATKSSAVDVVTEMDIASEKLITGLLADRRPDDGVLGEEGADVEGTSGVQWVIDPIDGTVNYLYGLPSWAVSIAARKDGETLVGVVHAPMRGETYSAVLGQGAFVNDLPARVRPAPAFGLALVGTGFGYLAERRARQAEVVRQLVPEVRDIRRGGSAAIDLCDVAAGRLDAYYERGLNPWDYAAGDLIAREAGALTGGRPGEPLSTDLTIAAPPGLFEALQTRLEDLGAWHD

SEQ ID NO: 86594 - protein, 68 aa, Picea sitchensis
MTTSRRLADRKSAKFQKNILKRGGVPETTVKKGNTYPVGPIVLGFFVFIVIGSSIFQIIRTASSGGTA

SEQ ID NO: 86595 - protein, 325 aa, Listeria monocytogenes str. 4b F2365
MSDLFTTIKGQVTGKNVRIVLPEGTDERIVGAAARLQKENIVKPILLGNKGEIEAKAKEIGVSVEGIAIHEPATDPLFDELVAAFVERRKGKATEEAARKMLVDPNYFGTMLVYTGKAEGLVSGAAHSTGDTVRPALQIIKTKPGVSKVAGAMIMVRGEERYLFSDVAINIAPVAADLAENAIVSAETAEIFGIDPRVAMLSFSTKGSAKSDETEKVVEATALAKEKAPELTLDGEFQFDAAFVPTVAEKKAPGSVIKGDANVFIFPSLEAGNIGYKIAQRLGNFEAVGPILQGLNAPVNDLSRGCNTDDVYNLTLITAAQAVNK

SEQ ID NO: 86596 - protein, 256 aa, Kluyveromyces lactis NRRL Y-1140
HTHNSHTIMARTFFIGGNFKMNGSKASIKEIVDRLNGASIPSNVEVVIAPPAIYLDHAVALNKRKEVKISAQNAYSKASGAYTGENSVEQIKDVGAEWVILGHSERRTYFNETDEIVAEKTKFALDSGVKVILCIGETLEEKQQNITLQVVQRQLQAVLEKVQDWTNVVVAYEPVWAIGTGLAATAEDAQDIHHSIREFLAEKLSRDVADSVRILYGGSANGKNAVTFKDKADVDGFLVGGASLKPEFVDIINSRV

SEQ ID NO: 86597 - protein, 748 aa, Photorhabdus luminescens subsp. laumondii TTO1
MLMRLREIVEKVAMATNLAEALELLVNETCLAMNTDVCSIYLADHQRRCYYLMATRGLRKPRGRAISLAFGEGVVGQVGQLSELINLADVRSHPSFKYLPQVKEDSFRAFLGVPVVYRRQLQGVLVVQQQEQRLFNETEESFMVTLATQLAVILAQAQTKGLFGRYRQTRIKALAISNGIVMAQGWQDCSQPSLDQIFEASTLDHAAERSRLIQALEDAIAECRRLSKRFTVGSQKESAAIFDLYSYLLNDPQLKQDLFSCVEQGSVAQWAVKQVIEKYAEQFSSLQDAYMRERASDLRALGQRLLFHLDDSLTASHQWPEWFILVADELSANLLAEMPQERLAGVIVRDGATHSHSAILVRAMGIPAIMGADIQPELLNNRMLILDGFRGEVFIEPEPLISQEYKQIIEEEKALSRLAEGDVEQEARLKSGERILVQLNAGLSLKYELQISNSIDGVGLYRTEIPFMLHCGFPSEDEQKARYQEMLQLFPDKPVVLRTLDIGADKQLPYMPISEENPCLGWRGIRVTLDQPEIFLIQLRAMLRANADMGNLKILLPMVTSVEEIDEAKRLVDRAKEEVEQMLARQISMPQLGVMIEVPSMIFLLPQLKNRVDFVSIGTNDLTQYLLAVDRNNTHVASLYDCLHPAVIRALKLVFENSQRAGLTISICGEMASFPMGALLLIGLGYRSLSMSGCSVPRIKYLLRHLELAQVEKLMAEILQAETSLRVKELSATFMEQHGVGGLVRGGI

SEQ ID NO: 86598 - protein, 140 aa, Oceanicola granulosus HTCC2516
MATERTLSIIKPDATKRNLTGKINAKFEDAGLRIVAQKRIKLTQEQAGEFYAVHKERPFFGELTEFMASGPVVVQVLEGEGAIAKNREVMGATNPADAAPGTIRAEFAESVGENSVHGSDAPETAKEEISFFFSGLELVG

SEQ ID NO: 86599 - protein, 552 aa, Coccidioides immitis RS
MVDSVLIVLSNRLGLTQLALKSTAIDKFLYLSAIRKNNVHLFYRLVVDHLKALTPLIYTPVVGEACLKWSEIYQQPEGMYISYEDRGNIAGVIQNWPQPNVEITCITDGSRILGLGDLGINGMGIPIGKLALYTACAGIRPEVTLPLTLDLGTSNKSLREDPLYMGSRREKVTPEQELEFLDELMTALTERWPGIVIQFEDFKNPFPALARYRHNYTCFNDDIQGTGAVILAGVMNAVKKSGIPPQNHKAVFLGAGSAGVGVAKQIVDFFVREGMTEDEARACFYLVDTKGLVTADRGDKLAAHKVYFARTDNGGRQYKTLEEVVDYVRPTMLMGLSTLGGVFTPQILKKMSDWNKKPIIFPLSNPSANSECNFESAVVNTDGRCLFASGSPFQPFSYTNHAGETKTHYPGQGNNMYVFPGIGLGTILSKAVEITDTMIYASAQALSTALTSEEIEQGLLYPDITRIREVSVLVARGVIRAAQEAKVDRETGIRTFSDSDLDAWIKSRMYNPHGEVQSLEREVGLLLSSIGRLNVNREEGSAAHEVNGDSKL

SEQ ID NO: 86600 - protein, 587 aa, Oryza sativa Indica Group
MESNGGGGGSPKEAAVVVPSSGDATLGGHLARRLVQVGVSDVFAVPGDFNLTLLDHLIAEPGLRVVGCCNELNAGYAADGYARARGVGACAVTFTVGGLSVLNAIGGAYSENLPLICIVGGPNSNDYGTNRILHHTIGLPDFSQELRCFQPLTCYQAVVNNLDDAHDQIDRAISTAIRESKPVYISVSCNLPAVPHPTFSRDPVPYFLSPRLSNQASLHAALDATLAFLDKAVKPVLVAGPKLRVAKAGGAFVDLADASGYAVAAMPSAKGLVPETLPRFIGTYWGAVSTAFCAEIVESADAYLFAGPIFNDYSSVGYSCLLKKEKAVVVQPDRVTVGNGPAFGCVMMRDFLSELAKRVRKNTTAFDNYKRIFVPEGQLPECEAGEALRVNVLFKHIQRMIGGAEIGAVMAETGDSWFNCQKLRLPEGCGYEFQMQYGSIGWSVGALLGYAQAVQKRVVACIGDGSFQVTAQDVSTMLRCGQRSIIFLINNGGYTIEVEIHDGPYNVIKNWDYVGLVNAIHNGEGRCWATRVRCEEELEAAIATATGDKADSLCFIEVVAHKDDTSKELLEWGSRVSAANSRPPNPQ

SEQ ID NO: 86601 - protein, 476 aa, Salinibacter ruber DSM 13855
MDRRTKIVCTLGPATTDPETLRRLVAAGMDVARMNFSHGTHEEHRERVETVREVAEAEGKGITVLQDLQGPKIRVGAVQNDSVMLAEGDEVRVSTDTPRESTNEHIFIDYEALARDAREGERILIDDGLLELRVIETNGSQLRATVVEGGPLRSRKGVNLPDLQASTPPMTEKDLKDLELGLELEVDVVALSFVQERSDVEALVHRIEETGKKTSVVAKIEKPQAVHNIDEILEVVDGIMVARGDLGIEMPMEEVPGTQKRLIRKSMEAAKPVITATQMLESMVEDPRPTRAEASDVANAVLDGSDAVMLSAETAVGDHPVRVVEAMNQIIRQAESYWHEERRALTMTPDHFEQGANVTNSVSFTACRLAEQVGAEAICCLTNSGSTARSIARHRPSMPIYAFTDNKRVVAQLGSLWGTEAFYIPFQQDTDQGIARVHGVLHDYDLVRSGGHVVLTVGMPLPARGRTNTVHVSTVQ

SEQ ID NO: 86602 - protein, 454 aa, Streptomyces avermitilis MA-4680
MTKRDVAALFGNRFLTEPAPSQTFPEEGMTATDTMRLLDEDLVMEGDPQRNLATFVTTWMEPEAQRIIAENLHRNFIDHAEYPISAEIEQRCVRMLADLFHAPGKTTGCRTQGSSEAIMLGALSLKWKWRERRQAANLPADRPNLVFGGDVHVVWEKFCRYFDVEPRIVPLAEDKYTIGPEDVEPHIDENTIGVVAVVGTTFTGHKDDVVGIDKLLRDVRKERDLDIPIHVDGASGGFVWPFLYPDSKWDFRLEQVRSINVSGHKYGLVYPGIGWLVFREESDLAKDLVFYENYLGKTDATFTLNFSTGASMVLAQYYNFVRLGRQGYTYVMETMQKNAHALADNLRSSGRFEVIGSDLEQLPLVAFRLAGEHAYDESDIAWQLSAERGWMVPAYTLPPNAERVKILRALVKETLSREQIERLTQDIADACATLDHKGGTTEVERAQIKRGTGY

SEQ ID NO: 86603 - protein, 585 aa, Coccidioides immitis RS
MGLEEHAVRPSNDDSRIDSSAEDLSASHDEDVEKGNGSLVRALRERHLQMIGIGGSIGAGLFIGSGQALSNGGPASTFLGFAITGAMVLCNLQALAELAVIYPVNGAFYTYAFRFIDPAWGFAMGWQYAVSWLIMLPIELTSAGLMITFWTSDINVGVWSAIFLVMVTVVQFFGIKGYGETEYILALVKVITCVGLIIVGLIINVGGVPTDNRGYIGGRYWHDPGAFRDGAKGFISVLVTAAFAYTGTEMIGLAAAETVNPRKSIPKATKQMLWCIVFFYVINILFVSLNIPSDSPALLGAKGGNIKASPFVIAAELAGIKVLPSIINAVIMLSIIGAANLCSYGSTRTLQALAATGNAPKFFAYIDSKGRPVWCILLQIAFGMLTFISEAASSEVVFTWMMALSGLSGLFLTTSICFTHIRFRRAWKLQGKNEEDIPYRSPFGVVGSIIGMGLSTIAIVATLYLGIFPIHATSRVEFFFQTCMAAPLALVAMLGWKIYKRNWKFGVDLRRVDLDEGRRMDYYSSGEDDHELREKGSSLTKKVAPWIHKEPYPGKMSAKPWAFLMDDSLKEHVRRGSTTPNSLTA

SEQ ID NO: 86604 - protein, 414 aa, Pseudomonas putida GB-1
MEGSDALQVVQGEGFALHRDARPLLQVPRNPDVAAVPVGAALCRDGPQRGPKSHHALASQRMPHLRPYKVALNGYGRIGRCVLRALFERGAKAGFEIVALNDLADQASLEYLTRFDSTHGRFPGEVKVDGDCLHINGDCVKVMRSATPEGIDWAALGIDLVLECSGAYNTRADGQRFLDAGAPRVLFSQPMASEADVDATVVYGINQACLTGSERLVSNASCTTNCGVPLLRVLDQAFGIEYVQITTIHSAMNDQPVIDAYHHEDLRRTRSAFQSVIPVSTGLARGIERLLPELAGRIQAKAVRVPTVNVSCLDITLQTARDTSAAEVNRVLREAALEGPLKGLLAYTELPHASCDFNHDPHSAIVDASQTRVSGPRLVNLLAWFDNEWGFANRMLDVAEHFLHVVHPTRNKQP

SEQ ID NO: 86605 - protein, 466 aa, Frankia sp. CcI3
MALHRQASGDRAEETVDVRPHLAPLGEEVVVPRFRMPQESTAPETAYQIVHDELMLDGKARLNMATFVTTWMDSYADRLMAECAPKNMIDKDEYPQTAALEERCVNILADLWHAPDAEHAVGCSTTGSSEACMLAGLAMIRRWRARRRSAGAPADRPNIVMGVNVQVCWEKFARYWDVEARLVPMAPGRTHLTADEAVAHCDENTIGVVAILGSTFDGSYEPVAGIVAALDHLAASGGPDVPVHVDAASGGFIAPFCDPDLVWDFQLDRVVSINTSGHKYGLVYPGVGWVLWRDRAHLPAELVFQVDYLGGTMPTFALNFSRPGAQVVAQYYTLLQLGYKGYRRVAQACRDNARWLAAEVAAMGPFELVSDGSGIPAFAFKLRDDITDYTVFDVSELLRTRGWLVPAYRFPPGLTDLAVLRVVVRHEFSRDLAGLLIADLRRVVNRLAHPGRRTAGDRPGESSFHH

SEQ ID NO: 86606 - protein, 580 aa, Dechloromonas aromatica RCB
MSFTLHGLGVSGGIAIGRAMLMSHATLEVSHLTLAPRMVDKEIERFDMAVNAVKEELILMKENTEHAPAELNAFIDIHTMFLEDPELAVKPRDIIRERRCNAEWALVQQMEHLVGQFEQFDDPYLRERKFDVVQVVERVVKELLGHRSRNALKTAKRSKEEALIVVAHDLSPADTIAFKEHRFAAFITDVGGATSHTSILARSMAIPAVLGLENARGLIRDGEQLIVDGMRGVVIVNPDQRVLDEYQLRKEQIELEKTKLKRLKTAKSETIDGVSVHLFANIELPNDVPVALDCGAEGIGLFRTEFLFLDRGDMPDEQEQYEAYKKVVKGMAGRPVTIRTFDLGADKDLNPQGNAGDRVKTNPALGRRAIRLSLAEPRMFQTQLRAILRASKHGPIKLLIPMLAHAHEIDQTLAALEQAKSSLRGEKATFDENIEVGGMIEIPAAALAVGLFLRRLDFLSIGTNDLIQYTLAIDRSDEQVAGLYDPLHPAVLMLIAHTLSMAEKVGVPVSVCGEMAGDPDLTRLLLGMGLRIFSMHPSQILKVKNRVLKAEVNELAPNVRRILRLDEPMKLREALDKLNA

SEQ ID NO: 86607 - protein, 387 aa, Pseudomonas putida GB-1
MTVLKMTDLDLQGKRVLIREDLNVPVKDGVVASDARILAALPTIKLALEKGAAVMVCSHLGRPTEGEFSAENSLKPVADYLSKALGRDVPLVADYLDGVSVQAGELVLFENVRFNKGEKKNADELAQKYAALCDVFVMDAFGTAHRAEGSTHGVAKFAKVAAAGPLLAAELDALGKALKAPAKPMAAIVAGSKVSTKLDVLNSLSSVCDQLIVGGGIANTFLAAAGHPVGKSLYEPDLVDTAKAIAAKVSVPLPVDVVVAKEFAETAEATVKAIADVAADDMILDIGPQTAANFAELLKSSKTILWNGPVGVFEFDQFGNGTKVLAKAIADSAAFSIAGGGDTLAAIDKYGVSKEISYISTGGGAFLEFVEGKVLPAVAILEERAKA

SEQ ID NO: 86608 - protein, 343 aa, Frankia sp. CcI3
MTDEIPAIDLEAALAEDAPADLLLRVREAAERIGLIQVVNHGVPLELIEDFERRVERVLRLPRPEKAKLASPTGHPFRGWRQWPDDLGRLELERYSVGQFDNPADAAAAGVSERWLGLYKHGNVWPPEDPDLRGVTFAYAKAAVVLAQRVLGLYERLLGLPAGSFPDAEPHHINMIVNDYPTWTYPDTVAEEEKLLLLEHTDGSAVTILHQHGEYSGLQAQQADGTWIPVPVVPGALQVFSGTILTRWTNGLFRPVRHRVVAGGSATRQSTGIFYHPSLDTVLEPLPAFVGEDGTEFEPVVLGEIDETNVENYLKVFGRPEQVAAWREGRPFVSELAETSAGR

SEQ ID NO: 86609 - protein, 496 aa, Burkholderia vietnamiensis G4
MNKLTLADWQDKAASLRIEGRAFIDGASRDAHGGKTFDCVSPIDGRVLAKVADCGEADVNAAVAAARRAFDAGVWAGLNPRARKAVLLRWAALMRTHLDELALLETLDAGKPIGDTTTVDVPGAAYCVEWFAEAIDKVGGEVAPADHHLVGLVTREPVGVVAAVVPWNFPILMAAWKFGPALAAGNSVVLKPSEKSPLTAIRVAQLAYEAGIPAGVFNVVPGAGEPGKLLALHRDVDCIAFTGSTAVGKLIMQYAAQSNLKRAWLELGGKSPNIVLPDCPDLERAAQAAAGAIFYNMGEMCTAGSRLLVHRDIKDAFIAKLVAAARAYVPGNPLDPSVSMGAIVDGIQLERVLGYIEAGRSEGTLVTGGARVRQETGGFYVEPTVFEVKPDAKIAREEIFGPVLSVIVFDDVDEAVRIANDTEYGLAAAVWTSDLTTAHDVSRRLRAGTVWVNCYDEGGDMNFPFGGYKQSGNGRDKSLHALEKYTELKSTLIRLR

SEQ ID NO: 86610 - protein, 357 aa, Oryza sativa Japonica Group
MARIVLVVAFAAVVVVQAAMAQRPGMPPAVVPPSLPTTTPPAPTVVAPPLPTTPPPAVVAPSPPLPPLTPPPAIVPPALPPPPPLPAIVVPPALPPTPAIAVPPALPPIPAIVPPSLPPTPEANLPCVAELAPCSEFYRNATAKPTGACCAPLKKAYESELGCLCSVLTNPAMAATVGVDTKKGLDLFGRCDVKVPADVCSSHAPAPVRVYNFVKYRSFGSLKFGKVLLQPAVLPQRLPQIFTLSPPTDAKEAAQPLPPCCMNDVAACRSPIASPSPMAGAPYQCTIATYPLSWSLISLRLSSVKRQERYSSRVLNCSILNHSFPDFLNFLHSGLVLHAFILMSKNMIWYSINVDPY

SEQ ID NO: 86611 - protein, 357 aa, Solanum tuberosum
SLTVRAASSYADELIKTAKTVASPGRGILAMDESNATCGKRLASIGLENTEANRQAYRTLLVSAPGLGQYISGAILFEETLYQSTVDGRKIVDVLIEQNIVPGIKVDKGLVPLAGSNDESWCQGLDGLASRSAAYYQQGARFAKWRTVVSIPNGPSALAVKEAAWGLARYAAISQDNGLVPIVEPEILLDGEHGIDRTFEVAQKVWAEVFFYLAENNVMFEGILLKPSMVTPGALNARQGTPQQVADYTLNLLKRRIPPAVPGIMFLSGGQSEVEATLNLNAMNQAPNPWHVSFSYARALQNTCLKTWGGQPENVKAAQDTLLVRAKANSLAQLGKYTGEGESDEAKQGMFVKGYVY

SEQ ID NO: 86612 - protein, 665 aa, Oryza sativa Indica Group
MGGGVEERKVVDLEDGDGEEGEDAAAVAAGSSRETRMLPRMPVRVLLAEGDDSTRHIICALLRKCGYRVAAASDGVKAWDILKEKSFNIDLVLTEVELPLMSGFLLLSTIMEHDACKNIPVIMMSSNDSVSMVFKCMLKGAADFLVKPIRKNELRNLWQHVWRKQLSSGVLDVQHTQQEDNLTERHEQKTGVTKAEHVTENVVHKNMECSEQESDAQMYLALQICINVGELIYQFFKSAKCHSSVLLGIAKWSTYDNSKSSCTRSELEADSRHTNNLLEYKQPMGRHFSKPDHKNTEKNGGTKIHASNDGNLIPRREEDASPRRMTCSNDINCEKASRDMELVHIIDNQQKNNTHMEMDVARANSRGNDDKCFSIPAHQLELSLRRSDYSRLESQEKNERRTLNHSTSSPFSLYNCRTASSTINAGDAQACSTSATHIDLENKNGDSKTPSQDKRETNQPPIRVVPFPVPVGGLTFDGQPFWNGAPVASLFYPQSAPPIWNSKTSTWQDATTQAISLQQNGPKDTDTKQVENVEEQTARSHLSANRKHLRIEIPTDEPRHVSPTTGESGSSTVLDSARKTLSGSVCDSSSNHMIAPTESSNVVPENPDGLRHLSQREAALNKFRLKRKDRCFEKKVRYQSRKLLAEQRPRVKGQFVRQDHGVQGS

SEQ ID NO: 86613 - protein, 505 aa, Geobacillus kaustophilus HTA426
MIYSKPGEKDAKVQFKTRYDNYINGEWIPPISGRYFQNITPITGEVFCEVARSQAEDIELALDAAHAAKEAWGKTSPADRALILNKIADRMEENLEMLAVAETWDNGKPIRETLNADLPLAIDHFRYFAGAIRAQEGTISQIDDDTIAYHFYEPLGVVGQIIPWNFPLLMAAWKIAPALAAGNCIVLKPAEQTPASIMVLMELIGDLLPPGVLNVVNGFGLEAGKPLASSPRIAKIAFTGETTTGRLIMQYASQNIIPVTLELGGKSPNIFFPDVMEKDDDFLDKAIEGFVMFALNQGEVCTCPSRALIHESIYDEFMERALERVKKIRTGNPLDTSTMMGAQASAEQMEKILAYIDIGKQEGAECLIGGEKNIIPGFENGYYIKPTVFKGHNKMRIFQEEIFGPVVSVTTFKDEQEALEIANDTLYGLGAGVWTRNINLAYRFGRGIQAGRVWTNCYHAYPAHAAFGGYKQSGIGRETHHMMLAHYQQTKNLLVSYNPKPLGFF

SEQ ID NO: 86614 - protein, 336 aa, Geobacillus kaustophilus HTA426
MKAAVVHKFKQKLQIEEVEKPKLGYGEVLVKIEACGVCHTDLHAAHGDWPVKPKLPLIPGHEGVGIVVEIGEGVKSIQIGDRVGIPWLYSACGECEYCLSGQETLCPHQLNGGYSVDGSYAEYCKAPANYVARIPKNLDPVQVAPILCAGVTTYKALKVSNAKPGEWVAIYGIGGLGHIALQYAKAMGLNVVAVDISDEKAELAAKLGADITINGLQEDPVAAIREKVGGVQAAISVAVTKKAFEQAYQSVRRGGCLVIVGLPHDELPIPIFDTVLNGVTIKGSIVGTRKDMQEALDFAARGKVRPIVEAVPLEKINEVFERMEKGQINGRVVLTM

SEQ ID NO: 86615 - protein, 175 aa, Azoarcus sp. EbN1
MGFELVKAGKDVPNDINVIIEISAQGEPIKFEVDKDSGAVFVDRFMGTSMRYPINYGYVPHTVAGDGDPVDVLVVTPFPLMPGVVIRCRPVGVLKMEDDGGQDAKVVAVPVSKLTPLYDKVQTTDDLPELLMKQTVHFFQHYKDLEPGKWVKVLGWGTVEDAKQEILNGLKNAAK

SEQ ID NO: 86616 - protein, 296 aa, Ostreococcus tauri
MENYEKVAKIGEGTYGVVYKAKSLRDDAMVALKRIRLDQDDEGVPSTAIREISLLKELRHENVVSLLEVIHEETKLYLVFEYLDLDLKKHMDSSPHISNDRMVIKGYVYQICAGIAFCHSHRVLHRDLKPQNLLIDTTNNVLKLADFGLARAFGIPVRAYTHEVVTLWYRAPEILLGVRTYSTPVDVWSIGCIMAEMVNHAPLFPGDSEIDELFKIFKTLGTPGETLWPEAKQLPDYQEGFPKWKAKPWESLCPALDEAGVDLLRSLLQYSPEKRISAKYATQHRWFDDYREHIGR

SEQ ID NO: 86617 - protein, 366 aa, Desulfovibrio vulgaris subsp. vulgaris str. Hildenborough
MALSIGIVGLPNVGKSTLFNALTKAQNAEAANYPFCTIEPNKATVAVPDKRLDALAEIVKPQRVLHATVDFIDIAGLVRGASKGEGLGNQFLANIRECAAILEVVRCFDDENITHVDGAIDPLRDIETIETELLLADIQSAEKRFERLQKMAKGDKDAKAAAEEVARLLEHMNAGNPASTFEARESDAFQLAWREMGLLTAKKIIYCANVDETGIGEENAHVLRVRELAASRGADVVKICAKIEEELQGLSDEEQAEMLGSYGIDESGLVSIIRTGYHTLGLASYFTAGEKEVRAWTIKQGWKAPQGAGVIHTDFERGFIRAEVIAYDDYVKHRSEAACRSAGVLRVEGKEYVMQDGDVVHFLFNV

SEQ ID NO: 86618 - protein, 380 aa, Clostridium difficile 630
MIYLDNAATTYPKPERVYNAVLDCMKNYCANPGRAGHKLAMRAAREIYDTRENIAKLFNVSNPMNIVFTSNATDSLNLAIKGVLQEGDHVITTSMEHNSVIRPIKALEKRGIENTVVKCDYEGFLDYEDLEKSIKSNTKLIVTTHASNVCGTLIDIKKVGEIAKKHNILFLVDASQTAGVYDIDVNECNIDMLAMPGHKCLFGPQGTGILYVREGLNLNILKEGGTGSKSEEIVQPELFPDKYESGTHNTPGIAGLNQGILFIFERGINNIRQHEEELCQYMIDKLEEVPDIKIYGPKDSKKRASVIALNIGDMDSGEVTFLLDSDYNIATRSGIHCSPLAHTTLGTLKQGAVRFSIGYFNTKDEIDKAVEALKKISKNK

SEQ ID NO: 86619 - protein, 104 aa, Glycine max
  misc_feature (67)..(67): Xaa can be any naturally occurring amino acid
MPAELLGPCCVHVVGGRDDFDSVPSIFSAYQLIDHKYMKPKSIHNEDILENFSNEYMYLAGIAFVKXVNTGVSAEHSPMLDDISGVPNWNKVNSGLLKMYKAEV

SEQ ID NO: 86620 - protein, 868 aa, Desulfovibrio vulgaris subsp. vulgaris str. Hildenborough
MRIAALFTCIIGVFMLATSVQAAQPADITRLSNGLTVLVLKDDRFPLASLRLYVHAGSAFETPEEAGISHLLEHMVFKGTVKRPKGQVARDVESVGGYLNAATSFDYTVYLTDMPSTQWKLGMDVLRDMAFEPALDPAELESEKDVVIAELQRGEDSPDSRIFQSLQAGTLKGTTYERPIIGYRETIRATTADTMRAYIRKHYQPQSMLLTVVGNVDPAEVRAEAERLFGGLTNDQNITPPAAIDARAFAHGPVVNVEHGPWKKVYLGVALPVPGLKALQAAQLDMLSQLLGGDPTALLYRTFKYEKQLVDDISVANYSFERVGMLYITAELDADKVETFWKELTTMLAGLKADAFTEQEFERARLNIEDGLYRSKETVAGLASKEGYFQFFSDGPQGEANYLQAVRDVERPQLEALIRDWLRPERLTVSVLLPEGTKAPALAATLKSTWPSKGKAAEEGNAAAVGKTETVDLGGGRKVVLIPDTTLPYTALDMVFSGGNALLDQNRQGLAALTASVLTKGTLKHDAPTLEAFQSDRAASLGASAGRRTFTLSLREPSRFDGDMFGLLHEVLTTPALAPDEVAREKRNQVASIRAREDQPLGLAFRHLTPFLFPGHSYGFYHLGQPETVEGFTRDDVKAFWARQAAQPWVMSVAGSFDREAVLRFAKSLPAPSGKPVSLDAPAWTPEKALDLRLPERNQAHLLLVFPTVGLAHKDTPALELLQSVLAGQSGLLFRDMRDKQGLGYTVTAMNWQSDLAGFMVLYIGTEPGKLEQAEAGFRKVIDQLHATALPDEELRRGKNQMRGDYYREHQRLGSRSSEAAMLTSQGYPLLFNREVIDKAEKLAPSDLERVARTYLDMNKVRVVKVLP

SEQ ID NO: 86621 - protein, 329 aa, Ostreococcus tauri
MGGHSINDAYEKLEKIGQGTYGKVYKARDRATGRLVALKKTRLEMEEEGVPSTALREVSLLQMLSESPYIVRLLRVEHVEEDGKAMLYLVFEFLDQDLKQFMDLTGRGPSNPLPTTTVQNYMYQLCLGCAHLHKHGVMHRDLKPQNMLVDKAKNLLKIADLGLGRAFSVPVKSYTHEIVTLWYRAPEVLLGGSHYSTPVDMWSVGCMFAEMARKQPLFPGDSELQQLLHIFKLLGTPSEQVWPGVSNLRDWHEFPQWKPQDLAKLIPQLDAHGIDLLQKLLVFDPAKRIHATDALEHPYFDSLDKTQFEKIEREFEIEFLREKENRMAQ

SEQ ID NO: 86622 - protein, 535 aa, Ostreococcus tauri
MAPEPARASAPSAAVDAARDAEQRAPRSPAPAPSSANDDGVRPRRYDNWGARSVECYEKLEQIGEGTYGQVYMARCKETMDIVALKKIRMDNEKEGFPITAIREIKILKKLRHRNVVDLKEIVTSKASASNGHKGSIYLVFEYMDHDLTGLAERPGMKFSVPQIKCYMKQLLMGLHYCHNNNILHRDIKGSNLLINNNGVLKLADFGLAKPITNENAQPLTNRVITLWYRPPELLLGATQYGPSVDMWSAGCIFAELIHGKPILPGKSEMEQMDIIFKLCGSPTPENWPDADKLPYAKHFTQKKTYPRRLREVFSQFTPSAKDLLEKFLTLDPAKRISAKDALMHDWFWEVPKPCEPEDLPRYEPSHEYQTKKRRQEAKRAEQQNKRQRMDGHRPPPPMDDQKPASGPDVRPRGHAGPPGGMRPGMPPSGRYGAGGSASGWSSGGQQKQSYAQRSIGRQPTSGYGSIGGGMNRLGGSGGSYSNLNITTGTSGGSYSGYRGGSKTAGWAGGGQKAGSQKAGWANVSKDAKDGERRN

SEQ ID NO: 86623 - protein, 466 aa, Caulobacter crescentus CB15
MADYDFDLFVIGAGSGGVRAARLAALSGAKVAVAEEYRVGGTCVVRGCVPKKFMVYASEVTSQLKTAKGYGWTIEDARFDWKTFLHEKDVEIARLSGIYVTNLQKAGAHLLHGRAQIVDAHTVEVLPKDGSDDAGTYTARKILVATGGRPVRPVFPGAELGITSDEAFHLPTLPKSVLVVGGGYIAVEFAGIYAGLGVQTTLLYRGANILRGFDDDVRMHLADELEKRGIKVVLGCSHKSIEKLDDGRLLSTLSNDLTFETEAVMFATGREPYVQGLGLEKAGVKLNDKGAIAVDKYSKTNVDSIWAVGDVTDRINLTPVAIREGAAFAQTEFYGNPTTFDHDLVASAVFSQPPVGAVGMSEAEARQAFGKVDIYRSIFRPMKVTFYGGQERCLIKLVVKQDDERILGVHVVGPDSPEIIQMAAIAVKMGVTKPQWDSTCAVHPTLAEELVTMREKYVPAEVGGAG

SEQ ID NO: 86624 - protein, 227 aa, Caulobacter crescentus CB15
MSADDQKRISGEAAAELVENGMVVGLGTGSTAAWFVKALAARGLKDIRGVPTSDATAALARELGIPLAALDDVKTVDLTVDGADEIGPGLSLIKGGGAALLREKLVWEASTRCVVIADAAKRVPALGKFPLPIEVVRFGHVHTGYRLADIAAEFDLPPPRLRTAERGMVVTDGGNLIYDMASGKIEDPTALAAALKSVTGVVDHGLFLDLADEALVGTDEGVVRLQP

SEQ ID NO: 86625 - protein, 742 aa, Oryza sativa Indica Group
MMGTAHHNQTAGSALGVGVGDANDAVPGAGGGGYSDPDGGPISGVQRPPQVCWERFIQKKTIKVLLVDSDDSTRQVVSALLRHCMYEVIPAENGQQAWTYLEDMQNSIDLVLTEVVMPGVSGISLLSRIMNHNICKNIPVIMMSSNDAMGTVFKCLSKGAVDFLVKPIRKNELKNLWQHVWRRCHSSSGSGSESGIQTQKCAKSKSGDESNNNSGSNDDDDDDGVIMGLNARDGSDNGSGTQAQSSWTKRAVEIDSPQAMSPDQLADPPDSTCAQVIHLKSDICSNRWLPCTSNKNSKKQKETNDDFKGKDLEIGSPRNLNTAYQSSPNERSIKPTDRRNEYPLQNNSKEAAMENLEESSVRAADLIGSMAKNMDAQQAARATNAPNCSSKVPEGKDKNRDNIMPSLELSLKRSRSTGDDANAIQEEQRNVLRRSDLSAFTRYHTPVASNQGGTGFVGSCSPHDNISEAMKTDSAYNMKSNSDAAPIKQGSNGSSNNNDMGSTTKNVVTKPSTNKERVMSPSAVKANGHTSAFHPAQHWTSPANTTGKEKTDEVANNAAKRAQPGEVQSNLVQHPRPILHYVHFDVSRENGGSGAPQCGSSNVFDPPVEGHAANYGVNGSNSGSNNGSNGQNGSTTAVNAERPNMEIANGTINKSGPGGGNGSGSGSGNDMYLKRFTQREHRVAAVIKFRQKRKERNFGKKVRYQSRKRLAEQRPRVRGQFVRQAVQDQQQQGGGREAAADR

SEQ ID NO: 86626 - protein, 614 aa, Oceanicola granulosus HTCC2516
MLRIENISYSVEGRPLIEHASATVPTGHKVGLVGRNGTGKTTLFRLIRGELTLETGEIRVPRGARIGGVSQEVPGNEVSLIDTVMAADTERAALMAEETDDPTRIADIQTRLADIDAWSAEARAASILKGLGFDDAEQRMPCSAFSGGWRMRVALAAVLFSEPDLLLLDEPTNYLDLEGALWLESYLAKYPHTVLIVSHDRGLLNRAVGGILHLEDRKLTYYATPYDKFAEVRAARLAAAESENAKAKARIAHLQSFVDRFRYKASKAVQAQSRLKMIERIKLISTPQEAALRAFSFPEPEELSPPIITMEGASVGYDGEPVLSKLDLRIDQDDRIALLGRNGEGKSTLSKLIADKLAPLSGKISRTNKLRVGFFAQHQLEELHADETPLEHVRRLRPDESPARLRARLAGFGLTADQADITAARLSGGQKARLSLLLATIDAPHLLILDEPTNHLDIESREALVEALTAYSGAVVLVSHDMHLLSMVADRLWLVKNGRVTPYEEDLEAYRRMLLGSDSPKTPKADKPKPKRPGRDELLALRAEARKCEERVNKINEMRDKLAAKLADPELYEDGRVGELETWNRKYAEVMDGLARAEAMWMAALEKLEAAEAA

SEQ ID NO: 86627 - protein, 367 aa, Bacillus megaterium
MTKKVAVLPGDGGQSNQRRCCRLKAIGERLRHQFEFTYGLIGGAAIDEAGSSSSRSTIETCNEADAVLLGSVGGPKWDRFPSHLRPEKGLLAIRKELDLYANLRPVTFYDSLADASPLKKEYIEGVDFIIVRELTGGLYFGKPSDRRTEGNKETVVDTLFYKRTEIERIIASIDTAVNRRKKVTSVDKANVLESSRVWREVAEEVAKDYPDVELEHMLVDSAAMQLIRNPKYFDVVVTENMFGDILSDEASMLTGSLGMLPSASLTADGPSLYEPVHGSAPDIAGQNKANPIAAAILSAAMLLRHSFGLEKEAAVIEQAVESVLHAGHRTADLADGNHYLGTDKMVEVITAVIANDSAISSIMTASR

SEQ ID NO: 86628 - protein, 368 aa, Ostreococcus tauri
MISFQKNYDVEIPPTGAPGEMAYGKKQRITSALRDLTNGELDNTRRRAPRPVQFSQVHPAEDIDTGLKSKDETSVIRRLHSPDVADIDDMQLAIAEDIHASLLKTQAFLVASKRFPPEISTSMRNILVDWMIEVAEEYKLVPETLFLSVMYTDVCLQEMNIHRSELQLLGTTCIMVAAKYEEIYAPPIDELCYITDNSYTRSQIIKMERAVLKCLEFSLTRTTVNTFLTFYLSRIHTSTRCSSLAAFLAELTLMCQTFLDFTPAVVATAAIFLAEYNLSDARPRILELDLFELLDNNQLTRCIESMNKEFASYDAEKFHALHEKYSSQKYNEVATVVAKGNPLAMLKQKCTIQRGAGRPNEQNIHREV

SEQ ID NO: 86629 - protein, 363 aa, Oryza sativa Indica Group
MGVSGGEEGARNGPSLMPGGHVDAYNNIRDILEKAAAQTEDGACVTFVGPGGAGNFVKMVHNGIEYGDMQLIAEAYDVLRRVGGLSNSEIADVFAEWNRGELESFLVEITADIFTVADPLDGSGGGGLVDKILDKTGMKGTGKWTVQQAAELAIAAPTIAASLDGRYLSGLKEERVAAAGVLEAEGMPSGLLETINVDKKMLVDRVRQALYASKICSYAQGMNLLRAKSVEKGWNLNLAELARIWKGGCIIRAKFLDRIKNAYDRNPELANLIVDREFAREMVQRQNAWRWVVARAVEAGISTPGMSASLSYFDTYRCSRLPANLIQAQRDLFGAHTYERIDRPGSFHTEWTKLARKSNGAAI

SEQ ID NO: 86630 - protein, 299 aa, Magnaporthe grisea 70-15
MWTTRLLSLLLLSLASKGCLGQSSAAIRGSVTQAELDTFKLYADYTAAAYCNKSPDRVSQKIVCGSDACPLIEAHETTIVATLADDGDRAGGYVALDSTAERIVVAFHGTITFAGYMAEDARSMQVSDLFGLPLAIWLTWRKPLPQVVMETVEKLHSEYPDYSIVTTGHSMGAALATLAGANLRQKIPEKVIDVYSLGSPRVGNQAFAEYVSAQPGSVFRITHVNDPVPRLPPNLMGYYHTDVEYWLSTGGALTTDYTPNDVLVCKGIFNRNCNTKSDFFGFGFAAHVNYLTRIGACKP

SEQ ID NO: 86631 - protein, 891 aa, Candida glabrata CBS 138
MEELDNLELEYNQFKNNERPSNTNAGADIEKGLDTKKYFERSITDNSTYGKKSYSIPSYEEDTITLKDYYDTNLRDYFTWASVVDYIRSLFPVVNWLPFYNPKWFLSDLIAGITVGTVLVPQSMSYAQIATLPPEYGLYSSFIGALVYSFFATSKDVCIGPVAVMSLQTAKVIARVKEKHPDLDPSITGPIIATVLAFICGIIATGVGLLRLGFLVELISLNAVAGFMTGSAFNIIWGQIPGLMGYSKKVNTRRSTYHVVIDSLKHLPDTKLDAAFGLIPLFTLFFWKWWCNSMGPKLTDRYFPANSRPRANKYWKAFYFYLQASRNGIIIILFTAVSYGITKGVAKDKRRISVLGTVPKGLRHTGVMKLPHGILNNIAAEIPSSIIVLLLEHIAISKSFGRVNDYKINPNQEIIAIGVSNLLGTFFNAYPATGSFSRSALKAKCNVMTPLSGIFSAACVLLAIYCLTGAFFYIPKATLSAVIIHAVFDLIASYHTTWSLWKMNVFDFIGFITTVFITVFSSIENGIYFAVCWSCAILLYNNAFPAGKFLGRIEIAEVVNPKIVDDDDFSFENSNESFDDEGIYFDNSVAEDKLGTSSNDLKKFNAGVKTRSINGELVNGQTSSDIRYYTKWVPFDHAYSKELNPSVRITPPPPGVIVYRLSDSYTYINCSRHYDLIFDEIKRVTRRGQLIQHRHKWDRPWNDPGEWEAPDLKKFFNVKKFVSVFKRKVTDVDTFENENEIEHIHDGEHYKKNDKDERPLLRVVCLDFSQVANTDATALQSLADLRKAVNKYADRQVEFHFVGIYSPWIKRGLRNLGFGTTNEEYSDESIIAGHSSYHLSRFRESEQDGFNELDSLESQRNIGSKTKVLAASGTNLPFFHVDIPDFSKWDI

SEQ ID NO: 86632 - protein, 401 aa, Vitis vinifera
MDRYFAPGTNHLFVPGPVNIPDHVIRAMNRNNEDYRAPPIPALTKDLLEDVKKIFKTTTGTPFLIPTTGTGAWESALTNTLSPGDRTVSFLIGQFSLLWIDQQKRLRFNVDVIESEWGQGANLEILAEKIAADRAHTIKAVCIVHNETATGVTNNLAAVRRILDEYRHPALFLVDGVSSICALDFRMDEWGVDVALTGSQKALSLPTGMGIVCAGPKALEASKSAQSVRFFFDWNDYLKFYKLGTFWPYTPSIQLLYGMRAALDIIFEEGLDNVIERHSRLGKATRLAVEAWGLKNCTQREEWFSDTVTAVVVPPYIDSTEIVKRAWKRYNLSLGLGLNKVAGKVFRIGHLGHLNDVQLLGCLAGVEMVLKDVGYPVKMGSGVGAASAYLQNTIPLIPSRI

SEQ ID NO: 86633 - protein, 460 aa, Lactococcus lactis subsp. lactis Il1403
MAAILISLIGKYGMNGIFIATFMAGIFLLLAGIFRLGNLISLIPSPVITGFTSGIAIIIASGQIKNFFGIEHFTGSFFDLMKFISGLHIDYPSTIIGLLTILLMIFYPKSWGKKFPASLLAILLSTLAVLALKLDIPLVGKIPTTLIPQAHLRLTELNPQDMKTLLIPAISITVLGMTESLLCGASAGRATNHPMDNNQELVAQGIGNIFIPFFGGIPATAAIARTSVAIKAGAQTRLTGIIHALILLLSMFLFAPFMTHIPLSALAGVLIMTAVRMNEWEAIRFLFKNKLKSGIIEFFVTMIITVIFDLSTAILAGIVVGFLLFIVKISQIEINSSQIEPERISQNHHEVFTDWTVIYISGPLFFLNSSKLKQAIDELPANTNAVLSLRGVPMIDVTSIKLLIDIYSIFHKEERQIVFASMNPKLKESFKRTGLISMVGEEAIYPSVNEFLLDLVDKNK

SEQ ID NO: 86634 - protein, 267 aa, Haemophilus somnus 129PT
MAIPLRTEQEIIKLRTACKLAADVLVMIEPYVKAGITTGELDRICHEYIVNEQKAIPACLGYYGFPKATCISLNEVVCHGIPTEGKELKNGDIVNIDVTVIKDGYYGDNSKMYIVGETNIRSKKLVEAAQEALYVGLRVVKPGVRLNEIGRAVQKYTESQGFSVVREYCGHGIGTEFHCDPQVLHYYADDGGVILREGMVFTIEPMINAGKKEVRLMGDGWTVKTKDRSHSAQYEHQLVVTKDGCEVMTIREEEEKVGRISRIMVNR

SEQ ID NO: 86635 - protein, 477 aa, Burkholderia vietnamiensis G4
MTYRNESAWVQPAAPATAPRTTQARTTAEYRALDAAHHIHPFSDMGALNRAGSRVIVKADGVYLWDSDGNKIIDGMAGLWCVNVGYGRKELADAAYRQLQELPFYNTFFKTTHPPVIELSAMLAEVTPAGFNHFFYCNSGSEGNDTVLRLVYQYWRVQGKPQKKYVISRHNGYHGSTIAGATLGGMDYMHEQMPSKVEHIVHIDQPYFFGEAQAGETPEAFGLARAQQLEAKILELGAENVAAFIGEPFQGAGGVIFPPSTYWPEIQRICRKYDILLVADEVIGGFGRTGEWFAHQHFGFEPDLITMAKGLTSGYVPMGAVGIHERVARPIIDNGEFNHGLTYSGHPVAAAVAVANLKLLRDEGIVERVKRDTGPYFQALMRDTFAQHPIVGEVHGQGMVASLQLAQAPAERRRFANGGEVGTICRDFCFNGNLVMRATGDRMLLSPPLVISRQEIDELVSKAKKAVDATAQQLGLS

SEQ ID NO: 86636 - protein, 256 aa, Brassica napus
  misc_feature (245)..(245): Xaa can be any naturally occurring amino acid
MRRRLLTHSRVALLELELTKRRMSAATPMADFLTKSPYSPPSWASHLRPLPSHTFSLAHRPTPIHRWNLPGLPNGTELWIKRDDFTGMELSGNKVRKLEFLMADAVEQQADTVITIGGIQSNHCRATTVASNYLNLDTHLILRTSKLLADGDPGLVGNLLVERLVGANVHLISKEEYSSIGSEALTSALKEKLEKEGKKPYVIPVGGSNSLGTWGYIEAAREIEEQLKCRTDGLKFDDMVVACGXGGTIAGIHWDL

SEQ ID NO: 86637 - protein, 494 aa, Pseudomonas putida GB-1
MPVVRNNTWNHRANGHEAGRLCGIFRFATQARLVTTESTAFATLPLSTAMLANLDALGYASMTPIQAQSLPVILKGQDLIAQAKTGSGKTAAFGIGLLNPINPRYFGCQALVLCPTRELADQVAKELRRLARAEDNIKILTLCGGVSLGPQIASLEHGAHIIVGTPGRIQQHLDKGTLVLDGLNTLVLDEADRMLDMGFFDAIASIIGKTPARRQTLLFSATYPAGIKQLAADFMRNPQQVKVESLHTDNQIEQRFIEIDPQHRLEAVTRVLGHYRPQSCVAFCFTKQQCEDVVAHLTAKGIVAQALHGDLEQRDRDQVLTMFANRSSSVLVATDVAARGLDIDGLDMVINVELARDAEIHVHRVGRTGRAGEKGIAVSLVAPAEGHRAQAIEDLQKSPLRWDSLDSLKNKGGEPLLPVMTTLCIAAGRKDKLRPGDILGALTGDAGIPGKQVGKIAIFDFQAFVAVERALAKQAMQRLNSGKIKGRALKVRII

SEQ ID NO: 86638 - protein, 391 aa, Lactococcus lactis subsp. lactis Il1403
MDLLKKFNPNLDKIEISLIRQFDQQVSSIPDVIKLTLGEPDFYTPEHVKQAGIVAIENNQSHYTGMAGLLELRQAASEFMNKKYGLSYAAEDEILVTVGVTEAISSVLLSILVAGDEVLIPAPAYPGYEPLITLAGGSLVEIDTRANDFVLTPEMLEQAIVEREGKVKAVILNYPANPTGVTYNRGQIKALAEVLKKHEVFVIADEVYSELNYTDQPHVSIAEYAPEQTIVLNGLSKSHAMTGWRIGLIFAARELVAQIIKTHQYLVTSASTQSQFAAIEALKNGAYDALPMKKEYLKRRDYIIEKMSDLGFKIIEPDGAFYIFAKIPADLEQDSFKFAVDFAKENAVAIIPGIAFGQYGEGFVRLSYAASMDMIEQAMARLTDYVTKKRG

SEQ ID NO: 86639 - protein, 192 aa, Oryza sativa Indica Group
MAVLLITRLLTLVLGYAYPAYDCYKTLELNKPQIDQLRFWCQYWILLAFLTTLETITDFTVSWLPMYGEAKLALVLYLWYPKTRGAKHVYESYLQPVLARHEADIDRGLLQLRASAKDATASHLQAAVSLGRACFAEVAGRVSSQLQAARSSGGGGRAGQADQLQKRQKINPEEEEEDEDATRGVPAAMRFL

SEQ ID NO: 86640 - protein, 331 aa, Zea mays
MRLVPSAGVCASRPFRQSLAFHLLRLISDQASAPDTHHLPPRSTTPAMATAFDSPTSSPAAAPFHDDPFLHFDGSAPAAADGFPASPDAYAPSPFGMPHSNGDLHDDPFAAPADSNGGPILPPPTEMGREEGFLLREWCRQNAIHLEEKEKKEKELRSQIIVDAEEFKKAFVEKRKLNAETSKGQNRDREKLFLANQEKFHAGADKQYWKAISELIPHEIANIEKRGARKDKEKKPGIVVIQGPKPGKPTDMARMRQILLKLKHTPPPHMKPPPPPAAATGKDGAPAAAGKDGAKPATVANGSVPEMEKAAAEASVPAAAPPAATEPIAAA

SEQ ID NO: 86641 - protein, 161 aa, Brassica napus
  misc_feature (84)..(84): Xaa can be any naturally occurring amino acid
  misc_feature (86)..(86): Xaa can be any naturally occurring amino acid
  misc_feature (88)..(88): Xaa can be any naturally occurring amino acid
  misc_feature (92)..(92): Xaa can be any naturally occurring amino acid
  misc_feature (98)..(99): Xaa can be any naturally occurring amino acid
  misc_feature (107)..(107): Xaa can be any naturally occurring amino acid
  misc_feature (112)..(113): Xaa can be any naturally occurring amino acid
  misc_feature (151)..(151): Xaa can be any naturally occurring amino acid
  misc_feature (155)..(155): Xaa can be any naturally occurring amino acid
DSPSPPPPPPPAPITSPSPHRDYREFSPSPSPYPFTDHYYSGFYYPPPPPRSMYDRASNYGQPSAPVDLPLAPPRFPQPSGPSXPXEXFQMXEYKPQXXSRLSSYGXPGGPXXPLDYSPYDHRQLQKTMGGLSLEEERGAAESDFGARPSXSYAXEYRREC

SEQ ID NO: 86642 - protein, 1850 aa, Vitis vinifera
  misc_feature (496)..(496): Xaa can be any naturally occurring amino acid
  misc_feature (509)..(509): Xaa can be any naturally occurring amino acid
  misc_feature (960)..(960): Xaa can be any naturally occurring amino acid
  misc_feature (994)..(994): Xaa can be any naturally occurring amino acid
  misc_feature (1437)..(1438): Xaa can be any naturally occurring amino acid
MYYVLLYTDHSLILSPAKAICARTASDQVIMLENALMWQFVIIVAFQGCCKGEGTGGGEEEDVYILFTVLVLLVSSRGWWLGGVVIGEEAVVVRFPRWFVSPGQRFAKRWEDGGKKFRLECRTNDAGRFLLCSVVDSEAKRHCLVFPEGKGFLGGWALLAEKLRSIGILSRDETREADISQKTESKVGVSKGKKEKSYVEVVNTREAPREKRLGEAVWIQLGEEDVVKGREFLDRCLVGSWGEKGVTDSDLSDMEKWGKHHWKLQGEMRIARMGGFCFLIVFELKAEANNVLQRGFRRFKESVIHLERWDPSVGCSQRREQVKEVWVRVMGLPLHLWSREVFKKIGDCCGGFIAVDESTGAMKELQWARILVNLEGIGGPSSLQVVIGTTCYAIQLWWEMLPRVTDVIPAGSSGTGKKMEVREEEGGRTRAGCAVEMVQAKGQPVKMAVPFEVGESSGMEANSSDMIRTRGAVAERQKDGGEYLQKDGPAIKANGXSGWVLDWKAERRXSEEIAVAIKEVSGLVLLSPPSKVTKPKAQKGPTEEDRFEVCGPPLLGPIQNIPAREMGRPQLVPNKGSAGIGHPISHSTDPAGVRAREACREEAYGWLDGILVGATQGSSFSGCNFKKLTDEALKEEAARYTSSCPRDVFSFEERGLYSSSSHSGWDGMFVDPVGASDFGGIDLDPLRMIMADGREAEVLGSPGMALGTIGKEVEKVVGWDITEERNEASEQCWQSSCLARFSRCLGMPTEGFEGEILLLLKKMKERKLQKGKKGNLETKIQEMTRGIIRSIGVGRFLDWGTVDSRGSAGGIVVFWDNRMLEMIELEKGECSISCHFKNCEDGFMWTFTGVYGLTKRRERESLWNELGAIHGLWNGPWCVAGDFNAILSPEEHSRGGSYNSDMRRFADVIEELQLKDLPLFGGPFTWSGGANNQTLSRLDRFLVVKTKLKEWNRDVFGRVXYRKNVALDQMQFWDAKEKTNRLTLEEMEARREAXEEYKKWVLLEEVTWRQKSREVWLKEGDRNTSFFHRMTNAHRRRNNMERIRINGVWKSEENGMSEGIVNAFRTLLSNPGEWRPSLAGLQCEQLQNLDADALEVPFTEEEVHGALVGCSGDKAPGPDGFTMSFWQFAWDIVKEDVLRFFREFHEHGKFVKRLNTTFLVLIPKKMGAEDLRDFRPISLVGSLYKWLAKVLANRLKRAVGKVVSKAQGAFVEGRQILDAVLIANEAIDSILKNNENGILCKLDIEKTYDNVDWSFILTVMKKMGFGEKWLGWIKWCISTASFSVLINGTPKGFFQSSRGLRQGDPLSPYLFVIAMEVFSSFLKRAVDNGYISGCQVKGRNEGGTQISHLLFADDTLVFCQASQDQLTYLSWLLMWFEAASGMRINLDKSELIPVGRVMDIDDLALDFGCKVGSLPSTYLGLPLGAPFKSVAVWDGVXXRFHKRLTMWKRQYLSKGRRATLIRSTLSNLPIYYISVLRLPSSVRRRLEQIQRDFLWGGGSLERKPHLVRWKVVCLSKKKGGLGIKCLSILNKVLLSKWNWRFANEREALWNQVIRGKYGEDRGGWCTREVREAHGVGLWKGIRMDWDLVGARISFSVGNGRRLSFWRDRWHIASECTTRSLCWNCQEPGHTASNCPNEGICHTCGKTGHLARDCSAPPVPPGDLRLCNNCYKQGHIAADCTNDKACNNCRKTGHLARDCRNDPVCNLCNVSGHVARQCPKANVLGDRGGGPRSSGFRDIVCRNCQQLGHMSRDCAAPLMICRNCGGRGHMAFECPSGRFMDRFPRRLVVIGIYSWSMIRDGPPNGSCLSGFVEQLLLVYLATNFMIHYFLRAISQERESIWLINFSKVVCD

SEQ ID NO: 86643 - protein, 512 aa, Oryza sativa Japonica Group
MGLPGRRNPLLSARRAAASLRRSRRLPVYVAAVFFVASVLLMFRDEILYLTTARSPSSSLPTTGGSAGGAGLARKEELVSVNKPVLLGHGGKPEKHHSVTERHRPKVSAKRRPNKKAAKAARKKFMASPSVAAGAEVNVPETCNLSKGKWVFDNATYPLYREQECEYLTAQVTCTRNGRRDDGYQKWRWQPRDCDLPLAFDARLFMERLRGKRLMFVGDSLNRNQWESMVCLVRPALSPGKSYVTWWDGQRVVLHAWEYNATVEFYWAPFLVESNSDDPKAHSIRDRVIKPEAIAAHAGDWVGVDYLVFNTYIWWMNTVNMKVVLPTRHDQFTVIRRPTGKTWEEYDEVGRIEAYRRVLDTWATWVNDNVDPARTSVFFMSVSPLHISPEAWGNPGGVRCAKEDAPVQNWHGPLWLGTDWDMFRAARNASRAAGRVPVTFVDVTAMSELRKDGHTSVHTIRQGRVLTPEQQADPATYADCIHWCLPGVPDVWNLMLYARILSRPPAAAGHVA

SEQ ID NO: 86644 - protein, 498 aa, Sinorhizobium meliloti 1021
MYELGHFIDGKRVAGTSGRVSNIFNPATGEVQGTVALASDADLAAAVESAKAAQPKWAATNPQRRARVFMKFVQLLNDNMNELAEMLSREHGKTIDDAKGDIVRGLEVCEFVIGIPHLQKSEFTEGAGPGIDMYSIRQPVGIGAGITPFNFPGMIPMWMFAPAIACGNAFILKPSERDPSVPIRLAELMIEAGLPAGILNVVNGDKGAVDAILTHPDIAAVSFVGSTPIARYVYGTAAMNGKRAQCFGGAKNHMIIMPDADLDQAANALIGAGYGSAGERCMAISVAVPVGEETANRLIDKLVPMVESLRIGPYTDEKADMGPVVTKEAEQRIRSLIDSGIEQGAKLVVDGRDFKLQGYENGHFIGGCLFDDVTPDMDIYKTEIFGPVLSVVRARNYEEALSLPMKHEYGNGVAIYTRDGDAARDFASRINIGMVGVNVPIPVPLAYHSFGGWKSSSFGDLNQHGTDSIKFWTRTKTITSRWPSGIKDGAEFSIPTMR

SEQ ID NO: 86645 - protein, 250 aa, Picea sitchensis
MAIGVAFGRFDEAFGLDGFKSYLAEFISTLLFVFAGVGSAMAYDKLTSSAALDPAGLVGVAICHGFALFVAVAIAANISGGHVNPAVTFGLVLGGQITILKGIFYWIAQLVGAIVACLLLKFVTGGLTTPTHNVAAGMSTIEGVVMEIVITFALVYTVYATAADPKKGSLGTIAPIAIGFIVGANILAAGPFSGGSMNPARSFGPAVVSGDFTNNWVYWVGPLVGGGLAGAVYGGVFIGSHSHAPLSQDY

SEQ ID NO: 86646 - protein, 244 aa, Coccidioides immitis RS
MADIPKFRNLSLTRHGNVFVITMQKPPENRLNSWYCQEIIRAFRTVQRILGPDSEGAVITRGSDAKFWCTGLDLDEQDENPFANTDGFYPMLYTILDFPYPTIALLTGHTFGGACPFALCHDYRVMNSKRGFISMPPVNLGLHFDGIGALPRLKLGPKVARKMLLEAHRWTGKEALQDGIVDAIAEPEQMFDVSMDLAQKWAPKAKMGVYGTLRAELWGEAIKKFQRISYVHSRETSTAAKVKI

SEQ ID NO: 86647 - protein, 302 aa, Candida glabrata CBS 138
MSSSQFKQLEKLGNGTYATVYKGLNKSTGVYVALKEVKLDSEEGTPSTAIREISLMKELKHDNIVRLYDVIHTENKLTLVFEYMDNDLKKYMDSRTVGNAPRGLEMNLVKYFQWQLLEGLAFCHENKILHRDLKPQNLLITKRGQLKLGDFGLARAFGIPVNTFSSEVVTLWYRAPDVLMGSRTYSTSIDIWSCGCILAEMITGKPLFPGTNDEEQLKLIFDKMGTPNETTWPGVTSLPKYNPNFQQRLPKDLKAELQPYVKEPLDDNVIDLLHGLLQLNPDMRLSAKQALLHPWFSEYYES

SEQ ID NO: 86648 - protein, 353 aa, Methanosarcina barkeri str. Fusaro
MAENIQSKGYAGKDESGKLVPWSFERRPVGDNDILIDIKYCGVCHSDIHQIKGHWGPQQYPQVPGHEIVGVVAAVGKNVTKFKVGDRAGVGCMVSSCMECESCKNGEEHHCDNNATIMTYGYPEESSPTGISQGGYSQNIVVTEHFAIKIPDSIDLQEAAPLLCAGITTYSPLMRANFKKGDKVGVAGIGGLGHVAIKLAVSKGAEVYAFTTTESKKEDCLAFGATEVIVVNSPSDLQPWKGKMDYMISTIPYAYEMSSYIDCVKPYGYFTQVGQPIGGELTINNFNMIFNRVNFNGSLIGGIPETQEVVDYCAENKIYPQIQMIKPEMINEIWEKVVNKEARYRYVIDMSSL

SEQ ID NO: 86649 - protein, 204 aa, Oryza sativa Japonica Group
MAEEKKTPCLNERILSSLSKRSVAAHSWHDLEIGPGAPQVFNVVVEITKGSKVKYELDKKTGMIKVDRVLYSSVVYPHNYGFIPRTLCEDGDPMDVLVLMQEPVIPGCYLRAKAIGLMPMIDQGEKDDKIIAVCVDDPEFRHFNDLKELSPHRLAEIRRFFEDYKKNENKEVAVNDFLPPATAQEAIKYSMDLYAEYILHSLRR

SEQ ID NO: 86650 - protein, 228 aa, Brassica napus
GQLPISSQHTKPKSAALTRRASMPISRKPVKEIKDSLYNSKTSSRSDQIKSPDVSMNAPRIDKIEFPLASYEEEPFVPVVRGKKKKKKASSRGSYSPPPEPPLDCSVTKDKFTLEPGQNFEGAIMKAVYQYEEAYPENKSESSDQNATAGASSRGSSGIRRQRFDPSSYQQRAEALEGLLEFSARLLQDERYDELNVLLRPFGPGKVSPRETAIWLSKSFKETTKLED

SEQ ID NO: 86651 - protein, 332 aa, Desulfovibrio vulgaris subsp. vulgaris str. Hildenborough
MNLAVFPRRGYVKDPTPIESCPAFSKALGGKVNIFIKRDDLLPGCAGGNKTRKLDFCMADALAKGADTIITCGAVQSNHCRLTLSWAVKEGLDCHLVLEERVKGSYKPEASGNNFLFKLMGVKSITVVPGGSNMMGEMEALAARLKEAGRTPYIIPGGASNPIGATGYVSCAQETLQQLFDMGLKVDHMVVPSGSAGTHAGIVVGMVGNNANIPVSGINVSRTKADQEALVRKLARETAQRVGMSGEFPDEAVTCFDGYVGPGYSLPTESMVEAVRLLAQTEGILLDPVYSGKAMAGLVDLVRSGYFAEGSNVLFLHTGGSPALYAYLDTFK

SEQ ID NO: 86652 - protein, 293 aa, Methanosarcina barkeri str. Fusaro
MCLTMNPDAAIANYGYPGAGPYDGGQAEYLRVPYGDWACLKLPGEPGDEFEDDFLLLSDIFPTAYYAAELAKVKTGKTVAVFGAGPVGLLAAYSSMLKGASEVYVVDKSDKRLKLAESIGAVPINFTDGDPVEMIMQYRQDNKKLMGSLRPGEEKALGVDCAIDAVGYQAFDRNNPEEFKANQVLMDIARIIAPGGSIGVIGVYSADPAGKDENEKRGYLTLPWAELWFKGVSIGTGPTPVKQMHVFLRNLIFNDKAKPSFIVSDRISIDEAPEAYKQFDKRNDVVKPIIKFY

SEQ ID NO: 86653 - protein, 639 aa, Hevea brasiliensis subsp. brasiliensis
MDSLSIRVPYRNLKKEVEVEMVGVEEQNHHSIQLDNSSPSSASSPNSASQIPNGDSGFSVRSKTAKHYSLITLILSCTVAAGVQFGWALQLSLLTPYIQTLGIEHAFSSFIWLCGPITGLVVQPCVGIWSDKSTSKFGRRRPFILAGSVMISVAVIIIGFSADIGYILGDTKEHCSTFKGTRTRAAFVFVIGFWLLDLANNTVQGPARALLADLSGPDQRNSANAVFCSWMAVGNILGFSAGASGSWNRWFPFLMSRACCEACGNLKAAFLVAVVFLTLCTLVTLYFAKEVPLITNQSHRLSDSAPLLDDPQQNGLELSKSKSEVSILSNSNGNINKGIEQNVNPKPGIANSIEDQNESLGDGPGAVLVNLLTSLRHLPPGMHSVLVVMALTWLSWFPFFLFDTDWMGREVYHGDPKGNSDEVKLYDQGVREGAFGLLLNSVVLGISSFLIEPMCQRMGPRLVWAMSNFIVFASMAVTAIISLISIGEYSGGIEHVIGASLSIRIAALIVFAFLGLSSCCTYMFYQNNSNVLQLLPLKACANCYVLQITYSVPFSVTAELTADSGGGQGLAIGVLNLAIVIPQMVISLGAGPWDALFGGGNIPAFALASVCALAAGVIATLKLPNLSSSSFKSSGFHFG

SEQ ID NO: 86654 - protein, 256 aa, Methanosarcina barkeri str. Fusaro
MAINETKRFLGKVVFITGGATGIGQATAVAFAREGANVALTYHKQGAEQTARMIEELDGQALVIKCDVSQDEDVKNAIEKTIQTFGRLDYAFNNAGIEGETVITAEYPVEEWNRVIATNLTGVFLCMKYEIPQMLKQGAGAIVNCSSGAGLTGFPGIPAYVASKHGVVGLTKTAALDYAKSNIRINAVCPGMTDTPMMERYSGGTPEGYKKIIEQEPIGRMGRPEEIAIAVLWLCSDAASFVTGDAMRVDGGQLAH

SEQ ID NO: 86655 - protein, 472 aa, Lactococcus lactis subsp. lactis Il1403
MVVGAQATEVDLVVIGSGPGGYVAAIRAAELGKKVTIIEKDNVGGVCLNIGCIPSKALINIGHHYQESLEEEKGENPFGLSVGNVKLNWESAQKWKQDKVVNQLTGGVKMLLKKHKVDVIQGTAEFIDNNTINVEQEDGFQLLQFNDVIISTGSRPIEIPSFPFGGRIIDSTGALSLPEVPKHLIIVGGGVIGSELGGAYRMLGSKITIVEGLDHILNGFDKEMSDIIANRVKSAGSEIFTSAMAKSATQTDKDVTLTFEVDGKEQTVTGDYLLVSVGRRPNTDLIGLNNTDVKLTDRGLIEVDDSYATNVPHIYAIGDVVPGPMLAHKASFQAKVAAAAIAGAEDDVDLHVALPAVAYTTTELATVGETPESVKDRKDVKISKFPFAANGRAISMNDTTGFLRLITETKEGALIGAQIVGPGASDLISGLSLAIENGLTSKDISLTIQPHPTLGEAIMDTAELADGLPIHV

SEQ ID NO: 86656 - protein, 532 aa, Lactococcus lactis subsp. lactis Il1403
MTEIFKMPDIGEGMHEGDIANWLVKVGDVVKEDDPIAEVQNDKLMQEILSPYSGTVTKLFVEAGTTVEVDSPLVEFDGDGSGSSAAAPTPQETAGSDTATTDAPSGEAQIFTMPDIGEGMHEGDIANWLVKVGDEIKEDDPVAEVQNDKLMQEILSPYSGKVTKLFVEAGTTVEVGAPLIEYNGNGAAPAAASPAPVAEAPKAASPASPANAPLTKTTSTGHILAMPSVRHYARKAGIDLSQVPATGRHGHTTLADVKAFESGSVAPIAQTTPEAAPAPKADKPAAPVAEKAPSVKAGAGDRREAMNPTRKVVSKVMTAQHTHIPPVTNFDQVEVSKLVKHRAVFKEIAAKQDIKLTYLAYVAKALATTAHKFPDINASVDYEKQEIVYHEHVNLGIAVNAPTGLYVPVIHEAETKSILEIAKEIAELATATREGTLKPQQMQGSTITISNIGSARGSWFTPIINGSDVVILGLGSIVKEPIVNGEGEIVVGQNMKLSMTYDHRLIDGMLGQTSLNYLKSLLADPEFMLMEI

SEQ ID NO: 86657 - protein, 396 aa, Haemophilus somnus 129PT
MFENINAAPADPILGLGEAFKSETRANKINLGIGVYKDANGNTPIMKAVKEAENRLFELETTKNYLTIDGIAEFNSYTKELLFGTNSKIIKQGRAKTVQSLGGTGALRIAAEFIKRQTTSQNVWISSPTWPNHNAIFNAVGMTIREYRYYDAEKKALDWDNLIADLSNASEGDVVLLHGCCHNPTGIDPTPEQWKILAEMSEKNGWLPLFDFAYQGLANGLEEDAIGLRTFAENHKELLVASSYSKNFGLYNERVGAFTLVAETEEISAIALTQVKSIIRTLYSNPASHGATAVSIILGDDLLRQQWESELTEMRNRIKRMRYQFVELLKEYGAKQDFNFIIEQNGMFSFSGLNAEQVDRLKEEFAIYAVRSGRINLAGVTEDNIRYLCESIVKVL

SEQ ID NO: 86658 - protein, 423 aa, Alkalilimnicola ehrlichei MLHE-1
MFLECNPRFVSRLTRDTLALIMAGGRGGRLSNLTDWRTKPAVPFGGKFRLIDFPLSNCINSGIRRIEVLTQYKAHSLIQHIQRGWGFLRGEFGEFVELVPAQQRMDKPLWYAGTADAVYQNIDIIKAHNPSYVLVLAGDHVYKMDYGGMIARHAESGAAMTVGCVEVPRKRASAFGVMSVNEERQVLAFNEKPKDPTPMPGNPDRALVSMGIYVFDRDYLFQLLREDAENFDSSRDFGKDVIPNAIANHKVQAYPFSDPVSGQQAYWRDVGTVDAFFQANMELIGEDPELNLYDEEWPIWTYQAQLPPAKFIQGRDGRHGTAINSMVSGGDIIHGAEVRDSLLFSQVVVQPGATVHEAVILPDVRVGEGCRIRKAVIDEGCRIPAGTVIGEDPAEDRRRFFVTPKDVVLVTAEMLGQEVAHVR

SEQ ID NO: 86659 - protein, 451 aa, Burkholderia vietnamiensis G4
MDFDYDLFVIGAGSGGVRLARMSASYGARVAIAEQEQIGGTCVLRGCIPKKLLVYASHYPHELEDAQGFGWRFDAGTHDWPALIAAKDREINRLSDIYINLLRQSGVDMHAGRATLVDAHTVAVGERTFRARHIAIATGSRPSLPPRPGIEHAITSREALSLPALPGRIAVVGGGYIAVEFAGIFNGFGSRVDLFYRGDRILRGFDDDVRQFLTDEMTKQGVAIHAHAVVESIARADDGTLSVQVGDATHGPYDAVLYATGRVPNVDGLGLERAGVLLDARGAIAVDAYSATSVPSIHALGDVTSRPQLTPVATRDGSLLARTLFGGARVATDHEWVPSAVFSQPEVATVGFTEAHARGVYGDLDIYRTSFRALRHTLSGRDERTLMKLVVARDSQRVVGAHMVGRDAGEIIQGIAIAIRAGATKAQFDDTIGIHPTAAEEFVTMRQKVAD

SEQ ID NO: 86660 - protein, 597 aa, Alkalilimnicola ehrlichei MLHE-1
MDWIYPLILIGAGLIALSVFTSVIAFRFGAPLLLVFLCIGLIAGEDGLGFVFNDADLAYLVGSLALAVILFDSGFGTPVQTLRRAAGPAIILATVGVLLTTLLVGVAAHFLFDLPWPYAFLMGAIVSSTDAAAVFFLLRAGGVKIYKRVRSVLEVESGSNDPMAIFLTLFFIELILAGGTEMPWGLQFLLGFGQQMGLGLVMGLVAGFLIVELVNRIQLEEALYPIAVMAMALCLFAATGYLGGSGFLAVYVAGIVAGNRAIRGAAKLRQYQAGMTWLAQIIMFLVLGLIATPSEFIPVAMPAIALGLFLMLIARPLAVWLCVLPFRLEREATTFLSWVGLRGAVSILLGILPIVAGVENGQLFLNVAFIMVLTSLLIQGWTIRPAARRLNLIVPEQLGPVERVELALPGAPRHELAVYRVTEDSPVGKGEPLPRWARPSLVVRNEQTIRYQDASHLQPGDYVYIFIPPDYLGLLDRVFARPVPPSKDDQAFFGELRINPDQPLSALQAAYGVDLGDLPPDESIAEHMRRALQGRPVVGDRVPLGPVELIVRAVRDKREVTDVGLALGHQADPEQPGHNLPRLLLDLLRPGRRSSRP

SEQ ID NO: 86661 - protein, 402 aa, Zea mays
MPLTRVAADAFGVLTIGLLALLAALGLFCIFQSVYFRCQIRRGPSFLPLGYFNGPWVTRVALVLITIWWGVGEVARLSFLKQKLFSSLTWQRNICDAYILSNLGFAEPGIFFAFAFLLHGSLQKKELGTLNQRWNWKSMAYTLVFCVPVFSVQAVLVFVVGPRLVRDSNHDLGRRKIAKYFVRTHTPVGDTSVCTYPLLGTIFLGLVDAFLMSYVSYVGSRALSLVINKSLRRRVYLLMLSVLCFLPTRVLLLGFSVLPRPGDAAFEGIVFLSFLTMLSCTAVGILLLVYYPVADSLALRDVGQRDMAAEMVPYDDYYCYEGASLVANRSFRELERNSDTSTKPGSISFRTMIREDQLQQDGAADEIGFSSRSGAHIGSPSPAGSSPSAAMPMLPVKEIPRY

SEQ ID NO: 86662 - protein, 334 aa, Haemophilus somnus 129PT
MRVKQFHYLIRYLLKLDIYHRILPVFRLSSSQANLNHIGGAMWKSISQVLAEQFGAYYFIKHKEKLYSGEMNEIWLINDEVQTVFVKINERSYRSMFRAEADQLALLAKTNSINVPLVYGIGNSQGHSFLLLEALNKSKNKQSSFTIFAEKIAQLHQIQGPDKYGLDFDTWLGPIYQPNDWQTSWAKFFSENRIGWQLQICKEKGLIFGNIDLIVQIVADTLSKHNPKPSILHGNLWIENCIQVDDKIFVCNPACYWGDRECDIAFSSLFEPFPTNFYQRYNEIYPLEEGYLERKLIYQLYYLLNFSYRYYNKKQSYVSLTQKLINQILHKIDK

SEQ ID NO: 86663 - protein, 569 aa, Oryza sativa Japonica Group
MELFYELLLTAAASLLVAFLLARLLASAATASDPRRRAPDHAAVIAEEEAVVVEEERIIEVDEVEVKSARARECVVSEGWVEVGRASSAEGKLECLPEEEEAPAKAARELVLDAVLEEREEEGQVGEERCDLAAAVAEVVGVKPHELGVEAAPGEVSDVTLEEGKVQDVGVEQHDLVAEAAPREALDTGLEKQGVPIIEAVEIKRQDDLGAEVAPSDVPEVEFEQQGVRIIEAIDVNQHHRVALAAPAEVVDAGLEERVQAIEAGSSGLTSETVPEEVLDELSEKQEEQVIEEKEHQLAAATAPVAIPGVALAETEELKEEQSSEKAVNVHEEVQSKDEAKCKLHLVDQQEGSASKVELVGRNTDNVEISHGSSSGDKMIAELTEEELTLQGVPADETQTDMEFGEWEGIERTEIEKRFGVAAAFASSDAGMAALSKLDSDVQLQLQGLLKVAIDGPCYDSTQPLTLRPSSRAKWAAWQKLGNMYPETAMERYMNLLSEAIPGWMGDNISGTKEHEAGDDAVGSVLTMTSNTINQHDSQGNEDNTGMYEGHLTSSPNPEKGQSSDIPAE

SEQ ID NO: 86664 - protein, 479 aa, Oryza sativa
MKLRLRSMDQRGGAGGAAETHRVQLPDTATLSDVKAFLATKLSAAQPVPAESVRLTLNRSEELLTPDPSATLPALGLASGDLLYFTLSPLPSPSPPPQPQPQAQPLPRNPNPDVPSIAGAADPTKSPVESGSSSSMPQALCTNPGLPVASDPHHPPPDVVMAEAFAVIKSKSSLVVGATKREMENVGGADGTVICRLVVALHAALLDAGFLYANPVGSCLQLPQSGSFVPVSMKYTLPELVEALPAVEEGMVAVLNYSLMGNFMMVYGHVPGATSGVRRLCLELPELAPLLYLDSDEVSTAEEREIHELWRVLKDEMCLPLMISLCQLNNLSLPPCLMALPGDVKAKVLEFVPGVDLARVQCTCKELRDLAADDNLWKKKCEMEFNTQGESSQVGRNWKERFGAAWKVSNNKGQKRPSPFFNYGWGNPYSPHGFPVIGGDSDMLPFIGHPNLLGRSFGNQRRNISPSCSFGGHHRNFLG

SEQ ID NO: 86665 - protein, 255 aa, Alkalilimnicola ehrlichei MLHE-1
MSVVIKTPEEIERMREAGRLAASVLDMIGEHIRPGVTTEHLDALCHDYMVNELEVVPAPLNYRGFPKATCTSVNHVVCHGIPGPKKLRKGDILNIDITVIKDGWHGDTSRMFFVGEPSIKARRLVEVTKECLWKGIEQVRPGATLGDIGHAIQTWAERHNYSIVREYCGHGIGQQFHEDPQVLHYGEPGQGLRLEEGMTFTIEPMVNAGKPGTKLLRDNWTAVTRDRSLSAQWEHTLAVTADGYDVLTVTDRYPG

SEQ ID NO: 86666 - protein, 248 aa, Bacillus clausii KSM-K16
MIVIKTERELDVMRKAGQIVALTHAHLKPYIKPGITTGELDALAEAFIRSHDATPSFLGYGGFTGSICASVNEELVHGIPGDRMLADGDVISLDIGAYYNGYHGDSAWTYGVGTIKEEDQKLLDATEASLYKGLELARPGNRLSDISHAVQTFVEQSGYAVVREYAGHGIGKDLHEDPNIPNYGPPGKGPKLKPGMVLAIEPMVNAGSRYVRTLADNWTVVTVDKKNCAHFEHTVAITETGYEILTKA

SEQ ID NO: 86667 - protein, 472 aa, Coccidioides immitis RS
MVSFSQALYLLSHPQELRSIIQWKVWHEPVHSRITGNETESEKKCYHFLKLTSRSFSAVIMELHPELLLPVCLFYLILRGLDTIEDDTSIPLKVKEPLLRNFKDFLEVDGWTFDGNRPEEKDRELLVQFHNVITEFKKIKPAYKAIIKDITDRMSNGMADYCRKAEFENVNVNTVEEYDLYCWYVAGLVGEGLTRLFVEAGFARPQLLERPQLFKSMGLFLQKTNIIRDVREDEDDNRRFWPKEIWSNHVDKWEDLFKPENREAAVNCGAEMILNALGHVDDCLYYLAGLKEQSVFNFCAIPQSMAIATLELCFRNPAMFDRNIKITKGQACRLMWQSTQNVRVICDVFRQYARAIHKKNTPKDPNFLRVSMACGKIEKFIESIFPTQSLEDANRRVSNKKSAEDAKRAAEAAEATRDTIFIVVSLVGILVVVSSLMFGVAWMMGARFDLAFQELKKGNFRPSQQTLRHGEL

SEQ ID NO: 86668 - protein, 395 aa, Desulfovibrio vulgaris subsp. vulgaris str. Hildenborough
MRTWVLLLAAGSGTRLATAGLPDAKQFLPLHGAPLYWASARTMAHVAGIEGIVFVFPPHRVEEERARISALDDGSVLGLDWHVVGGGAARQDSVACGLAALPRSCEAVLVHDAARPFASPALVARVLSALHDGHAGVVPGIPLTDTVKETTDGFVANTPDRSRLVAVQTPQGFTLKALSTAHETARTAGWNVTDDAALLERCGIPVRIVAGEVVNAKITTPEDLAMLDANEPQVTVPCVGWGYDVHRYGEGRPMKLGGVLIPEGPEVVAHSDGDVLLHALADALLGCIGAGDIGLHFPDSDAAFDNANSAMLLDRVLHMTHEARLRLTHVDLTIVAQVPKLSPWRDKIRANVARLLDLPVTSVNFKATTEEGLGFTGEKRGIKAIAAVTGLRPMP

SEQ ID NO: 86669 - protein, 185 aa, Saccharophagus degradans 2-40
MEATVANSNPVRTFKNITPSLGERVFVDPAAVVIGDVHLGEDASVWPCAVIRGDMHRIRVGARTSVQDNAILHITHASSFNPDGWPLIIGDDVTIGHGACLHGCTVGNKVLVGIGATVLDGAIVEDEVIIGAGSLVPPGKRLQSGFLYVGSPVKQARPLKDSEKAFFAYSAQNYVKLKDEYLGDS

SEQ ID NO: 86670 - protein, 633 aa, Arabidopsis thaliana
MNAITFLGNSTMIPSQCILRAFTRISPSKYIRDTSFRSYPSRFSSCINQYRNADSDRIIRPTNAVPFCTDRQSSVTAQVVSEARSHSASTTCANDTTLDQIYTKNGLNVKPLVVERLKRDEKDEEAVNEDEEGVKRDGFEGVKCNDVEEEAWRLLRDSIVTYCDSPVGTVAAKDPTDTTPSNYDQVFIRDFVPSALAFLLKGESEIVRNFLLHTLQLQSWEKTVDCYSPGQGLMPASFKVRTLPLEEDKFEEVLDPDFGEAAIGRVAPVDSGLWWIILLRAYGKITGDYSLQERIDVQTGIKMIANLCLADGFDMFPTLLVTDGSCMIDRRMGIHGHPLEIQALFYSALRSSREMITVNDSSKNIIKTISNRLSALSFHIRENYWVDKNKINEIYRYKTEEYSMDATNKFNIYPEQVSPWLMDWVPESPDSGFLIGNLQPAHMDFRFFTLGNLWSIISSLGTPKQNQAILNLVEEKWDDLVGHMPLKICYPALESSEWHIITGSDPKNTPWSYHNGGSWPTLLWQFTLACIKMGRPELAEKAVTLAEKRLQADRWPEYYDTRDGKFIGKQSRLYQTWTIAGFLTSKQLLQNPEIASSLFWEEDLELLESCVCVLTKSGRKKCSRAAAKSQILI

SEQ ID NO: 86671 - protein, 138 aa, Glycine max
  misc_feature (35)..(35): Xaa can be any naturally occurring amino acid
  misc_feature (82)..(82): Xaa can be any naturally occurring amino acid
  misc_feature (108)..(108): Xaa can be any naturally occurring amino acid
RETPALKEKEELFANVNGLKAQLQRQPIDTTQVFXKTKLCLNTKHVDPPKKKVDKASLSVFKTIPVPAKKVVPMATDQVNIXPVGDKERSDIQGPKARIIYVKEVAPXTDGNSLDIPVVNQPGTNPPHEQGGNFFHQP

SEQ ID NO: 86672 - protein, 1468 aa, Ustilago maydis 521
MPYSSQQNGYTSASTSRLSEQTSSHSRSSREDRHLTEKGRRPPSPEARHRSDRDYDRRRSTEYVRDDDYRRSSRSSHDSRYADAYDHWRSARSAYSPTPRDDRRDEARNDLSSTKRHRSPEHSTSRLRHRSPESAHRRQNGTANRLDSKPDRGGDRKTGEALDSGRSRWSQRAYEYDDWRNERPSARYERYRHDREPHRSRREDEYETKRSRDDSNGNSIYAPTRRSRSRSRSRSRSRDRYRSRDHSRERRRERSRDRSNGTYSSRDDRRPKADRSAHTIKRDEHSTRLNGTSEDSKDLRHESQRRVSASVQSASEGPASTPVARAVYIKHAEVDQEAPAPPTTRDYHSCPQRWPDQADSAVRASSAPNGSATAPSRSDRPPANGSSGRHSPRSLPTREKAEEARTSSTRRPSSQTNDNVNNSRDPLTQRKATSERSFGHVLLPHELPVECRGKNYMATATYKEGVKSIYKSAADKHLVDVDTRDPRRLGKKSSRYRESLHSASFRWDSNSRGKKPLPPPRNLVLTNLSGLLQPHQILLHILPHGRIESSKLEIDPKIGQSLGIFRVTFAHDFDEHGKPLESMPAGQNPQHGAKVAKAACLALNGRMIGQTRAQAFLDRDGEVIAERIKAKLAENEHKLRPTIVPPAPPAAASSSPATPSTTKQSMPPPQVPRGPKVFMPAAPSPSYASSPASARANTDRYEYSATSHSRYRSSYEESRKLASSETYHRRRGTEEYDTYNRSKPYADAQVPAGSRSETRKDIKRPDEEILNELRDKKRPYVHIPRPKNCDIDVTSVEAQLRSTAPIWVREGQKGFYAAFHTSKEANQCKVVNETLTIGGYTLQVDVRSAPSQHAPSQQIRTPSGKHASVPLSMPAPPKQERKAIDTGLRPPTADEKLKVDWSAAELQDAVFRMLQKELADTFVRDVKSRVVGPYLTAYLKPDGEGGKMLAKATMKKPVIPTSINDHGTTLFEATGEARLPSFRKLAGAHPKKKASDADTTTSQAKRDQTDAKKKRGHTHRSKVHRDRDVSSSENESDDMERGMVVAARRNSYTRSKSSTKRRGAAAWLLEASDAEAGTDDVDSTETDALSRSVSASVEPTGEEQIEVDVGAKAKKIPKVKAATVSKKKGTTAARKKLDVAPPEAVVEADQGSETATPETDVPIKTAAAKAKVKPAKTSAKAKSALVDPFEAGLVEDSEDCHYLRLALEHLSRTGELASEHTLPDEIELEVEAEEQAMAAGGIPKHSTGSARTEGYYRIPPEQKAMHLPDRNKATEDVDTSSNAQILQSARNNRADSRRLVLGIEQHKRETATDTDIFKFNQLRTRKKQLKFAKSPIHDWGLYAMELIPAGDMVIEYVGEVVRQQVADEREKQYERQGNFSTYLFRVDDDLVVDATHKGNIARLMNHCCTPNCNAKILTLNGEKRIVLFAKTAIRAGEELTYDYKFQSSADDEDAIPCLCGSPGCRRFL

SEQ ID NO: 86673 - protein, 270 aa, Photorhabdus luminescens subsp. laumondii TTO1
MQTSLSDAYMQRFAGTARLYGQKALSLFCHSHVCVVGIGGVGSWAAEALARTGIGAITLIDMDDVCITNTNRQLHALKQHIGQPKTEVIAERILAINPECKVTCVDDFLTPDNVEEMMAAGFSYVIDAIDSVRPKAALLAYCRRHKIPLVTTGGAGGQLDPTQIQVVDLAKTVQDPLAAKLRERLKSDYRVVKNGKGKLGIDCVFSTEQLVYPQSDGSVCAAKSTAEGTKRMDCASGFGAATMVTATFGFVAVSHALKKMIAKAQRQGDL

SEQ ID NO: 86674 - protein, 555 aa, Acidobacteria bacterium Ellin345
MPTDVIMPQMGESIFEGTITKWLKQPGDQVQRDEPLFEISTDKVDAEIPAPAAGILKEIKAQAGQTVQVNTVVAIIDAAGSATTSAPKPAAAAPPKSAPQPDGVSSSAPSTSAPSVPAAGPKTDVVMPQMGESIFEGTITKWLKNVGDTVQRDEPLFEISTDKVDAEIPAPVAGVLSEIKVQAGATVQVNTVVATIGGAAGASARAPQAAAPAPSAPAPAAPAPQAPAAAEPEEEEISASGDRVRTSPLVRKMAKEANVDLGKVRGTGMGGRITKEDIQAFVEKQKTAPTPTPQPQAAQPSAPAPAPSAPVAATPNKFAGTPGAIEPMSVMRKKIADHMVMSKRTSAHVHGVFEVDFTKIVKLREKNKNSFQEKTGLKLTYTPFYARAVAHALRAWPIINASVEGENIHYKKDINLGIAVALDWGLIVPVVKQADGLSFVGLQRAITDLGERARAKKLKPEDVQGGTFTITNPGIFGAKFGMPIISQPQLAILGIGAITKVPMVVTDKDGNDSIAIRSRCHISIGYDHRVIDGAVADQFMVVVRDYLQNWNEPLI

SEQ ID NO: 86675 - protein, 162 aa, Glycine max
MANSKGSSGFRNFMYPGKHPLLPPKSPFPSVSQAYADYVPNPAVGLKAGNRPRDGNTHHQRTSSESLVIEEQPSWLDDLLNEPETPVRRGGHRRSSSDSFAYIDTVNASNINYANQDEYKYKNMMSIPSWSSQDFDRSKDARHVPVYAEMNSVKQKNRSWDS

SEQ ID NO: 86676 - protein, 219 aa, Oryza sativa
  misc_feature (128)..(128): Xaa can be any naturally occurring amino acid
LELITTPLASHHTKCPPSSSSSPTTASGSASSSVRPPPPRRMQRAIQAIGSHGSLLKSAVLRHISAPKPSILPAVYSRSMSVSSAQIEESGFETATVADILKSKGKSADGSWLWCTTDDSVYDAVKSXYLRKIIVQGRSSKSTKVGDIMTEENQLITVKPDTRVLQAMQLMTEKRIRHIPVIDGTGMVGMVSIGDIVRAVVSEHREELNRLNAYIQGGY

SEQ ID NO: 86677 - protein, 417 aa, Photorhabdus luminescens subsp. laumondii TTO1
MKKFEPEQFRQQFPALQQFPSQQFPSQQLPSQQQTVFLDSAATALKPQAMIKATQDYYRNSSATVHRSQHHAALEITSRYEQARQQVAEFINAPQAENIIWTKGTTESLNLVVQSYFRPHLQPDDEIIVSEQEHHSNLIPWLMLAEQIGAKVIKWPLGNGKLPDIHMLPELLNKHTRLIAISQMSNVTGGAVDLAAITAIAHQHGCLVVVDGAQGVVHNPIDVQQSDIDFYAFSAHKLYSSNGVGILYGKSELLNAMPPWQGGGKMLSHTSFSGFIPEAVPFRFEAGTPNVAGIIGFSATLEWLKDIDITKAETHAVTLADYTEEQLSALPGFISYRIAGSSLLAFNFTDIHHSDLAAILAEQNIALRSGQHCAQPLIEALGISGCLRASFMPYNNQQDADALIQAVKFGLSLLQDE

SEQ ID NO: 86678 - protein, 437 aa, Silicibacter sp. TM1040
MGTPGTPALLEAAHRKWGRANWGGLFTDAIRLAELGFAVSPRMADSIANDAERLGRFPETAAYFLPEGIPLAAGEVITNQPYANVLRRIAMEGTRAFYSGPVAADIVRAVQGATGNPGVLSELDLALYQVKERPAVCASYRAFEACGMGPPSSGALTVGQILGMLEPYDLAALGPDSPESWRLIGDASRLAFADRGRYMADSDYVPVPTKGLLDPEYLSKRAALLEGDAALETVAPGAPEFDHALIWADDESIEFPSTSHISIVDQYGNVLSMTTTIENGFGSRLMTNGFLLNNELTDFSFRSHRDGVPIANRLEPGKRPRSSMAPTIVMQDGKPVLAIGSPGGSRIIGYVATAIIGWADWGLDIQDAISLPHAVNRFGTYDLEAGTGAEALEAALTDMGYQVNVRDLTSGLHAIEIDNGLKGGADPRREGIALGDE

SEQ ID NO: 86679 - protein, 437 aa, Lactococcus lactis subsp. lactis Il1403
MKENKLLSPAAIFLLGVNSIIGSGIFLLSGKIYEDAGIWSLLAILCAGLSIFVIAFAYANMSKIYSKNGGAFVYAKETFGRFPGFIVGMVTWLLGTVTLATEVSVLLTAMKMILPNLNSRLIGIIIILALGIISYFGSSIIAGLDNLTSFVKIVLVLVFIFTCLWLVRGLNFSSPNLLTASSANLGGFKGFLSAYGTVFFFFTGFSFLPVNAEKMKNPAKNLPKMMSLVMLTCLAVYLIIQTITIGALGPELTKTLVPAATAFSKIVGSIGIPLFVVGICFSIFGVIVATTFNTPTILASLAQAHEDVPMFVSKNNRFGTPTWAIILTTVCGIALFLSGNYVFLSGLTVFMSFVQYLSTGLANIKKKFLLIGIGSVLFSLVLLTSFTLSVLILGLGILILLVMIYFVVKLDDDEREKWLKEHQEKSKGADVNTVKRL

SEQ ID NO: 86680 - protein, 390 aa, Phytophthora megasperma
TELGEYRAAVPSGASTGEFEALEMRDGGADYMGKGVLNAVKNVNDIIAPALIGKDVTKQEELDRFMVEKLDGTQNEWGWCKKKLGANAILGVSLALCRAGAAAKKQPLWQYIADLAGNPSPCLPVPSFNIINGGSHAGNKLAMQEFMILPVGATSFTEAMKIGSEVYHNLKKVIKGRYGLDATAVGDEGGFAPNIQSNGEAIDLIEEAIKTAGYTNQVRLGMDVAASEFYTGAKDARYNLDFKNENAPESEKIPAEKLQSVYEGFIAKCAASSKIVSIEDPFDQDDWESWVKFTAKVGKDVQIVGDDLTVTNPTRVKKAIELKACNALLLKVNQIGSITESIEAVTMAKKAGWAIMASHRSGETEDTFIADLAVGLSAGQIKTGAPCRSE

SEQ ID NO: 86681 - protein, 335 aa, Alkalilimnicola ehrlichei MLHE-1
MASRKITVLPGDGIGPSIVEATQRVLDRLNCGLEYEYADVGLTALEQGRELIPQEALDAIERNGIVLKGPITTPVGEGFTSVNVTLRKEFQLFANVRPVITIPGTRARYENIDIITVRENTEGMYSGIGQTLSEDGNTAEARSVITRDESLRLVRFAFDMARRLGRQQVTVVHKANILKTTSGLFLNCAREVAEDYPDIEMNEMIVDACCMKLVMNPEQFDVIVTTNLFGDIISDLCAGLVGGLGMAPGANIGEDKALFEAVHGSAPDIAGKNIANPTAMMLAAALMLDHMQLHEPASRMRTAIRNAIFAGDRVTPDLGGHGTTTGFTDAVIERI

SEQ ID NO: 86682 - protein, 624 aa, Oryza sativa Indica Group
MRGGGFVNEMRHTGKRPQQHRDHDREERRDQKRRPVPRAQENSGNDELVVYRILCPDRVIGNVIGKNGKVINSIRQQTSAKVKVVDPHPGADKRVILVYCFVKHRNLDVNDDDDREPVCTAQDALLKVHDAIVDALSITRDSDDEEANILVPASQSASVIGKSGAVIKRLRSTSKAFIKVSPKDPNEVTHSCAMSFDNFVQITGDARAVRKALFAVSTIIYKCPSKETIPLETSVSDLPPSIIVPSELPVYPSSNFYSPSDAAISSGHPSLSILGSTPHVPELTVSADAHSRLPIYQSVLPVIPAYNTPKCSGELVLRVLCPAGKIGLVIGKGGVTIKSIRKESGARIDVDDSKNDREESIITITSNEATDDAKSAAVEAVLLLQSKINDDNEGKVIGCLIGKGGSIVNDMRSKTKAAIYISKGEKPRKASSSDELVEVFGEVENLRDALVQIVLRLRDDVLRDSVDRQNSEKDGKLTVATTDPLYASSYPLPALLPYRQQITPLGYDHRGDIERGLEVYPHSSLYGYSSLQAIDDGYSAVSSYASKGYGGRPPHMEMTIPASGLSKVMGKHGTNLDNIIKISGAHIEIIESKSSRHGHVARISGTTEQKQSAENLIKAFIMST

SEQ ID NO: 86683 - protein, 545 aa, Lactococcus lactis subsp. lactis Il1403
MLTVSDISLQFSDRKLFDEVNIKFTPGNCYGLIGANGAGKSTFLKILDGEIQPTTGHISMGPNERMSVLRQNHYDYEDQTPLDVVMMGNEKLFAINQEKNAIYMNPDATDDDFMKAAELEAEFGEMGGYEAEADAARLLQNLGIKAEQHTDLMANLTSGEHVKVLLAKALFGKPDVLLLDEPTNGLDIQAIAWLEEFLINFENTVIVVSHDRHFLNNVCTYMADLDYGKIKLYPGNYDFWKESSELALRLQGDQNRKAEEKIAELKEFIARFSANASKSKQATSRKKMLDKIEVEEFVPSSRKYPFVGFEQEREIGNDLLRVENLSVAIEGEMIIENTSFILNPGDKTVFIGQNDIQQTTLLRALMDDVEDNWTVTGDIKWGVTSSRSYLPKDNTKDFDTSDSILDWLRQFVLTKEEDDNTYLRGFLGRMLFKGEESLKAVNVLSGGEKVRVMLSKMMLQRANVLVLDDPTNHLDLESISALNDGLKSFKGSILFASHDHEFINTIANHIVVLGKSGVIDRIGETYDDFLDNAEVQEKVKALWAD

SEQ ID NO: 86684 - protein, 325 aa, Zea mays
MKLNIANPTTGCQKKVEIDDDQKLRNLYDKRISQEVVGDLLGEEFKGYIFKIMGGCDKQGFPMKQGVLTSGRVRLLLHRGTPCFRGFGRRNGERRRKSVRGCIVSQDLSVINLVIVKKGENDLPGLTDTEKPRMRGPKRASKIKKLFNLGKDDDVRSYVNTYRRTFLNKKGKKVSKAPKIQRLVTPMTLQRKRARIADKKKRIAKKKSEAAEYQKLLAQRLKEQRDRRSESMAKRRSKLSAATKAPAASALDGYSPLHFVGKIYPLLSVFLGLVIVQFLREHGYFIIVSFVTGVTFLGFVPDAVLHEHDGYSIVMSFAKICMVIF

SEQ ID NO: 86685 - protein, 156 aa, Glycine max
  misc_feature (99)..(99): Xaa can be any naturally occurring amino acid
  misc_feature (101)..(101): Xaa can be any naturally occurring amino acid
  misc_feature (142)..(142): Xaa can be any naturally occurring amino acid
ASSMIYSPTVTTVNRAGAGMVATFTGLKSMAGFPTKNTNNDITSIASNGGRVQCMHVWPPVGKNKDETHCYLPDLDDAQLAKEVEYLFRKGWIPRLEFXVXHGFMYGEHTRSPGYYDGHYWTMWKLPMVCCTDASKVLNDLXDAKTAYPNGFIRII

SEQ ID NO: 86686 - protein, 465 aa, Bordetella petrii
MSETRTTTLLVIGGGPGGYVAAIRAGQLGVSTIVVEGQQPGGTCLNIGCIPSKALIHAAQEYERAREYAGASPLGISVQAPAIDIGKTVAWKDGIVARLTGGVEALLKKNGVQLVRGWARVLDGKTVEVDTGQGSQRIQCEHLLLAAGSEPMPLPSMPFAGRVISSTEALSPASIPGRLVVVGGGYIGLELGTVYRKLGAEVTVVEAQERILPTYDAELTKPVAAALARMGVQLCLGRKVLGMNAAGDAVRVQDASGAETALPADQVLLAIGRRPRTQGWGLENLQLDRAGNALRIDDQCRTSMRNVWAIGDIAGEPMLAHRAMAQGEMVAELVAGQRRRFAPAAIPAVCFTDPEIVTAGLAPQQAQAAGLDCVTAAFPFAANGRAMTLESTDGFVRVVARRDNHLVVGWQAVGRGVSELAAAFSQSLEMGARLEDVGGTIHAHPTLGEAVQEAALRALGHALHI

SEQ ID NO: 86687 - protein, 456 aa, Bordetella petrii
MGIHIIKMPDIGEGIAEVELVGWHVNVGDTVAEDQPLADVMTDKATVEIPSPVVGKVVALGGSVGDVMAVGSELIRLEVEGAGNAKADAAPTPTGQEAAAPADDGVGVAAAPAPEAGGIAGQIARDVASGAASAPGAAQAPAVAPSRPQADARPAPAGPARQPGERPLASPAVRKRAWDMGIELRFVHGSGPAGRILHEDLDAYLQGQGAAMPSAQGGYRERHDEQQVPVVGLRRKIARKMQESKRRIPHFSYVEEVDVTELEALRAQLNRKYGEARGKLTLLPLLARAMVIALRDFPQINARYDDEAGVVTRYGAVHLGVATQTDNGLIVPVLRHAEARDIWALGAEIARLAQAVRSGKAERDALSGSTITLTSLGALGGIVSTPVINHPEVGIVGVNRIVERPAIYQGAMVARKLMNLSSSFDHRVVDGMDAAQFIQAVRALLEQPALLFVEAP

SEQ ID NO: 86688 - protein, 480 aa, Mycobacterium sp. JLS
MTALTAQLTSPANTHRLQVAGAALTSRFPSREEPLATPPPGSNLKPVTGNYGFPFLGHTLSALAEPLDFARRRYDMYGPVSWAGGVGFRVVALMGPDALETAWINRDKVFSSTRGWAPVIGPFFHRGIMLLDFEEHRDHRRIMQQAFTRTALDGYLELMRPGIDRTLGGWPASDAFPFYPSIKHLLLEQAAEVFVGTHLGPESDQLSADFHDTVRGGQALLRADVPGGVWARGLRARKRLERYFGDQIADRQRGDGADLFSMLCRSEDDDGARFTPADIVNHMIFLLMAAHDTTAIALSMLVYELGRNQKWQKTLRDEAVGRPNDAPAVGDLDAYPLLDAAFKEILRMYAPAGTLFRQTTRDTDILGHFVPAKTQVAINVHASMRLADWWPDPDTFDPARFIDQPGARAAVSRYAFAPFGGGAHKCIGQQFADMTVKTTMHQMLRRFEWSVADGYRIPLTWGTGPTPADDLPITLRTLTT

SEQ ID NO: 86689 - protein, 846 aa, Magnaporthe grisea
MTVVAGPTYPLELLQGTKVTKFAKKRGSTTSRKQLMLVLDAQSAKITWDKSKPSKSIYIDDIKDIRTAEDIRQYRLDFGIPESEEPLCFSIIYATHDVKPKTKMMHLVAGDPAIVDMWVSTLHTISMHRQDIMSSLMAFNDKAIRTYWKNELHKQLKNTSNNGEENIDFLGVERVCQNLHIHVSSETLKEKFLEALGTSSVDADASVKNGRLNFSQFQEFVRLMKRRADIRPIFRERASDIERGMTLLDFVSFLTDVQNEDVDADRAYWEAIFARFAKRNKSKDLEGDDVPRISEAALVSFLTSTYNVPIVSAPKNYTLDRPINEYYISSSHNTYLLGRQVMGFSSVEGYISALMRGCRSVEVDCWDGGDGWPLVSHGWTMTTNIAFREVMNVINKYAFVKSEFPLWISLEVHCNPDQQRKMVAIMKEIFGARLVTEPLEGLPADKLPSPSQFKNRILIKAKKPGHEEPNPERTGRRRGNSLTSPYTKPVMLDNSTIPSQSLPHSPLLTPTHSQIRRMGAKTRVYTITEGRVHDSTSGSPSDCDSGSERDIQQPISPNSGTSKIVKELGDLAVYCAGIKFSGFEHPDSKTVNHIFSFHEGTFQRHGRPGDAKRALYRHNMRYMMRVYPHRGRVYSSNFDPLLMWRRGVQMAALNWQTFDLGMQLNHAMYDGGMDQSGYVLKPKEFREIQHFPYLPEHMVGGKRPRKNVKFSIDVISAQQLMRPHNLRDRHTLDPYIEVEAFLADDKRNTNKEYSDAGPSKTKHKTPIAKDNGFNPIFDQRYNFNFNTKYPDLIFIRWTVRLSEGGSQSDRSTILGTESVNKLRSLGRTVFNRSNNSPKSSVDGGSQ

SEQ ID NO: 86690 - protein, 440 aa, Desulfovibrio vulgaris subsp. vulgaris str. Hildenborough
MERDIYLIGLNHRTAGVEVRERFALTDCNVLEQGVVPIDDVVSEVLILSTCNRVEILAVGRGPEVVSRVLRGWSAARGQCEHDLAPYVYTHKGPEAIRHLFRVASSLDSMVVGEPQILGQLKDAYRKAIERNCTRVILNRLLHKAFSVAKRVRTETGVASSAVSISYAAVELAKRIFGEMNQYKAMLIGAGEMAELAATHLLHAGISKIYVANRTFERGRELARQFNGEAIHFEDLFERLADADIIISSTGAHEAIIRARDIKDVLRRRKHRPMFFIDIAVPRDIDPDVNNLDNVYLYDIDDLKEVVEENLAQRREEASKALTIVEEETGKFGQWLRSLELQPTIVDLIRRSERIAQDELARTLKRLGPVDDETRDALEAMLSSMVRKLNHEPITFLKRRHSEEDAGPRYIDIARRMFNLDDDNVPPDAHCDRRRHDEDN

SEQ ID NO: 86691 - protein, 517 aa, Oryza sativa Japonica Group
MAVRRRRRRSRAAAVLVAALLLAASAATASAASSYPAKVVTGLLSSTASAVVKQLWSLKSTATRTGSAAAGRSMVKYEGGYAVETVFDGSKLGIEPHDVEVTPSGELLVLDSMNSNVYRVQLPLSRYSRPKLVAGSPEGLSGHVDGRLREAKMNHPKGFTVDDRGNIYVADAMNMAIRKISDTGVTTIAGGKSMRGGHLDGPSDDAKFSTDFEIRYISSSCSLLVIDRGNQAIREIALHNDDCEYQYEAGFPLGIALLFAAGFFGYMLALLQRQVLGMVSTADEPQTPPRPSIASIPPYQKPLKPSLRPPLIPTEDQAGKHEAEEGFFTSIGKLIGGAKSSAVEIFSRKKRPTHQYHHHLQQQRANPWPVQESYAIPHDETPPPLDMRAATPRKNYAFMTKEPEKVHHVRHGRPYFNGWDMQHAPQQQPEQQMYHQQHLQQHRQYSAGPQTFYEQSCETTNEIVFGAVQEVDTKRRMVEIKAVNYGDTFYEQYGMRYRNNYIGYNNSSNGNNNSYYY

SEQ ID NO: 86692 - protein, 416 aa, Arabidopsis thaliana
MANISEISGDSNDGGDPNKKPEEQVLRRSRRIATRNENQNKKPKEEEEKDNRSVSFPIPNELTEACVALIRKCDYPSLSSVSSYFFNLIASSELYETRSRLGLSETFLYAAIRFPDTNPPNWYILHRNKVSSLRLSKLESLPPVPYGCSVVTIGQEMYVIGGLLDVRRLQLMTLIDCRTHKCRSLPKMKRGRYHAAAGVFDGKIYVIGGFRMRKPDAEWIEVFDLKKQIWESLPGPYPKTSMDSQFFAHAVMEDKLYILGSRCLIYEPKRNGEWDATVNANPIWNLWKVPCTMQCVIDDMLYTIDPQCTLGHPIVVYNPKDKTWRPVKGESLRTLPSYFVSDGSEMANFGGKLVILGSNGSCYDTGDCIGEKGIWCVMIELEKREGGEIWGKVESLDCVLGDINFLSVWLCQTLTL

SEQ ID NO: 86693 - protein, 308 aa, Desulfovibrio vulgaris subsp. vulgaris str. Hildenborough
MDCVENARLQSKVLIESLPYLRQFHGETVVIKYGGHAMKDEALKKAFALNVALLKLVGINPVIVHGGGPQIGKMLEQLNIQSHFREGLRVTDDATMDVVEMVLVGKVNKEIVNQMNLAGAKAVGLSGKDGMLIRARKMEMVISKEAQAPEIIDLGKVGEVMGVNTTLLRSLERDGFVPVIAPVGVDDNGETYNINADAVAGAVAAALKAKRLLLLTDVAGILDHDKKLIRSVNMREAVNLFSDGTLTGGMIPKVKCCLEALEEGVEKAMIIDGRTENCILLELLTDKGVGTEIVSDRAAQAACNCVLR

SEQ ID NO: 86694 - protein, 498 aa, Scaevola aemula
MRMNSTNSSSVISTLEKKNAGRIAQIIGPVLDVAFPPGKMPNIYNALVVKSRDTAGQTINVTCEVQQLLGNNRVRAVAMSATDGLTRGMGVIDTGAPLSVPVGGATLGRIFNVLGEPIDNLGTVDTSTTSPIHRSAPAFIQLDTKLSIFETGIKVVDLLAPYRRGGKIGLFGGAGVGKTVLIMELINNIAKAHGGVSVFGGVGERTREGNDLYKEMKESGVINEQNIAESKVALVYGQMNEPPGARMRVGLTALTMAEYFRDVNEQDVLLFIDNIFRFVQAGSEVSALLGRIPSAVGYQPTLSTEMGSLQERITSTKEGSITSIQAVYVPADDLTDPAPATTFAHLDATTVLSRGLAAKGIYPAVDPLDSTSTMLQPRIVGEEHYKTAQEVKQTLQRYKELQDIIAILGLDELSEEDRLTVARARKMERFLSQPFFVAEVFTGSPGKYVGLAETIRGFQLILSGELDGLPEQAFYLVGNIDEATTKAMNLEMESNLKK

SEQ ID NO: 86695 - protein, 392 aa, Phytophthora multivesiculata
TELGEYRAAVPSGASTGEFEALEMRDGGKEYMGKGVLNAVKNVNDIIAPALVGKDVTKQAELDRFMVEELDGTQNEWGWCKKKLGANAILGVSLALCRAGAAAKKQPLWQYIADLAGNPTPCLPVPSFNIINGGSHAGNKLAMQEFMILPVGATSFTEAMKIGSEVYHNLKKVIKGRYGLDATAVGDEGGFAPNIQSNGEAIDLIEEAIKAAGYTNQVRLGMDVAASEFYTGTKDARYNLDFKNENAPDSEKISAEKLQEVYEGFIAKCAGSSKIVSIEDPFDQDDWESWVKFTGKVGKDVQIVGDDLTVTNPTRVKKAIELKACNALLLKVNQIGSITESIEAVTMAKKAGWAIMASHRSGETEDTFIADLAVGLSAGQIKTGAPCRSERL

SEQ ID NO: 86696 - protein, 389 aa, Phytophthora hedraiandra
ELGEYRAAVPSGASTGEFEALEMRDGGKDYMGKGVLNAVRNVNEIIAPALIGKDVTKQAEIDRFMVEELDGTQNEWGWCKKKLGANAILGVSLALCRAGAAAKKQPLWQHIADLAGNPTPCLPVPSFNIINGGSHAGNKLAMQEFMILPVGATSFTEAMKIGSEVYHNLKKVIKGRYGLDATAVGDEGGFAPNIQSNGEAIDLIEEAIKAAGYTDKVRLGMDVAASEFYTGAEDARYNLDFKNENAANSEKISADKLQEVYEGFIAKCAGSSKIVSIEDPFDQDDWESWVKITGKVGKDVQIVGDDLTVTNPTRVKKAIEQKACNALLLKVNQIGSITESIEAVTMAKKAGWGIMASHRSGETEDTFIADLAVGLSAGQIKTGAPCRSE

SEQ ID NO: 86697 - protein, 641 aa, Triticum aestivum
  misc_feature (432)..(432): Xaa can be any naturally occurring amino acid
  misc_feature (450)..(450): Xaa can be any naturally occurring amino acid
  misc_feature (533)..(533): Xaa can be any naturally occurring amino acid
MAASRTASASASVKLGSKPDAFRRQGQAWFCTTGLPSDVTVEVGGMSFHLHKFPLLSKSAVLEQLIEESSDQEECIIKLSDIPGGAKSFEMVARFCYGVKIELSAANVVHLRCASEHLQMTEEISDDNLIAQTEMFLNQVVLRNWKDSLKALETCDDLLPHAEDLQIVKRCIESLASKATTDPNLFGWPIREHGIMQSPGGSVLWNGISTGARPRNFSSDWWYDDVSSLSFPPLRLLSGMEFRRIRPEIIAGSLAYYARKYIPGLSRRNSMGTMPLAGTLSDVEQRNLLEEIDRLLPVQKGLVPTKLLLGLLKTSMILKASSTCIANLEKRVGMQLDQASLEDLLLPNYSYTMETLYNVECVHRILEHFLAMDQANGGCSPCIDDMMASPSMIPITAVAKLLDGYLAEVAPDVNLKPPKFQALASALPEYAXRPLDDGLYRAIDVYLKAXHSWLSEAEREQLCRLMDCQKLSLEACTHAAQNERLPLRVVVQVLFFEQLQLRTSIAGCLLVSDNLEGSSRPLRSGGVAMSGEXGGWSAAVRENQVLKVGMDNMRMRLAELEKECSDMRQEIEKLGRGGGGGGKSGGGWASHVPRRFSLKMKPQMCSTQEGSVSEQQKSMSAKLDKLQAKLSKQKRQLSADA

SEQ ID NO: 86698 - protein, 388 aa, Phytophthora trifolii
IGEYRAAVPSGASTGEFEALEMRDGGKDYMGKGVLNAVKNVNEIIAPALVGKDVTKQAELDRYMVETLDGTQNEWGWCKKKLGANAILGVSLALCRGGAAAKKQPLWQYIADLAGNPSPCLPVPSFNIINGGSHAGNKLAMQEFMILPVGATSFTEAMKIGSEVYHNLKKVIKGRYGLDATAVGDEGGFAPNIQANAEAIDLIEEAIKAAGYTNQVRLGMDVAASEFYTGVKDARYNLDFKNADAPESEKIPADKLQEMYEGFISKCADSSKIVSIEDPFDQDDWESWVKFTGKVGKDVQIVGDDLTVTNPTRVKKAIELKACNALLLKVNQIGSITESIEAVTMAKKAGWAIMASHRSGETEDTFIADLAVGLSAGQIKTGAPCRSE

SEQ ID NO: 86699 - protein, 117 aa, Arabidopsis thaliana
  misc_feature (19)..(19): Xaa can be any naturally occurring amino acid
HQTLRPSSTLSSATMVASXAQAGIYTPGNGLKSSAAFPATRKANNNITSITSNGGRVNCMQVWTTIGKKNFETLSYLPDLTDSELAKEVHYLIHNKSIPCVQFKLQHPFVYRKHSNS

SEQ ID NO: 86700 - protein, 307 aa, Streptomyces avermitilis MA-4680
MAPVRHLISIDDLSDTDLYSLVLRGAAFSAGTAGRPAPLAGDVVGIYFRKTSTRTRTAFSSGALRLGAQIIAYGPDDLQLNTGETSEDTGRVMSGMLDVLVARTAGDPAEMRAWAAQDRMAVVNAMSADEHPTQALTDLTTLQGHFGGIEGLRVLYVGEGNNTASALALALTRYPGVSLELRTPPGYGLAPYYRERAADQAGRHGATFRERHDMDDLPADQDAVYTSRWQTTGTSKPDPDWREIFAPFQVSAALWETSPKAVFLHDLPAHRGDEVTAEVLDGPASIAFAQAENKMHSAMAVLEWCRP

SEQ ID NO: 86701 - protein, 393 aa, Phytophthora cajani
LVTELGEYRAAVPSGASTGEFEALEMRDGGKAYMGKGVLNAVKNVNEIIAPALVGKDVTKQAELDRFMVEELDGTQNEWGWCKKKLGANAILGVSLALCRAGAAAKKQPLWQYIADLAGNPTPCLPVPSFNIINGGSHAGNKLAMQEFMILPVGATSFTEAMKIGSEVYHNLKKVIKGRYGLDATAVGDEGGFAPNIQSNGEAIDLIEEAIKAAGYTNQVRLGMDVAASEFYTGAEDARYNLDFKNENAPESEKISADKLQEVYEGFIAKCAGSSKIVSIEDPFDQDDWASWVKFTAKVGEDVQIVGDDLTVTNPTRVKKAIEQKACNALLLKVNQIGSITESIEAVTMAKKAGWAIMASHRSGETEDTFIADLAVGLSAGQIKTGAPCRSER

SEQ ID NO: 86702 - protein, 1212 aa, Daucus carota
MHTQRRMDSMSLLFLLILLFCNFSESRKLSGQVKDQGNEVEGLANFKKFSVDAGPNGFLKTWDSSSSSSPCSWKGIGCSLEGAVTVLNLTGAGLVGHLQLSELMDNLPSLSQLYLSGNSFYGNLSSTASSCSFEVLDLSANNFSEPLDAQSLLLTCDHLMIFNLSRNLISAGSLKFGPSLLQPDLSRNRISDLGLLTDSLSNCQNLNLLNFSDNKLTGKLTSFLSSCKNLSTVDLSYNFFSQIHPNFVANSPASLKFLDLSHNNFTGNLVNLELGTCHNLTVLNLSHNSLSGTEFPASLANCQFLETLDMGHNDFHLKIPGDLLGNLKKLRHLSLAQNSFFGEIPPELGNACRTLEVLDLSGNQLIEQFPTEFSLCTSLVTLNVSKNQLSGDFLTSVLSPLPSLKYLYLSFNNITGSVPPSLTNATQLQVLDLSSNAFTGTIPTGFCSTSSSFSLEKLLLANNYLKGRIPSELGNCKNLKTIDLSFNSLIGPVPSEIWTLPYIADIVMWGNGLTGEIPEGICIDGGNLQTLILNNNFISGSIPQSFVKCTNLIWVSLSSNQLRGTIPAGIGNLLNLAILQLGNNSLTGEIPPGLGKCKSLIWLDLNSNALTGSIPPELSSQSGLVSPGPVSGKQFAFVRNEGGTACRGAGGLLEYEGIRAERLEKFPMVLACPSTRIYSGRTVYTFASNGSIIYFDLSYNALSGTIPESFGSLNSVQVMNLGHNNLTGSIPSSFGGLKYIGVLDLSYNNLQGAIPGSLGGLSFLSDLDVSNNNLSGSVPSGGQLTTFPSSRYENNAGLCGVPLPPCGSENGRHPLRSNSQGKKTSVTTGVMIGIGVSLFSIFILLCALYRIRKYQQKEELRDKYIGSLPTSGSSSWKLSSVPEPLSINVATFEKPLQKLTFAHLLEATNGFSANSLIGSGGFGDVYKAQLGDGRVVAIKKLIHVTGQGDREFMAEMETIGKIKHRNLVPLLGYCKIGEERLLVYEYMKWGSLESFIHDRPKVGGGLRIDWPARKKIAIGSARGLAFLHHSRIPHIIHRDMKSSNVLLDENFEARVSDFGMARLVNAFDTHLSVSTLAGTPGYVPPEYYQSFRCTAKGDVYSYGVVLLELLSGKRPIDPAQFGDDNNLVGWAKQLHKEKRDLEILDSELLLHQSSEAELYHYLQIAFECLDEKAYRRPTMIQVMAMFKELQMDSETDILDGLSVKNSVIDESL

SEQ ID NO: 86703 - protein, 704 aa, Oryza sativa Japonica Group
MAAAAISHLRRGAPRHARALLYLSTRRFSSSSAAGVAPLAAVAASARRLLSTSVDSGASSTGESYKPPLFDPFRAASLASSAPPLESPPIEELPDDATPPPEEEPGLPAPEKDPVATACQHELEGLKAWVETVRSRKESTEEKEAWSLLGRSVVSYCGTAVGTVAANDPSTANQMLNYDQVFIRDFVPSAIAFLLKGEGDIVKNFLLHTLQLQSWEKTVDCYSPGQGLMPASFKVRSIPLDGNSEAFEEVLDPDFGESAIGRVAPVDSVTDGSCMIDRRMGIHGHPLEIQSLFYSALRCAREMVSVNDGSNSLIRAINYRLSALSFHIREYYWVDMKKINEIYRYKTEEYSHDAINKFNIYPEQIPSWLADWIPEKGGYLIGNLQPAHMDFRFFSLGNLWAIISSLATQRQAEGILNLIEAKWEDIIANMPLKICYPALEYEEWRIITGSDPKNTPWSYHNGGSWPTLLWQFTLACIKMGRRDLAQRAIEVAEKRLSEDKWPEYYDTRTGRFIGKQSRLYQTWTIAGYLSSKMLLDCPELASILICEEDLELLEGCACSVNKSARTKCSRRAARSQLTESPEVMRARHAVQLLHPALFRSKQSWVKLSVVKTRLQSRSEIAPFFFTDAPSLTSLIAPCILCHLKEQEPGGSWNCEVSLAETNKIQARSLALQLDQLNTVVGEQKSIQQNLEDVKKKKLKYANIC

SEQ ID NO: 86704 - protein, 241 aa, Arabidopsis thaliana
KTRKMMLLVMAGKPVDDFIESLLPFLEQGDIIIDGGNSHFPDTNRRTKYLAGKGIRFVGSGVSGGEEGARYGPSLMPGGNEEAWPFIKDVMQSIAAKSDGEPCCEWVGDEGAGHYVKMVHNGIEYGDMQLICEAYDIMKRALNLSNKEIGDVFAKWNSGVLDSFLIEITRDIMYFNDETDGTPLLEKIQDSAGQKGTGKWTAINALDLGMPVTLIAEAVLSRCLSSIKSERTRASKVLQFV

SEQ ID NO: 86705 - protein, 462 aa, Bacillus subtilis subsp. subtilis str. 168
MANKELKRGLGARHIQMIALGGTIGVGLFMGSASTISWTGPSVLLAYAICGIFIFFIMRAMGEMLYVEPSTGSFATFGHQYIHPMAGYITAWSNWFQWIIVGMSEIIAVGSYTKYWFPDLPAWIPGIVAMVILGAANLISVKSFGEFEFWFAMIKIVTIILMIIAGIGIIFFGFGNGGDAIGLSNLWSHGGFFAGGFSGFFFALSLVIAAYQGVELIGITAGEAKDPQNTLRNAIQSIIWRILIFYIGAIFVIVTVYPWDELNSLGSPFVSTFSKIGITAAAGIINFVVITAAMSGCNSGIFSAGRMLYTLGVNGQAPKFFKKISRNGVPLYGTIAVLIGLAVGVVLNYIAPPKIFVYVYSASVLPGMIPWFIILISHIGFRKAKGAALDKHPFKMPFAPFTNYLTIAFLLMVLVGMWFNDDTRISLIVGVIFLALVVISYYVFGIGKRTQANLTKSEQAAE

SEQ ID NO: 86706 - protein, 172 aa, Physcomitrella patens subsp. patens
MAQYGRKQDTEETNCQPPEGPVRCTNNCGFFGSAVTMGMCSKCYRDFVLTQAKTSSAKIAETTPIVSVPKEPVADRALFQSSHFLSAQPEAAGASSGASASGQDPSRPKANRCFSCKKRVGLTGFECRCGNLFCSAHRYSDKHSCTFDYKTAGRDAISKANPVVKADKMNKI

SEQ ID NO: 86707 - protein, 166 aa, Physcomitrella patens subsp. patens
DTECQPPEGPLMCTNSCGFFGSATTLGMCSKCYRDYDSTEAKESSATGAEVVATSSAPRLLVEHSLERTKSDGSYLAAHLPGDQGTSTEVGPSASGQHPCRPQAYRCFLCKKRVGLTGFKCRCGNIFCSLHRCSDKHSCSFDYKTAGRDAIAKANPVVKADKFDKI

SEQ ID NO: 86708 - protein, 148 aa, Azoarcus sp. EbN1
MTTMTVRQILETKGAGAHAVSPGVSVFDALAVMAKHDIGAVLVTENDHLTGIFTERDYARKLVLKGLSSKEATVGELMTPNVCTITPSHTVDEVMNIMTENRFRHLPVVERGKIAGIVTIGDVVKSIIVQQEETISHLSSYIAGDITN

SEQ ID NO: 86709 - protein, 573 aa, Glycine max
MTTSFGPATTSAPLKDHKVQIPSFHGLRSSSASALPRNALSLPSSTRSLSLIRAVSTPAQSETATVKRSKVEIFKEQSNFIRYPLNEDILTDAPNISEAATQLIKFHGSYQQYNREERGSRSYSFMIRTKNPCGKVSNQLYLTMDDLADQFGIGTLRLTTRQTFQLHGVLKKDLKTVMGTIIRNMGSTLGACGDLNRNVLAPAAPLARKDYLFAQQTAENIAALLAPQSGFYYDIWVDGEKILTSEPPEVVQARNDNSHGTNFPDSPEPIYGTQFLPRKFKIAVTVPTDNSVDILTNDIGVVVVTDDDGEPQGFNIYVGGGMGRTHRLETTFPRLAEPIGYVPKEDILYAVKAIVVTQRENGRRDDRKYSRLKYLISSWGIEKFRSVVEQYYGKKFEPFRALPEWEFKSYLGWHEQGDGKLFYGLHVDNGRIGGNMKKTLREVIEKYNLNVRITPNQNIILTDVRAAWKRPITTTLAQAGLLQPRFVDPLNITAMACPAFPLCPLAITEAERGIPNILKRIRDVFDKVGLKYSESVVVRITGCPNGCARPYMAELGLVGDGPNSYQIWLGGTP

SEQ ID NO: 86710 - protein, 275 aa, Physcomitrella patens subsp. patens
YNYNLGTTDWGNLPCSQTCGTGLLQSPINIVPNNLIPRINGDLTRSYTQAIVTAEIFTDGKTPTSLGCRICSIPFVTYTPVQWAKPDVHLIHEAYIFGFQAHQPVVVCASVQVEIVSPLNAGTITVGGITYFLRHFHFHIPSEHTIFGIRQEMELHLVHTSINVTPQRTTVIAVRFTLEEADDTNSFLAQFFPQLPPVTQPVTTRTTIRIQLPFKEIKGAYYRYNGSLTTPPCTEGVNWAVIAKVDLVAKVWEGVPQTSNTASHNAGSNAHSQGT

SEQ ID NO: 86711 - protein, 378 aa, Frankia sp. CcI3
MGTVRRLVIEADGGSRGNPGPAGYGAVVRDAGSGKLLAERADSIGRATNNVAEYSGLIAGLRAAAEIAPDAELEVRMDSKLVVEQMSGRWKVKHPAMRPLVAEATELAARFPAVRFQWVPRARNADADRLANEAMDAAAAGRAWEPAVPQSPDPVPHHAPTTNRLSGWMAPPAPPTTTVLLRHGQTPLSVEKRFSGTVEAALTDVGLGQAAAVANRLRDEPFDLVVSSPLKRARQTAEALGRDYVVVDDLRETDFGAWEGLTFAEVREKFPDELNAWLADPHVPPPGGESLIATVARVARVRDRLLAEQPGGRVLIVSHVTPIKGLAQLALAAEPAVLYRLHLDLVSMTTIDWYSDGPAVLRGFNDTHHLAGQTIYGE

SEQ ID NO: 86712 - protein, 326 aa, Zea mays
MAEEPAVVVASSSYEVDLGNLMAYDPSHHVATASREELRQECLRKGTELAQAVADVLFALPPNEDRDGPIIHLPPPTFRLPREKHLPKPKPPTKWELFAKAKGITKRKKNKREWDEQTQSWKRTHGYDRVNDDKDIPIIEAKLTDEPGVDPFAQRRDEKKKRVEKQEKNRLDNLKKAAKVGALPSHIQLAAKALPITGTKADLPKKSRKEDLESVVGMASSATASGGKFDEKLPGEKPPKHPGKHRKFLPVAEGKGMGSLEKQQNDKILNSLLARNSDEPLDVGKAITMYKVKKEKQRRKEKGMPSKSDKLKPQKKPHKKSSKKRA

SEQ ID NO: 86713 - protein, 418 aa, Emericella nidulans
MSDLQVQGRKVFKVFNQDFIVDDRYTVTKELGQGAYGIVCAATNVQTGEGVAIKKVTNVFSKKILAKRALREIKLLQHFRGHRNITCLYDMDIPRPDNFNETYLYEELMECDLAAIIRSGQPLTDAHYQSFIYQILCGLKYIHSANVLHRDLKPGNLLVNADCELKICDFGLARGFSIDPEENAGYMTEYVATRWYRAPEIMLSFQSYTKAIDVWSVGCILAELLGGRPFFKGRDYVDQLNQILHYLGTPNEETLSRIGSPRAQEYVRNLPFMPKVPFQRLFPNANPDALDLLDRMLAFDPSSRISVEEALEHPYLAIWHDASDEPSCPTTFDFHFEVVDDVQEMRRMIYEEVVRFRQSVRMPPQAQSLAQQQQIGNIPIPEHQQGVWRQEEPRPQEAGAVGGNHNDLESSLQRGMDA

SEQ ID NO: 86714 - protein, 300 aa, Candida albicans SC5314
MSSEVPGKPMKIAGGGNHTMVILDNGEVFSCGSNEFGQCGLPRGESLGVFHKVPGNDWLDISCGWEFSILVKRSGEVYVCGRGLKGELGLGKETPESELIYSTTVDGFKEIKSCMQHTIIQTTNGLVGWGNSRKGQLGETEDKIMWTPKTLRFGVVCKDFSLGREFTAIQTDTNRVKIFGKSSIKNIPESTVARVAAMWSSVHILSETNVLQSFGNNSHEQLFPNNSSVAVEEYAIGSEHGLVTSDNIVYAWGWSEHGNCGTSNASDKVTFDYLNKLYTGSAKVVLIGAGCATSWVVVEK

SEQ ID NO: 86715 - protein, 350 aa, Bacillus clausii KSM-K16
MITDQEIMEALKRIKDRDLNKSIVETGGIRELKNKNGHVSLKVALAKTGTAEQMQVQQEIVNVLKSEGAESVGLRFDTLTEEELDALGGLKEEPFNGPALLAPTSKTTFITVASGKGGVGKSTVSVNTAVSLARLGKKVGIIDADIYGFSVPDMMGIEERPKVINKRIHPVERFGVKVISMGFFVEDNAPVIWRGPMLGKMINQFFSECEWGELDYLILDLPPGTGDVALDLHSMLPGSKELIVTTPHATAAFVAARAGAMAIKTNHEMLGVVENMAYFESKVTGEKEYVFGTGGGERLAEELKTELLAQIPLGQPEIDENDFAPSVYAQEHPIGEIYHRLAERIVEKTE

SEQ ID NO: 86716 - protein, 461 aa, Candida albicans
MAPTSTKNSIKHFDYLVIGGGSGGVASARRAAKYGAKVLLIESNFKKFGGTCVNVGCVPKKVMWYTADLAHKKHDLYAYGLDKEPESIKYGDFDWAKLKHKRDAYVTRLNGIYENNLKREKVDYAYGFAKFINSEGEVEVTLSGDQELPFLDEGKTYKKGEKLVFSADMTLIATGGTAIVPPSVPGAELGTTSDGFFALEKQPKKVAIVGAGYIGVELSGVFSSLGSETHFFIRGDTVLRSFDEVIQNTVTDYYIDNLGINIHKQSTITKIEGSKDGKKVVHLKDGTSVEVDELIWTVGRKSLIDIGLDKVGVKINDKQQIVADEYQVTNNPKIFSLGDVVGKVELTPVAIAAVSSIDIVSDCKIMDIHIHQCILTSRAGLWFITREPLKIRGGNLKYIILNLSPMYYAMMMIKKINHLSSTRSFVSDPEEKVIKMGATKKDFDNCVAIHPTSAEELVTMT

SEQ ID NO: 86717 - protein, 400 aa, Oceanicola granulosus HTCC2516
MQLLSATLDRVKPSPTVAMSGRALELKAAGRDVIGLAAGEPDFDTPPHVAAAGIRAIEEGRTRYTAVDGTAELKRAICAKFARDNGLDYGPAEISVGTGGKQVLYNALMATLNPGDEVVIPAPYWVSYPDMVRLAGATPVIVEAPLSAGFKITPAQLEAAITGRTRWLILNSPSNPTGAAYSEAELKGLTDVLLRHPHVWVLSDDIYEHLVYDGFRFTTPAQVEPRLKARTLTVNGVSKAYAMTGWRIGYAAGPEALIAGMRKVQSQSTSNPCSISQFAALAALEGPHDFLAERNAAFLRRRDMVVARLNEIDGIDCPVPEGAFYVYPSIKGLIGKVSAGGTEIADDEAFAMALLDEAEVAVVFGAAFGLSPAFRISYALADETLAQACDRIARFCAGLR

SEQ ID NO: 86718 - protein, 379 aa, Phytophthora iranica
YRAAVPSGASTGEFEALEMRDGGKDYMGKGVLNAVKNVNEIIAPALIGKDVTKQAEIDRFMVEELDGTQNEWGWCKKKLGANAILGVSLALCRAGAAAKKQPLWQHIADLAGNPTPCLPVPSFNIINGGSHAGNKLAMQEFMILPVGATSFTEAMKIGSEVYHNLKKVIKGRYGLDATAVGDEGGFAPNIQSNGEAIDLIEEAIKAAGYTNQVRLGMDVAASEFYTGTEDARYNLDFKNENAADSEKIPADKLQEVYEGFIAKCAGSSKIVSIEDPFDQDDWESWVKFTGKVGKDVQIVGDDLTVTNPTRVQKAIEQKACNALLLKVNQIGSITESIEAVTMAKKAGWGIMASHRSGETEDTFIADLAVGLSAGQIKTG

SEQ ID NO: 86719 - protein, 388 aa, Phytophthora gonapodyides
ELGEYRAAVPSGASTGEFEALEMRDGGADYMGKGVLNAVKNVNDIIAPALIGKDVTKQEELDRFMVEKLDGTQNEWGWCKKKLGANAILGVSLALCRAGAAAKKQPLWQYIADLAGNPTPCLPVPSFNIINGGSHAGNKLAMQEFMILPVGATSFTEAMKIGSEVYHNLKKVIKGRYGLDATAVGDEGGFAPNIQSNGEAIDLIEEAIKTAGYTNQVRLGMDVAASEFYTGAKDARYNLDFKNENAPESEKIPAEKLQSVYEGFISKCAASSKIVSIEDPFDQDDWESWVKFTGKVGKDVQIVGDDLTVTNPTRVKKAIELKACNALLLKVNQIGSITESIEAVTMAKKAGWAIMASHRSGETEDTFIADLAVGLSAGQIKTGAPCRS

SEQ ID NO: 86720 - protein, 265 aa, Photorhabdus luminescens subsp. laumondii TTO1
MAISIKTSEDIKKMRVAGRLAAEVLEIIEPYVKPGVTTGELDRICHDHITNKQQAVSACLGYHGFPKSVCISVNDVVCHGIPSDDKTLKDGDIVNIDVTVIKEGFHGDTSKMFIVGKPTIQGERLCRITQESLYLALKMVKPGIRLRTLGRAIQQFVEANDFSVVREYCGHGIGAGFHEEPQVLHYDADDSGVVLQKGMAFTIEPMVNTGDYHIRTMKDGWTVKTKDRSLSAQYEHTIVVTDNGCEIMTLRKEEEPALSSVLVNE

SEQ ID NO: 86721 - protein, 327 aa, Streptomyces avermitilis MA-4680
MPDKTFPGILSTVGNTPLVELERLLPDFGSRVFGKIERFNPGGSIKDRSALGMLLAGIRSGEVQPGRTVIIESSSGNLAVGLAQICRYFGLRFICVVDGKTTEQNLAILSAFRAEVEVVTERDELTGEFLPVRLRRVRELVAATPDAYWPNQYASLLNPKAHETTMREIEESLDGAVDFLFCSVSTFGTLRGCRDHIRARGLDTTIVAVDALGSAIFGLESTQRLIPGHGASVVPPLMDASAADEVVHISDLECVVACRRLIGREAVLAGGSSGATVAALWKIRHRIPEGSNCVLIFPDGGDRYLDTIYSDAWVNQNFGDVAHLWKD

SEQ ID NO: 86722 - protein, 390 aa, Phytophthora colocasiae
TEIGEYRAAVPSGASTGEFEALEMRDGGKDYMGKGVLNAVKNVNEIIAPALVGKDVTKQAELDRYMVEQLDGTQNEWGWCKKKLGANAILGVSLALCRGGAAAKKQPLWQYIADLAGNPSPCLPVPSFNIINGGSHAGNKLAMQEFMILPVGATSFTESMKIGSEVYHNLKKVIKGRYGLDATAVGDEGGFAPNIQSNGEAIDLIEEAIKAAGYTNQVRLGMDVAASEFYTGASDARYNLDFKNENAPDSEKIPADKLQEVYEGFIAKCAGSSKIVSIEDPFDQDDWESWVKFTAKVGKDVQIVGDDLTVTNPTRVQKAIEQKACNALLLKVNQIGSITESIEAVTMAKKAGWAIMASHRSGETEDTFIADLAVGLSAGQIKTGAPCRSE

SEQ ID NO: 86723 - protein, 393 aa, Phytophthora idaei
LVTELGEYRAAVPSGASTGEFEALEMRDGGKDYMGKGVLNAVRNVNEIIAPALIGKDVTKQAEIDRFMVEELDGTQNEWGWCKKKLGANAILGVSLALCRAGAAAKKQPLWQHIADLAGNPTPCLPVPSFNIINGGSHAGNKLAMQEFMILPVGATSFTEAMKIGSEVYHNLKKVIKGRYGLDATAVGDEGGFAPNIQSNGEAIDLIEEAIKAAGYTDKVRLGMDVAASEFYTGAEDARYNLDFKNENAADSEKISADKLQEVYEGFIAKCADSSKIVSIEDPFDQDDWESWVKITGKVGKDVQIVGDDLTVTNPTRVKKAIEQKACNALLLKVNQIGSITESIEAVTMAKKAGWGIMASHRSGETEDTFIADLAVGLSAGQIKTGAPCRSER

SEQ ID NO: 86724 - protein, 336 aa, Methanosarcina barkeri str. Fusaro
MKINTWFGNLETARAGEILESRLLSKDVRELALHSLSLRDNKSDLPPEGFDLKNAAIKSGFVESTAEYYSLLHEVTLEAAKLQVSGSLTPDQRIIQAVEALDDINETTNALSERLSEWYGGYFPESGLVGENLALFIVKYGSRENVGSEDPLYSKARNSMGAKLEPADEVLLKGFAENVCSLYERRRQIEAYIENSMELVAPNLKLIAGSMLGARLISLAGSLEKLAEFPSSTIQVIGASKALFKHLRARAPSPKHGIVYSHHLINTAPWWVRGKVARAVASKLSLAARIDFYSGEINPSLTEKLEAKVLQIRTLNPRSPQKRQESGAKPKKRRRK

SEQ ID NO: 86725 - protein, 75 aa, Glycine max
  misc_feature (10)..(10): Xaa can be any naturally occurring amino acid
  misc_feature (39)..(39): Xaa can be any naturally occurring amino acid
  misc_feature (54)..(54): Xaa can be any naturally occurring amino acid
ASSMISSPAXTTVNRAGAGMVAPFTGLKSMACFPTQKTXHDITFIASNRGRMQXLQVLQPICKKNFETFSYFQTL

SEQ ID NO: 86726 - protein, 541 aa, Oryza sativa Japonica Group
MARRLRWHDLVGLGLGGMVGAGVFVTTGRATRLYAGPGVVVSYAIAGLCALLSAFCYTEFAVDMPVAGGAFSYLRVTFGELAAFLTGANLIMEYVFSNAAVARSFTAYLGTAVGVDAPSKWRIAVPGLPKGFNEVDLIAVGVILLISVCICYSTKESSVVNMVLTAVHVAFILFIIVMGFWRGDTRNLTRPVDLAHNPGGFFPHGAAGVFNGAAMVYLSYIGYDAVSTMAEEVERPSRDIPVGVSGSVVLVTLLYCLMAASMSMLLPYDAIDTEAPFSGAFKGSSGWGWVSNVIGAGASLGILTSLMVAMLGQARYLCVIGRSGVMPAWLAKVHPCTATPVNASAFLGVFTAALALFTELDVLLNLVSIGTLFVFYMVANAVVYRRYVAADDDDADHRRAWPTLVFLAAFSLVALCFTLLWQFAPAGRARTGLLAACGAAAVATVGAFRALVAEARRPELWGVPAMPWVPAASVFLNVFLLGSLDRPSYVRFGFFTAAAVLVYVLYSVHASYDAEEGGGAGAGAAALDGAKVQDEAADFKV

SEQ ID NO: 86727 - protein, 379 aa, Phytophthora trifolii
YRAAVPSGASTGEFEALEMRDGGKDYMGKGVLNAVKNVNEIIAPALVGKDVTKQAELDRYMVETLDGTQNEWGWCKKKLGANAILGVSLALCRGGAAAKKQPLWQYIADLAGNPSPCLPVPSFNIINGGSHAGNKLAMQEFMILPVGATSFTEAMKIGSEVYHNLKKVIKGRYGLDATAVGDEGGFAPNIQANAEAIDLIEEAIKAAGYTNQVRLGMDVAASEFYTGVKDARYNLDFKNADAPESEKIPADKLQEMYEGFISKCADSSKIVSIEDPFDQDDWESWVKFTGKVGKDVQIVGDDLTVTNPTRVKKAIELKACNALLLKVNQIGSITESIEAVTMAKKAGWAIMASHRSGETEDTFIADLAVGLSAGQIKTG

SEQ ID NO: 86728 - protein, 185 aa, Aspergillus niger
MSSPKRRIETDVMKMLMSDYEVTLVNDNMQEFYVRFKGPEETPFAGGHWKIHVELPDQYPYKSPSIGFVNRIFHPNIDELSGSVCLDVINQTWSPMYDMINIFEVFLPQLLRYPNPSDPLNGEAAAMLMREPKSYEAKVKEYVAKYASKEAVDEAGEDTESEDELSSAGSYESGGEEPAGTMDDV

SEQ ID NO: 86729 - protein, 380 aa, Oryza sativa Japonica Group
MPPPPPPQPQPTTTATTSANGGKVTPNLTMDAEGTRLLNLTVLQRLDPAVEDILITAAHVTLYDFNIDLNQWSRKDVEGSLFVVKRNTQPRFQFIVMNRRNTDNLVEDLLSDFEYELQPPYLLYRNAAQEVNGIWFYNQHDCEAVASLFGRILNAYAKVPPKPKVPSTKSEFEELEAVPTSAAIDGPLEPSPATTTIVSDAPDESLVNYFSSAASIGSVSNAPMAGRAHPSSESVATPHVPLIIPSATPTHQIPPPLVGSSAPPLPLHDTNVHTARSANLVTPAFFTPPSSSSTSMVPPASSMMPTAPPLHPTSASAQRATYGTPLLQPFPPPTPPPSLTPSYNEGPIISRDKVKEALLRLVQNDQFIDLVYRELQNAHM

SEQ ID NO: 86730 - protein, 356 aa, Hordeum vulgare subsp. vulgare
MGSIAAGADEDACMYALQLVSSSILPMTLKNAIELGLLETLMSAGGKFLTPAEVAAKLPSTANPEAPDMVDRMLRLLASYKVVSCRTEESKDGRLSRRYGAAPVCKYLTPNEDGVSMSALALMNQDKVLMESWYYLKDAVLDGGIPFNKAYGMSAFEYHGTDPRFNRVFNEGMKNHSIIITKKLLESYKGFEGLGTLVDVGGGVGATVGAIIARYPAVKGINFDLPHVISEAPAFPGVTHIGGDMFQKVPSGDAILMKWILHDWSDEHCATLLKNCYDALPAHGKVVLVECILPVNPEATPEVQGVFHVDMIMLAHNPGGRERYEREFEALAKGAGFAAMKTTYIYANAWAIEFTK

SEQ ID NO: 86731 - protein, 163 aa, Azoarcus sp. EbN1
MRHVISLLIENESGALSRVSGLFSARGYNIESLTVAPTEDASMSRMTIVTSGSDDIIEQITKQLNKLVEVIKVVDISESAHIERELMITKVRATGKDRDEMKRMADIFRARVIDVTDTSYVIELTGNQSKLDAFIDAIEPALILEIVRSGVCGIGRGDRILKV

SEQ ID NO: 86732 - protein, 511 aa, Oryza sativa
MRTSDMEFFTEYGEASQYQIQEVVGKGSYGVVAAAVDTHTGERVAIKKINDVFEHVSDAIRILREIKVLRLLRHPDIVVIKHIMLPPTRREFRDIYVVFELMESDLHQVIEANHDLSPEHHRFFLYQLLCALKYIHSANVFHRDLKPKNILANSDCKLKICDFGLARVAFNDSPSTIFWTDYVATRWYRAPELCGSFFSKYTPAIDIWSIGCIFAEILTGRPLFPGRNVVHQLDLITDLLGTPSSETLSRIRNENARGYLTGMQRKHPIPFSHKFHNADPLALRLLERLLAFDPKDRPTAEEALADPYFRGISKLSREPSRLPVSKFEFEFERRKLTKDDVREMIYREILEYHPQMLQEYIRGGEQISFLYPSGVDRFKRQFAHLEENYSRGERSTPLRRQHASLPRERVCSSVDSNNQDSDNEERRAISSIARTMISPPRSQEKGKNRASAYPNGIINLNSNPKIYLKSASISASTCIIRGNKGPKENGISEDMEEVVYELSDNVTRMLS

SEQ ID NO: 86733 - protein, 558 aa, Mycobacterium sp. JLS
MGVERSGDSDTDGDVPGAASDLTRLPDLAHGTPRAGPVRLRYPVYVDLLPPCNDACPAGENIQAWLGHVRAGRHEQAWRRLVADNPFAAIHGRVCYHPCETHCNRGQLDSPVAIHAVERFLGDLATQNRWEFAPPAARSGKRVLVVGAGPSGLSAAYHLALRGHDVEIRDAGPEPGGMMRYGIPSYRLPREVVDAEVDRIAALGVRLTCGHHVEDLAAERDSGDFDAVFVAVGAHLAKRVDIPGRDAGALLDAVTFLRSVAAGQPPELGRHVAVYGGGDTAMDVARVARRLGAEDSVIIYRRTREQMSAHAEETEEAEREGVRINWLRTITAFDRPDLQVEVMDLDEHGQPRPTGRFEKLAADTVIMALGQKTESEFMRTLPGVRFDDDGTVQVSPTLMTGCPGVFAGGDMVPGERTVTVGVGHGKRAARHIDAWLAGLSGERAPRHPPVAFDDLHLWYFGDAPQRPQPHLDAERSVAGFDEVVGGLTEPAAVYEAARCLSCGNCFECDGCYGACPEDAIIKVAEGHHGYEFVYDRCTGCGACFEQCPVHAIEMLPET

SEQ ID NO: 86734 - protein, 815 aa, Alkalilimnicola ehrlichei MLHE-1
MLAELPAPCTATRRQSRNIKGDATLQEYVVNFDTLGMGDVDRVGGKNASLGEMISHLSAAGVSVPGGFATTAKAYWDFLDESGLRERINGLLEPLDIEDVDALVRTGAEIRQLIIDTPFPAALEQAITEAYQKLEAETPGEASFAVRSSATAEDLPDASFAGQQETFLNVRGLDGIMEAVKHVFASLFNDRAISYRVHHGFEHSQVALSAGIQRMVRSDIGAAGVIFTMDTESGFRDVVFITSSYGLGETVVQGAVNPDEFYVHKPTLEAGRPAVLRRNLGSKAIKMVYSGDQTHGKTVATVDVDEAERLQYSLTDDEVQDLARQAMIIEKHYDRPMDIEWGKDGQDGKLYILQARPETVKSRDAGQTLERFHLKARGDVLSTGRAIGQRIGAGPARVVDSINDMNKVKAGDVLVTDMTDPDWEPIMKRASAIVTNRGGRTCHAAIIARELGIPAVVGTGDGTERIKDGHEVTVSCAEGDTGYIYAGKQDYEVRKIALDKLPELPFKIMMNVGNPDRAFDFASLPNAGIGLARLEFIINRMIGIHPKALLEFDQQDENLKQVIRTQAAGYSDPVQFYVDKLAEGISTLAAAFTPKPVIVRLSDFKSNEYANLIGGAQYEPDEENPMLGFRGASRYTADSFRDCFALECKALKKVRDEMGLDNVWVMVPFVRTVEEGKGVLAELEKNGLKKGENGLKVIMMCELPSNALLADEFLEHFDGYSIGSNDLTQLTLGLDRDSSLIAELFDERDEAVKKLLSMAIQSARRAGKYVGICGQGPSDHPDLARWLMDEGIESVSLNPDSVVETWLYLAGEQAQ

SEQ ID NO: 86735 - protein, 414 aa, Xanthomonas oryzae pv. oryzae KACC10331
MNMSAVPHSAAPDWDRVRLDFPLLMRQVHGKPLIYFDNANTGQKPLQVIAATDEFYRRQNANVSRAVHALGSEATDAFEGARSKLARFLNVRADELVLCSGTTFAINLVAYSWALPRLGAGDVILISRMEHHANIVPWQLVAQRTGATIRVAEITPDGALDLDALRKAMTPDVKLLAITHISNVLGTVNPVHDICREARKRGIVTVVDGSQAAPHRRIDVASIGCDFYAITGHKMCGPTGTGVLWARREHLQAMPPFLGGGEMIKEVSFENTVFNDAPHKFEAGTPNIAGFIGLRAAVDYLESVGLAHVEAREAELLAHFTEELQRIDGLRIFGTTPGKAAVVSFLIDGAHSHDLATLLDLEGVAVRSGQHCAHPLLQYYGVAATCRASLAFYNTHDEIERFVAALVKVRRLLG

SEQ ID NO: 86736 - protein, 338 aa, Neisseria meningitidis
MNILVTGGTGFIGSHTVVSLLKSGHQVVILDNLCNSSINILPRLKTITGQEIPFYQGDIRDREILRRIFAENRIDSVIHFAGLKAVGESVAEPIKYYDNNVSGSLVLAEEMARAGVFSIVFSSSATVYGDPGKVPYTEDMPPGDTTSPYGASKSMVERILTDIQKADPRWSMILLRYFNPIGAHESGLIGEQPNGIPNNLLPYICQVASGRLPQLSVFGGDYPTPDGTGMRDYIHVMDLAEGHVAAMQAKSNVAGTHLLNLGSGRASSVLEIIRAFEAASGLTIPFEIKPRRAGDLACFYADPSYTKAQIGWQTQRDLTQMMEDSWRWVSNNPNGYDD

SEQ ID NO: 86737 - protein, 324 aa, Bacteroides fragilis
MKKFTCVQDIGDLKSALAESFEIKKDRFKYVELGRNKTLLMIFFNSSLRTRLSTQKAALNLGMNVIVLDINQGAWKLETERGVIMDGDKPEHLLEAIPVMGCYCDIIGVRSFARFENREYDYNEVIINQFIQHSGRPVFSMEAATRHPLQSFADLITIEEYKKTARPKVVMTWAPHPRPLPQAVPNSFAEWMNATDYEFVITHPEGYELDPKFVGNARVEYDQMKAFEGADFIYAKNWAAYTGDNYGQILSTDRNWTVGDRQMAVTNNAYFMHCLPVRRNMIVTDDVIESPQSIVIPEAANREISATVVLKRLLENLPHHHHHH

SEQ ID NO: 86738 - protein, 672 aa, Neisseria meningitidis
MNKSLSGSVEEYRELTLRGMILGALITVIFTASNVYLGLKVGLTFASSIPAAVISMAVLKFFKGSNILENNMVQTQASAAGTLSTIIFVLPGLLMAGYWSGFPFWQTTLLCIAGGILGVIFTIPLRYAMVVKSDLPYPEGVAAAEILKVGGHEEGDNRQGGSGIKELAAGGALAGLMSFCAGGLRVIADSASYWFKSGTAIFQLPMGFSLALLGAGYLVGLTGGIAILLGISIAWGIAVPYFSSHIPQPSDMEMAAFAMKLWKEKVRFIGAGTIGIAAVWTLLMLLKPMVEGMKMSFKSFGGGAPATERAEQDLSPKAMIFWVLSMMFILGVSFYHFIGDSHITGGMAWLLVVVCTLLASVIGFLVAAACGYMAGLVGSSSSPISGVGIVSIVVISLVLLLVGESGGLMADEANRKFLLALTLFCGSAVICVASISNDNLQDLKTGYLLKATPWRQQVALIIGCIVGALVISPVLELLYEAYGFTGAMPREGMDAAQALAAPQATLMTTIASGIFAHNLEWVYIFTGIAIGAVLIAADLVLKKSSGGKLALPVLAVGMGIYLPPSVNMPIVAGAVLAAVLKHIIGKKAENREGRLKNAERIGTLFSAGLIVGESLIGVIMAFIIAFSVTNGGSDAPLALNLQNWDAAASWLGLAFFVTGMFFFAQRVLKAGR

SEQ ID NO: 86739 - protein, 822 aa, Oryza sativa Japonica Group
MTPLNNLCNFRVKKQYYNPRCLIPAVSLLLFVVILTVSNTYFPFPTTKSRTLSYSSFSSSPGGQKAADEACNIFRGEWVPDPDAPYYTNNTCSVIHEHYDCMKYGKPDLGFVQWRWRPDSCDLPRLDPARFLSSMRGKTLAFIGDSLARNHMNSLICLLTRVAEPTTSWPSSEHTVYHYGGGYNFTVLSFWAPFLVQNELVDADGPAHTGLWNLYLDEPDAVWAPHVPAFDYAVVSASSWFYRPSMLYEAGRLVGCHHCLLPNVTDLTLRYALRMATRAALRAVVGGGGGGGVTAVLRTVSPSQYEGGEWNKDGNCVRTRPYRRGEKTLQGVELDFHTLQVEEFEAAKRAASGGGARMMLMDTTEAMILRADAHPSRYRGWTRRKGWMKEYFTISNDCVHWSMMKFHEVIKLPSIAHYGLRYVLPAAAVAACVLVLATVSLPGRVPLPLLLAPEVMTKTADGVGGDTSGCDIFKGEWVPDMAGEPPPYTSESCPVIHGHYDCMRYGRPDLGYVRWRWRPDGGCELLRFDAARFLAAMRGRSVAFVGDSLARNQMHSLVCLLSHAERPAPWTNGSYAYRFERHGLTVTAFWSPFLVRAVETDPDGPTGSGSGLWSLHLDEPDAGWAAHVGAFDYVVVSAGSWFYRPSMFYDRRGRLVGCNTCLSPNVTDLTLRYSLRMAFRSALRAAATGSHRHATRRTVIVRTISPSHYENGTWNGDGDCLRTRPARRGEWELNAMEKDMHRIQVEEFAAAAEETAGKRGKEAARMLLMDATEAMAQRPDGHPSKYRLWQPDKFKVSRDCVHWCLPGAMDACNDMLFHMLIG

SEQ ID NO: 86740 - protein, 362 aa, Frankia sp. CcI3
MGAQTVEAVVAREKGAAVSLEQIVVPDPGPGEARVRVRACGVCHTDLHYREGAINDDYPFLLGHEAAGTVESVGEGVVGLAPGDYVVLAWRAPCGTCRACRRGMAWYCFDSRNARNPMTLADGTPLAPALGIGAFTPLTLVAAGQCVPVDPAARPEAAGLIGCGVMAGFGAAVNTGRVTRGETVAVIGCGGVGGAAIAGASIAGARKIIAVDVDDRKLTWARRFGATDVVNATADDPVAAIRALTDGFGADVVIDAVGRPETYRQAFDARDLAGRLVLVGVPDPTMTVELPLAEVFGRGGHLSSSWYGDSLPSRDFPILIDLYRRGRLDLDAFVTETIGIGDVEEAFTRMQRGDVLRSVVIL

SEQ ID NO: 86741 - protein, 438 aa, Oryza sativa Japonica Group
MTKKKLQVVRPRAVSPLPALAAAAAVAVVLLLLTAAGRPSFLGRYEAITISGVASLPFGYSSESARRAPPAVAVARVPSDCDIFRGEWVPDDGGGAAPYYTNESCPLIQEHQNCMKYGRPDLGFLRWRWRPERCELPRFDAAAFLELVRGKSMAFVGDSLARNHMQSLMCLLSKVEYPKDVSKTTDPGFRTMHYGSHNFTIAVFWSPYLVTANQSSDPAAGGLWDLYLDEPDAAWAVAVAGFDYAVVSAANWFTRPSMFHERGRLVGCHYCLVPGVPDLTLRYSLRAAFRTALRALAAGAGGAGVFNGTAIVRTLSPTSHFEGGEWNKGGDCRRTRPSTANETRMSGLDLDFHTAQVEEFRRAAMASGRSAARLLLMDTTAAMVLRPDGHPSRYGHWAHEKVTLYNDCVHWCLPGPIDVWNEMLLQMLLLHQPGAVSV

SEQ ID NO: 86742 - protein, 222 aa, Medicago sativa
MAASITAITVENLEYPAVVTSPVTGKSYFLGGAGERGLTIEGNFIKFTAIGVYLEDIAVASLAAKWKGKSSEELLETLDFYRDIISGPFEKLIRGSKIRELSGPEFSRKVMENCVAHLKSVGTYGDAEAEAMQKFAEAFKPVNFPPGASVFYRQSPDGILGLSFSPDTSIPEKEAALIENKAVSSAVLETMIGEHAVSPDLKRCLAARLPALLNEGAFKIGN

SEQ ID NO: 86743 - protein, 391 aa, Phytophthora tentaculata
VTELGEYRAAVPSGASTGEFEALEMRDGGKDYMGKGVLNAVKNVNEIIAPALIGRDVTKQAEIDRFMVEELDGTQNEWGWCKKKLGANAILGVSLALCRAGAAAKKQPLWQHIADLAGNPTPCLPVPSFNIINGGSHAGNKLAMQEFMILPVGATSFTEAMKIGSEVYHNLKKVIKGRYGLDATAVGDEGGFAPNIQSNGEAIDLIEEAIKAAGYTNQVRLGMDVAASEFYTGAEDARYNLDFKNENAADSEKISADKLQEVYEGFIAKCAGSSKIVSIEDPFDQDDWDSWVKFTGKVGNDVQIVGDDLTVTNPTRVMKAIEQKACNALLLKVNQIGSITESIEAVTMAKKAGWGIMASHRSGETEDTFIADLAVGLSAGQIKTGAPCRSE

SEQ ID NO: 86744 - protein, 259 aa, Silicibacter sp. TM1040
MGANPLRQSLLQEVRDLFAQEPALRGLYGYDPDQVGTVPALFAAVLSSSSPDPKLRDLVRDLALKVFETGSELVEVILDDLLATTARDEAESAAQVLHSAHGFQALMSYRLTRALWLDGRQTLALALKLQFTRVFSVEIWPQAQIGRGVWVDHGLGLVIGQAAVIEDDVCLWHGVTLGSNFVDMGEARHPTLRRGVVVGAGATLLGPIEIGAGATIAAGAVVTRDVPAGHVVAGPPASDRGVGRFAGFTPLQQLRGQDR

SEQ ID NO: 86745 - protein, 393 aa, Phytophthora boehmeriae
LKTETGLYTAAVPSGASTGEFEALEMRDGGSAYMGKGVLNAVKNVNEIIAPALVGKDVTQQAELDKFMVETLDGTQNEWGWCKKKLGANAILGVSLALCRAGAAAKKQPLWQYIADLAGNPTPCLPVPSFNIINGGSHAGNKLAMQEFMILPVGATSFTEAMQIGSEVYHNLKKVIKGRYGLDATAVGDEGGFAPNIQSNGEAIDLIEEAIKAAGYTDKVKLGMDVAASEFYTGASDARYNLDFKNENAPESEKISAAKLTEVYEGFIAKCKNTSAIVSIEDPFDQDDWESWINFTSKVGKDVQIVGDDLTVTNPTRVQKAIDTKACNALLLKVNQIGSITESIEAVTMAKKAGWGIMTSHRSGETEDTFIADLAVGLSAGQIKTGAPCRSER

SEQ ID NO: 86746 - protein, 409 aa, Corynebacterium glutamicum ATCC 13032
MVKGVKGRPNVLAIVLAGGEGKRLFPLTEDRAKPAVPFGGTYRLIDFVLSNLVNSGFLKIAVLTQYKSHSLDRHISLSWNVSGPTGQYIASVPAQQRLGKRWFTGSADAILQSLNLISDEKPDYVIVFGADHVYRMDPSQMLDEHIASGRAVSVAGIRVPREEATAFGCIQSDVDGNITEFLEKPADPPGTPDDPDMTYASMGNYIFTTEALIQALKDDENNENSDHDMGGDIIPYFVSRNDAHVYDFSGNIVPGATERDKGYWRDVGTIDAFYECHMDLISVHPIFNLYNSEWPIHTTSEGNLPPAKFVRGGIAQSSMVSSGSIISAGTVRNSVLSNNVVVEEGATVEGAVLMPGVRIGKGAVVRHAILDKNVVVRDGELIGVDQVRDAQRFKVSAGGVVVVGKNQVV

SEQ ID NO: 86747 - protein, 295 aa, Frankia sp. EAN1pec
MSTRTHITLNNGVEMPALGLGVFQTPPEETRSAVETALSAGYRHIDTAAAYGNERQVGEAVLKSGVDRTDVFLETKIWISDYGYDQTLHGFEKSARKLGVDQIDLLILHQALPSEFDRTLEAYRALEALLADGKVRAIGVSNFMVEHLTALLERASVVPAVNQIEVHPYFTQREVQAIDTKHGILTQAWSPIGGITFYRAGSHGSTLRDPAIGEIAQAHGRTPAQVMLRWHLQQGRSAIPKSTRPERIAENFDVFDFELTDKQLAVIDGLDTGRRGGPEPSDITLATFSKAIPEA

SEQ ID NO: 86748 - protein, 392 aa, Phytophthora humicola
LVTELGEYRAAVPSGASTGEFEALEMRDGGADYMGKGVLNAVKNVNDIIAPALIGKDVTKQAELDRYMVEQLDGTQNEWGWCKKKLGANAILGVSLALCRAGAAAKKQPLWQYIADLAGNPTPCLPVPSFNIINGGSHAGNKLAMQEFMILPVGATSFTQAMKIGSEVYHNLKKVIKGRYGLDATAVGDEGGFAPNIQSNGEAIDLIEEAIKAAGYTNQVRLGMDVAASEFYTGAKDARYNLDFKNENAPESEKIPAEKLQSVYEGFISKCAGSSKIVSIEDPFDQDDWESWVKFTGKVGKDVQIVGDDLTVTNPTRVKKAIELKACNALLLKVNQIGSITESIEAVTMAKKAGWAIMASHRSGETEDTFIASLAVGLSAGQIKTGAPCRSE

SEQ ID NO: 86749 - protein, 305 aa, Aspergillus nidulans FGSC A4
MEDAHAAVLDLQAKQSGSNDQPTDPDRRLAFFGVYDGHGGDKVALFAGENVHKIVAKQETFLKGDIEQALKDGFLATDRAILEDPKYEEEVSGCTAAVSIISKKKIWVANAGDSRSVLGVKGRAKPLSFDHKPQNEGEKARISAAGGFVDFGRVNGNLALSRAIGDFEFKKSPELSPEQQIVTAYPDVTVHELTEDDEFLVIACDGIWDCQSSQAVVEFVRRGIAAKQDLYRICENMMDNCLASNSETGGVGCDNMTMVIIGLLNGKTKEEWYNQIAERVANGDGPCAPPEYGKSLEEPTASNPY

SEQ ID NO: 86750 - protein, 304 aa, Silicibacter sp. TM1040
MVATQNKRAGVIGLGAMGLGMARSLLKAGFAVSGYDPAETARENAAAAGVWLTADTDAVFADCDVIVLSLPTAQHVLAVVQAAQAAGHLAQTGAARVIVDTSTSEAATSRTLAAELSALGHGFLDAPVSGGPAGAASGQLSVMLGGETQWLEAARPALEAMAAKILHVGPSGAGNVAKLVNNMLVANHMVTTLEALRLGEAAGVAAKEMLEVVNSATGRSAISEVHYPNWVLPRSFDSGFSAGLMRKDLRLARALAAEVSVATPMADRVAELWAETQSGLSDSDDFMRMGDPQVDRLSAKEEQA

SEQ ID NO: 86751 - protein, 511 aa, Silicibacter sp. TM1040
MTKEMIDITGRVATLLRDLTGTSEVRSYVGGELVQGSGAELELTDPASGVVFARYRDAGPDVVARAAEAAQVAQKIWYAKTASERGRILFEIGRQIRQHAAALSELEALSSGRPMRDTGGEPARMAEMFEYYAGWCDKITGDVIPVPSSHLNYTRQEPLGVVAQITPWNAPLFTCCWQVAPAICAGNAVMIKPSELTPLTSVVIGILCEKAGAPKGLVNVIAGDGPGSGQAMIAHPETALVVFVGSAEAGSKIAAAAAKRLIPSVLELGGKSANIVFDDADIDRAVVGAQAAIFASCGQSCVAGSRLLVHRSVQTEVVEKLSAAAARIPVGDPMDPATQVGPVNNLRQWNKIDTMVQAATRAGASVASGGGKPAALAASGGFFYAPTVLDAVTPQMEIANEEVFGPVVSVLPFDDEEEAIQLANATPYGLAGAVWTRDVGRAHRVAGAVRAGTFWINSYKTINVMSPFGGFGRSGYGRSSGREALSAYTQTKSVWVETAENPAQGFGYAPG

SEQ ID NO: 86752 - protein, 392 aa, Phytophthora insolita
  misc_feature (31)..(31): Xaa can be any naturally occurring amino acid
  misc_feature (246)..(246): Xaa can be any naturally occurring amino acid
  misc_feature (250)..(250): Xaa can be any naturally occurring amino acid
  misc_feature (255)..(255): Xaa can be any naturally occurring amino acid
  misc_feature (257)..(257): Xaa can be any naturally occurring amino acid
  misc_feature (293)..(293): Xaa can be any naturally occurring amino acid
  misc_feature (322)..(322): Xaa can be any naturally occurring amino acid
  misc_feature (358)..(358): Xaa can be any naturally occurring amino acid
DTETGMYRAAVPSGASTGEFEALEMRDGGAXYMGKGVLNAVKNVNEIIAPALVGKDVTKQAEIDRYMVETLDGTQNEWGWCKKKLGANAILGVSLALCRAGAAAKKQPLWQYIADLAGNPTPCLPVPSFNIINGGSHAGNKLAMQEFMILPVGATSFTEAMKIGSEVYHNLKKVIKGRYGLDATAVGDEGGFAPNIQSNGEAIDLIEEAIKAAGYTDKVKLGMDVAASEFYTGAKDARYNLDFKNXNAPXSEKIXAXKLTEVYEGFIAKCKBSSNIVSIEDPFDQDDWESWVXFTSKVGKDVQIVGDDLTVTNPTRVKKAIXLKACNALLLKVNQIGSITESIEAVTMAKKAGWAIMXSHRSGETEDTFIADLAVGLSAGQIKTGAPCRSER

SEQ ID NO: 86753 - protein, 107 aa, Physcomitrella patens subsp. patens
WNSSRAVKYRLIYQITGLNGTSVNVLAMVFGSMRASSSIGVFFTRNPSTGEKKPYGESIVMRMPGEDVVAGIRTPEDIDTVKYVPLHTYKELRENCDILEAHYKEMM

SEQ ID NO: 86754 - protein, 393 aa, Phytophthora andina
  misc_feature (71)..(71): Xaa can be any naturally occurring amino acid
LVTELGEYRAAVPSGASTGEFEALEMRDGGKDYMGKGVLNAVKNVNEIIAPALIGKDVTKQAEIDRFMVEXLDGTQNEWGWCKKKLGANAILGVSLALCRAGAAAKKQPLWQHIADLAGNPTPCLPVPSFNIINGGSHAGNKLAMQEFMILPVGAKNFTEAMKIGSEVYHNLKKVIKGRYGLDATAVGDEGGFAPNIQSNGEAIDLIEEAIKAAGYTNQVRLGMDVAASEFYTGAEDARYNLDFKNENAAESEKIPADKLLEVYEGFIAKCADSSKIVSIEDPFDQDDWESWVKITGKVGKDVQIVGDDLTVTNPTRVKKAIEQKACNALLLKVNQIGSITESIEAVTMAKKAGWGIMASHRSGETEDTFIADLAVGLSAGQIKTGAPCRSER

SEQ ID NO: 86755 - protein, 226 aa, Streptomyces ansochromogenes
MTAPTAPSTDTYLGTNVRLLPQTDQLRALHTVIRDRDARREDFVRYSRRIIRLLIEAGMDLLPFEPHEVRTPTGAAYQGLRFASGLCGVTVVRAGESMEGELRDVCPGIRIGKILIQRDETTKEARLYYTSLPADIARRHVLLLDPVMATGGTALAALRVLTDLGVPEENIVFVNFITVPEGITTVCEQYPRVRIVTSAIEERLTEDAWMLPGIGDFGDRYFGTDD

SEQ ID NO: 86756 - protein, 517 aa, Lactococcus lactis subsp. lactis Il1403
MSILNVKNLSHGFGDRAIFEDVSFRLLKGEHIGFVGANGEGKSTFMNIITGTLVPDEGKVIWSKKHRVGYMDQHAVLGKGKTTREALAEAFQYLFDIEAQINDTYMKMAEMSEDEMNAALENVGELQEELDNSDFYLIDAKVEETARGLGLTPLLDKDVAELSGGQRTKILLGKLLLEKPDILLLDEPTNYLDEEHILWLKNYLKNYENAFILISHDVPFMDEVVNIIYHVHGLGITRYSMGYAEFERVFEEKKAQLESLHNAQVAEQAKLKDFIARKKANVATSGQAKAREKKLAKMEIVETISEKPKPHFDFKFSRKPSRLVFEAKDLVIGYNEPLSSEINLKVESGQKIAFIGSNGIGKSTLLKSLMGLIPSLDGEVEKGNFQDIAYYEQEIKNPSQKTVLDDLWDEYPSWNQAELRGALARVGLTAKQIESRVYVLSGGEQAKLRFAKLMNTESNILILDEPTNHLDVDAKEELKRALIEYPGTVLMVSHEPEFYEGLVSDVINCEEWTTRIL

SEQ ID NO: 86757 - protein, 354 aa, Physcomitrella patens subsp. patens
CDLFEGSWVPDTRPPQYTNSTCKFIQGHQDCMKNGRPDTGYLHWKWQPYKCDLPRIDARAFLSTMRGRSVVFAGDSISRNQFQSLLCILSQAEMPFLKYQSPDDKNVAYVFPSTNFTFTIRWSPYLVHVEEKQVTRSDNETITVPYIHIDELDKSWADYAPGADILQLSTGQWWFKPGLFLQGGQPIGGHTCDGWETECKEIGFSDAYRTAIRNVLQGILSIPGFTGSVVFRSFSPDHFENGRWDNGGECVRTTPGGVAMHYVTKWMLDIQKEAFKNVTGTLNAADKLRIKMLNVTNIAQFRADAHPNVYRTFQPYSKEHQGFVQKDCLHWCLPGSIDTWNDLLVQSLQDVIHR

SEQ ID NO: 86758 - protein, 162 aa, Triticum aestivum
MLPGCSPAGLPSALYRPLHEPLPQQPRCGRKYMFFLQTNVATPIVITAAAPGKGGGVLDRPAEKVSPGRQSEFDKKKSRKMSPPFRVVLHNDNENRREYVVQVLMKVIPGMTVDNAVNIMQEAHVNGMAVVIVCSQPEAEEHCTALRGNGLRSSIEPASGGC

SEQ ID NO: 86759 - protein, 263 aa, Oryza sativa Japonica Group
MTKIVGTLGPKSRAVDTISSCLKAGMSVARFDFSWGDAEYHQETLENLKLAIKSTKKLCAVMLDTVGPELQVVNKSEAAISLEANGTVVLTPDQGQEASSELLPINFSGLAKALKPGATIFVGQYLFTGSETTSVWLEVSEVKGDDVVCVIKNSATLAGSLFTLHCSQIHIDLPTLSDEDKEVIRRWGAPNKIDFLSLSYTRHAEDVRQAREFLSKLGDLSQTQIFAKIENVEGLNHFDEILQEADGIILSRGNLGIDLPPEK

SEQ ID NO: 86760 - protein, 212 aa, Bordetella petrii
MTEIWFIRHGETSWNREGRLQGWQDIDLNAAGREQAAQLAARIGAAGQAFGALYSSDLRRAYATAEPLSAGLGLRLRSEPGLRERSYGVLEGLDLGRIDELAPEAAAARKSRDPHRPLEGGESLGQFQARIIATVDDLAARHSGECILAVTHGGVLDIIWRHACGVTLDGERAVPLLNASINRIGVEGRRWQVLEWGDVGHLDAESASDVVP

SEQ ID NO: 86761 - protein, 268 aa, Bordetella petrii
MQAIAARSGGRFHDIAMTSVFITGASSGLGRALAWRYARSGARLGLVARRGEALRALADELPGDHHCYAVDVCDRAALHAAAGDFLARSGGRVDVVVASAGISVGTLTEHTEDFEVFKAIVDTNLLATVATFEPFIEPMRQARAGRLVGIASVAGIRGLPGAGAYSASKAAVISYCESLRLELAHAGIRVVTIAPGYIKTAMTAHNPYSMPFLMEADAFAARAQVAIERGVSYTVIPWQMGIVARLMRLLPNTIYDRAARNAPRKPRR

SEQ ID NO: 86762 - protein, 229 aa, Zea mays
PFRPPTRPPTRPRTRGIFPLKYREGGVLKRAGHTEASVDLAMLAGLPPVAPLCERRKRDRLIERAFVARLPLKWGNVHAYCYKSVIDGIEHIGMMKGDIGDSQDILVRVHSECLTGDIFGSARCDCGDQLAMAMEMIEKAGRGVLVYLRGHEGRGIGLGPKLRAYNLQDDGRDTVEANEELGLPVDSQEYGIGAQVRLDYLSSYRGTFLHNTSFLLKSACIGKLYHISF

SEQ ID NO: 86763 - protein, 222 aa, Medicago sativa
MAASITAITVENLEYPAVVTSPVTGKSYFLGGAGERGLTIEGNFIKFAAIGVYLEDIAVASLAAKWKGKSSEELLETLDFYRDIISGPFEKLIRGSKIRELSGPEYSRKVMENCVAHLKSVGTYGDAEAEAMQKFAEAFKPVNFPPGASVFYRQSPDGILGLSFSPDTSIPEKEAALIENKAVSSAVLETMIGEHAVSPDLKRCLAARLPALLNEGAFKIGN

SEQ ID NO: 86764 - protein, 650 aa, Listeria monocytogenes str. 1/2a F6854
MILLQVQQISKFFGAEVILDNIKLEVKTGDRIALVGRNGAGKSTLLKIIAGKMSYDGGTISKPKSVEIGYLAQNTGLESSKTIWDEMLSVFDSLRKMEADLRKMELRLGEPELYNDPEKYQALMTDYDTLQHTFKESGGYTYEAEIRSVLNGLRFYPEDYEVEIASLSGGQKTRLALAKLLLAKQDILVLDEPTNHLDIETLAWLETYLQNYHGSLLIVSHDRYFLDKVVNQVYEISRTKIDYYKGNYSSFVNQKQAKLEQMWKEFDKQQKQIAKLEDFVARNIVRASTTKRAQSRRKQLEKMDVLGRPQGDEKAAHFGFQFEKQTGKDVLMVDQLSIGYAKDKRIASNLTFEMKRQDSLALVGPNGIGKSTLLKTLIRDIPALSGEFHFGAGVKIGYYDQEQAKLTSNKTVLMELWDDYPELNEVNVRTTLGNFLFSDDDVLKNVQSLSGGEKARLALAKLTLLEANVLILDEPTNHLDIESKEVLEAALIDFEGTILFVSHDRYFINRIASKIVELAPEKATVFLGDYDYYQEKLAEEKELARLDAEDRRKKGEQVEATASVRKLNYQEEKEQQKLLRQRKRKLEEIEKSMEETDEKIAELELQLTNPEVFQDHEKSLEITQELDAVKADGEKLMEEWEQISEELESI

SEQ ID NO: 86765 - protein, 298 aa, Xanthomonas oryzae pv. oryzae KACC10331
MSPHQSLVKGAAMTTPVASTPSSSSSDVARIAFVGGGNMARSLIAGLIRQGMPAASIRVAEPVAELRDALARDFGVQVVEDARTAVDAAATWVLAVKPQVLPTVCAQLAELAQAQQPLLVSIAAGITATQLQRWSGGDIAVVRAMPNTPALLGAGVTGLYANARVSDPQRQQATRLLDSAGVTVWIDDEAQMDAVTAVSGSGPAYVFLLAEAMEAAAQAQGLPAETARTLVLQTLLGAARMLTESGEAPDVLRRRVTSPNGTTHAAIETFQAGGFEALTANAIAAATERGRSLSAAND

SEQ ID NO: 86766 - protein, 384 aa, Bordetella petrii
MLPQLFPEGANRFPPAILALADGTIFRGVSIGAPGHTVAEVVFNTAMTGYQEILTDPSYNGQIVTLTYPHIGNTGVNTEDVETARVLASGLVVRDCPSRVSNFRATQSLPEYLAAQGVVAIADVDTRKLTRILRDGGAQGACILVGDDAERAVELARGYAGMNGLDLAKVVSIKAAQDWSQGTWQLGKGFSAPAQDRFHVVAYDFGVKYNILRLMADRGCRITLVPAQTPAEDVLKLNPDGVFLANGPGDPEPCDYAIAATKVFLERKLPTFGICLGHQIMGLAVGGKTVKMKTGHHGANHPVQDVDSKRVFITSQNHGFGVDAASLPANARVTHISLFDGTLQGFELTDRPAFCFQGHPEASPGPHDIIVLFDKFISLMAGQK

SEQ ID NO: 86767 - protein, 492 aa, Sorghum bicolor
MDLADIPQQQRLMAGLALVVATVIFLKLLLSFRSGGGKKRLPPTIPGAPVVGGLVKFMRGPIPMIREQYAALGSVFTVPIITRRITFLIGPEVSAHFFKGNEAEMSQQEVYRFNVPTFGPGVVFDVDYSVRQEQFRFFTEALRANKLRSYVDQMVAEAEEYFSKWGESGTVDLKYELEHLIILTASRCLLGREVREKLFDDVSALFHDLDNGIQPISVLFPYLPIPAHKRRDKARARLAEIFATIIKSRKASGQSEEDMLQCFIDSKYKNGRPTTEGEVTGLLIAALFAGQHTSSITSTWTGAYMLRFKQYFAEAVEEQKDVMKRHGDKIDHDILAEMDVLYRCIKEALRLHPPLIMLLRQSHSDFTVTTKEGKEYDIPKGHIVATSPSFANRLPHIYKNPDSYDPDRFGPGREEDKAAGAFSYISFGGGRHGCLGEPFAYLQIKAIWTHLLRNFEFELVSPFPENDWNAMVVGIKGEVMVNYKRRKLVVDN

SEQ ID NO: 86768 - protein, 828 aa, Frankia sp. CcI3
MAGGEGTRLRPLTANLPKPLLPVVNRPIMEHVLRLLKRHGFDETVVTVQFLASMIRTYFGSGDELGMHLSYATETTPLGTAGSVKNAEDALRDEAFLVISGDALTDIDLTDLVAFHRRQGALVTVALKSVPDPLEFGIVITGEDGRIQRFLEKPTWGQVFSDTVNTGIYVMEPEVLAQVPPGEAVDWSGDIFPRLVEAGAPVYGYVASGYWEDVGTIASFQRAQADVLNRQVDVEIGGFEVSPGVWIGEDAEVHPEAILKGPLVVGDYSKVEAGAELREFSVLGSNVLVKSGAFLHRAIVQDNALIGPQTNLRGCVIGKSTDVLRAARIEEGAVVGDECVVREEAFVSHDVKVYPFKTIEAGAVVNTSVIWESRGQRTLFGPRGVSGLVNAEITPELVVRLAGAYATTLKKGATVTTARDGSRAARALKRAVISALTAGAINVRDLEVAPMPVTRFDVRSSNAAGGIMLRTTPGDPERIDIIFLDADGDDLSPVAQRKLDRVFSRQEFRRAFPGEIGDLRFPARTMDLYIQDLLDRVDTAGVAEADLKIVVDSSGGSASLVLPTLLGRLGVDVLTVNGRVDETIPPRSALEDLRATDRLGALVASSGAAFGVRFDHVGERVTIVDERGDLIDDDRALLVFLDLVAAENPGAEVALPVTITRVADQVTRFHGLTVRRTSLSAAALTGVARDDGIVFAADGRGGFIVPEFAPAIDGIAAFVKLLALVARTRLTLSTIDARIPSVAILRRSVPTPWAVKGTVMRRVVESVDPDTGYVIDTTDGVRIVGPDGSWILVLPDPSEAVTHLWSEGADIEEAHVLLRRWVEVVEAR

SEQ ID NO: 86769 - protein, 375 aa, Corynebacterium glutamicum ATCC 13032
MMTQVTESAVRSALSRVEDPEIGKPITELGMVKSVSIDGSDVQVEVYLTIAACPMKTTIVTNTEAALKDIDGVGQVHVTTDVMSDEQRRALRVSLRGETSEPVIPFAQPGSTTRVYAVASGKGGVGKSSMTVNLAAALAKRGLSVGILDADIYGHSVPGMLGSDQRPHQVDDMIMPPQAHGVKMISIAHFTEGNAPVVWRGPMLHRAIQQFLTDVFWGDLDILLLDLPPGTGDIAITVAQLIPNAELLIVTTPQAAAAEVAERAGTISVQTNQKVAGVIENMSAMVLPDGTTMDVFGTGGGQKIADRLTAVTGEEVKVIGSVPLDPNLRIGGDVGNPIAISEPHSPTAAAINEIAEHLAHRKVSLVGKTLGLGVK

SEQ ID NO: 86770 - protein, 207 aa, Triticum aestivum
QLLESMVEYPTPTRAEVADVSEAVRQYADAIMLSAESAIGAFPEKALSVLRAASERMESWSREENMQSLLPQYQLAIALPDRISEQICTSAVEMANNLAVDAIFVYTKHGHMASLLSRNRPNPPIFAFTDDSNTRKSMNLYWGVIPLQLPLSNSMDDNFKQTIKLLKSKGSVKPGDSVLVVADSDLNQPCAAATSSVYQSIQVRLVD

SEQ ID NO: 86771 - protein, 329 aa, Phytophthora andina
  misc_feature (166)..(166): Xaa can be any naturally occurring amino acid
LVTELGEYRAAVPSGASTGEFEALEMRDGGKDYMGKGVLNAVKNVNEIIAPALIGKDVTKQAEIDRFMVEKLDGTQNEWGWCKKKLGANAILGVSLALCRAGAAAKKQPLWQHIADLAGNPTPCLPVPSFNIINGGSHAGNKLAMQEFMILPVGAKNFTEAMKIGXEVYHNLKKVIKGRYGLDATAVGDEGGFAPNIQSNGEAIDLIEEAIKAAGYTNQVRLGMDVAASEFYTGAEDARYNLDFKNENAAESEKIPADKLLEVYEGFIAKCADSSKIVSIEDPFDQDDWESWVKITSKVGKDVQIVGDDLTVTNPTRVKKAIEQKACNA

SEQ ID NO: 86772 - protein, 396 aa, Escherichia coli O157:H7 EDL933
MFENITAAPADPILGLADLFRADERPGKINLGIGVYKDETGKTPVLTSVKKAEQYLLENETTKNYLGIDGIPEFGRCTQELLFGKGSALINDKRARTAQTPGGTGALRIAADFLAKNTSVKRVWVSNPSWPNHKSVFNSADLEVREYAYYDAENHTLDFDALINSLNEAQAGDVVLFHGCCHNPTGIDPTLEQWQTLAQLSVEKGWLPLFDFAYQGFARGLEEDAEGLRAFAAMHKELIVASSYSKNFGLYNERVGACTLVAADSETVDRAFSQMKAAIRANYSNPPAHGASVVATILSNDALRAIWEQELTDMRQRIQRMRQLFVNTLQEKGANRDFSFIIKQNGMFSFSGLTKEQVLRLREEFGVYAVASGRVNVAGMTPDNMAPLCEAIVAVL

SEQ ID NO: 86773 - protein, 332 aa, Silicibacter sp. TM1040
MTVYAVNGLGRMGKLALNPLLERGAQIAWINDAVGDAEMHAHLLEFDTVHGRWDAEFTCDAESITIDGTRLPVLNKTNLADLPLDGVDVVIDCTGVFKTDAKLAPYFEAGVKKVVVSAPVKDGDAANIVMGVNHDIYDPSRHRIVTAASCTTNCLAPVVKVLHEGIGIKHGSMTTIHDVTNTQTIVDRPAKDLRRARSALNSLIPTTTGSATAITLIYPELEGKLNGHAVRVPLLNASLTDCVFEVARDTTVEEVNAFFKEAANGALDGILGYELRPLVSADYTNDTRSSIVDAPSTMVVNGTQVKIYAWYDNEMGYAHRLVDVAMMVGESL

SEQ ID NO: 86774 - protein, 384 aa, Phytophthora insolita
  misc_feature (239)..(239): Xaa can be any naturally occurring amino acid
  misc_feature (243)..(243): Xaa can be any naturally occurring amino acid
  misc_feature (248)..(248): Xaa can be any naturally occurring amino acid
  misc_feature (286)..(286): Xaa can be any naturally occurring amino acid
  misc_feature (315)..(315): Xaa can be any naturally occurring amino acid
  misc_feature (351)..(351): Xaa can be any naturally occurring amino acid
RAAVPSGASTGEFEALEMRDGGADYMGKGVLNAVKNVNEIIAPALVGKDVTKQAEIDRYMVETLDGTQNEWGWCKKKLGANAILGVSLALCRAGAAAKKQPLWQYIADLAGNPTPCLPVPSFNIINGGSHAGNKLAMQEFMILPVGATSFTEAMKIGSEVYHNLKKVIKGRYGLDATAVGDEGGFAPNIQSNGEAIDLIEEAIKAAGYTDKVKLGMDVAASEFYTGAKDARYNLDFKNXNAPXSEKIXAPKLTEVYEGFIAKCKBSSNIVSIEDPFDQDDWESWVXFTSKVGKDVQIVGDDLTVTNPTRVKKAIXLKACNALLLKVNQIGSITESIEAVTMAKKAGWAIMXSHRSGETEDTFIADLAVGLSAGQIKTGAPCRSE

SEQ ID NO: 86775 - protein, 389 aa, Phytophthora glovera
IGEYRAAVPSGASTGEFEALEMRDGGKDYMGKGVLNAVKNVNEIIAPALVGKDVTKQAELDRFMVEQLDGTQNEWGWCKKKLGANAILGVSLALCRGGAAAKKQPLWQYIADLAGNPSPCLPVPSFNIINGGSHAGNKLAMQEFMILPVGATSFTESMKIGSEVYHNLKKVIKGRYGLDATAVGDEGGFAPNIQSNGEAIDLIEEAIKAAGYTNQVRLGMDVAASEFYTGASDARYNLDFKNENAPESEKIPADKLQEVYEGFIAKCADSSKIVSIEDPFDQDDWASWVKFTAKVGKDVQIVGDDLTVTNPTRVKKAIEQKACNALLLKVNQIGSITESIEAVTMAKKAGWAIMASHRSGETEDTFIADLAVGLSAGQIKTGAPCRSER

SEQ ID NO: 86776 - protein, 634 aa, Glycine max
TSIEVVLFDRHEDYRLKELQDKAQELYSASENALVLVEKLGKLVAICMGGSFPVEQGDLHKRWKLVSKRLRNFHQCVVLPVGSLSSGLCRHRAILFKRLADYIGLPCRIARGCRYCVSDHRSSCLVKIKDDRQLSREYVVDLVGEPGNIHGPDSSINGAYVSSIPSPFQISHLKESQSPYVDVAACSQSLGCVQVDCVQEDQQAEETDLQKNNNGSIYPAIDQTRGGAEPPLIPFGLKGNHKECAILGLLNFPPVYEGVSEDLHPATEASLHEYPRLSKDSVVVLEASNKEIEIIVKGSSGVKSNYKQSTVSLSSESKQEQEHVKNKVENQGAGNIPRYLNLEPSLAMDWLEIPWDDLRIKERVGAGSFGTVYRAEWHGSFNLQDVAVKVLTVQDFQDDQLKEFLREVAIMKRVRHPNVVLFMGAVTKRPHLSIVTEYLPRGSLFRLIHKPASGEILDPRRRLRMALDVAKGINYLHCLKPPIVHWDLKTPNLLVDRNWTVKVCDFGLSRFKANTFLSSKSVAGTPEWMAPEFLRGEPSNEKSDVYSFGVILWELVTLQQPWNGLSHAQVVGAVAFQNRRLAIPPNISPALASLMESCWADNPADRPSFGSIVESLKKLLKSPADAIKMGGAIT

SEQ ID NO: 86777 - protein, 200 aa, Agrobacterium tumefaciens str. C58
MSVFKKIYFALSAFIVAPHIFLLMSSRHDNPIFRDIEVWSEKLLGKKISGRSGLVASVVELLSLAPEFRNLFYYRVPRARFFKFLSRPENTLHIHTRTIGPGFFIQHGFATIISAESIGADCWINQQVTIGYVDSTGAPKIGDNVTINAGAKVLGNIVIGDNAKVGANAVVVKNIPADCVVVGVPARIIRRAGARVDEAL

SEQ ID NO: 86778 - protein, 126 aa, Thermobifida fusca YX
MTETFEPLDRIAIRGLRARGRHGVFDFERHEGQEFVVDVVLGVDTRPAARTDSLTDTVDYGELSSRLVDVIEGEPVNLIETLAQRLADVCLTDPRVVAVDVTVHKPEAPIQHRFDDVSVTISRRRG

SEQ ID NO: 86779 - protein, 469 aa, Lactococcus lactis subsp. lactis Il1403
MGFMRKADFELYRDADKHYNQVLTTRDFLALGVGTIISTSIFTLPGQVAAQFAGPGVVFSYLLAALVAGFVALAYAEMSTVMPFAGSAYSWISVLFGEGFGWIAGWALLAEYFIAVAFVGSGFSANLQQLLAPLGFHLPKVLANPFGTDGGVVDIISLLVILLSAIIVFRGASDAGRISQILVVLKVAAVIAFIIVGITVIKPANYHPFIPPHNPKTGFGGFSGIWSGVSMIFLAYIGFDSIAANSAEAKKPQKTMPRGIIGSLLIAVVLFAAVTLVLVGMHPYSAYAGNAAPVGWALQQSGYSVLSEVVTAIALAGMFIALLGMVLAGSRLLYAFGRDGLLPKGLGKMNARNLPANGVWTLAIVAIVIGAFFPFAFLAQLISAGTLIAFMFVTLGIYSLRRRQGKDLPEATYKMPFYPVLPALGFIGSLFVFWGLDVQAKLYSGIWFLIGILIYFAYGNRRSRKSEEK

SEQ ID NO: 86780 - protein, 398 aa, Agrobacterium tumefaciens str. C58
MDMSRNRGVVYLKPGQVEVRDIDDPKLEAPDGRRIEHGVILKVISTNICGSDQHMVRGRTTAMPGLVLGHEITGEVIEKGIDVEMLQVGDIVSVPFNVACGRCRCCKSQDTGVCLTVNPSRAGGAYGYVDMGGWIGGQARYVTIPYADFNLLKFPDRDKAMSKIRDLTMLSDILPTGFHGAVKAGVGVGSTVYVAGAGPVGLAAAASARILGAAVVMVGDFNKDRLAHAARVGFEPVDLSKGDRLGDMIAEIVGTNEVDSAIDAVGFEARGHSGGEQPAIVLNQMMEITRAAGSIGIPGLYVTEDPGAVDNAAKQGALSLRFGLGWAKAQSFHTGQTPVLKYNRQLMQAILHDRLPIADIVNAKIIALDDAVQGYESFDQGAATKFVLDPHGDLLKAA

SEQ ID NO: 86781 - protein, 422 aa, Frankia sp. CcI3
MALLVAKFGGSSVADADRIKRVAERIVENRRAGNDVVVVVSAMGDTTDELLDLAEQVSPLPPARELDMLLTAGERISMALLAMAITTLGAEARSFTGSQAGVITDSVHGKARIIDVTPGRIRAALDSGAIAIVAGFQGVSQDTKDITTLGRGGSDTTAVALAAALGADACEIYTDVDGVFTADPRIVPDARRIDTISYEEMLEMAACGAKVLMLRCVEYARRYSVPVHVRSSFSAKPGTWVTEIPEEQLVEQAIIRGVAHDLSEAKVTVVGCPDKPGVAAAVFRAVADTDVNLDMIVQVGSVAGSGRTDISFTLPKADGRTALTALTKVQSEIGFERTLYDDHIGKLSLIGAGMKSHPGVSARFFGSLADAGVNVEIISTSEIRISVVVRDTDLPLAVRAVHGAFDLGDPNGGAIVYAGTGR

SEQ ID NO: 86782 - protein, 114 aa, Triticum aestivum
  misc_feature (37)..(37): Xaa can be any naturally occurring amino acid
  misc_feature (47)..(47): Xaa can be any naturally occurring amino acid
  misc_feature (59)..(59): Xaa can be any naturally occurring amino acid
  misc_feature (89)..(89): Xaa can be any naturally occurring amino acid
TIKKKKALTPCEAKANTYLKSVIIRLSLFYQVSNSLXNAFYNHILQXLRKKYNLDQRFXSLAYKLEFVKHNIHFFPKLLRNERSNFSQXGVIILLAIEIVISLCEINKYSSMMS

SEQ ID NO: 86783 - protein, 736 aa, Bordetella petrii
MAIRALVAAPLCISGAPAARNWLYNPSMTYLVLARKWRPRSFDTLVGQDHVVRALTHALDSQRLHHAWLFTGTRGVGKTTLSRILAKSLNCETGITSKPCGQCRACTEIDAGRFVDYLELDAASNRGVEEMTQLLEQAVYAPGAGRYKVYMIDEVHMLTGHAFNAMLKTLEEPPPHVKFILATTDPQKIPVTVLSRCLQFNLKQMPPDAIVGHLQAVLGDEAVACELPALRLIAQAAGGSMRDALSLTDQAIAYSAGNLTEDAVRGMLGTIDQRHLVRLLEALPAGDATGVLAVADELSTRGLSYAGALADLAVLLSRVAIEQRVPGATPADDPLAADISRLAGVLHPDAVQLFYSVAVHSRGELSLAPDEYAGFVMACLRMLALNGQAGPATALQAPAAATPRPEAVAATAASPAAPAAAAPVASATAAPVAQAAAAAPPPPAAVQPRAGAASGAAPAAPAVPVAQTANPAPQAQGAAPAAPVSSAPAAQPAAADTPPWEDLPATPAAAEPAAAAKAPPAAALAVTPPAAQAKAPPPDADGEPPAWVDEDIPDEAQGGYVPAAEFTADPDDEFETLATGASAAELAPVARPQPAPRRARQAAPRLDSMSAADWPGLAARLPVTGLAAELARQSEWAGVHGDAVVLRVAVKTLAESESRVRLQTVLCEHFGQGLRLEIEVGATGDGTAHAVAQIERAARQQAAEHAVAADPFVQALTTDFGGRVIPGSVRAVDPSA

SEQ ID NO: 86784 - protein, 78 aa, Bartonella henselae str. Houston-1
MSDTVERVKKIIVEHLGVNADKVVEDASFIDDLGADSLDTVELVMAFEEEFGVEIPDEAAETIFTVGDAVKFIDKASA

SEQ ID NO: 86785 - protein, 334 aa, Vibrio vulnificus YJ016
MAFNLRNRNFLKLLDFSTKEIQFLIDLSADLKKAKYAGTEQKKLLGKNIALIFEKASTRTRCAFEVAAFDQGAQVTYIGPSGSQIGDKESMKDTARVLGRMYDGIQYRGFGQAIVEELGAFAGVPVWNGLTDEFHPTQILADFLTMLEHSQGKALADIQFAYLGDARNNVGNSLMVGAAKMGMDISLVGPQAYWPDEELVTACQAIAKQTGGKITLTENVAEGVQGCDFLYTDVWVSMGESPEAWDERVALMKPYQVNTNVLKQTGNPNVKFMHCLPAFHNDETTIGKQVADKFGMKGLEVTEEVFESEHSIVFDEAENRMHTIKAVMVATLGS

SEQ ID NO: 86786 - protein, 640 aa, Oryza sativa Japonica Group
MEPPFFLLLLLLVVSSSSPSAALLSAKGVNNEVQALIVIKNLLKDPHGVLKSWDQNSVDPCSWAMITCSPDFLVTGLEAPSQHLSGLLSPSIGNLTNLETVLLQNNNITGPIPAEIGRLENLKTLDLSSNSFYGEIPSSVGHLESLQYLRLNNNTLSGPFPSASANLSHLVFLDLSYNNLSGPIPESLARTYNIVGNPLICDANREQDCYGTAPMPMSYSLNGSRGGALPPAARDRGHKFAVAFGSTAGCMGLLLLAAGFLFWWRHRRNRQILFDVDEQQIENVNLGNVKRFSFRELQAATEGFSGKNILGKGGFGNVYRGQLPDGTLVAVKRLKDGNAAGGEAQFQTEVEMISLALHRNLLRLYGFCMTATERLLVYPFMSNGSVASRLKAKPALEWGTRRRIAVGAARGLVYLHEQCDPKIIHRDVKAANVLLDEACEAVVGDFGLAKLLDHRESHVTTAVRGTVGHIAPEYLSTGQSSDRTDVFGFGILLLELVTGQTALEFGKSSNHKGAMLDWVKKMQSEKKVEVLVDKGLGGGYDRVEVEEMVQVALLCTQYLPAHRPRMSDVVRMLEGDGLADRWEKASGHSTAAADSLSHSHRTSDPAPPAADFAAAFGRCFSDLTDDSSLLVQAVELSGPR

SEQ ID NO: 86787 - protein, 842 aa, Candida albicans SC5314
MANSHRNTLKHDHKPFKSKHATKGQIKARIKGKVEKSSNSSGGSKSSKVVSKLERKNLSKQQRDNKILETKLTKKLFEGNSGAEKIVTIITLTNDLSAVDIANRLFNEQEDTSNESITRFDFGYPSVTNINIAKFKTNLKVIIPKQNNMISILDAAQVSDFVLLGISATEEIGENSFGETVLRALIAQGISTTIGVLPNIVSAYPKRNLQLDVKQSLQSFYHHFFPSRDGSSNRGSGTDSGGNKLYSLELDSDNSNCLRIICQKFPQSITWRDSRGWLVADKVEIFNPNGMPVENQQQMMVVEGMVRGVGFNVNRLVHLPGLGDFQLHKLEKLARKARGNSSRNHRGGMDIDTGNDGDAEETFLPNEQQESLDELNPDEGIDMGTMEDDDDFLNNDNFGVRSEGKIYFDNGNSNGTSSSSTGKKLVPRGTSEYQGRWFVDDVLDEDASDLEEQREGEGEEEEDANIVDDDMMVEDNMEADDITDSIHDSEMMHVDLSPEEESRQLEEYRSLAKDDLEFPDEIELHPNESAIERLKGFRGVKSLGNCDWDYDEYDPEAPSILKRLFQVSNYKATKNKVNKQFIKQTEITAGNRVRLYIIIPPGASNNVSSVIGSCSSVPFPVYELLEHEHKLGVCNFSFEAWQDYEKPIINKEQIIVQYGPRRQIIQPLYNQANNNPNNVHKLENFVHHNQGGGGAIIATAITPVLFTNSPTLFFKIHPDADDSSNSNGGSVEFVGKGTYLGSDAKRIMVQRVVLTGHPIKIHKRVVTIRYMFFNREDINYFKAVSLFTKNSGRVGFIKESLGTHGYFKANFDGKLTSQDVVAMSLYKRSWPEVSTAWNKFNY

SEQ ID NO: 86788 - protein, 393 aa, Methanosarcina mazei Go1
MYDVDAVREDFPVLKEVVYLDSTATTQTPVPAVEAMVEYFYRYAGNHGRGAHRLARETTNRYEDARETVAHFLNADPSKTVFTKNTTEGINLIANSYPWEAGDHIVTTMLEHHSNLLPWLRLQKKGIDVTVIKPDREGIIDPRMIENALTDRTKLIAVTHISNVFGSVQNVSRITKLARKNGVKILVDGAQSAGHVPVNIKTLGCDFFATAGHKGLLGPQGTGVLYIKDPEVMESASLGGGTVSDVRGHEYTLEPSPTCFEAGTPNIPGVIGLGKAVEYVKKIGISEIEKHEAELSRQAAKRLSELDHVEVYGPENRAGIVPFNVTGLHAHDVALILDQTRKICVRSGHHCAIPVTRFLEVESTVRASFALYNTKEEVDILVKAVDALKALVS

SEQ ID NO: 86789 - protein, 444 aa, Spinacia oleracea
MVTIKSVKARQIFDSRGNPTVEADIHLDDGTFARAAVPSGASTGIYEALELRDGGKDYMGKGVFKAVQNVNEIIGPALVGKDPTEQTAIDNFMVQELDGTTNEWGWCKQKLGANAILAVSLAVCKAGAQVKKIPLYQHIAEISGNKKMVLPVPAFNVINGGSHAGNKLAMQEFMILPTGASSFREAMKMGSEVYHHLKSVIKKKYGQDATNVGDEGGFAPNIQENKEGLELLKTAIEKAGYTGKVVIGMDVAAAEFYSKDKTYDLNFKEENNDGSQKISGDALKDLYKSFVSEYPIVSIEDPFDQDDWEHYGKLTAEIGDKVQIVGDDLLVTNPKRVEKAINGKSCNALLLKVNQIGSVTESIEAVKMSKRAGWGVMASHRSGETEDTFIADLSVGLSTGQIKTGAPCRSERLAKYNQLLRIEEELGDKAIYAGADFRAPVEPY

SEQ ID NO: 86790 - protein, 274 aa, Agrobacterium tumefaciens str. C58
MVARTEARQPEQLAIVDPIWGSLLNEARSAAAQDPLLSAFLYSTILNHRSLEECVIYRICELLDHPDMQAVLLRQTFQDMLEDWPEWGSVLRVDIQAVYDRDPACTRFMEPLLYFKGFQAIQTHRLAHWLLQKGRKDLALYLQSRSSSIFQTDINPAARIGKGIFLDHATGLVVGETAVIGDNVSILHGVTLGGTGKEGADRHPKIANGVMIGAGAKILGNIEIGSCSRIAAGSVVLKPVPPKTTVAGVPARVVGEAGCSEPSRLMDQLIGADI

SEQ ID NO: 86791 - protein, 393 aa, Phytophthora citricola
LVTEIGEYRAAVPSGASTGEFEALEMRDGGKDYMGKGVLNAVRNVNEIIAPALVGKDVTKQAELDRYMVEQLDGTQNEWGWCKKKLGANAILGVSLALCRGGAAAKKQPLWQYIADLAGNPSPCLPVPSFNIINGGSHAGNKLAMQEFMILPVGATSFSESMKIGSEVYHNLKKVIKGRYGLDATAVGDEGGFAPNIQSNGEAIDLIEEAIKAAGYTNQVRLGMDVAASEFYTGATDARYNLDFKNENAPESEKIPADKLQEVYEGFIAKCAGSSKIVSIEDPFDQDDWESWVKFTAKVGKDVQIVGDDLTVTNPTRVQKAIEQKACNALLLKVNQIGSITESIEAVTMAKKAGWAIMASHRSGETEDTFIASLAVGLSAGQIKTGAPCRSER

SEQ ID NO: 86792 - protein, 390 aa, Phytophthora niederhauserii
  misc_feature (29)..(29): Xaa can be any naturally occurring amino acid
  misc_feature (65)..(65): Xaa can be any naturally occurring amino acid
  misc_feature (234)..(234): Xaa can be any naturally occurring amino acid
TELGQYRAAVPSGASTGEFEALEMRDGGXAYMGKGVLNAVKNVNEIIAPALIGKDVTKQAELDRXMVEQLDGTQNEWGWCKKKLGANAILGVSLALCRAGAAAKKQPLWQYIADLAGNPTPCLPVPSFNIINGGSHAGNKLAMQEFMILPVGATSFTEAMKIGSEVYHNLKKVIKGRYGLDATAVGDEGGFAPNIQSNGEAIDLIEEAIKAAGYTNQVRLGMDVAASEFYTGAXDARYNLDFKNENAPESEKISADKLQEVYEGFIAKCAGSSKIVSIEDPFDQDDWASWVKFTAKVGEDVQIVGDDLTVTNPTRVKKAIEQKACNALLLKVNQIGSITESIEAVTMAKKAGWAIMASHRSGETEDTFIADLAVGLSAGQIKTGAPCRSE

SEQ ID NO: 86793 - protein, 371 aa, Silicibacter sp. TM1040
MIKTRAAVALEAGKPLEIMEVNLEGPKAGEVLVEIKATGLCHTDEFTRSGDDPEGIFPAILGHEGAGVVIEVGEGVKSLKPGDHVIPLYTPECRECDYCLNPKTNLCQAIRSTQGQGLLPDGTTRFSLPDGTPIHHYMGCSTFANHTVVPEIALAKIREDAPFDKVCYIGCGVTTGIGAVINTAKVEIGSTAIVFGLGGIGLNVIQGLRLAGADQIVGVDLNPGKVAMAEKFGMTDFVNPSEVEGDLVAHLVELTGGGADYTFDATGNVSVMRTALEAAHKGWGESIIIGVAPAGAEISTRPFQLVTGRSWRGTAFGGASGRTDVPKIVDWYMDGKIEIDPMITHKLTLDQINEGFDLMHEGKSIRAVVEF

SEQ ID NO: 86794 - protein, 458 aa, Alkalilimnicola ehrlichei MLHE-1
MSEAKAPPRSNRWAEHLRRRRQRVRAPRLVVEGVLRRMVGLTLEAEGCQAPLGSRCTLRTQQDRDVEAEVVGFAGDKLYLMPTGELHGMMPNARVVPRGGTAEAGMGPGLLGRVLDGGGRPLDGKGLLDHSEYRSLVGEGINPLARAPIKAPLDVGVRAINSLFTVGRGQRMGLFAGSGVGKSVLLGMMTRYTNADVVVVGLIGERGREVKEFITDILGDEGLARSVVVASPADKSPLMRLHGAMLATSIAEYFRDQGLNVLLLMDSLTRYAQAQREIGLAIGEPPTTKGYPPSVFALLPRLVERAGNGPDDGGSITAFYTVLTEGDDQQDPIADAARAILDGHLVLSRQLADAGHYPAIDIEASVSRAMINITERGHQRLAQRFRQLWSTYRENQDLISVGAYQKGSDPRVDEAIAIMPRLRAFLQQDVSTAVNFGESLEQLFGLLSDQAQTGGGNG

SEQ ID NO: 86795 - protein, 406 aa, Agrobacterium tumefaciens str. C58
MEEFHKVRRLPQYVFEQVNRLKASARAAGADIIDLGMGNPDLPTPKAIVDKLCEVVQDPRTHRYSSSKGIPGLRRAQAGYYARRFGVKLNPDTQVVATLGSKEGFANMAQAITAPGDVILCPNPTYPIHAFGFLMAGGVIRSMNVEPDESFFGPLERAVRHSIPKPLALIVNYPSNPTAHVASLDFYKDVIAFAKKHEIIVLSDLAYSEIYFDDNNPPPSVLEVPGAIDVAVEFTSMSKTFSMPGWRMGFAVGNERLIAALTRVKSYLDYGAFTPIQVAATHALNGDGSDIAEVRSVYRRRRDVMVDTFGKAGFEVPPPAATMFAWAKIPEKFRHLGSLEFSKLLVEKADIAVAPGIGFGEMGDDYVRLALVENEHRIRQAARNLKRFLSSADETMHNVVSLNAHR

SEQ ID NO: 86796 - protein, 298 aa, Vibrio vulnificus YJ016
MCGYQKERTTMWQAISQQLSETLMFSYDIVEKVHLSGGDINECYMISDGEQRYFVKINSKDFLSKFQVEAENLRLLRQTDSVTLPELVLIGNTKSNAFIILNFLPTKPLEDPENSYIFGQQLAYLHLWGEQKEYGCDQDNYLGATLQPNAWHKKWSTFFSEQRIGWQLQLLKEKGVTFGVIDEIVEVVARQLLNHNPRPSLIHGDLWHGNVALSAFGPICYDPACYWGDRECDIAMTELFGGFSDEFYRGYEDIAPLPFGYTQRKEIYNLYHILNHCNQFGGHYLEQAQKSIDKILSY

SEQ ID NO: 86797 - protein, 141 aa, Zea mays
MLNQELTTYCLDVSGLLGTVAPCVLYGSNVERLAAGQGTFANSCLPYTGLYLLGNSLFGWNCLAPWFSHPTRTAPQGSPPWIQQWALRLCHDAAHGADHGAWHVSYSTTFPTLVLSVLPVVYHLLLLALMCDVSPSVNTSL

SEQ ID NO: 86798 - protein, 245 aa, Xylella fastidiosa Ann-1
MTPSQLLAITHVSNVLGTVNPIHHICRQARQRGITTVVDGSQAAPHRHIDIPAIGCDFYAITGHKLYGPTGTGALWARREHLHIMPPFLGGGEMIKEVSFDGTLFNTPPHKFEAGTPNIAGFIGLSAAVDYVRRIGIDQIETRETELLAHLTEELQKIDGMRLFGTAPNKAAVVSFMIEGTHAHDLATLLDLEGVAVRSGQHCAHPLLQYYGVTATCRASLAFYNTHEEIERFITALLKVRKLLG

SEQ ID NO: 86799 - protein, 86 aa, Glycine max
LATEKAVGAAAVVGSHTAKWMQDTSKKSPMELINEVPPIKVEGRIAACEGDKNPALGHPIEYICLDLDAPAVCKYCGLRYVQDHHH

SEQ ID NO: 86800 - protein, 812 aa, Frankia sp. CcI3
MSTALYNRYRPATFAQVVGQEHVTDALRKALRTGRLHHAYLFSGPRGCGKTSSARILAASLNCVQGPTPEPCGVCDECVGIRTGASMDVTEIDAASHGLVDDARDLRERAFFAPASARFKVFVVDEAHMVTAAAFNALLKVVEEPPPYLKFVFATTEPDKVIPTIRSRTHHYAFRLVPPGVLREHLASVCAREGVVVDPAVLPLIVRAGAGSVRDSLSVLDQLLAGADDDGLRYDRAVALLGMTDGVLLDETVDALADRDGAALFTVVDKVVSAGHDPRRFATDLLDRFRDLIVMAAVPDADARGLLESFSPDQIDRMRAQTTRMGPAELSRTADVLHNGLVEMRGTASPRLILELIMARALLPTASTDPAALLTRLERLERRAVLGGEEPEPGPPAPLPVGRAPAPVHPPAADPEPMPLAVRASARTGPVSRPAAGPQPGSPGPAFTSGDRPSGPAGVPGTAGTPGTGRIDAAGLRMLWDELLALAGRHSRKTHAILKDHATVADVRGDEVVLAFATPTMGRMFGQGNNAELFCTVLAERLGGTWRVTVAPAGGSGRGSGRPAAGPGPGGGGYSGPPGPSKASGFAGSGGAPGPTGQAGASRSPAPAPAPARAAGPAGQSSGPSWGPRLDPPVGAENRAVSPGSPRAMPGQMRGPAGLSPDTGNGYGGSTDGTEGGTTDPGRGPDGYGDPREHGDPREHGDPREHGDSHGAGHGSTGPGPGPEGGPGPEGDRPWSATGRDGSSPGPANGVAAAASAPPAGDEPGPRREDEPSLDDEAVPSGPGGARGGEEAAVSLLRSGLGATIIEQISSG

SEQ ID NO: 86801 - protein, 299 aa, Chlamydomonas reinhardtii
MQADVDFQDEEGVSPLMRAAEGGHTAVMAALLQAGAPWNAQDSSGYCAGEYAMGSGQQEAVDMLLDFAVQAELVLGALHRRMQVGSPSFSAAANSDYLTQKLVYRGEQLLDADGEAVMMGWERPLMLRHAERRKGGHVVNVGFGLGIVDTAIQTHSPDRHTIIEAHPDVLEHMTRTGWADKPGVRILRGRWQDVLPELLAEAPYDGIFFDTYGEYYEEMREFHMHLPRLLARDGVYSFFNGLASDNIFFHMVYCRLISLELASKGLHTEYTPLAVGELGDEVWQGVRNKYWTFETYFLP

SEQ ID NO: 86802 - protein, 339 aa, Glycine max
MDHSADAQRTDLMTITRFVLNQQSNHPESRGDFSILLSHIVLGCKFLCSAVNKAGLAKLIGLAGETNVQASEQKKLDVLSNDVFIKALVSSGRTCILVSEEDEEATFVEASKRGKLYCVVFDPLDGSSNIDCGVSIGTIFGIYLIKEDHEPTIEDVLQPGKNMLAAGYCMYGSSCTLVLSTGSGVNGFTLDPSLGEFILTHPDIKIPKKGKIYSVNEGNAKNWDDPTTKYVENCKYPRDGSSPKSLRYIGSMVADVHRTLLYGGIFLYPADKKSPNGKLRVLYEVFPMSFLMEQAGGQAFTGNQRALDLVPKKLHERSPIFLGSYEDVEEIKALYAAEE

SEQ ID NO: 86803 - protein, 302 aa, Xanthomonas oryzae pv. oryzae KACC10331
MCPSCGSTPMTTRRFLQLDVFSARPGSGNPLAVVLDAQGLDDAAMQSIARWTKLPETTFVFPAESAHSSYRLRIFSPQKEVPFAGHPSVGTAHAALEAGLAAPIDGVLVQDGIAGQLPLRVEQRNGHRSIAIRTPRARVAEQVHADDPRLRDALHGWPLGTLPPALMDGGRTWWVVELASETALRSLQPDWDAIAALAESTGSMGVFAYARAAAPGAYDLAVRAFVGNGRRFEDAASGAANAVLAAWLDSRHALPGTDSRYVVSQGREIGFDALLELHIDADGDVWSGGQIQTVIRGTLDWA

SEQ ID NO: 86804 - protein, 298 aa, Triticum aestivum
  misc_feature (249)..(249): Xaa can be any naturally occurring amino acid
  misc_feature (267)..(267): Xaa can be any naturally occurring amino acid
  misc_feature (279)..(279): Xaa can be any naturally occurring amino acid
MEGKEEDVRLGANRYSERQPIGTAAQGGGDDKDYKEPPPAPLFEPGELKSWSFYRAGIAEFIATFLFLYVTVLTVMGVSKSPSKCATVGVQGIAWSFGGMIFALVYCTAGISGGHINPAVTFGLFLARKLSLTRAIFYIIMQCLGAICGAGVVKGFQQGLYMGNGGGANVVASGYTKGDGLGAEIIGTFVLVYTVFSAADAKRNARDSHVPILAPLPIGFAVFLVHLATIPITGTGINPARSLGAAIIXHRDHAWNDHWIFWVGPFXVGAALAAVYHQXSIRAIPFNKKRSLSRPRLR

SEQ ID NO: 86805 - protein, 246 aa, Mycoplasma penetrans HF-2
MIYLKSNYEIEQIKKACSVWKKVRQALIENAAAGKSLIELDELAKKVTIENDCTTPFHQYRGFPGYNCISVNDVVIHGVPTNYKLKDKDMVTFDVGVAYNGYICDAAFTVIIGENVEAQKINDVCYKSLIEGIKQIKPGNRIGDISNAIEEYVVSNGYYILEDFGGHGCGRKLHEDPIILNYGVKNSGPIIKPNMVLCIEPMILTEDASYYIDKDKWSVIASNHKLSCHWEHMVLVTNEGYEILTE

SEQ ID NO: 86806 - protein, 412 aa, Hyphomonas neptunium ATCC 15444
MQMPAEGRPWDEVRADMLARGAGDVAWRDGKTAVYVFNAGEDVHALQHEAYGLFMAENGLGPLAFPSLAQMEKDVISMALGLLHGPEGSTGAITSGGTDSITMAIKTARDYARAKGMAKDRHNIVIPRSGHLAFHKAALLMDIEIRSVPLKTDGSYEADPAAMAAAIDGATIMMVGSAPNFPHGIIDPIAELGKIAEEKDVWLHVDACVGGYFAPFARMNGVPVPDFDFAIPAVKSISADLHKYGYCAKGASTVLFRSVDLYKHMPFSLSEWSGAPMKTPTLAGTRPGGAISAAWAVMNVLGISGYREKQGLVCQTRERIEAGVNALGFEVLGKPLLGLVAFRHPQADTLALYSAMRQRGWFTSFTVEPPSLHLMLSPKHAEVADDYLADLAASLEAVKAGDTAPKVEARYS

SEQ ID NO: 86807 - protein, 466 aa, Oryza sativa Indica Group
MAGLAAARELRREGLDVTVLEQSAGVGGQWLYDAATDGGDPLGMAGVHSSIYSSLRLNSPREVCGFSDFPFRPTNGGGGDARRYPVHGELLRYIREFCDVFGLMDAVRLDTTVVRVAMAPPRRDGSLRWTVRSKHNGDAETEEVFDAVVVATGHYSQPRLPSIDGMDKWRRRQLHSHSYRVPDSFAGEVVVIVGCNLSGKEVALELLRVAKEVHLSSKSTKEAMTPSMSKMLARYDNLHLQPLVEHLCEDGRVVFDDGSFVVADAVIYCTGYNYSFPFLETEGKVTVDDNRVGPLYEHVFPLALAPSLSFVGIPVKVILPRFAEVQARWVAQVLSGRRTLPSPGEMLRAVEEYNRAKEAAGLPKRQTHDLFLDLEYCDEYGERHCGFPRTEQWKKELIWSSISDMCDDIENFRDDYHDSDIVRDGRRLHGWASSPPLAPRPQEKDDDHDKEEDKHLGFGPSKFSLR

SEQ ID NO: 86808 - protein, 372 aa, Zea mays
  misc_feature (155)..(155): Xaa can be any naturally occurring amino acid
MVKVIQGRPAEMGFRMPAEWEPHEQCWMGWPERPDNWRENAGPAQEVFARTAIAISKFEPVTLCASAKQYPKVHELMEHQTNIRVVEMSMNDSWFRDMGPTFVTHKGDSGIAEQTIAGIDWQFNAWGGIYDDWSLDSDVAKKIVEIERIPRFPQXIILEGGSIHVDGEGTCITTEECLLNPNRNPNMTKLEIENELKDFLGVSKVIWIPRGLYGDEDTNGHVDNLCCFIKPGVILLSWTDDEEDHQYERSVEALSVLSQSVDAKGRQLQVVKIHVPGPLYMTEEEAQGVVSSGHSVPRPAGTRLAASYVNFYIANGGIIAPSFGDRWDEEAYAVLQKAFPDHEVVMVEGGREIALGGGNIHCITQQQPVRPS

SEQ ID NO: 86809 - protein, 625 aa, Bartonella henselae str. Houston-1
MLVLNDITIRIAGRLLISRANIALPTGSKTGFVGYNGTGKSTLFRAITGEISPENGDIIMPKSTKIGHVAQEAPATEHSLLATVLAANTEHANLLHEAESATDPLRIAAIYARLADIDAHAAEARAGKILSGLGFDSHTQQRPLSSFSGGWRMRIALAAILFTEPDLLLLDEPTNYLDIEGTLWLTEYVRQYPHTVIIISHDRDFLNNTVNSIMHLENNQLTFWRGNYDQFEQQKAEVVKVQQKQIEKQEVQQKHMEDFIVRFRAKASKARQAQSRLKALEKLKPLTTWKIQHVQPFIFPKVEKPVASPIIALSNVSVGYETGKPILKELNLRIDNDDRITLLGSNGNGKSTLAKLLAGRLKAEKGTITLAPHLKIAFFSQHQLDDLKPEENAIDHMRHLMPGKADAKIRAAVARMGISTEKMMTKAKELSGGEKVRLLMGLTVFEGPHLLILDEPTNHLDIDSRQELIHALNHFNGAVILIAHDRHLIEATMDRLWLVKNKTVLPYEGDMHTYRKEILGLSSKKETNVSLKKQLSLSKNDQRKSNAQKRSSLAPLRKKIVETEALIEYLHKQIAQLDEELISASFHNKIPEKIKERAQKAKKLQEAETLWFTLSDQYETQMMQK

SEQ ID NO: 86810 - protein, 440 aa, Davidiella tassiana
MPISKIHSRYVYDSRGNPTVEVDIVTETGLHRAIVPSVASTGSHEACELRDGDKSKWAGKGVTKAVANVNEIIAPALIKENLDVKDQAAVDAFLNKLDGTTNKTKIGANAILGVSMAVAKAAAAEKRVPLYAHISDLSGTKKPFVLPVPFMNVVNGGSHAGGRLAFQEFMIVPSGAPSFTEAMRQGAEVYQKLKSLTKKRYGQSAGNVGDEGGVAPDIQTAEEALDLITDAIEEAGYTGQIKIAMDVASSEFYKADEKKYDLDFKNPDSDKSKWITYEQLADQYNELAAKYPIVSIEDPFAEDDWEAWSYFYKTSGSDFQIVGDDLTVTNPEFIKKAIETKACNALLLKVNQIGTITEAINAAKDSFAAGWGVMVSHRSGETEDVTIADIVVGLRAGQIKTGAPARSERLAKLNQILRIEEELGDKRLYAGDNFRTAINL

SEQ ID NO: 86811 - protein, 140 aa, Bartonella henselae str. Houston-1
MAVERTFSMIKPDATRRNLTGAITKMLEDAGLRVIASKRVWMSQREAEKFYAVHKERAFFSELVELMSSGPTIVQVLEGENAIAKNREVMGATNPEDAQEGTIRKVHALSIGENSVHGSDSAETAKTEIAFWFSEVEIVG

SEQ ID NO: 86812 - protein, 193 aa, Bartonella henselae str. Houston-1
MKNHTFSFPNILTYARIVAVPMVVACFFLEGRLQSSDIARWAAVSIFVVASITDFLDGYLARIWEQTSNIGRMLDPIADKLLVSACLLLLAADSTIAGWTLWAAIIILCREILVSGLREYLAELKVSVPVSRLAKWKTFVQMIAIIFLLAGPAGNKIIPYTLEFGITMLWISALLTLWTGWDYFRAGLKHVII

SEQ ID NO: 86813 - protein, 486 aa, Pasteurella multocida subsp. multocida str. Pm70
MGGISMQQFSLLKTKAYINGEYVQAKEHKTFAVTNPANQQIICELPDLSAEETEYAIACAAQAQKKWQKVTPKERANLLRRWYNLVIENQEELAQLLSLEQGKPINESRGEILYGASFIEWFAEEAKRIYGDVLPQDKENHRLLVIKQGIGVVAAITPWNFPNAMITRKAAPAFAAGCAMVLKPAQETPLSALALAELAHQAGLPAGLFNVITSTRSVEIGKVLTEHPTVRKVTFTGSTRVGKILMAQSASTVKKLSLELGGNAPSIVFDDADLENAIEGIIASKFRNSGQTCVCTNRIYVQAGIYDRFVELFSAKVAAFKVGSANEAGVNIGPLISQSAVNKIQEHIDDATAKGANLVIGGKLHTRGGTFFEPTVLRDVTQAMLVAKDETFAPLAPVFKFDTEAQVIEMANDTEFGLASYVYTQDISRIWRVSEALEYGIVGINEGLISNEMAPFGGVKESGLGREGSRYGIDEFLEIKYLCLKV

SEQ ID NO: 86814 - protein, 225 aa, Zea mays
  misc_feature (35)..(35): Xaa can be any naturally occurring amino acid
  misc_feature (47)..(47): Xaa can be any naturally occurring amino acid
SKESEHTNPNPNPPTSPLKPSPATDATQAPNPSEXERGGGGGNPVDXGEMVFFALLVGAELDGLTNLQPRGGCDDPSYPYYFKLRCESCGETSAKTTCVSLNEVVELPTGKGTSNLLQKCKLCSRDGSVVMIPGQGTPLTAEQSQKGEMTCLMVFECRGYEPIEFAFGNGWKAESVHGTPFDIDLSEGEFDEYDEKGECPVALSKLQSTFKVVKKQGFHGKTRYV

SEQ ID NO: 86815 - protein, 319 aa, Agrobacterium tumefaciens str. C58
MHKVIFDTDPGVDDAMALLFLHRHPDIDLIGVTTVFGNAPIDITTRNALFLKREWQMTAPVAKGAGVTFDPARKEGHWPTFIHGENGLGDIDIPETIDLPLDPRPAHRFIIETVKANPGEVTLIAVGRMTNLALALREEPDFAALVKQVIVMGGAFDINGNVSPAAEANIHGDPEAADLVFTAPWRVVVVGLDVTTKTVMTSAFMAEMAEAGGKPVQLLSDLSQFYIDFYKTRTGDGMVVHDSCACVYLVAPELFTTRSGPVRVVCGGLADGETIQKPDGRAFPPGDWDGHPSQLICTDIKPERVLSVIRAAIVKGERG

SEQ ID NO: 86816 - protein, 319 aa, Synechocystis sp. PCC 6803
MGLLVNGIWQDQWYDTESTGGRFVRHDSQFRHWITPDGSPGPTGHGGFKAEAGRYHLYVSLACPWAHRTLIFRKLKGLEGMIDVSVVHWLMRENGWTFAPGPGVMPDPLFNAEYLYQIYTRADAQYSGRVTVPILWDKQKQTIVNNESSEIIRIFNSAFDGLGAKSGDYYPKALRTQIDALNDRIYHTINNGVYKCGFATTQTAYEEAIAPLFESLDWLEGILQGHQYLTGDEITEADWRLFTTLIRFDVVYVGHFKCNLRRIQDYPNLWRYLRDLYHQPGIAETVNFQHIKGHYYESHLNINPTGIVPMGPALDLSLA

SEQ ID NO: 86817 - protein, 389 aa, Phytophthora cactorum
ELGEYRAAVPSGASTGEFEALEMRDGGKDYMGKGVLNAVRNVNEIIAPALIGKDVTKQAEIDRFMVEELDGTQNEWGWCKKKLGANAILGVSLALCRAGAAAKKQPLWQHIADLAGNPTPCLPVPSFNIINGGSHAGNKLAMQEFMILPVGATSFTEAMKIGSEVYHNLKKVIKGRYGLDATAVGDEGGFAPNIQSNGEAIDLIEEAIKAAGYTDKVRLGMDVAASEFYTGAEDARYNLDFKNENAADSEKISADKLQEVYEGFIAKCAGSSKIVSIEDPFDQDDWESWVKITGKVGKDVQIVGDDLTVTNPTRVKKAIEQKACNALLLKVNQIGSITESIEAVTMAKKAGWGIMASHRSGETEDTFIADLAVGLSAGQIKTGAPCRSE

SEQ ID NO: 86818 - protein, 389 aa, Phytophthora cactorum
EIGEYRAAVPSGASTGEFEALEMRDGGKDYMGKGVLNAVRNVNEIIAPALIGKDVTKQAEIDRFMVEELDGTQNEWGWCKKKLGANAILGVSLALCRAGAAAKKQPLWQHIADLAGNPTPCLPVPSFNIINGGSHAGNKLAMQEFMILPVGATSFTEAMKIGSEVYHNLKKVIKGRYGLDATAVGDEGGFAPNIQSNGEAIDLIEEAIKAAGYTDKVRLGMDVAASEFYTGAEDARYNLDFKNENAADSEKISADKLQEVYEGFIAKCAGSSKIVSIEDPFDQDDWESWVKITGKVGKDVQIVGDDLTVTNPTRVKKAIEQKACNALLLKVNQIGSITESIEAVTMAKKAGWGIMASHRSGETEDTFIADLAVGLSAGQIKTGAPCRSE

SEQ ID NO: 86819 - protein, 260 aa, Colwellia psychrerythraea 34H
MNNPVLKPLVIKIGGAILEKESALNALLNVISQLKNKQVVLVHGGGCVVDEMLAQAGFTTEKKHGLRVTPKEQVGLISGALAGTVNKAIVGTANSMDLAAVGLSLNDGDMISCTLSTQDLGQVGVPQTNNSKLLDCLLKAKFLPVISSIGALDNGDLVNVNADDAAVAICQLLNAELLLLTDVNGVKDADGEYLSSLNAEQAQKLIEQGVIAGGMTAKVNAALHAAQQLRRSIAVASWQSPEQITQLLDGHGVGTQIQPN

SEQ ID NO: 86820 - protein, 467 aa, Methanosarcina barkeri str. Fusaro
MSEHESASLVKTLRPFHVWALGVGIVLVGEYMGWNFTVAKGGVLGSLLAMLVAGTMYVIISLCASELGSATKLAGGPYDWARLFIGPGAAASVGLAVYMEYIALEAADAIVVASISQSIFPELQVYPVTLLVIALLTFINYRGVVAALTLNFVLTMIAFIAILAFFFSTAFGIGDIHPEYLLQGALPNGMIGLFAALQFGPWFYLGIEGAAMCAEECKHPSRAVPLGQQAGMITLLIGAAMTLYLCSVLIPADLLGVSVYPLFEAAQNSGIFIFVALLGLGTFLTCVASANGCVCDSSRSWFALSRDNYVSSWFSAVHPKYNTPYRAVIFTVPVAIGFAFSGYLDQVITFSIVSGLLCYVLIPFSLIRFRKLFPETTSKVRPFVGPLQPYIAYFAIAIAITILSTLFWGYKYNLIFAFVFYGIAYFYFSHKHKKSNIENNWAEMGWPLPKGSGNKRIKKEATGIGDE

SEQ ID NO: 86821 - protein, 339 aa, Phytophthora cactorum
IGKDVTKQAEIDRFMVEELDGTQNEWGWCKKKLGANAILGVSLALCRAGAAAKKQPLWQHIADLAGNPTPCLPVPSFNIINGGSHAGNKLAMQEFMILPVGATSFTEAMKIGSEVYHNLKKVIKGRYGLDATAVGDEGGFAPNIQSNGEAIDLIEEAIKAAGYTDKVRLGMDVAASEFYTGAEDARYNLDFKNENAADSEKISADKLQEVYEGFIAKCAGSSKIVSIEDPFDQDDWESWVKITGKVGKDVQIVGDDLTVTNPTRVKKAIEQKACNALLLKVNQIGSITESIEAVTMAKKAGWGIMASHRSGETEDTFTADLAVGLSAGQIKTGAPCRSE

SEQ ID NO: 86822 - protein, 419 aa, Oryza sativa Japonica Group
MESNAEKLRGLTITSLDEEDDEPELPHRSPPASGGGGGGGAGYEDDDEEEEEEAEVTLGFLEKPKHPGLLLRHLFPSKAGGIPAWLDPVNLPSGNSRCCGFCGEPLQFVLQIYAPIEDNAASFHRTLFMFMCPSMACLLRDQHDQWKHRQGNPCRSVKVFRCQLPRSNAFYSSEPPKHNDSDKPLCPGAPVCHWCGTWKGDKLCSSCKKARYCSEKHQTLHWRSGHKSDCLQLISSSEASSSIFPAVGKVPASKSWPEYEIAIDYEGAFNSDSCDESNSKSLVMQRPGKPDDMMQSWMDQFEADADNKCWASFQERVSRAPKQVLRYCREENAKPLWALSAGCPSNADIPSCSYCRGPLCYEFQIMPQLLYYFGVKNEPDSLDWATIVVYTCKGSCDQNVSYKEEFAWVQLYPTTTTRS

SEQ ID NO: 86823 - protein, 462 aa, Agrobacterium tumefaciens str. C58
MTAYDYDLFVIGGGSGGVRSGRVAASLGKRVGIAEEYRYGGTCVIRGCVPKKLFVYASQFPEYFEDAEGFGWSVGERRFDWKKLIAAKDKEITRLEGLYRKGLENAKADIFDSRAELVDAHTVKLTKTGETYTAERIVIAVGGTPNEHKALPGHELTISSNEAFDLEEPPKSILIAGGGYIAVEFANIFHGLGVETTLIYRGKEILSRFDHDMRKGLHEAMEAKGIRIILEDIIEEVSKDGAGGFVARTKQGSSLHVGLVMLALGRDPNTKGLGLENAGVKVDARGAIIVDDYSRTNVPSIFALGDVTDRVQLTPVAIHEAMCFIETEYKNNPTKPDHELIATAVFSQPEIGTVGLSEEEAGKKYRELEVYRAQFRPMKATLSGRQEKTIMKLIVNASDRRVVGVHILGHEAGEMAQLLGITLKAGCTKDDFDRTMAVHPTAAEELVTMYAPSYRVVNGERV

SEQ ID NO: 86824 - protein, 226 aa, Agrobacterium tumefaciens str. C58
MKIKAAEAALSHVQDGMRLGIGTGSTAEEFVRLLAEKVAAGLKVEGVPTSERTARLCVELGVPLKSLDELPELDLTIDGADEVDHVLRLVKGGGGALLREKIVAAASGRMIVIADQSKVVETLGAFPLPIEINPFGQVATRIAIEKLAARSGLSGELTMRSSGDGAFMTDGGHLILDASFGRIPDAEALARELNTIPGVVEHGLFINLASLAIIAGPEGARMMQAV

SEQ ID NO: 86825 - protein, 505 aa, Hordeum brevisubulatum
MAAPPAIPRRGLFIGGGWREPTLGRHIPVINPATEATIGDIPAATAEDVELAVAAGGPVLARRREHWARASGAVRAKYLNAIAAKIKEKISYLALLETVDSGKPKDEAVADMDDVAACFEYYAGLAEALDGKQHAPISLPMEEFKTYVLKEPIGVVGLITPWNYPLLMATWKVAPALAAGCTAVLKPSELASLTCLELGAICEEIGLPSGVLNIITGLGPDAGAPIASHPHVDKIAFTGSTATGKMIMTAAAQMVKPVSLELGGKSPLVIFDDVADIDKAVEWAMFGCFFNGGRVCSATSRLLLHEKIAARFLDRLVEWVKNIKISDPLEEGCRLGSVISKGQYEKIKKFISTARSEGATILHGGDRPKHLGKGFFIEPTIITDVSTSMQIWREEVFGPVICVKVFKTESEAVELANDTHYGLAGGVISDNLERCERIAKVIHSGIVWINCSQPTLVQAPWGGNKRSGFGRELGEWGLENYLSVKQVTRYCKDELYGWYQRPSKL

SEQ ID NO: 86826 - protein, 82 aa, Oryza sativa
DSMTDNLRPTRAEATDVANAVLDGSDAILLGAETLRGLYPVETISIVGKICAEAEKVFNQDLYFKRTVKYVGEPMTHLESIA

SEQ ID NO: 86827 - protein, 421 aa, Alkalilimnicola ehrlichei MLHE-1
MSTVEPVRDRERAGPPLDVAALRAQFPVLHQQVNGYPLVYLDNAASCQKPEAVIEAEAACYREYYANIHRGVHALSQRCTTAFEGAREKVQRFLNAERDGEIVFLRGTTEAINLVAHSYVEPLLQPGDEILISYLEHHSNIVPWQMVCERTGAELRVIPVQDNGELDLEAFQALLSDRTRFLSVGHVSNALGTVNPVRWMIEQAHARDIPVLLDGAQAVPHGPVDVRELDCDFYAFSGHKLYGPTGVGVLYGRHDLLKGMRPWQGGGDMIRTVSFEKTLYAEPPARFEAGTPNIAGAIALGAAVDWVQAVGLEAIAAHEARLLDYATERLGALEGVRLLGTAPDKAAVLSFVMDEAHPHDIGTILDQQGVAIRTGHHCAEPVMKRFNVPATARASFAAYNTEAEVDALVEGVEKVRELFGG

SEQ ID NO: 86828 - protein, 533 aa, Coprinopsis cinerea okayama7#130
MGDTTATAEGRFRNIRVYWLAFIVYWGILLFGYDTGIGGGVVSAPYFLESFGLIENGVKDVKKSDEVSGNVVAVLQAGAFFGALSSAPVSSRLGRRNTLFAFTVIFTIGAILTTVAAGPPHGLPLIYAGRVLGGYGIGAISAVSPAYVSECAPKEVRGRITGLFQIMVSIGVMISYFVNFAIGLHVPTGVNVWRIPFGVQLIPAGIMVLGLLTVKESPRWLASVGKDEQALKNLAYLRRAPIDSPAILEEFAEIQAAIQEEREARAGLGLKEAFLGKGNFIRFVIAFVIFLLQQWAGQNSINYYAPQIFASIGFVARKNSLLASGVYGIIKVVATAIFIFFGVETIGRKLSLLISALGMGSLFFIIGAILKTHPPPSTNPNVAPPEPSAAAKGMAAMLYIYVCFYSIGWGPLPWVYVSDIFPTRTRHYGLATASASQWLWNFVISKVTPQLLTALGFKIFMMFGAINVGAMGLFSALIPETKGKSLEEMDIIFGSISAEERNENIRKVQRERGEHVHEEGSEKTESVTRKEVA

SEQ ID NO: 86829 - protein, 639 aa, Lactobacillus acidophilus NCFM
MIIAQGHNLEQQFGANTLFKNVNFSIDSNARIGLVGPNGVGKTTLLKIMMGEQEPTHGEFTVNKGIDVGYIAQENALDEDKTIWDEMEGVFAPLIKDSKTLISMQQQIADHPEDQELLKQYDQKQFAFEQKGGYTYQSDIKSILNGFKFPENTWQKKIGSLSGGEKTRLAFVKLLLQKPALLLLDEPTNYLDLDTLDWLEGFLKNYDGAILVVSHDQYFLDHLATQIFELQFGNLTSFKGNYSAYVMQRQQRDKDLEAAYEKQQAEIKKDEEFIQKNLVRATTTKRAQSRRKKLEKIERLTPPKHKNKVKIHFNSERPSGKEVLIFNDLTIGYPDKTMVSDISFQINKGDRVAIIGPNGIGKSTLLKTIMKKLQPKSGSIKYGASLDIGYYDQELQGLDPTKTVLDTVWDRHKTMPERDVRSILASFLFTAKDIDKTVGQLSGGQKARLTLTVLSLEHDNFLLMDEPTNHLDIEAKEVLEKALKDFDGTLLFVSHDRYFINELANKIVSVRDGHAQIYNGNYSYYFNEKAKQTATTINNNAEKPEPINQVSQQKLSYQEQKQRDSQKRKLQRTIDQAEKQIEELEEKEQEIQNEMANPDIASNFDKLGPLQEKLSDIQAQLDDANVNWEKAIEALDNFE

SEQ ID NO: 86830 - protein, 449 aa, Wolinella succinogenes DSM 1740
MPYIQQTLEQLQKTFPAQKEFHQAVHEVLDSLRPLLAKESKYERYNILQRIVIPERQIGFRVTWMDDAGRIQVNQGYRIQYNSTLGPYKGGIRLHPSVNEGIIKFLGFEQIFKNALTGLAMGGAKGGSDFDPKGKSEAEVMRFAQAFMSELYRHIGPLTDVPAGDIGTGAREIGYLFGQYKKLVNRYEGVLTGKSLLWGGSLARKEATGFGSVYFAEEMLRERGESLEGKTCLVSGSGNVAIYTVQKLLELGAKPITVSDSTGMIHDASGIDLDLLKEIKENRRESLTSYAKEHPGSRFISVGEYPKDHNPLWAIPCFAAFPSATQNELNEKDAKHLLQNGCICVSEGANMPSTPSAVEKFLAAKICYGPGKAANAGGVATSGLEMSQNASMTSWSFEEVDMKLHGIMRGIYRAAKETAKEFGEPHNLVLGANIAGFRKVADAMIEQGI

SEQ ID NO: 86831 - protein, 1430 aa, Cryptococcus neoformans var. neoformans B-3501A
MVPPARAHTHNTTNTKQAQLSSAYHELANELGTDNISVVGNYTLGRVIGQGTYGSVHLATHRLTGTRAAVKKVPKSFTPHLTRELHHHRRLHHPHIVHLHEIIATESHIWLVTELCSGGELFDYLVERGRILEGEARRLFGELTLAVGWLHMHGVVHRDLKLENVLLDGELRIKLGDLGFAREWQKGRLMDTYCGTTGYASPEMLACQKYLGVETDIWSLGIILYTLLCGGLPFDDDDERVMKELIQKGEYEEPDWLSQEARDLIRGMLQHDPSKRLSIREILTHPWFKMTIVDKVYPNGDVPSIPPSPNPTSPTAAGDDFFAESALRQQQQQQSRLTPHVAGRSPLSTHLPTTPRQNSGSSEAENGDSRTERKASNMQRLNSAEFSTTEKELEQLHLCTSRPAATATGSGAISPRSISSPSMRGKTLRTLPEGQVDVDETPAGLPPPLSLIDEHPHLPVALHSRTPSRTKRRSVSSTLSLERRLSHHSSHNSYITFPPEDYLSKLDPSLLPNPDSSSSSTTTPPARSFTTPSETRLLRQLDDLGLDVGQLKHSVETDACDASAGLWWLLRQKQEERGETDEVVRRREKEVVRREEKVAEYAKEERRKAREAERERERIPTSPMGILGTRPGKRDSIEKSSEGLRFKEEQPPSIPTTPSYTSVIDLGPPVLPVDVDVDVERTAVGRDAPREAAGEEMKSWKRVESPQSVAISSQSSLDPAPTLPPPAAAGGGGAAGAKTQKEDGRDQAGLDPVAVATPMSNANSSTGASTVAKPEPNVNASANANTSANPRLKAKSPSMNMLQRATSVLGGVGKKGDDKDKDKNGMNEKREESTNDSLHPKRGGSSSPNKLKKPMPAGMKGLTSTLSRSESESEGLLAGGGGGGGGGDSPAVSASGSKTVTPGSSPRRKGLTPQGTPRGGLRDAGAKDSSGERASGNGNGNAGGGNEKGKGGKKDSLWTTFRHLFYEDRRRRKRESVTPSASSPLLLPPSDIKLPAGAVVLSRGANSRTSQFKRSNVGYAPSTGSRRTSLDGNRPVYSRRSSSVHTTSRRSSVGSLHFQDHQAMISDLSRRASQRSHGSQTPTSDREYLDYPSAAAPISRPGSSHSIRGGVGGGSRRSSFSVRSPSLHPETFSASAGGPTSTRFKSSVPPPASPLLGYRRRPAGGNDSSRVRHIKVIPESQIMRSSSVASSIRSNASSRASSMDRDRDRDRESEYESGRDDVSLRSGKRQKRRSGSQRSLAQQIHRTRSPLALSLENTYGSNSVANVGLGIGGASRIPKKPLRDVFQKKGKRKDGGDDDWVSEDEDGFACGLGQGRGIAKSFSNANANGTVWMNVNAKTNPARSAAAFPTSKMVAQPTAQGGTSRRRERGRRSSLEEERGRPQEGKGKAKGETVAQGLMGIESLSGRSRRNLPDRSTAPGIIEEEEEDEE

SEQ ID NO: 86832 - protein, 184 aa, Glycine max
MAATSTSLASQLYIGLRRPCLKLDSFNSQSFSLFDPNLRLSLSPPKPSRAVIAMAGTGKFFVGGNWKCNGTKDSISKLVADLNNAKLEPDVDVVVAPPFLYIDQVKNSLTERIEISAQNSWVGKGGAFTGEISAEQLKDLGCKWVVLGHSERRHVIGENDEFIGKKAAYALSQGLGVISKKVAA

SEQ ID NO: 86833 - protein, 717 aa, Oryza sativa Indica Group
MATHERKTIDLEQGTIYNMCTQKPPHDYSQQLYEKYRESFEEYITSMVLPSLREKHDEFMLRELVKRWSNHKVMVRWLSRFFHYLDRYFISRRSLPQLSEVGLSCFRDLVYQEIKGKVKSAVISLTYFLEQIDQEREGEQIDRALLKNVLDIFVEIGLTSMDYYENDFEDFLLKDTADYYSIKAQTWILEDSCPDYMLKAEECLKREKERVAHYLHSSSEQKLLEKVQHELLTQYASQLLEKEHSGCHALLRDDKVDDLSRMYRLFSRITRGLEPVSQIFKQHVTNEGTALVKQAEDAASNKKPEKKEIVGLQEQVFVRKIIELHDKYVAYVTDCFQGHTLFHKALKEAFEVFCNKGVSGSSSAELLATFCDNILKKGGSEKLSDEAIEDTLEKVVRLLAYISDKDLFAEFYRKKLARRLLFDKSANDEHERSILTKLKQQCGGQFTSKMEGMVTDLTVARDHQAKFEEFISTHSELNPGIALAVTVLTTGFWPSYKSFDINLPAEMVKCVEVFKEFYQTRTKHRKLTWIYSLGTCNINAKFEAKTIELIVTTYQAALLLLFNGVDRLSYSEIVTQLNLSDDDVVRLLHSLSCAKYKILSKEPNNRSISPNDVFEFNSKFTDKLRRLKIPLPPVDEKKKVVEDVDKDRRYAIDASIVRIMKSRKVLGHQQLVMECVEQLGRMFKPDFKAIKKRIEDLITRDYLERDKDNPNVYRYLA

SEQ ID NO: 86834 - protein, 428 aa, Frankia sp. CcI3
MADVGDLVARDRRVVWHPYASVSGSTPLFPVASAAGTRLTLTDGRELIDGMSSWWAAIHGYRHPVLDEAVRGQLETMSHVMFGGLTHEPAVALAETLVAITPDPLRRVFPCDSGSVAVEVAIKMALQYWTGRGRPGRTRLLTIRRGYHGDTSGAMAVCDPDAGMHHLFSHLLPRHLFASAPACAFDEPCEDAHVAEIEGLLAGHADEIAAVICEPVVQGTGAMRWYAPGWLARLRELCDHYGVLLIADEIAVGFGRSGELFGCDHAGISPDIMCVGKAMTGGYLSMAATLCTDEVAAGVCDSPAGVFMHGPTFMGNPLASAVANASIDLLLSSPWQARVREISAGLAAGLAPAADLPGVADVRVLGAIGVIETREPVDMTVIQPLLVDLGVWVRPFGRLVYTMPPFIISPADVATLAAAMVEAVARTI

SEQ ID NO: 86835 - protein, 543 aa, Aspergillus oryzae
MSLSTSSGDFVRLAFVQYTVFLVSINAPAWDYNLVALDYLPKCDLHWVGNCNELNAGYAADGYARINGMSALVTTFGVGELSALNAIAGAYSEFVPIVHIVGQPHTKSQKDGMLLHHTLGNGDFNVFTRMSADISCTLGCLNSTHEVATLIDNAIRECWIRSRPVYISLPTDMVTKKIEGERLDTPLDLSLPPNDPEKEDYVVDVVLKYLHAAKKPVILVDACAIRHRVLDEVHEFVEKSGLPTFVAPMGKGAVDETHKNYGGVYAGTGSNPGVREQVESSDLILSIGAIKSDFNTTGFSYRIGQLNTIDFHSTYVRVRYSEYPDINMKGVLQKIVQRMGNLNVGPVSPPSNLLPDNEKASTEQAITHAWLWPTVGQWLKEKDVVITETGTANFGIWDTRFPAGVTAISQVLWGSIGYSVGACQGAALAAKEQGRRTVLFVGDGSFQLTLQEVSTMIRNNLNPIIFVICNEGYTIERYIHGWEAVYNDIQPWDFLNIPVAFGAKDKYKGYKVTTRDELRELFANEEFASAPCLQFEIDSRIGR

SEQ ID NO: 86836 - protein, 637 aa, Hyphomonas neptunium ATCC 15444
MLEIKNLDYRVEARPLFDAASARVAAGWKVGLIGRNGTGKSTLLRLIREEIASPGKDSPIRLQNGARLGWVAQEVAPTDQTILDVVLEADAERHALMLESETATDPDRIGDIHARLLDIDAWTAEPRAAEILMGLGFQTADLARATREFSGGWRMRAAIAGALFAQPDLLLLDEPTNYLDLEGAAWLEGYLRRYPNTVLIVSHDREMLNRSVTHTMALEHRKLMITPGGYDDWLKLRAAKLAQLESQKTKQDKDRAHLQSFVDRFRAKASKARQAQSRIKMLEKMQEISIPLEERAAPFNFPAPENMLAPPLLEIEDASMGYGPQAVILKGVKLRIDPDDRIAIIGTNGQGKTTLVKSIAERLPLLGGKRRMPKKVEIGYFSQDQLDELSIGDTVLEHVMRALPANTPVAKQRSVAAQLGFSHEKVETKVEKLSGGEKVRLILGLIGLARPQVLILDEPTSHLDIDSREALIYALNDFAGAVLLITHDVYLAEATADQLWLVKDGKVAPYAGDLSDYRALVMSSDRDKGGAAKPAAPAAVVVEDPVDKAEQRRRASQARESAAPLKKKADAAEKAFEKANGRIKTIDLELSKSGLSPQKITELSVERGKLEAEAAKAETEWLAALDAYESAVKEAVG

SEQ ID NO: 86837 - protein, 218 aa, Brassica napus
MVKICCIGAGYVGGPTMAVIALKCPSVEVAVVDISVPRITAWNSDQLPIYEPGLDDVVKQCRGKNLFFSTDVEKHVREADIVFVSVNTPTKTRGLGAGKAADLTYWESAARMIADVSVSDKIVVEKSTVPVKTAEAIEKILTHNSKGIKFQILSNPEFLAEGTAIEDLFKPDRVLIGGRETPEGFAAVKALKDVYSQWVPEERILTTNLWSAELSKLA

SEQ ID NO: 86838 - protein, 535 aa, Burkholderia pseudomallei K96243
MQSDDVVTETPEAPPREAVAPTAIAPRARTLDDYLKLVLNARVYDVARETALERARNLSARLGNAVYLKREDNQPVFSFKLRGAYNKMAHIPADALARGVITASAGNHAQGVAFSAARMNVKAVIVVPVTTPQVKVDAVRAHGGPTVEVIQAGESYSDAYAHAVKVQAERGLTFVHPFDDPYVIAGQGTVAMEILRQHQGPIHAIFVPIGGGGLAAGVAAYVKAVRPEIKVIGVQTDDSCAMKQSLAAGRRVELTEVGLFSDGTAVKLVGEETFRLCAAYLDEVVTVDTDALCAAIKDVFQDTRSVLEPAGSLAVAGAKRYAEQAGIEGETLVAVTSGANMNFDRMRFVAERAEVGEAREAVFAVTIPEERGSFKRFCALVGERNVTEFNYRIADARSAHLFVGVQIEHRGDSATIAASFVAHGFGTVDLSGDELAKQHVRHMVGGRSPLAHDERLFRFEFPERPGALMKFLSSMAPDWNISLFHYRNQGGDASSILVGLQVPRADHAAFDRFLAALGYPYREETGHPAYRLFLG

SEQ ID NO: 86839 - protein, 167 aa, Salmonella typhi
VLGRNGSDYSAAVLAACLRADCCEIWTDVDGVYTCDPRQVPDARLLKSMSYQEAMELSYFGAKVLHPRTITPIAQFQIPCLIKNTGNPQAPGTLIGASSDDDNLPVKGISNLNNMAMFSVSGPGMKGMIGMAARVFAAMSRAGISVVLITQSSSEYSISFCVPQSDC

SEQ ID NO: 86840 - protein, 641 aa, Colwellia psychrerythraea 34H
MIIATDLSLDRGAKNLIKSSSFTIHPNHKVGLVGSNGCGKSSLFAALLGDLSPDSGDLALPTSWDIATVRQETPSLEQTALDYVMDGDKEFRQLEHELEQARIMDNGNLEATIINKIDTISGYSLPARAGELLHGLGFLQSQLDNPVKDFSGGWRMRLNLAQALISRADLLLLDEPTNHLDLDAVIWLQRWLKRFTGTLVLISHDRDFLDTVIGQILHIEHQRAKLYSGNYTAFERQRREHLAQQDAQFQKQQKEAAHLTAFVDRFRAKASKAKQAQSRLKRLEKLPDLAPAHVDSQFTFSFAEPESLPYPLLSLDKSQCGYPKSDHGEQAIILDDVGLTLIPGSRIGLLGRNGAGKSTLIKSLAGELALLGGERYCAQDLTVGYFSQHQLEQLHAPSSPVDHILRAKPALGEPQARTFLGKFGFSGDQALSQVSTMSGGEKARLVLALIVLEKPQLLLLDEPTNHLDLEMRQALVMALQDFGGAIILIAHDRFLLESCVDEFYLVANGRVSDFSGNIDDYQQWLNDDKKQAIKSIKTDQQSGDKGLYKKQLRQQQAELRKKSAPMRKEADKLEKKVHQWQEELTKIEALLSDSDIYQSERKAELTDLLKKQANLKGDIEENEMLWLELAEQIEEMMSVTD

SEQ ID NO: 86841 - protein, 275 aa, Pasteurella multocida subsp. multocida str. Pm70
MLALSPSLLEKTLEIADQAGDFLTRFYTDSGQNALAIQTKQDNTPVTAVDLFLSQFLIEKLTSLTPEVPILSEESCKIPLQDRAHWAEYWLIDPLDGTQQFINRTDQFSILITLVQHNQPVLSITHAPILQTTYYAMQGFGAYRRQGNQQEKLNNQARPEQRKIKIAVGVGGVERKIQPLLNPAYQYEFLVYGSSGLKGGLVADGTCDCYIRVGKTGEWDTGAAEILLREMGGAVFDFAFQPLSYNQRESFINPNFVMVANTEFDWQKIFQFHSH

SEQ ID NO: 86842 - protein, 392 aa, Phytophthora tropicalis
LVTEIGEYRAAVPSGASTGEFEALEMRDGGKDYMGKGVLNAVKNVNEIIAPALVGKDVTKQAELDRFMVEQLDGTQNEWGWCKKKLGANAILGVSLALCRGGAAAKKQPLWQYIADLAGNPSPCLPVPSFNIINGGSHAGNKLAMQEFMILPVGATSFTESMKIGSEVYHNLKKVIKGRYGLDATAVGDEGGFAPNIQSNGEAIDLIEEAIKAAGYTDQVRLGMDVAASEFYTGASDARYNLDFKNENAPESEKISADKLQEVYEGFIAKCAGSSKIVSIEDPFDQDDWASWVKFTAKVGKDVQIVGDDLTVTNPTRVKKAIEQKACNALLLKVNQIGSITESIEAVTMAKKAGWAIMASHRSGETEDTFIASLAVGLSAGQIKTGAPCRSE

SEQ ID NO: 86843 - protein, 496 aa, Pasteurella multocida subsp. multocida str. Pm70
MKIEADNNCIVIFGASGDLTYRKLIPALYNLYKIGRLTEHFSVLGVARTELSDEGFREKMRQALIKSEKANGETLDQFCSHLYYQALNTADAADYGKLIPRLDDLHDKYQTCGNTLYYLSTPPSLYGVIPECLAAHGLNTEEFGWKRLIVEKPFGYDIRTAKELDIQIHRFFDEHQIYRIDHYLGKETVQNLLVLRFSNGWFEPLWNRNFIDYIEITGAESIGVEERGGYYDDSGAMRDMFQNHLLQVLAMVAMEPPAIINADSMRDEVAKVLYCLHPLSEDDLENHLVLGQYTAGTVEGEAVKGYLQEKGVPAESNTETYMALRCEIDNWRWAGVPFYVRTGKRLPSRVTEIVIHFKTTPHPVFSQKAPENKLIIRIQPDEAISMRFGLKKPGAGFEAKEVSMDFRYADLASPSLLTAYERLLLDSMKGDATLFARTDAVHACWQFVEPILQYKAQNGRVYEYEAGTWGPTEADKLIAKTGRVWRKPSGLMKKKV

SEQ ID NO: 86844 - protein, 337 aa, Ustilago maydis
MSQVNIGINGFGRIGRIVFRNSVVHNTANVVAINDPFIDLEYMVYMLKYDSTHGVFNGDISTKDGKLIVNGKSIAVFAEKDPSNIPWGQAGAHYVVESTGVFTTIDKASAHIKGGAKKVVISAPSADAPMYVCGVNLDAYDPKAQVVSNASCTTNCLAPLAKVIHDKFGIVEGLMTTVHATTATQKTVDGPSAKDWRGGRAAAANIIPSSTGAAKRVGKVIPSLNGKLTGMAFRVPTTNVSVVDLTARLEKGASYDEIKAEVKRASENELKGILGYTEDAVVSQDFIGNSHSSIFDAAAGISLNNNFVKLVSWYDNEWGYSNRCLDLLVFMAQKDSA

SEQ ID NO: 86845 - protein, 338 aa, Gibberella zeae PH-1
MAPIKVGINGFGRIGRIVFRNAVEHPDIEVVAVNDPFIEPHYAVYMLKYDSSHGIFKGEVGNQGNDLVVNGKTIKFYSERDPANIKWSETGADYVVESTGVFTTIDKAKAHLQGGAKKVIISAPSADAPMYVVGVNENKYDGSADIISNASCTTNCLAPLAKVINDKFGIVEGLMTTVHSYTATQKTVDGPSSKDWRGGRGAAQNIIPSSTGAAKAVGKVIPELNGKLTGMSMRVPTANVSVVDLTVRLEKGASYDQIKQVIKEASEGDLKGVLAYTEDDVVSSDLNGNTNSSIFDAKAGISLNDNFVKLVSWYDNEWGYSRRVLDLLAHVAKVDASK

SEQ ID NO: 86846 - protein, 478 aa, Silicibacter sp. TM1040
MTHTVEKIGGTSMSRVNELVGTLFTGGRKPDDLYGRVFVVSAFGGITNLLLEHKKTGEPGVYARFADAESDHGWHEALSRVGDEMRKAHEAVLENAGDVAQADAFVSERIEGARNCLIDLQRLCSYGHFRLAEHMLQIRELLSGLGEAHSAYVTALLLQRAGVNARFVDLSGWRDEGDVTLEERISSALNDVDPATEMPIVTGYAQCAEGLMREFDRGYSEVTFSCLAALTGASEAIIHKEFHLSSADPKLVGEGVAQKLGHTNYDVADQMSNMGMEAIHPKAAKTLRQADVPLRVTNAFEPEDPGTLIDDKPADQPAVEMITGLDIIALELFEQDMVGVKGYDAAILEVLTRHDVRIVSKTSNANTITHYLDTSLTVLKRVEKDLAKIYPNADISARLLSMASAIGRDLKGLSVLTRGLQAIADVGLASLGASQGPRNVDVQFIVEREDLKPVISALHKVLVEGRPAKQEKPIKAAA

SEQ ID NO: 86847 - protein, 191 aa, Triticum aestivum
  misc_feature (11)..(11): Xaa can be any naturally occurring amino acid
RGLLLPQLMYXLDWMNSSEPAYIYINSTGTARDDGEPVGMETEGLAIYDAMMRMKTEVHTLCIGAAAGHACLVLAAGKKGKRYMFPHAKALIQQPRIPSYGMMQASDVVIRAKEVVHNRNTLVKLLARHTGNPPEKIDKVMRGPFYMDSLKAKEFGVIDKILWRGQEKYMSDMLSPEDWDKVAGVRGPGGM

SEQ ID NO: 86848 - protein, 362 aa, Aspergillus nidulans FGSC A4
MSGLFGATANTSTAASNTTGDISKDVALNSPPEDSISDLRFSPASEHLAVASWDKKVRIYEINEQGQSEGKALFEHEAPVLNCCWSPDGTKVVGAGADKAARMLDLAANATAPIQVAAHDAPIRCCHMIPNPAGGTPLLVTGSWDKQVKYWDLRQSTPIASLECQERVYTMDVKDKLLVIGTADRYINIVDLNNPTKFYKTMQSPLKWQTRVVSCFTDANGFAVGSIEGRCAIQYVEDKDSSSNFSFKCHRETPPNQRDINNIYSVNAISFHPVHGTFSTAGADGTFHFWDKDAKHRLKGYPSVGGTISSTAFNRTGNIFAYAVSYDWSKGYSANTPQLPNKVMLHPVAQEEVKPRQNARRR

SEQ ID NO: 86849 - protein, 392 aa, Phytophthora palmivora
LVTELGEYRAAVPSGASTGEFEALEMRDGGKAYMGKGVLNAVKNVNEIIAPALVGKDVTQQAELDRFMVETLDGTQNEWGWCKKKLGANAILGVSLALCRGGAAAKKQPLWQYIADLAGNPTPCLPVPSFNIINGGSHAGNKLAMQEFMILPVGATSFTEAMQIGSEVYHNLKKVIKGRYGLDATAVGDEGGFAPNIQSNGEAIDLIEEAIKAAGYTNQVRLGMDVAASEFYTGAADARYNLDFKNENAPDSEKIPADKLQEVYEGFIAKCAGSSKIVSIEDPFDQDDWESWIKFTGKVGKDVQIVGDDLTVTNPTRVKKAIEQKACNALLLKVNQIGSITESIEAVTMAKKAGWAIMASHRSGETEDTFIAGLAVGLSAGQIKTGAPCRSE

SEQ ID NO: 86850 - protein, 484 aa, Pasteurella multocida subsp. multocida str. Pm70
MSVKGDIGVIGLAVMGQNLILNMNDHGFKVVAFNRTTSKVDEFLQGAAKGTNIIGAYSLEDLANKLEKPRKVMLMVRAGEVVDQFIEALLPHLEEGDIIIDGGNTNYPDTNRRVAYLREKGIRFIGTGVSGGEEGARFGPSIMPGGDESAWEHVKPILQAISAKTDKGEACCDWVGRDGAGHFVKMVHNGIEYGDMQLICEAYQFLKEGVGLSDDELEATFKAWRNTELDSYLIDITADILGYKDEDGSRLVDKILDTAGQKGTGKWTGINALDFGIPLTLITESVFARCVSSFKEQRVQASRLFNKVVGKVEGDKAAWVEAVRKALLASKIISYAQGFMLIREASENFGWHINYGGTALLWREGCIIRSRFLGNIRDAYEANPDLIFLGSDAYFKGILENSLGEWRKVVAKSIEVGIPMPCMASAITFLDSYTSERLPANLLQAQRDYFGAHTYERTDKPRGEFFHTNWTGRGGDAASTTYDV

SEQ ID NO: 86851 - protein, 177 aa, Triticum aestivum
MAVDLTPRQPAKAYGGEGGAYYEWSPAELPMLGVASIGAAKLSLAAGGMSLPSYSDSAKVAYVLQGKGTCGIVLPEATKEKVVAVKDGDALAIPFGVVTWWHNTPGSTTELVVLFLGDTSKGHRPGQFTNFQLTGASGIFTGFSTEFVGRAWDLKQDDAAKLVSSQPASGINQLGRA

SEQ ID NO: 86852 - protein, 359 aa, Triticum aestivum
  misc_feature (33)..(34): Xaa can be any naturally occurring amino acid
  misc_feature (65)..(65): Xaa can be any naturally occurring amino acid
  misc_feature (117)..(117): Xaa can be any naturally occurring amino acid
YCWLIYLADELIKNAAYIGTPGKGILAADESTXXTIGKRFASINVENVEDNRRALRELLFCTPGXALQYLSGVILFEETLYQSTKGGKPFVDILKAGNVLPGIKVDKGTIELAGTNXRTTTQGFDDLGKRCAKYYEAGARFAKWRAVLKIGATEPSQLSIDQNAQGLARYAIICQENGLVPIVEPEILVDGPHDIDRCAYVTEIVLAACYKALNDQHVLLEGTLLKPNMVTPGSDSKKVAPEVIAEYTARTLQRTVPAAVPAIVFLSGGQSEEEATLNLNAMNKLQTKKPWNLSFSFGRALQQSTLKAWSGKTENEEKARAAFLVRCKANSEATLGTYKGDATLAEGASESLHVKDYKY

SEQ ID NO: 86853 - protein, 715 aa, Oryza sativa Indica Group
MNMSPRIPVVDLEDGWRDVLAGVAKLKCILDGSNVVHFVPDEYMHLYTTVYNMCTQKPPNDYSQVLYDRYKQALDDHIESVVLPSLNEKHGVFLLREIVQRWEKHKLMVRWLRRFFDYLDRYYVTRRSLDSLKDLGWSSFRDLVFDKLKSTVATIMIGMGRQSNRPSTPEECPDIYVEIGDSQLNYYSDDFEQSFLNGTTDYYSKKAQTWILENSCPEYMLKAALFELIDRRAEEILNKENSGCKVLLCDEKTEDLARMFRLFSRITDGLLPVSKIFKEHVIAEGMSLLKHATDAANSRKDEKKGVVVGLPEQDFVRSVIELHDKYMAYVTNCFQSNSVFHKALKEAFEVFCNKDVVGCSSAELFAAYCDSILKRGGSEKLSDEAIDESLEKVVKLLTYLSDKDLFVEFHRKKLGRRLLFDKNTNDEHERILLSKLKQFFGGQFTSKMEGMLKDITLAKEHQSSFEEYVSNNPESNPLIDLNVTVLTTGYWPTYKNSDINLPLEMVKCVEVFKEYYRSDKQHRKLTWIFSLGNCVVIGNFDAKPVEFVLNTYQAALLLLFNEADKLSYSDIVSQLKLSDDDAVRLLHSLSCAKYKILNKEPSNRVISPEDEFEFNSKFTDRMRRIKVPLPQIDEKKKVVDDVNKDRRFAIDASLVRIMKSRKVLGHQQLVAECVEQLSRMFKPDIRIIKRRIEDLISREYLERDSENAQTYKYLA

SEQ ID NO: 86854 - protein, 988 aa, Schizosaccharomyces pombe
MVQLDDALQDAYKKVEREESLILGAKSNGGFDQESEVKRRLESNIAVSENNIKYLRERIDALKVESGSERESQSDKDSSKKYSDSAKSTNSDDHLLSYNRSAFDLFNSEKPLSPEKISTMLQHLQMRLSIEQQCVSGIEKIMSLYSKEQKDKTDVIIKLKEGKQKVNLLKRSLKRYNELHIPFDISTPSSEEKQQASGLNFRGLAKPISGTLKVTIHSLRNIEHTSFLQTHSFTMPSYAVLYVDDAQVAKSRISQTDTWDETFIFDVHRAKEFQIIIYEKKKDFDIPIALILIPTTIIAEELRRKRNIQEMSETSWKPSIAESASRSDEKGSKSDPINAPNSSSSISTNSPLAPTAYYKLLSKSWLSLEPVGQICISLSFSKRTTKRQFPETGLGRQGAIRQKKEDVVASQVGHQFVQRQFYQIMRCAVCAELFSYSPGLQCENCSFVCHKKCVTKVLASCIAQSNSEKSDFGGLRYRIPHRFEPFNSLGAQWCAHCGFFLPLRRKDCFKCVECGITCHGQCAHLIPDYCGMSNDLKHQLLTELEVSKRPKKPELPNQENKTTNEKVYRKPLSSQNTFDTLPTISQGLLAATQPVTSVLNTSPLPKTPEKDRSLNVTPSSSTPTPASVLAPPSSASLSSSKDANRSVPESPRREKKNRVTLDDFTFLAVLGKGNFGKVMLAEYKVNKKFYAIKVLKKEAILKNEELESLKTEKHVFEVANKEKHPFLLNLFASFQTSTRVYFVMEYILGGDLMVHIQRQQFSVKRARFYGAEVCLALKYFHENGIAYRDLKLDNILLCPDGHIRIADYGLCKENMLLGNTTSTFCGTPEFMAPEILLEQQYSKDVDWWAFGVLMYQMLLGQSPFKGEDEEEIFDAILSDEPLFPINMPADAVSLLRGLLTRDPNQRLGSGPKDANEVMAHPFFASIVWDDLYNKLYEPSYKPLINDPRDLNNFDEEFTSACPTLTPVNTVLTRQQQECFRGFSSFATE

SEQ ID NO: 86855 - protein, 397 aa, Rhodopseudomonas palustris CGA009
MTNSASHPAWPDHKPTALLVLADGTVFEGFGLGAEGHAVGEVCFNTAMTGYEEILTDPSYAGQLITFTFPHIGNVGTNDEDIETVNMAATPGARGVILRSAITDPSNYRSSRHLDAWLKARGIIGLSGIDTRALTALIRSKGMPNAVIAHSPTGEFDLHALKEEAREWPGLEGMDLVPMVTSAQRFTWDETPWAWGESFGRQDKPEFNVVAIDYGIKRNILRLLAGEGCKVTVVPATTSAEDILAMKPDGVFLSNGPGDPAATGKYAVPVIRKVIETGVPTFGICLGHQMLGLALGGKTVKMHQGHHGANHPVKDLTTGKVEITSMNHGFAVDKSTLPANVQQTHISLFDDSNCGIALADKPVFSVQYHPEASPGPQDSHYLFRRFTDLMRAKKAAA

SEQ ID NO: 86856 - protein, 485 aa, Chlamydomonas reinhardtii
SHLGYRHTRHSYFYTTLKLGTPERTFSVIIDTGSTITYIPCKDCSHCGKHTAEWFDPDKSTTAKKLACGDPLCNCGTPSCTCNNDRCYYSRTYAERSSSEGWMIEDTFGFPDSDSPVRLVFGCENGETGEIYRQMADGIMGMGNNHNAFQSQLVQRKVIEDVFSLCFGYPKDGILLLGDVTLPEGANTVYTPLLTHLHLHYYNVKMDGITVNGQTLAFDASVFDRGYGTVLDSGTTFTYLPTDAFKAMAKAVGDYVEKKGLQSTPGADPQYNDICWKGAPDQFKDLDKYFPPAEFVFGGGAKLTLPPLRYLFLSKPAEYCLGIFDNGNSGALVGGVSVRDVVVTYDRRNSKVGFTTMACADVARKLAERSTAAPNATVIKVSPPPPNPAPPAPKPPSPAPTPKPAAPKPGRARRGPCSTRSPSQRTQAAASGVAVTAAAAGVRVPPRPQPPAVLAPAPVHRLAAAVPAAQARRAAVAPRPTTLRW

SEQ ID NO: 86857 - protein, 254 aa, Bartonella henselae str. Houston-1
MSPNIRPFIAGNWKMNGTGESLGELRAIAAGISSDLGRLFEALICVPATLLSRAFDILGGENILLGGQNCHFDDYGPYTGDISAFMLKEAGASHVIIGHSERRTVYQESDAIVRAKVQAAWRAGLVALICVGETLEERKSNKVLDVLTRQLEGSLPDGATAENIIIAYEPVWAVGTGNTATSADVAEVHAFIHHKMHSRFGDEGAKIRLLYGGSVKPSNAFELLSTAHVNGALIGGASLKAIDFLTICDVYRKL

SEQ ID NO: 86858 - protein, 382 aa, Salmonella enterica subsp. enterica serovar Typhi str. Ty2
MIKSALLVLEDGTQFHGRAIGATGSAVGEVVFNTSMTGYQEILTDPSYSRQIVTLTYPHIGNVGTNEADEESSQVHAQGLVIRDLPLIASNFRNTEDLSSYLKRHNIVAIADIDTRKLTRLLREKGAQNGCIIAGDSPDAKLALEKAKAFPGLNGMDLAKEVTTAETYRWTQGSWTLKDGLPEAKSEDDLPFHVVAYDFGAKRNILRMLVDRGCRLTVVPAQTSAEEVLKMNPDGIFLSNGPGDPAPCDYAIEAIKKFLQTDIPVFGICLGHQLLALASGAKTVKMKFGHHGGNHPVKDMDRNVVMITAQNHGFAVDEDSLPANLRVTHKSLFDGTLQGIHRTDKPAFSFQGHPEASPGPHDAAPLFDHFIELIKHYRSSAK

SEQ ID NO: 86859 - protein, 573 aa, Burkholderia pseudomallei K96243
MNATNRFKSTVLAALVSSALAGFLPSAPAHAKGPQQRVVLDGSAVAVADKYSADAAEEIFRQGGNAVDAAVAIAFTLAVTYPEAGNIGGGGFMTVYMGGKPYFLDYRERAPLAATKDMYLDKDGNVVKGMSLYGDRAVGVPGTVAGMWEAQKRFGKLKWKQVIAPAIRYARDGFVVDEQLAQRGVDASKEFGGKTNFDQYFSGLKAGATFKQPELAAVLARIANDGAKDFYDGKTADLIAASMKKGGGLITKQDLVQYKAVWRQPIQANWNGYRVITAPPPSSGGIGLVQLLTMKADRKADFDGVALNSPQYVHLIAEIEKRVFADRAQYLGDPDFYKVPVAQLTDAAYIAKRAAEVNPEKPSDTKSVLPGLGTSMPEKAETTHFSVVDKWGNAVSNTYTINGYFGSGVVAEGTGIVLNDEMDDFSAKPGVANMFGVVGSDANAIEPKKRPLSSMSPTVLTKDGKVALVIGTPGGSRIFTSIFQVITNLYDFKMPLKDAVGAMRFHHQLLPPNTIFWEPYHPIDGELAKGIEAKGYTLKGQDFSGDIQAIRIDGKTPEAVSDPRGRGVSRVIR

SEQ ID NO: 86860 - protein, 422 aa, Bartonella henselae str. Houston-1 [sequence omitted]

SEQ ID NO: 86861 - protein, 1193 aa, Arabidopsis thaliana
MEYASTFQRPILFHGGDGASYCFPNRLISPKGISITSGDSKVHSCFRLRRNVAQSGTLNLMNACFSGRFYSGHLHSTKSILGNGHQAKRIPFGFRLRCQGHESLGNADSNDHRIGESSESSDETEATDLKDARVENDTDSLEELKELLHKAIKELEVARLNSTMFEEKAQRISERAIALKDEAATAWLDVNKTLDVIRDTVYEEALAKEAVQTATMALSLAEARLQVIVESLEAGAGNDIPHVSEETEETIDVNDKEEALLAAKDDIKECQVNLDNCESQLSALLSKKDELQKEVDKLNEFAETIQISSLKAEEDVTNIMKLAEQAVAFELEATQRVNDAEIALQRAEKSLSISQTPEETQGQLSDEETSQEDAMVLSGNVEDVTHQVEKESPKDGDLPVVQITAELVPDIVGQRNKKLTQPYESSDHENGKPSVESSKVVEADSEKPKINVQTKKQETQKDLPKEGSSLNSPKASFNKSSRFFSASFFSSNPDGTATVFGSLVGSVKQQWPKLVLGLALLGAGLTLYSNGVGGNNQLLQQPDVTSTSTEDVSSSTKPLIRQVQKLPKRIKKLLEMIPHQEVNEEEASLFDFLWLLLASVIFVPLFQKIPGGSPVLGYLAAGILIGPYGLSIIRNVHGTRAIAEFGVVFLLFNIGLELSVERLSSMKKYVFGLGSAQVLVTAAVVGLLAHYVAGQAGPAAIVIGNGLALSSTAVVLQVLQERGESTSRHGRASFSVLLFQDLAVVVLLILIPLISPNSSKGGIGFQAIAEALGLAAVKAAVAITAIIAGGRLLLRPIYKQIAENRNAEIFSANTLLVILGTSLLTARAGLSMALGAFLAGLLLAETEFSLQVESDIAPYRGLLLGLFFMTVGMSIDPKLLLSNFPVIVGTLGLLIVGKTMLVVIMGKLFGISIISAIRVGLLLAPGGEFAFVAFGEAVNQGIMSPQLSSLLFLVVGISMAITPWLAAGGQLIASRFELHDVRSLLPVESETDDLQGHIIICGFGRVGQIIAQLLSERLIPFVALDVSSDRVTIGRSLDLPVYFGDAGSKEVLHKIGAGRACAAVVALDAPGANYRCVWALSKFYPNVKTFVRAHDVVHGLNLEKAGATAVVPETLEPSLQLAAAVLAQAKLPTSEIANTINEFRTRHLSELTELCEASGSSLGYGYSRTSKPKPQPSDASGDNQIIEGGTVVI

SEQ ID NO: 86862 - protein, 506 aa, Petunia x hybrida
MMLLTELGAATSIFLIAHIIISTLISKTTGRHLPPGPRGWPVIGALPLLGAMPHVSLAKMAKKYGAIMYLKVGTCGMAVASTPDAAKAFLKTLDINFSNRPPNAGATHLAYNAQDMVFAHYGPRWKLLRKLSNLHMLGGKALENWANVRANELGHMLKSMSDMSREGQRVVVAEMLTFAMANMIGQVMLSKRVFVDKGVEVNEFKDMVVELMTIAGYFNIGDFIPCLAWMDLQGIEKRMKRLHKKFDALLTKMFDEHKATTFGRKGKPDFLDVVMENGDNSEGERLSTTNIKALLLNLFTAGTDTSSSAIEWALAEMMKNPTILRKAQAEMDQVIGRNRRLLESDIPNLPYLRAICKETFRKHPSTPLNLPRISNEPCIVDGYYIPKNTRLSVNIWAIGRDPQVWENPLEFNPERFLSGRNSKIDPRGNDFELIPFGAGRRICAGTRMGIVMVEYILGTLVHSFDWKLPSEVIELNMEEAFGLALQKAVPLEAMVTPRLQLDVYVP

SEQ ID NO: 86863 - protein, 431 aa, Burkholderia pseudomallei K96243
MNAPAEPGATTVPHRAGSLTILQGAALYIGAVLGTGVIALPALAAEVAGPASLLAWAALVMLSIPLAATFAALGARYPDAGGVSTYVRKAFGPKAAAVVGWCFYFAVPAGAPAAAMFGGAYVAAVTGGAHATMIASAAVLIALVAAANAFGVTVSGRMQLVLSALLVALLVAAVLASAPHARAANLHPFAPHGWLAVGEAAALLVWSFAGWEAITHLAAEFRRPARDLPRSTGIAVAVVGLLYLSVAAASVLVLGPAAGESGAPLAALIARGIGGNAQLIATAAALLLTLGTMNAYFAGAAKLGAALGRDGALPRWFAQGSQTGGVPRRSLAVIAALAGCALVAAVATGMGPKPLVLATSGNFVMVYVLGAAAATRLLPRGGLAHRASIVALLSALLLLATTGWYLLWPLLLTASAIGYLFITGRRAAAKR

SEQ ID NO: 86864 - protein, 487 aa, Frankia sp. EAN1pec
MSALTYQLYIDGAWRDSDGDGVLEVLNPATEEVIGAVPDGTVSDVDRAVAAARRAFDEGPWPTLSANERATALLRMADVMERRVDELKELSVREAGSTRALADTLQVSVPLHHFRDMAERVLRQFPFERAMLPTVGPTLAQGVVRREPYGVAALISAYNFPLFLNILKLAPALAAGCTVVLKPAPTTPLEAFVLGEMADEAGLPPGVLNIVSGGIAAGEALTTHPGVDIVSFTGSDTVGRLVYTQAAQSLKKVVLELGGKSANIITADVDLDLVVPTIVNGMTTHAGQGCSLLTRTLVHRSRLDELVGLVKQSLDHITVGDPADPATTMGPLISAAQRAKVESLISAGRAEGAQVAYGGGRPAHLDKGFFVEPTLFVDVDNSMTVARKEFFGPVGVVIAFDDDDEAVRLANDSEFGLGGGVWAQSPVRAYEIAKRLRTGMIYINGGGAGSSPHTAFGGYKQSGLGLERGEFGLEEFLLSKSIIWSAR

SEQ ID NO: 86865 - protein, 355 aa, Aggregatibacter actinomycetemcomitans
MLKTILVTGGAGFIGSAVVRYIIENTQDSVVNVDKLTYAGNLESLEAVKNNPRYIFEQVDICDAKALARIFEQHQPDAVMHLAAESHVDRSIDGPATFIETNIVGTYILLEAARAYWSSLNDEKKAGFRFHHISTDEVYGDLDGTNNLFTETTPYSPSSPYSASKASSDHLVRAWLRTYSLPTIVTNCSNNYGPFHFPEKLIPLIILNALDGKPLPVYGNGQQIRDWLFVEDHARALYKVVTEGKIGETYNIGGHNEKANIDVVRTICALLEELVPDKPAGVTKYEDLITYVKDRPGHDVRYAIDATKISRELGWKPQETFESGIRKTVEWYLNNRKWWSRVLDGSYNRERLGSQ

SEQ ID NO: 86866 - protein, 771 aa, Agrobacterium tumefaciens str. C58
MTSHDKNNTPANTAKADIEEQALFFHRYPRPGKLEIQATKPLGNQRDLALAYSPGVAAPCLAIHENPEMAAEYTARANLVAVISNGTAVLGLGNIGPLASKPVMEGKAVLFKKFAGIDVFDIEIDAPGINDMVSTIAALEPTFGGINLEDIKAPECFEVERQLREKMNIPVFHDDQHGTAIIVAAAVTNALELAGKSLSSVKIVASGAGAAALACLNLLVAMGANKENIWVHDIEGLVYEGRNTLMDEWKEVYAQKTDKRVLADSIDGADVFLGLSAAGVLKPELLERMAENPLILALANPNPEIMPEAARAARPDAMICTGRSDFPNQVNNVLCFPYIFRGALDCGATTINEEMKMAAVQAIAELAREEVSEVAARAYSGETPIFGPNYLIPSPFDPRLILRIAPAVARAAAASGVATRPITDFEAYFDQLNRFVWRSGFIMKPVFNAAKAAEKKRIIFAEGEDERVLRAAQVLLEEGTGVPILIGRPQIIETRLKRFGLRIRPHADFAVVNPEDDPRYREYVDDYFALVGRAGINPEAARTIVRTNSTVIGALSVKRGEADALICGLEGRYDRHLRDVNQIIGKQESVRSFAGLSLLITQQGALFLTDTFVNNDPTSEEVAEMAILAAKEIRRFGITPKIALASHSNFGSRDSESARKMRRALKIIQQAAPELEVDGEMQGGSALSEALRKRAMPNSVLTGEANLLVFPNLDAANITLGVTRTLTEGLHVGPILLGTALPAHILSPSVTSRGVVNMAAFAVVQASHPSV

SEQ ID NO: 86867 - protein, 460 aa, Euglena gracilis
MAVGSSMSATTQMHVQPAVRATTRVQPTLAMRGQISRLAANSQVYAEAPAAYEFQAPAQASGVSSGIAAMVMAPVAAAAAFFAYKKGQSDAQTYEVADPAGVQTYGTELVFAMNATIGNKYPGNSNTKAAISGFGRIGRNVLRCWYGRNPKPFDIVAINAGSMSPEQAAHLLKYDSVLGTFEADVQYGDDWISVDGKKLKLLTTRDPAQAPWKELGVEIVIEGTGAFNSLDGSSKHLTAGAKKVVITAPGKNCPTYVCGVNEDQYNPATDHVISNASCTTNGMAGVCKVLDENFTVQYGTMTTTHSYTGDQMILDGRHSDLRRARAGAVNIVPTSTGAAKAVALVLPNLKGKLNGIALRVPTPNVSIVDLVVKVDKKTTKEEVNAALKKAADGPLNGVLGYTELPLVSSDFKGTNVSATVDGQLSMVMGEDMVKVVMWYDNEWGYSQRVVDLTAVVAGKL

SEQ ID NO: 86868 - protein, 353 aa, Euglena gracilis
MAPVKIGINGFGRIGRMVFQALCDQGLLGTTFDVVGVVDMATDADYFAYQMKYDSVHGKFKHTVSTKKSDANLAEADIIVVNGHEIKCIMATRNPEDLPWGKLGVEYVVESTGLFTEADKARGHLKAGAKKVIISAPGKGDLKTIVMGVNHTEYQASMDVVSNASCTTNCLAPLVHVLLKEGVGVEKGLMTTIHAYTATQKTVDGPSKKDWRGGRAAAINIIPSTTGAAKAVGEVLPAVKGKLTGMAFRVPTPDVSVVDLTFLAEKDTSIKEIDSLLKKASQTYLKGILGFTDEELVSTDFVHDNRSSIYDSLATLQNNLPGEKRLFKVVSWYDNEWGYSNRVVDLLKHMSGN

SEQ ID NO: 86869 - protein, 1016 aa, Schizosaccharomyces pombe
MDMIDEAITEVVRKIERERSVIHGALSMKRLTQNQTVHQQLHSNIEESKKSIIYLEERLEKLKLRKNGVRKSNSEKPSVGIEKNPSFSTTKSAKSFSSTSSNIDSNLDLLNYDTPLTISKISFLLQQLEFKLSVEEQYRKGIEKMAKLYERVHDRRSIAEAEKKYVESAQKITLLKQALKRYHDLHIEIDEEDVPSTESRGNLNARRPQSGLLKITVGSLRNVTHSAGISKQTEMIVAIRAEDLERARTRPSRTDRFNETFEIDLEKTNEVEIVVYEKKNEKLLLPVGLLWIRLSDLVEKQRRKKVEQEVSDKGWVSADKMINQRLSIFLPSALNNISKPESTDRPNTASGNQSVSAWFSLEPMGQINLTMNFTKHNTRKRPMDAGLGRQGAIRQRKESVHEVYGHKFLQHQFYQIMRCALCGEFLKNAAGMQCIDCHYTCHKKCYPKVVTKCISKSSDSASSEYEKINHRIPHHFESHTNIGANWCCHCGYILPLGRKTARKCTECGITAHAQCVHLVPDFCGMSMEMANRVISEIRTTKIYKAQQHKQKSSHHKHHHHKKSKSSSSKHKENDKASVSITTTTTPSITPADPVPTSPKPLAIEPVKRKPVHAGNLEVTSVSDNKLGATVQVVEQKVDDKADALTKPPSLDAVKEPIPVPSVETSVVAQDLTHKAKRIGLEDFTFLSVLGKGNFGKVMLAELKSEKQLYAIKVLKKEFILENDEVESTKSEKRVFLVANRERHPFLVNLHSCFQTETRIYFVMDFVSGGDLMLHIQQEQFSRRRAQFYAAEVCLALKYFHDNGIIYRDLKLDNILLSPDGHVKVADYGLCKEDMWHDNTTATFCGTPEFMAPEILLEQQYTRSVDWWAFGVLIYQMLLGQSPFRGEDEEEIFDAILSDEPLYPIHMPRDSVSILQQLLTRDPKKRLGSGPNDAEDVMTHPFFSNINWDDIYHKRTQPPYIPSLNSPTDTKYFDEEFTRELPVLTPVNSILTKEMQQHFEGFSYSCEDDKPSTTDNA

SEQ ID NO: 86870 - protein, 530 aa, Lactobacillus sakei subsp. sakei 23K
MLEKNKMSLFSLVMLGLSSIIGSGWLFGAWEATTVAGPAAIISWVVGAIVIGAIAFNYVELGTMFPESGGMSHYAQYSHGSLLGFIASWSNWVSLVTIIPIEAVAAVQYMSSWPWSWANWTNRFMHHNEISTRGLLVVFAFIIVFTLLNFWSVKFLTRFTSFIAIFKLAIPLLTIIMLVSTGFHAENFGHSVATFMPYGSAKIFAATSISGIIFSYNAFQTVINVGSEIRDSKRNIGRGIAISLGISIVIYLLLQITFIGAVSPALIAKTGWHGLNFQSPFADLAILLGIHWLAVLLYLDAFISPFGTGVSFVASCARTLAALKQNKHMPPIVGKMNHQYNIPRVAMAINAVVSMLLVSVFRSWGTLASVISTATLIAYLTGPVTVMSLRKMAPDMNRPVHSPWMKVMAPLSFVLASLATYWAMWPTTIKVIGVIMLGLPFYFYYEYRIHWENTWAQFKGSLWLIIYLALLSLISFLGSREFNGINVIPYPLDFVLISALALIFYYWGIISRFYSKYFSRAKRINKDVQL

SEQ ID NO: 86871 - protein, 379 aa, Wolinella succinogenes DSM 1740
MSQVSLVVMGAGESSRFRQGLSIKKQWLRLGETPLWKHVALHLSKQACFDQVIITASPKEVKYMQKQVDFEVIEGGGTRQESLQNALASVKTPWVLVSDVARFDVPSEVISRVIGRLGEAECVAPAIGVSDTVSYQGEYLSRSEVKLIQTPQLSHVESLLLAFRQGDFTDESSAIAKSGGRVLLVEGSERLKKLTHPHELTLLQGFEPPFGGCYGGSGFDVHAFMEGEGLRLAGVNIPAPVTFKAHSDGDVAIHALIDALLGAAGAGDIGEWFPDSDLAYKGVDSTLLLQEVIKFIRGIGFELINADLTIMAQAPKLSPYKEAMERRLGEVMEVSRQRISVKATTTESLGFVGRKEGVAVSAQVVLKLLDWTKHACFNR

SEQ ID NO: 86872 - protein, 483 aa, Lactobacillus acidophilus NCFM
MKNIPVVMIIFGGSGDLAHRKLYPALFNLYEQGLIHDNFAVIGTARRPWSHEYLREQVSDAIHETHDQVDENDVKRFASHFYYQSHDVTNVEHYETLKKLAQELDDRYSAQGNRLFYMAMAPRFFGTIATHINDQSLTGSGFNRIVVEKPFGHDLASAEELNKEITASFNEDDIFRIDHYLGKEMIQNIMPMRFTNPLIKNIWTSENVKNIQVTLAERLGVEARGGYYDTSGALRDMVQNHIFQIITLLAMPEPKDLSSSSIHKAKQDLLESMIIPTPEEVEKDFVRGQYLGSDNTFAYKKEPNVDPESTTETFVAGKVKFKKGPVADVPIYFRTGKEFKEKKNRIDIVLKHMNNPYGQAHSNNITIEIDPVSKIYITINGKKIDTSGIRRENLTYEFSKEEMAKVPDGYERLLHDVFVDDSTNFTHWSELKRYWEFIDTVEDAWQKENEKGNPKISQYLPYRMGPKEASDIFESPTEHWIYE

SEQ ID NO: 86873 - protein, 240 aa, Brassica juncea
MGEESEAFATTAPLAPVTGQRKVRNDLEETLPKPYLARALVAPDTEHPNGSEGHDSRGMSVMQQHCAFFDQTGDGIVYPWETYAGFRDLGFNPISSVFWSIIINLAFSYVTLPSWLPSPLLPVYIETYTKPNMGSDSSTYDTERRFVPVNLENIFSKYALTVPNKMSLKELWNLTEGNRMAIDPFGWLANKVEWLLVYLLAKDEEGFVSKEAVRGVFDASLFEYCAKKNKEKKADSRKQD

SEQ ID NO: 86874 - protein, 370 aa, Wolinella succinogenes DSM 1740
MKNEAILDLLKEVTYPGFEKDIVTFGFVQKALLENDTLHVAIKIPSGVPEVEQKLRAEITQKLAPLGAKNIDLVIEQPQAQEEPKPQGPKNIAPHIKNFVMVSSGKGGVGKSTSSVNLAIALAQQGKRVGLLDADIYGPNIPRMLGLTKERPDVNAEQKKLIPLSAYGVEMMSMGVLYEEGQSLIWRGPMIIRAIEQMLKDVLWSDLDVLVIDMPPGTGDAQLTLAQSVPVTAGVTVTTPQRVALDDSERSLDMFKKLKIPIAGIIENMSGFICPDSGKEYDIFGKGTSQAVAEDFKTQVLAQVPIEPAVREGGDAGKPIVFFRPESQSAKEYMKAASILWSFIEQANSQKIVDNSEIQPVDAGKSACSS

SEQ ID NO: 86875 - protein, 172 aa, Mycoplasma penetrans HF-2
MGYEEIKNTIATIEDFPKKGISFKDITPLLLDHKKMNFIIDELAKFAKTIDFDIIVAPESRGFLFGLPLALNLKKPFVPIRKKGKLPREVISQEYELEYGKATIEVTKNDIPANSKVLIIDDLIATGGTTVAIQDLVTKLGSTVVGQAYLIELVGLCDYEKLQGKFFSMIKY

SEQ ID NO: 86876 - protein, 594 aa, Physcomitrella patens subsp. patens
MAVDEGVSYQPPSSFSSFSEYGRAILDTPRRLYKHAWDISTPTDEMSEVRARSGAEMSRSLHWWDVIALGVGGMVGAGIFVSTGTAARSSGPSVVIAYLVAGISALLSALCYTEFAVEMPVAGGAFSYLRITFGEFPAFIAGANLIMEYVLSNAAVARSFTSYAASAYGVLHADAWRVQVDGLADGYNQIDVVAVLVVMFLTAFLCCSTKKSCTLNLVMTVLHIAFILFIIVMGFVKGDVKNLTTAGDPVANPSGFAPMGIRGILGGAAIVYFSYIGFDSVSTTAEEVKNPARSMPIGVSGSVIIVTVLYSLIAIALCMLQPYDMIDTGAPFSSAFQHVVGWEWVTKFIGAGASLGIMTSLLVALLGQARYMCVLGRAHIVPQWFAAVNPSTGTPINATIFLGACTAAISLFTDLTVLLNLVSIGTLFVFYMVANALIFRRHYVRGKTSSLPTAAYLVVLSVLAITFVTVWQCGQHYRHNWALYLVGGLAIALTAVFWFKIPTAQKGKDWSVPCMPWVAAASIFLNVFLLGSVDKASYMRFVIWIIIAIVFYILYSVHSTHDAEARASLDTPLIAGTVQVKVESLPWIRVILSV

SEQ ID NO: 86877 - protein, 362 aa, Perilla frutescens
MVTSAMGPSPRVEELARSGLDTIPKDYVRPEEELKSIIGNILAEEKSSEGPQLPTIDLEEMDSRDEEGRKKCHEELKKAATDWGVMHLINHGIPEELIDRVKAAGKEFFELPVEEKEAYANDQAAGNVQGYGSKLANNASGQLEWEDYFFHCVYPEHKTDLSIWPTKPPDYIPATSEYAKQLRALATKILSVLSIGLGLEKGRLEKEVGGAEDLIVQMKINFYPKCPQPELALGWEAHTDVSALTFILHNMVPGLQLFYEDKWVTAKCVPNSIIMHIGDTLEILSNGKYKSILHRGLVNKEKVRISWAVFCEPPKEKIVLQPLPETVSEVEPPRFPPRTFAQHLKHKLFRKTDGDLDEKPTY

SEQ ID NO: 86878 - protein, 249 aa, Xanthomonas oryzae pv. oryzae KACC10331
MTRKLVLLRHGQSQWNLDNRFTGWVDVELTDQGRQEAVAAGKLMKDEGLQFDVAHTSVLKRAIHTLQGALKELDQDWLPVSKSWRLNERHYGGLQGLDKAETAAKHGEEQVKIWRRSYDIPPPAMDVDDPGHPCHDRRYATLDRNALPGTESLATTLVRVLPYWHDAIAPQLKAGQTVLVTAHGNSLRALYKYLNDVSNEQILELNIPTGIPLLFELDDNLQVRSFRYLGDPEAAKRAAEAVANQGKAK

SEQ ID NO: 86879 - protein, 198 aa, Salmonella enterica subsp. enterica serovar Typhi str. Ty2
MSYYAFEGLIPVVHPDAFVHPSAVLIGDVIVGAGVYIGPLASLRGDYGRLILEAGSNLQDGCIMHGYCDTDTIVHENGHIGHGAILHGCVVGRDALVGMNSVIMDGAVIGEESIVAAMSFVKAGFQGEARQLLVGSPARVLRQVTDQELHWKRLNTKEYQDLAIRCRTGLSETKPLTQVEENRPRLKGTTDVKPKSAQ

SEQ ID NO: 86880 - protein, 165 aa, Mycoplasma penetrans HF-2
MLRLNYHIWILIKMKYKIGNGIDIHKIKKEKCKQRLAGLDFELDYKIIAHSDGDIILHSISSAILGALSLQDLGTYFSDTDSKNKNLDSLEILSMCLNELKKQDYSISNVDITIICEYIIFKDIKDQIKSNLEKLLNNTEISLKATRYEEDKNMIQVNTVLLINK

SEQ ID NO: 86881 - protein, 178 aa, Wolinella succinogenes DSM 1740
MVIPLLGVIPQIDPSVLVCEGSYIIGDVVIGEESSVWFGAVIRGDVHFIRIGCRTSIQEGSVLHVEHYNLPDRSDGHPLLIGDEVTVGHKVILHGCTIANRCLIGMGAIVMDGVEIGEDSIVGAGALVTKGKRFPPRSLILGSPAKRVRELSDAEVEEIKASALRYVEYQNRYPRVEA

SEQ ID NO: 86882 - protein, 442 aa, Arabidopsis thaliana
MGICFSAEDQHYQFSQQQNYPKKTTPGKKAAVYLMKSDCEDVVGKVSGSGSGGGGLPLAQKNIKDLQSNPGYENVDIFTYEEMKIATKQFRPDYILGEGGFGVVYKGVIDESVRVGFKSTKVAIKELNPEGFQGDREWLAEVNYLGQLSHPNLVKLIGYCCEDDHRLLVYEYMAMGSLEKHLFRRVGCTLTWTKRMKIALDAAKGLAFLHGAERSIIYRDLKTANILLDEGYNAKLSDFGLAKDGPRGDQTHVSTRVMGTYGYAAPEYVMTGHLTSRSDVYGFGVLLLEMLLGKRAMDKSRACREHNLVEWARPLLNHNKKLLRIIDPRMDGQYGTKALMKVAGLAYQCLSQNPKGRPLMNHVVEVLETLKDDGDAQEEVMTNLHSRGKSVTLYEASSDSQGTRDGNGQRRRRPESGRSKSEAAVDTEKYVSTLSEPDTTKI

SEQ ID NO: 86883 - protein, 460 aa, Cytophaga hutchinsonii ATCC 33406
MALVELVMPKMGESVMEGTILNWLKKPGDRIQQDESVLEVATDKVDTEVPSPFNGILKEIKANQGDVVQVGTAIALIETDVNQAANSEPATTAPAANTNSGTATTQTVQQTAVAEKIPVSTPQTHIPAHTAGAKGGRFYSPLVLNIARQENISLAEVETIAGTGKDGRVTKNDLFDYLQAKKEGKVTAVTQETVVNETPQATEQKAPVAEPVYVNKPASSQSGNVEIIQMDRMRKMIADRMVESKRISPHVTSFVEADVTNIVYWRNRWKNDFMERENVALTFTPIFIEAVVKAIKDYPMVNISIEDDKIIVKKDINIGIAVALPNGNLIVPVIKNADQLNIVGLTKKVNDLAKRARQNKLTADDLSGGTYTVSNVGSFGNLMGTPIIVQPQAAILALGAVVKKPAVIETPQGDTLGIRHMMFLSHSYDHRAIDGSLGGMFVRRVADFLENFDVNRKIFV

SEQ ID NO: 86884 - protein, 486 aa, Bartonella henselae str. Houston-1
MANLYDVIVIGSGPGGYVTAIRAAQCGFKTAIVEREHLGGICLNWGCIPTKALLRSAEIKHFSEHLKDYGLKLNGSIEADIKDVVARSRAVSARLNAGVGFLMKKNKIDIIWGEAKFTKKAKGSQLVEITVSSSSKPIMQPQNPVPKGTLGEGIYQAKHIIIATGARPRILPGIEPDGKLIWTYFEAMIPHVMPKSLLVMGSGAIGIEFASFYHDMGASVTVVEMMPHIMPAEDIEISTFARKRLEKKGIRILSQAKVTKVEKAVDSITAHIDVKGKRETITADRLISAVGVQGNIENLGLEALGIKTDRGCIVTDEWSWTGVEGIYAIGDVAGPPMLAHKAEEEGVICIERLARLENIHPLDKRKIPGCTYCTPQVASVGLSEAAAKEAGYDIRVGRYSFSANGKAIALGEDQGLVKTIFDKKTGQLLGAHMVGAEVTELIQGFVIAMNLETTEEELMHTVFPHPTLSEMMKESVLDAYGQVLNA

SEQ ID NO: 86885 - protein, 373 aa, Vibrio vulnificus YJ016
MSIQSFIPPRRILMGPGPSDISPQVLQALSRPTVGHLDPLFIQMMDELKQLLKYAFQTKNDFTIAVSAPGSAGMEACFVNLIEPGDKVIVCRNGVFGERMRENVIRAGGEAILVDDEWGTPVSIEKVEQALTQHPDTKILAFVHAETSTGARSDAETLGKLAKQYGVLTIVDTVTSLGGIPLKVDEWQLDAVYSGSQKCLSCVPGLAPVTFSSAAIEKIQSRKTPVQSWFLDQSLVLGYWSGEGKRSYHHTAPVNSLYSLHEALLMLKNEGLENAWARHEKMHNKLKVGLEKLGFQFVVDEEYRLPQLNAIYVPEGIDEAKVRSHLLETYNLEIGAGLGALAGKAWRIGLMGYGAREENVALCLRALEESLTQ

SEQ ID NO: 86886 - protein, 490 aa, Vibrio vulnificus YJ016
MDFLIIQTDLSKLLCPFPHQNKHRMLDYQRLIFFGSRGRNAVSALNVAKFGGTSVANFEAMSRCSAIIENNPETRLVVSSACSGVTNLLVELANGVQSQERRAELLAQLAEIHDAILNQLEDATEAAAEVYAILDTITSLAEAASIQASNKLTDHLVACGELMSTHILAQLMRERGVNAVRFDIREVLRTDDNFGRAEPDVAKIAELAQEKLLPLCRDYVVVTQGFIGSDEEGNTTTLGRGGSDYSAALIAEGVKASGLEIWTDVPGIYTTDPRIAAKAAPIPEISFAEASEMANFGAKILHPSTLVPALRHDIPVFVGSSKEPEKGGTWIRHEAQSSPLFRALALRCNQTMVTLRSAKMFHAYGFLAKVFEILAKHKISVDLITTSEISVSLTLDKTDTSGGAPEVPQAAREELEELCTVEVEHNLCLVALIGNHMETKGYAKEVFSTLGDFNLRMICYGASDHNLCFLVDAHDSKSVIQKLHQDLFER

SEQ ID NO: 86887 - protein, 444 aa, Bordetella bronchiseptica RB50
MRQYHYITEMMRVALQDLSTLRIKGRVVQVVGTIIKAVVPMVKIGEVCLLRNPGEDFEMHGEVVGFVRDAALLTPIGDMYGISSATEVIPTGRTHMVPVGPGLLGRVLDGLGRPLDVAESGPLHAHKFYPVFADAPDPLTRRIIHAPLELGVRVLDGLLTCGEGQRLGIFAAAGGGKSTLLGMLVKGAAVDVTVVALIGERGREVREFLEHELGPEGRRKSVIVCATSDKSSMERAKAAYVATAIAEYFRDQGQRVLFLMDSVTRFARAQREIGLAAGEPPTRRGYPPSVFATLPKLMERAGMNQTGSITALYTVLVEGDDMNEPVADETRSILDGHIVLSRKLGAANHYPAVDVLASASRVMNAVVSPRHKYLAGRMRELMAKYQDVELLVKIGEYKQGADASTDEAIQKIGQINAFLRQLTDEREAFEDTVLRMAEIIGPES

SEQ ID NO: 86888 - protein, 444 aa, Vibrio vulnificus YJ016
MSVYYTLCFLSAAAMLIAFVNSKIGKMQTTIAITAGSMVLSLLILIAGQNNWFHLTEIATQTMSSIDFEDFLLKGILGFLLFAGGLGIKLPNLKDQKWEITVLALGATLFSTFFIGFALYGICQLIGIQFDLIYCLLFGALISPTDPIAVLAIVKKLKAPRRISTQIEGESLFNDGFGLVIFVTLFTIAFGHETPTVGSVTMLFIQEAIGGILYGFALGLLFHYLICATDDHSMELLLTIGIPTAGYAFAEVLHVSGPLAMVVSGIMIGNWTRFIGFSKESEDHLDHFWELVDEFLNGVLFLLIGMSMLLFKFHQEDWILMAIAIPLVLIARYLSVFLSYIGFKRFRQYNPWSIKILTWGGLRGGLALAMALSIPSGIWVIPDKLIDVKEIILVMTYAVVVFSILVQGSTITPMIEKAKQSEAEFEAKQSSVTAPEGKTESISS

SEQ ID NO: 86889 - protein, 359 aa, Bartonella henselae str. Houston-1
MRCFCQNPAITTIILVIHPEDRQICEQAIADFKEQLIIVEGGNTRQKSTLRGLQALRKFKPKYVHIHDGARPFVENKLLEQIHTTVTPQEGVLPVLAVCDTLKRINSTHHVLETIPRTHLYSAQTPQCFPFERILAAHEKAIKTCKKEFTDDSAIAEWFGISMRTIPGSPHNIKITWHEDLNTAHLYLQKKMQMFPDIRTGNGYDVHSFEEGNSLILCGIKIPFHKKLNGHSDADVALHALTDALLATRGAGDIGTHFPPSDPQWQNVSSEIFLRHALDIVKQAGGRIANVDITLIAEEPKIGPYRHAMVGNLMNMLTILPDRISIKATTNEKLGFIGRGEGIAAFATANVLYPGEIPK

SEQ ID NO: 86890 - protein, 360 aa, Cytophaga hutchinsonii ATCC 33406
MEKKIAVLKGDGIGPEVTDQALKVLKAVEKTFGHKFHYTEALVGAVAIDATGNPFPEETLKVCQSSDAILFGAIGHPKYDNDPKAKVRPEQGLLAMRKALGLFANIRPVNTYKILENASPLRADLVQNVDFVVFRELTGGIYFGTRGRSEDGNMAFDTCTYTRDEILRISKLAFESARQRKNHVTLVDKANVLASSRLWREVVKEYHAANFADVTLDFMFVDNAAMKIIQQPAFFDVVLTENMFGDIITDEASVITGSMGMLPSASVGSVVGLYEPIHGSYPEGAGLNIANPNGAILSAALLLETSFGMVAEAKAIRAAVEKAMEDGILTIDIRREKPNSTTEVGDYVANLVAKGASVVA

SEQ ID NO: 86891 - protein, 1027 aa, Magnetococcus sp. MC-1
MKSLLSINHIFGLFTLAGMLLLSLFFGGLMLSGFNEVFDHHVERTMDARLTGFAQQLTDYVSLHDAMLHDLASNPLLVQGVMQQESGKANAVDFLERYRIMGAQRRLTLYGFDGHLLHDTAKQPRRPPLSENLVQILLRGHNKHIWRFQAQDKDQSSLWMAVPISWNAVPEGVLAMEIPSLEMPQLKRHYGQGEEDDIELFKDGERIFGVDGHLNGRQAQLYMPTLGITLRYTAHLGEIYSHRDRLLARIKMIGLAALLLAGSGVFWMGRVLFVRPLQRLKERTTHLANGEVRDLLNEVRRRVMVRELQELTDQFDVMALQVSSARTSLEEKVHERTAQLEWELEERHKTEHRLRQVLTLQTAILDSANSSIISTDRTGIVQTFNKGAERMLGYKAVAVVGQYTLDMFYNSNELRQHSLQLSATLDKRVDPGIESLFVLAREGKVDEREWMILHQDGHQVPVLMTVTPIYNSSGLLVGYLNMGTEISERKRLAAELKETNWRLQRALDSAQAGTFYYAVVHDHMQWNRRALEMFGLNDATFNGHLQDWLQRVVAVDRHRIDTLFAEVLATPNVETLDISYTILRQGDEAQRVIRTQGWIHRDPHGKATHLSGLFLDITEQMQAQQVLEEARQAAEEASQAKSDFLASMSHEIRTPMNAVIGLSDVLAETPLNPEQQHYVTTLQRASHTLLDLINAILDLSKIESGRFELIERPFDLSDMAHGVCSVLRVQAEQKGLSLALEMDETLPPFVVGDSPRLRQILINLIGNAIKFTEQGFVKVSVQARDQQRTLWFGIADSGVGIAPTQVEQIFEKFTQVDSSVVRRFAGSGLGLAISKQLVGLMGGHIGVESRLGEGSLFYFSLPLRPGETLFEAPLRAPIYQESPAESVPIRLLVVEDSVDNRMLVRTYFKKYHCELRFAVDGQEGVEMFQEGGCDLVFMDVQMPRMDGYTATRLIRNWERSHGMQPTPILALTAHALESDVKKSRQAGCNEHLTKPVSKRTLVDAVERQLNIKLMLRSLPAVSLPQTV

SEQ ID NO: 86892 - protein, 213 aa, Zea mays
  misc_feature (200)..(200): Xaa can be any naturally occurring amino acid
MLLTKPQLSSSLLASTPLFNPTSNPNHARPIAASPSPRRRLRISAASTAVSPGATALSRVDVLSEALPFIQRFKGKTVVVKYGGAAMKSPELQSSVIRDLVLLSCVGLRPILVHGGGPEINSWLLRVGVEPQFRNGLRVTDALTMEVVEMVLVGKVNKNLVSLINLAGGTAVGLCGKDARLITARPSPNAAALGFVGEVXRVDATVLHPIIAS

SEQ ID NO: 86893 - protein, 366 aa, Phytophthora megasperma
ELGEYRAAVPSGASTGEFEALEMRDGGADYMGKGVLNAVKNVNDIIAPALIGKDVTKQEELDRFMVEKLDGTQNEWGWCKKKLGANAILGVSLALCRAGAAAKKQPLWQYIADLAGNPSPCLPVPSFNIINGGSHAGNKLAMQEFMILPVGATSFTEAMKIGSEVYHNLKKVIKGRYGLDATAVGDEGGFAPNIQSNGEAIDLIEEAIKTAGYTNQVRLGMDVAASEFYTGAKDARYNLDFKNENAPESEKIPAEKLQSVYEGFIAKCAASSKIVSIEDPFDQDDWESWVKFTAKVGKDVQIVGDDLTVTNPTRVKKAIELKACNALLLKVNQIGSITESIEAVTMAKKAGWAIMASHRSGETEDT

SEQ ID NO: 86894 - protein, 392 aa, Phytophthora inflata
LVTEIGEYRAAVPSGASTGEFEALEMRDGGKDYMGKGVLNAVKNVNEIIAPALVGKDVTKQAELDRYMVEQLDGTQNEWGWCKKKLGANAILGVSLALCRGGAAAKKQPLWQYIADLAGNPSPCLPVPSFNIINGGSHAGNKLAMQEFMILPVGATSFTESMKIGSEVYHNLKKVIKGRYGLDATAVGDEGGFAPNIQSNGEAIDLIEEAIKAAGYTNQVRLGMDVAASEFYTGASDARYNLDFKNENAPDSEKIPADKLQEVYEGFIAKCADSSKIVSIEDPFDQDDWESWVKFTAKVGKDVQIVGDDLTVTNPTRVQKAIEQKACNALLLKVNQIGSITESIEAVTMAKKAGWAIMASHRSGETEDTFIASLAVGLSAGQIKTGAPCRSE

SEQ ID NO: 86895 - protein, 467 aa, Agrobacterium tumefaciens str. C58
MYQFDLIVVGSGPAGRRAAIQAAKLEKKVLVIEKGSRVGGVSVHTGTIPSKTLRETALNLTGWRERGFYGRAYRVKQEIDADDLRRRLLITLDHEVEVLEHQFARNRVQHIRGTASFIDANTMKVVKSDGEVMTVTATSILLTIGTRPYRPPHIPFDGQAVLDSDEILEIKELPRSMVVVGAGVIGIEYATIFSALDTQVTVVEPRETMLEFIDKEIVEDFTYQLRDRNMKLIFGQKAEKVERDESGKCLVSLSNGRVLKAETVLFAAGRVGATDTLNLSACGLEADSRGRLKVDPETFQTSVPNIYAAGDIIGFPSLASTSMEQGRIAARHAVGAPAGEPPQFFPYGIYAVPEISTCGLTEEEVVERGIPYECGIAHFRETSRGHIMGLDSGLLKMIFSLKTRRLLGVHIVGEGATELVHIGQAVLNLKGTVEYFVENTFNYPTLAEAYKIAGLDAWNRMGELKKD

SEQ ID NO: 86896 - protein, 114 aa, Brassica juncea
MESTLNTTARIGSWSSVISPPLQVCESFKWKLPTATRKVVVATDRQNSNFRWRKVTTGRANVAAEAAARVPTSVPVRVARELAQAGYKYLDVRTPDEFSIGHPSSAINVPYMYR

SEQ ID NO: 86897 - protein, 392 aa, Phytophthora primulae
TTEIGEYRAAVPSGASTGEFEALEMRDGGADYMGKGVLNAVRNVNEIIAPALVGKDVTKQAELDRYMVETLDGTQNEWGWCKKKLGANAILGVSLALCRAGAAAKKQPLWQYIADLAGNPSPCLPVPSFNIINGGSHAGNKLAMQEFMILPVGATSFTEAMKIGSEVYHNLKKVIKGRYGLDATAVGDEGGFAPNIQANAEAIDLIEEAIKDAGYTNQVRLGMDVAASEFYTGAKDARYNLDFKNAEGAESEKISADKLLEMYEGFISKCADSSKIVSIEDPFDQDDWESWVKITAKIGKDVQIVGDDLTVTNPTRVKKAIEQKACNALLLKVNQIGSITESIEAVTMAKKAGWAIMASHRSGETEDTFIADLAVGLSAGQIKTGAPCRSER

SEQ ID NO: 86898 - protein, 392 aa, Phytophthora capsici
LVTDIGEYRAAVPSGASTGEFEALEMRDGGKDYMGKGVLNAVKNVNEIIAPALVGKDVTKQAELDRFMVEELDGTQNEWGWCKKKLGANAILGVSLALCRGGAAAKKQPLWQYIADLAGNPSPCLPVPSFNIINGGSHAGNKLAMQEFMILPVGATSFTESMKIGSEVYHNLKKVIKGRYGLDATAVGDEGGFAPNIQSNGEAIDLIEEAIKAAGYTNQVRLGMDVAASEFYTGASDARYNLDFKNENAPESEKIPADKLQEVYEGFIAKCADSSKIVSIEDPFDQDDWASWVKFTAKVGKDVQIVGDDLTVTNPTRVKKAIEQKACNALLLKVNQIGSITESIEAVTMAKKAGWAIMASHRSGETEDTFIASLAVGLSAGQIKTGAPCRSE

SEQ ID NO: 86899 - protein, 521 aa, Oryza sativa
MSKDAKSPTKESKRKSKSSDAAESPKKSKKTASATASSSSNVESTSSKGKSKAKDGQATLKVQGSKSASQQLSKAGAAFASFADYNPAPSTKFSLYRAEGLPDETGARDDASDERLLLAGETDTMAYVGNNFEFGSTAEARGYTGEYMVGIYDPSSSSITLRALPTFQVARSIKANSSLASISSSRTFADYGEMTAARRALGDAFGNRKQKANARNQDRMKVDTANMEVILDDFTGGIQDSVASLPSLDEVLASSTASRPMPPANLDAKHPAEAYRISDLIPTDVFQALPIQKLIDNVHDADELQKLIPYSREFPDWIWSRLVDNLQRSSHLGGGSKSQKHTTFDDDDEDADKPANGDDDDVMMMPALGATEDKEDATNKVRLAYYMSMLWYLHSRPKSVSQRSRLITSLKLDGEDANKRIVRALLNTFSETPANSDRAQMSAFHQTKLLAYMCALALHLDNFSVDYDKLARNCNIAPSTLRELFRTLGCTAATTGGERRMVLKTPFTLPQPRKGKAGGRK

SEQ ID NO: 86900 - protein, 166 aa, Pseudomonas syringae pv. tomato str. DC3000
MSNHDQKRDEGYIEKLVQVNRVAKTVKGGRIFTFTALTVVGDGKGRVGFGRGKSREVPAAIQKAMEAARRNMIQVDLNGTTLQYAMKSAHGASKVYMQPASEGTGIIAGGAMRAVLEVAGVQNVLAKCYGSTNPVNVVHATFKGLKGMQSPESIAAKRGKRVEEII

SEQ ID NO: 86901 - protein, 450 aa, Lactobacillus sakei subsp. sakei 23K
MKRNLNARQMQMIALGGTIGVGLFMGANTTIKWTGPSVLIAYGIAGLLLYLIMRALGEMLYVDPDTGSFAKFATEYMHPIFGYLTAWSNVFQFVVVGMSEMIAIGGYLEFWWPNLPGWVPGLVAITFLCAANLISVSMFGELEFWFALIKVVTIVLMIVAGLGLIIFGIGNHMHPVGISNLWAHGFFTGGFKGFVFALAIVLASYQGIELIGITAGEAENPQETLVKAIQSTVARILIFYIGAIFVILSIYPWNELNQVGSPFVQTFAKIGITAAASIINFVVITAALSGANSGIYSASRMTFTLANNGQLPKRFLKLNRHGVPFYAVGAISLGILIGVILNAILPLVYPKAGNIFVLVYSSSVLPGMVPWFVILISQIAFRKQHAEKMATHPFKMPWSPYSNYITLAMLCLTLVFMFINPETRISLIVGLIFLVLMIVIYFVKFGRQKE

SEQ ID NO: 86902 - protein, 139 aa, Triticum aestivum
QSAYFDRYGGGANSLASGYSRGTGLGAEIIGTFVLVYTVFSATDPKRNARDSHVPVLAPLPIGFAVFMVHLATIPVTGTGINPARSLGAAVIYNKDKPWDDHWIFWVGPLVGAAIAAFYQQYILRAGAIKALGSFRSNA

SEQ ID NO: 86903 - protein, 391 aa, Medicago truncatula
MEILNSLTKEEILEVLSHGLCHHCETLVHDRLIRMPHKRKRGGENLYPVEDLEDLLVDDNGSISESWNKRIRKEGKSSRKANDMKYNFDSSPPKYLKERRRSDTEVLLCDGIVDVSPPDNELKEEPDELIRYYEVHCKRINGRDINLLEGLELHSSVFNATEQNEIVDYIYILQRRGQQGRLRERTYSKPRKWMRGKGRETLQFGCCYNYAVDKNGNPPGISRTEEVDPLPRMFKQMIKRMVRWKIIPPTCVPDSCIVNIYDVGDCIPPHIDHHDFVRPFYSVSFLNKAKILFGSNLKAVRPGEFFGPASISLPVGSVFVLKGNGADIAKHCIPSVLSKRISITFRKMDKRKLPYTYSPDHDLVGSSQFSSNNVLTRQRVLNLNLIQFGRH

SEQ ID NO: 86904 - protein, 443 aa, Pichia jadinii
MGKLLQLALHPDELASIVQFKLFRKNENARNPATESAELIRCYELLNLTSRSFAAVIEELHPELRNVIMVFYLVLRALDTVEVDMSIENSVKLPVLRQFHEKLDTKDWTFDGNSPNEKDRCVLVEFDRILGQYHELKPQYQKVIKEITEKMGNGMADYIENENFNSNGLLTIEDYDLYCYYVAGLVGDGLTQLIVLAKFGNSELSVNKQLFKSMGLFLQKTNIIRDYEEDQVDGRAFWPKEIWGKYANELSDFMKPENQSQGLWCISELVCNALDHVIDVLQYLALVEEQTSFNFCAIPQVMAIATLELVFQNPQVLTQHVKIRKGTTVSLILESRTLEGCARIFRRYLRKIHHKSHPSDPNYLRLGITIGKIEQFLDGMYPHYVPKGITPQTTSIRTQVVKRLQLDEPMKRDIDEEILKTRILLLSLGVAVFGVVYGVVRII

SEQ ID NO: 86905 - protein, 365 aa, Mycoplasma penetrans HF-2
MSLSTGIVGLPNVGKSTLFNAITNSSVEAANYPFATIEPNVGIVNVPDVRLTNLANLINPEKVVYNTFKFVDIAGLVKGASKGEGLGNKFLSNIREVDAICHVIRCFENTDITHVNSSVDPIRDLEIINLELIFSDIEVINNRLGRIGKKAQSRCKDSAFEKEVCEKILAALTNEKLANTVELNDKEKLVIKSYSLLTIKPIIYVANVSENDLNNLDANIHYKNLENKVGKENIIPLAIKLEQELSKIENYEEKKEFLKMMNLTEIGLDKLILKAYQILDLMTYFTYGKKEVRAWEFKKGMTAPECAGIIHSDFQRGFIKAEIIKYDDLMEYKSEDEVKKQGKMKLAGKDYIVEDGDICTFKFNV

SEQ ID NO: 86906 - protein, 159 aa, Clostridium thermocellum ATCC 27405
MRITIIAVGKIKEKYLKEGINEYSKRLSRYCKLEIIEVEDEHAPDNLSSLEEQQVKKREAERVVKRLKEGTLLVVLDVRGSKMSSEELARKLESFFISGKSHVTFVIGGSLGIDKELLNMADFSLSLSDMTFPHQLTRLILLEQLYRSFKIINGEPYHR

SEQ ID NO: 86907 - protein, 2275 aa, Emericella nidulans
MPETVGHEEPALPSSPQARGAVAYNAISKELQPLPPTETANGGIIPPASSRIEGSTGRLCALELEDGTVYQGYNFGAEKSVAGELVFQTGMVGYPESITDPSYRGQILVITFPLVGNYGVPSRETMDELLKTLPKHFESTEIHIAALVVATYAGENYSHFLAESSLGQCVKEQGVPAIHGVDTRALTKRIRQKGSMLGRLLLHKADVAETDAALAQDTWKSSFEQIDWVDPNTKNLVSEVSIREPKLFSPPENVALKHPSSRPIRVLCLDVGLKFNQLRCLVARGVEVLVVPWDYDFPTLAGKDYDGLFVSNGPGDPATMTTTVNNLAKTMQEARTPIFGICLGHQLIARSVGAQTLKMKFGNRGHNIPCTSLVTGKCHITSQNHGYAVDSSTLPSDWQELFDNANDGSNEGIRHVSRPYFSVQFHPESTPGPRDTEYLFDVFINAIKDTIASAEALQKPVNFPGGAVAENIKASPRVSVKKVLILGSGGLSIGQAGEFDYSGSQAIKALKEEGIYTILINPNIATIQTSKGLADKVYFLPVNADFVRKVIKHERPDAIYVTFGGQTALQVGIQLKDEFESLGVKVLGTPIDTIITTEDRELFARSMDSIGEKCAKSASASSLEEALQVVESIGFPVIVRAAYALGGLGSGFADNLDELKDLCAKAFAASPQVLIERSMKGWKEIEYEVVRDARDNCITVCNMENFDPLGIHTGDSIVVAPSQTLSDEDYNMLRTTAVNVIRHLGVVGECNIQYALNPYSKEYCIIEVNARLSRSSALASKATGYPLAFIAAKLGLNIPLNEIKNSVTKVTCACFEPSLDYCVVKIPRWDLKKFTRVSTQLGSSMKSVGEVMAIGRTFEEAIQKAIRSVDFHNLGFNETNALMSIKTELQTPSDQRLFAIANAMAAGYRLDDIWKLTNIDKWFLTRLKGLSDFGKLMTNYNASTVTAPLLRQAKQLGFSDRQLAKFLSSNELAIRRLRVEAGIIPIVKQIDTVAAEFPSVTNYLYLAYNASEHDVRFDDNGIMVLGSGVYRIGSSVEFDWCSVRTIRTLREQGHKTVMVNYNPETVSTDYDEADRLYFENINLETVLDIYQLESSSGVIMSMGGQTPNNIALPLHRLNVRILGTSPEMIDGAENRYKFSRMLDRIGVDQPAWKELTSIEEAREFCDKVGYPVLVRPSYVLSGAAMNTVYSEHDLASYLNQAADVSREHPVVITKYIENAKEIEMDAVARNGVMVGHFISEHVENAGVHSGDATLILPPQDLDPETVRRIEEATRKIGNALNVTGPFNIQFIAKDNDIKVIECNVRASRSFPFVSKVMGVDLIEMATKAMIGAPFAEYPPVTIPKDYVGVKVPQFSFSRLAGADPVLGVEMASTGEVASFGRDKYEAYLKALLSTGFKLPKRNILLSIGSYKEKMEMLPSIIKLRDVGFELFATSGTADFLKENGVPVKYLEILPGEDEDIKSEYSLTQHLANNLIDLYINLPSSNRFRRPANYMSKGYRTRRMAVDYQTPLVTNVKNAKILIEAIARHYALNVQTIDYQTSHRSIILPGLINVGAFVPGLGSADSKDFEAVTKASIAAGFSMIRVMPVGVDSSITDARTLKLVQQNAGKASFCDYNFSVVATSSNSAEVGQLTGEVGSLFIPFNHLSGNISKVAAVTSHFGAWPSSKPIITDAKSTDLASVLLLASLHSRNIHVMSVTSKEDIGLIALSKEKGLKVTCDVSIYCLFLSRDDYPEAAFLPTREDQKALWEHLSTIDIFSIGSIPYQLAGEKGSPAAGIAEALPLLFTAVSEGRLTVEDIIARLYENPKKIFELHDQSDSSVEVEIDRPYLFQSAQAWSPFSGKSVKGLVQRVIFQGKTSCLDSEITPDAPKGSDMSGHRIVPASPSLKAMSPRVDGALDRRQSISIAGTPARLGRKPVDHFPAATGAELGPPLYTPVPRASSPLLQMLSRSPFKQKHVLSVNQFNRADLHLLFTVAQEMRLGVQREGVLDILKGRLLCTLFYEPSTRTSASFDVAMQRLGGRTIAISTEHSSTKKGETLQDTLRTLGCYGDAVVLRHPEPSSTEVAAKFSPVPVINGGNGSVEHPTQAFLDLFTIREELGTVGGLTITFTGDLKYGRPVHSLIKLLQFYDVRVQLVAPKDLSLPADIRQQLLATGQLLTESEELTPEIVARSDVLYSTRVQKERFADLEQYERLKNSFIIDNALLKHAKSHMVVMHPLPRNAEVSEEVDFDQRAAYFRLVSLQSRGPSSEFDMLMWMQMRYGLYCRMALIELIMAP

SEQ ID NO: 86908 - protein, 433 aa, Magnaporthe grisea
MASLGSYAKKHKVTIIGSGNWGSTIAKIVAESTREHKDVFEEDVQMWVFEEKVTIPKDSPYYESEEPQKLTEVINKHHENVKYLPGIKLPSNIIANPSLTDAVRDSSVLVFNLPHEFLGKVCQQLNGHIVPFARGISCIKGVDVSGSGINLFCEVIGEKLGIYCGALSGANVASQIAAEEGVSETTIAYDPPPIDSSRAATPRDRSPNYDSTSANKLPDLTVTSADSNGKDDRGRRTKAKLTPVPESYPPLDHETLQILFDRPYFSVSMVSDVAGVSLSGALKNIVALAAGFVDGKGWGSNVQSAVIRVGLAEMLKFAREFFGESVDPFTILLESAGVADVITSCISGRNFRCASMAVKRGVSVAEIEEKELNGQKLQGTSTAKEVNSLLKARGREGDYPLFTTVNEILEGKARVDDLPKLVIRQKHTIEKSG

SEQ ID NO: 86909 - protein, 290 aa, Zea mays
LKVVYAHWVPEANIITTNLWSAELSKLAANAFLAQRISSVNAMSALCEATGANVSEVSYAIGKDSRIGPKFLNASVGFGGSCFQKDILNLVYICECNGLPEVANYWKQVIKINDYQKSRFVNRVVSSMFNTVSGKKIAVLGFAFKKDTGDTRETPAIDVCKGLVGDKAQVSIYDPQVTEEQIQRDLAMNKFDWDHPMHLQPTSPTAVKQVSVVWDAYEACKGAHGVCILTEWDEFKKLDYQKIFDNMQKPAFVFDGRNVVDAEKLREMGFIVYSIGKPLDGWLKDMPAVA

SEQ ID NO: 86910 - protein, 160 aa, Brassica napus
NKKSMKQKKKVDSDLEEGTSSLVPEFSITIRKSHLVFLGVPKVFVEMHMPKKTKWFKIRPEGKDSWDVLFLVTDTQSRFSAGWSRLSRELGLVIGDFCTFKLIKPTEMLVKVSRHGDDDDEDDIEEDDDNDEEEAEDADDDDSDDEDAEDDDDDADESED

SEQ ID NO: 86911 - protein, 578 aa, Vibrio vulnificus YJ016
MTFSIENNKQVVLGEELGKLSDNERLKTQSNFLRGTIEQDLQDRITGGFTADNFQLIRFHGMYQQDDRDIRNERAKQKLEPLHNVMLRARMPGGIITPKQWLAIDKFATEHSLYGSIRLTTRQTFQFHGVLKPNIKLMHQTLNSIGIDSIATAGDVNRNVLCTTNPVESELHQEAYEWAKKISEHLLPKTKAYAEIWLDGEKVETTEDDEPILGKTYLPRKFKTTVVIPPQNDVDVHANDLNFVAIAENGKLIGFNVLVGGGLAMTHGDTSTYPRRADDFGYIPLEKTLDVAAAVVTTQRDWGNRSNRKNAKTKYTLDRVGTDVFKAEVEKRAGIKFEVSRPYEFTERGDRIGWVEGIDGKHHLTLFIENGRLLDYPGKPLKTGVAEIAKIHKGDFRMTANQNLIVAGVSKSNKAKIEKLAREHGLMDEGVSEQRKNSMACVAFPTCPLAMAEAERFLPQFVTDVEGILDKHGLDKEDNIILRVTGCPNGCGRAMLAEIGLVGKAPGRYNLHLGGNRGGTRVPKMYKENITEKQILEEIDQLVGRWANERLPNECFGDFTVRVGIIEEVIISKRDFYA

SEQ ID NO: 86912 - protein, 405 aa, Ipomoea trifida
MGPGFRFQWALKLVLEKENWLILPPEVTQVVSFAGLIGDGAALIASTSNSLDTRLGHAHKSNDLAQTNSKRSGFSNWLKNENPFLVKLNCSSNEYTDSYFPGSPSSREVGSSNGSYFKKDSTQENHAENHMNGSPSLSEDENEDLHADFIDEDSQLPSRISKPSRSRHRSTLSNDEEMTAQTGSSLTLLRLMDKYARLMQKLEFVNVELFKGISQLFGIFFHFVFESFVNQSTLPGGKVLTDMLPHKLKTALSRITQDCDQWMKPQSSPFNSSSPTSSNTPFTHMDVTPTSPPSLLAGASFSLKERCAGADTISLVARLLHRSKAHLQSMLLKKNSATVEDFYVHLVDVVPDLVEHIHRTTARLFLHINGYVDRIANAKWELKDLGLEHNGYVSVANFFSSQIFL

SEQ ID NO: 86913 - protein, 210 aa, Bartonella henselae str. Houston-1
MSDPIKTALSLVPMVIEQTNRGERAYDIFSRLLKERIIFINGPVEDGMAMLVCAQLLFLEAENPKKEISLYINSPGGVVTSGMAIYDTMQFIRPPVSTLCMGQAASMGSLLLTAGAKGHRFTLPNARIMVHQPSGGFQGQASDIERHAQDIIKMKQRLNEIYVQHTGQNYDVIERTLDRDHFMTAEEAKQFGLVDDVIQYRAETEKEEKD

SEQ ID NO: 86914 - protein, 174 aa, Ipomoea trifida
MGAKVRSTAELVMQGVKISAFMKKEKMAVELTRVYVDLLLGEFKHYKTRLVTGGIQKEVQDLLLEYGLDNVAETLVEGLSRVKRCTDEGRALMSLDLQVLINGLKHFVSVDVRPKLQIVETFIKAYYLPETEFVHWSRAHPEYSKSQVVGLVNLVATMKGWKRKTRLEVLEKIE

SEQ ID NO: 86915 - protein, 400 aa, Picea sitchensis
MAGSNGPNWDGLLKWSLSHSDGTESARQLSDEDRKWFMEAMQAQTMDVVKRMKEISIVMQTPQEVLEAQGVTVEEMEGLLEELQEHVESIDMANDLHTIGGLVPLLGYLKNPHASLRARAAEVVSTIVQNNPKSQQLVMEANGLELLLSNFISDSDITVRTKALGAISSLIRHNKPAIVAFRLANGYAALRDALSTEDVRFQRKALYMMQYLLQENTADCNVAAELGFLRLLTHLASSEDADVREAALQSLLELTRAGKAEAAGLTDEEGKLRQVLQDRITDICQMSPDDLGAAKEERQLVDSLWQACYNEPSALRANGLLLLPEEDELPPDIASKHFEPPLRAWAAPRSAITGSNTTDKKESPVLLLGAGPVTPSGNSEDSRNRDSAGNRSGGQEGTIS

SEQ ID NO: 86916 - protein, 326 aa, Vibrio vulnificus YJ016
MTHSCRLSVAPMLDWTDRHCRYFHRLMTKETLLYTEMITTGAIIHGKGDFLAYNQEEHPVALQLGGSNPQDLATCAKLAAERGYDEVNLNVGCPSDRVQNGRFGACLMAEPQLVADCVAAMKEVVDIPVTVKTRIGIDDQDSYEFLTDFVSIVSEKGGCEQFTIHARKAWLSGLSPKENREIPPLDYPRAYQLKKDFSHLTIAINGGVKSLEEAKEHLQHLDGVMIGREAYQSPYLLASVDQELFGSQSPIKKRRQIVEEMYPYIEQQLANGAYLGHMTRHMLGLFQNMPGARQWRRHISENAHKPGSGIEVLQQALAKIPQELDV

SEQ ID NO: 86917 - protein, 580 aa, Salmonella enterica subsp. arizonae serovar 62:z4,z23:--
MKSTFMRWVAIAALLVGGTFSAVAHSPIAPPASWNAEEDVFHPVRATQGMVASMDALATQVGVNILKQGGNAVDAAVAVGYALAVTHPQAGALGGGGFMLLRTKDGNTTALDFREMAPTRSTRDMFLDKRGNPDSKKSLTSHLAVGTPGNVAGFSLALEKYGTMPLNKVLRPAIKLAQEGFIVNDALADDLKKYGSETLPQHKNSKAIYWKNGEPLKKGERLVQQNLAKSLILIAENGPDAFYKGAIADQIVEEMRQHGGLITKEDLAAYRAVERTPIVGRYRGYQIYSMPPPSSGGIHIVEILNILENFNIKKYGFGSADAMQVMAEAEKYAYADRSKYLGDPDFVKVPWQALTNKTYAKSIAEQIDINKAKPSSEIRPGKLAPYESDQTTHFSVVDKDGNAVAVTVTLNSLFGTGIVAGNTGILLNNQMDDFSAKPGVANVHGLLSGDANAIAPGKRPLSSMSPTIVVKNGKTWLVTGSPGSSRIITTVLQMVVNTIDFGMNVAEATNAPRFHHQWLPDELRVEKGFSPDTLKLLEQKGQNVVLKEAMGSTQSIMVGPDGELYGASDPRSVDDLTAGY

SEQ ID NO: 86918 - protein, 550 aa, Vibrio vulnificus YJ016
MLKTINPTQTQAWNALTAHFESAQDMDLKDLFAQDAARFDKFSARFGSDILVDYSKNLINEETLKHLFALAKETELSAAIKAMFSGEAINQTEGRAVLHTALRNRSNQPVLVDGEDVMPAVNAVLEKMKSFTDRVIGGEWKGYTGKAITDIVNIGIGGSDLGPYMVTEALAPYKNHLNLHFVSNVDGTHIVETLKKVDPETTLFLIASKTFTTQETMTNAHTARDWFLATAGDQAHVAKHFAALSTNAPAVSEFGIDTDNMFEFWDWVGGRYSLWSAIGLSIALAVGYDNFVELLEGAHEMDNHFVSTELESNIPVILALIGIWYNNFHGAESEAILPYDQYMHRFAAYFQQGNMESNGKYVDRNGNPVTYQTGPIIWGEPGTNGQHAFYQLIHQGTKLIPCDFIAPAVSHNPAGDHHQKLMSNFFAQTEALAFGKNEATVKAELVKAGKNAEEVAAIAPFKVFEGNRPTNSILVKQITPRTLGNLIAMYEHKIFVQGVIWNIFSFDQWGVELGKQLANQILPELADDSEISSHDSSTNGLINAFKAFKA

SEQ ID NO: 86919 - protein, 446 aa, Pseudomonas aeruginosa
MKITVFGSGYVGLVTGACLADVGHSVVCVDVDKGKIERLNNGIIPIYEPGLQELIVNNTKAGRLVFTTNAQAAVEHGLLQFIAVGTPPDEDGKADLQYVLTVARTIGSFMSGEKIVVNKSTVPVGTADKVRAAIMDELAKREEFYSFEVCSNPEFLKEGAAIEDFTKGARIVVGTESEHVMDVMRHCYAPYNRNHDKLMFMDVRSAELTKYAANAMLATKISFMNEISNIAEHLGADIEHVRLGIGSDPRIGYHFIYPGCGYGGSCFPKDVQALARTADEVGYQAELLTAVEAVNGRQKQVLFKRLAQAFDGQLAGKRIAIWGLAFKPNTDDMRDAPSRSLMEALWAAGAQVQAHDPEAMQECRRLYGERKDLLLCASREEALVGADALVICTEWKAYRALEPQWLKANLAFPVVVDGRNLFDPQEMADAGLLYFAIGRGLSVAGR

SEQ ID NO: 86920 - protein, 185 aa, Cytophaga hutchinsonii ATCC 33406
MQNRILSVGSAFPAFKKTAVVSIEKGKEFTEISSENLVNEDNQWTVMFWWPKDFTFVCPTEIAEFNNAFGDFRDRDTTLIGASTDSEFVHAAWRRDHEDLRGLKFPMLADTSKSLAEELGILEAAEKVALRATFIIDPQGIIRWVSVNDLNVGRNVKEVIRVLDALQTDELCPCNWEKGQETIHA

SEQ ID NO: 86921 - protein, 640 aa, Pasteurella multocida subsp. multocida str. Pm70
MLFFTNLTLKRGQSVLLENTSVAINPGQKVGLVGKNGCGKSSLLALLKKEISAEGGDVSFPSNWTLSWVNQETPALMTSAIDYVIEGDREYCRLQRELVLANEQGDGHKIAHLHAQLDAIDAWTIQARAAALLHGLGFSQSELQQPVKAFSGGWRMRLNLAQALLCPSDLLLLDEPTNHLDLDTVMWLERWLVQYKGTLVLISHDRDFLDPIVNKIIHIEHQKLNEYTGDYSSFEVQRATKLAQQNALYRQQQQKVAHLQKYIDRFKAKASKAKQAQSRVKALERMELIAPAYVDNPFHFTFREPLSLPNPLLAMQQVSAGYPSAEGQSAVEILEKIKLNLVPGSRIGLLGKNGAGKSTLIKLLAGELTPLSGQVQLAKGVQLGYFAQHQLETLRLDESPLWHLQKLAPQHTEQQLRDYLGGFAFKGDKVNEAVKSFSGGEKARLVLALIVWQRPNLLLLDEPTNHLDLDMRQALTEALVDYQGSLVVVSHDRHLLRNTVEEFYLVHDKKVEPFSGDLEDYQKWLTDVNRNTEEKADTNAPVDNANSSANRKEQKRREAELRQQTAPLRKKLQQLEQKMETVSSHLGQIEAQLVESDLYLAENKEKLTALLNEQVSNKKHLETLEMDWLALQEELEGLLE

SEQ ID NO: 86922 - protein, 372 aa, Gibberella zeae PH-1
MDQVILWSLILGLVLATSVPLLLRGKTGQETGLEVTQLYVYPVKGIRGCALDKARLGPFGFEGDRTFCLQKVRRDADSNINYATLLIGYELKLALFQASIDYDKSEVAIKWNTNNNEDIIHFPLKPSLEGRPIIEASLHASNTKAYDMGDNLAGWFSDRIGHEVRLVYIGDGSRAVHGSVAPHSSDALQKSSFTQRMKNSIPFLAHEPERLAFNDIAHYLVVTEESNNELSSRLSEGYSMDITKFRPNIVVRGASAPFAEDYWGELSFSSGVRMALTANCFRCQSITVDYETGKTATDERGLVWKKLNKDRRVDKGAKYSPVFGRYGFCYGDDTSKSLSIGQRVDVTKINKQRTTFDWPCLSTFGVSQTTYT

SEQ ID NO: 86923 - protein, 497 aa, Medicago truncatula
MELLSSLTKEEILEVLSHGLCHQCETLGHDRIRRTLHKRKRGETWYHGEGWEDIGDEIYMSMNGNGSNSESLNTRVRKKGKSPINSSLKHDSTLDENVGKHGENLYPGGDLKDIGGAIHMNGNASLAKSLNKRIRIVYNPRNSLQKHDSTLTSDTELLLNDGTVDVSSSKNELSEEQKEHIRYNSEIQCKKDFTFIERINGRDINLLQGLELHTDVFNATEQDEIVEYIYGLQRRGQQGRLRDRTYSKPRKWMRGKGRETLQFGCCYNYAVDKYGNPPGICRTEEVDPLPDVFKQMIKRMVRWNIIPPTCVPDSCIVNIYDVGDCIPPHIDHHDFVRPFYSVSFLNEAKILFGSNLKEIQPGEFSGPASISLPLGSVFVLNGNGADIAKHCIPSVSSKRISITFRKMDERKLPYKYPPDPELVGIKSLSDSHLNKPDRNSETQVKKAGSVQSKPNPVLKTRHESSFHIKDEYPQTFYGNFSNFRKLKDSEFERTERH

SEQ ID NO: 86924 - protein, 255 aa, Thermus thermophilus HB27
MAIKLKSPWEIERMREAGALLTEVVEEVARHVEPGVSTWELDQIAYEAIRKRKAKPAFLGLYGFPATLCTSVNEVVVHGIPSKEPLKEGDILSVDVGLIYQGFAADMARTFPVGRVSPEAERLIRDTEAAFWEGMKYLRPGFRLGDVGHAIQTFLESRGYGVVREFVGHGVGREIHEDPQVPNFGKPGTGPKIRPGMTLALEPMVTLRPAPVVILDDGWAASAGRGNLAAHYENTVLVTEEGPELLTGVALARAE

SEQ ID NO: 86925 - protein, 708 aa, Aspergillus nidulans FGSC A4
MASRNTRRILRPLLYGTAAVTTVGAGALYFSIRPRNIPGLEAPAVPPPGYHEGKLVPPSFPKIKSRLEQIEDLKRSSSGDDADVYDLLVIGGGATGSGIALDAATRGLKVAVVERDDFSAGTSSKSTKLVHGGVRYLEKAVWELDYNQYKLVKEALRERKYFLNTAPHLSSWLPIMVPVQKWWQIPYFWAGTKCYDWLAGSEGIESSYFLPKSKAIEAFPMLRKDNVLGAMVYYDGAHNDSRMNVSLAMTAALYGSTVVNHMEVTGLTKDASGRLNGARLRDCIPERDGQGAEEISIRAKGIINATGPFTDSIRKMDDPNTKEIVAPSSGVHVILPGYYSPSNMGLIDPSTSDGRVIFFLPWQGNTIAGTTDAPTEITRQPQPSEKDIDWILKEIRGYLAPDINVGRSDVLAAWAGIRPLVRDPKVKSSEALVRNHLITVSSSGLLTCAGGKWTTYRQMAEEAVDEAIKEFNLKPCELHDVPDISGVGGRGLVADNASLDGSCQTHQVRLIGAHGWSKTLFINLIQHYGLETDVARHLTTSYGDRAWQVAALSSPTQTRFPVRGQRISALYPFIDGEVRFAVRHEYAQTAVDVIARRTRLAFLNAQAALEALPTVIDLMGEELHWDKNRKEVEWKDSVQFLASMGLAPDLLNVTRDQVENGKVQQLLASERGAFTRTDRDRLAAVYCGLSLGSKGLASFWTRSSFSYA

SEQ ID NO: 86926 - protein, 388 aa, Arabidopsis thaliana
MTIMSDLPRDLLAEILSRVPLTSLRAVRLTCKKWNDLSKDRSFLKKQIVETKKKQLESKEIEVIMMRNFRVYLTSIDIHNNVDPSFTPKGTLISLSDDANHHQVDNVSRVFHCDGLLLCITKDLHYRLVVWNPYFGQTRWIQPRNSYHRKDNYALGYDEKKNHKILRLKDNYYAPRERICEFELYSFESNSWKVVLDVSPDWYIPSYNRGLSLKGNTYWYATEKHVNVDFLICFDFTTEKFGPRLPLPFNATESPTYEDVVTLSSVGEEQLAVLFQSEYTLMMEIWVTSKVESTEVLWNKLFLEVDLIAISSHFQFLAEAGSFFIDQKKNVVVVFDKDMDEATDRDMAYVVGKNGYFKKVDIGEEAYTSCFPLVCSYVPSSEQIRQLT

SEQ ID NO: 86927 - protein, 390 aa, Pseudomonas syringae
MAQSYSARSRAIEPFHVMALLARANELQAAGHDVIHLEIGEPDFTTAEPIIAAGQAALAAGKTRYTAARGLPELREAISGFYQQRYGLDIDSSRILITPGGSGALLLASSLLVDPGKHWLLADPGYPCNRHFLRLVEGAAQLVPVGPEVRYQLTADLVERYWDQDSVGALVASPANPTGTILSRDELASLSAAIKARNGHLVVDEIYHGLTYGCDAASVLEVDDSAFVLNSFSKYFGMTGWRLGWLVAPPEAVADLEKLAQNLYISAPSMAQYAALACFEPQTLAILEERRAEFGRRRDFLLPALRELGFGIAVEPEGAFYLYADISAFGGDAFAFCRHFLETEHVAITPGLDFGRFQSGHHVRFAYTQSLPRLQEAVERLARGLQSWKG

SEQ ID NO: 86928 - protein, 460 aa, Zea mays
MHVAVKMMASSTEEELEMNKKKVCVVGAGVSGLVSARELRREGHDVTVMEQSGGVGGQWLYDPRTDASDPLGAAGVHSSVYASLRLTSPRDIMGFSDFPFFPRSNDDGDSRRYPGHAEFLRYIRDYCDTFGLMDAVRLNTKVLHVGRPLLDDDGVVTRWTVRYCSSGHGVSEHEAVAEEEFDAVVVASGHYSQPRLPAINGMDKWTRRQLHSHSYRVPDSFHAEVVVLVGFHQSGVDIALELCKVARDVHVVSVKSLEGLTPGVRKAVPRHHDLHLHLQIECLREDGQVMFADGSRVVADSIIYCTGYDCSFPFLDTGGLVTVDDSRVGPLYEHTFPPALAPSLSFVGLPKKVLVPRFYEAQARWVAQVLSGRRSLPPEAEMLRSAEENNRARGKHLAHDILDDYDYCDDFWEKHCGFPRLEGWKKELRWSSLARRHDSTESFRDVYHDDSNLIREGFQA

SEQ ID NO: 86929 - protein, 558 aa, Arabidopsis thaliana
MEEGHKEPLVLRVEGSHCSLSEMDDFDLTRALEKPRQLKIERKRSFDERSMSELSTGYVRQDSILEMAHSPGSRSMVDTPLSVRNSFEPHPMVAEAWEALRRSMVFFRGQPVGTIAAYDHASEEVLNYDQVFVRDFVPSALAFLMNGEPDIVKNFLLKTLQLQGWEKRVDRFKLGEGVMPASFKVLHDPVRKTDTIIADFGESAIGRVAPVDSGFWWIILLRAYTKSTGDLTLSETPECQRGMRLILSLCLSEGFDTFPTLLCADGCSMVDRRMGVYGYPIEIQALFFMALRCALSMLKPDEEGRDFIERIVKRLHALSFHMRSYFWLDFQQLNDIYRYKTEEYSHTAVNKFNVMPDSIPDWVFDFMPLRGGYFVGNVSPARMDFRWFSLGNCVSILSSLATPDQSMAIMDLLEHRWEELVGEMPLKICYPCIESHEWRIVTGCDPKNTRWSYHNGGSWPVLLWTLTAACIKTGRPQIARRAIDLIESRLHRDCWPEYYDGKQGRYVGKQARKYQTWSIAGYLVAKMMLEDPSHIGMISLEEDKQMKPVIKRSASWTC

SEQ ID NO: 86930 - protein, 671 aa, Alkaliphilus metalliredigens QYMF
MDYLILAPIVGVIALIFAYILAGKINAVEAGTDRMKEIASYIQEGSMAFLTREYKSLVIFVVVLFVVLGLAIGWWTAICFLIGALFSALAGFFGMQVATKANVRTANGARVGGMNKALSVAFSGGAVMGMSVVGLGLLGIGTLYLVISNVTGDAVEAAEIITGFALGASSIALFARVGGGIFTKAADVGADLVGKVEAGIPEDDPRNPAVIADNVGDNVGDVAGMGADLFESYVGSIISAIALGLLAYGSNGALFPLLLAAIGIIASIIGTFFVKGDENSDPHKSLKMGTYVSGGITVIAAYFLSQMLLGSITGFLAVVTGLIVGLAIGQVTEIYTSAEFKHVQKIADQSETGAATTIISGLAVGMASTAWPILILAVGILVAHGVAGLYGIALAAVGMLATAGMTIAVDAYGPIADNAGGIAEMCDLPKEVRQITDKLDAVGNTTAAIGKGFAIGSAALTALALFATYTAAVNLEIINLTSPSVIAGMLIGGMLPFLFSALTMEAVGKAAFEMIEEVRRQFRDIPGIMEGTATPEYAKCVDISTAAALREMIIPGVLAVVAPIATGVLLGTEAVGGLLAGALVAGVLMAIMMANAGGAWDNAKKYIEEGHHGGKGSEPHKAAVVGDTVGDPFKDTSGPSINILIKLMTIVSVVFAPLFLRYGGLLGKFFE

SEQ ID NO: 86931 - protein, 430 aa, Alkaliphilus metalliredigens QYMF
MTIISDVYAREVLDSRGNPTIEVEVYLESGVLGRAIVPSGASTGAFEAVELRDGDKGRYLGKGVLKAVENVNDIIAPEITGLDALDQVAIDKIMLDLDGTPNKAKLGANAILGVSMAVAKAAAEALDIPLFQYLGGVNAKQLPVPMMNILNGGSHADNNVDIQEFMVMPVGAKTFKEALRMGTEIYHNLKDVLKSKGLATGVGDEGGFAPNLSSNEEALQIIMEAIEAAGYKPGVDIKLALDVAATEFYDEDEKLYKLTGEGVTKTAEEMVDFYEALVKKYPIVSIEDGLSEDDWEGWRVMTERLGDNIQIVGDDLFVTNTERLKKGIQTKTANSILVKLNQIGTITETLDAIEMAKRAGYTTVISHRSGETEDATIADIAVAVNAGQIKTGAPARTDRVAKYNQLLRIEDMLGFTGQYIGNEVFYNIKK

SEQ ID NO: 86932 - protein, 195 aa, Cytophaga hutchinsonii ATCC 33406
MFLLSKELIFRYMITEKEQIRISKFLSLVLRHQPELIGLQLNEQGWAHIETLLEKSAAYGVSFDKQTLKYLVATNSKKRFAFSPDAEYVRASQGHSVDIELGYKNQKPPEILYHGTAEKFMQSILETGLEKCRRQHVHLSSTIETAIHVGQRHGKPVVFTVLAQQMYANDFSFYLSDNGVWLTDHVPVIYLTINP

SEQ ID NO: 86933 - protein, 511 aa, Alkaliphilus metalliredigens QYMF
MKNPVALVILDGLGNREGELGNAVKKANLPNYHRLMSQYPHTEVEASGLAVGLPEGQMGNSEVGHLNIGAGRVVYQELTRISRAIETGDFFKNEHFLKLLRKLKTSGKALHLMGLVSDGGVHSHMNHIVALLKLAKREGLKRVCLHCFLDGRDTPPQSGLDYIKSLEASIAEIGVGRIVTISGRYYAMDRDQRWERVQQAYDAMTLGKGRLAEGAITAVEMAYSLKETDEFVIPTVIPNDEGEFELIEPDDGIIFFNFRPDRAREMTRALMDETFEGFKREKGYFSLNFVSMTSYDKTIENAEVAYPPQSLANTLGEYISKQGIKQLRMAETEKYAHVTFFFNGGVEIANIGEQRKLVPSPKVATYDLQPEMSAYELTEELIKEIDKDQYDFIVVNFANPDMVGHTGIEIAVIKALETVDECLGKVIDKLIEKGGKAIVTSDHGNAEEMIDEVTGGPVTSHTINPVPLILVGEEQTSLRDDGKLCDIAPTLLEMMNLSKPLEMTGKSLIKK

SEQ ID NO: 86934 - protein, 439 aa, Clostridium thermocellum ATCC 27405
MGLYEKIVNKEEKISVIGLGYVGMPLAIAFAKYAQVIGFDVDKKKIEIYKSGIDPTKEIGNEAIKNTTVEFTSDETKLKEAKFHIVAVPTPINIDKTPDLTPVESASVIVGRNMARGSYVVYESTVYPGVTEDICIPILERESGLKCGVDFKVGYSPERINPGDKKHTLETIKKIVSAIDDESLDEIAKIYSLVIKAGVHKTSSIKVAEAAKVVENSQRDINIAFMNELAMVFDRMGIDTKEVIDAMNTKWNALGFYPGLVGGHCIGVDPYYFIYQAEKLGYHSQIILSGRKINDGMGEFIANTIIKKLIHVNKVVKKSKVVIFGITYKENCPDTRNSKVVDIIKGLNEYGIEPIVVDPQANREDTKQEYGIELMDIDDVKDADCLVFAVAHDEFKNMAWEQIEKFFKNIDNSEKVIIDVKGIFDKNKIEKLGYCYWRL

SEQ ID NO: 86935 - protein, 88 aa, Synechococcus sp. CC9605
MQRPVATAMSQEAILEKVRSIVAEQLSVDSGEVKPESNFQNDLGADSLDTVELVMALEEAFDIEIPDEAAEGITTVGDAVKYIEDKQA

SEQ ID NO: 86936 - protein, 197 aa, Thermoanaerobacter tengcongensis MB4
MAATKTFGVDAIKEAISCGITAIGENRVQELMEKYPHLKGQVDFHFIGHLQTNKVKYIIDKVKLVHSLDREKLAEEIDKRAKQKGIIMDCLIEVNIGGEDTKFGISPEEMHNLVKKLEKYDNIKIKGLMTIAPYLPPEEVRPYFKRMRELFEDLKRINQRNVEAQYLSMGMSNDYWVAVEEGANIVRIGTAIFGERR

SEQ ID NO: 86937 - protein, 426 aa, Gibberella zeae PH-1
MSNQTQKLQPAGRVQGQKKDVWSMINEAAASSPIQPIVNLGQGFFGYNPPDFILNAAKEALDRVECNQYAPAKGRPRLRQALADAYSPSWGRQLDPETEIIITTGANEGMLSAFMGFIEAGDEVIVFEPFFDQYISNIQMPGGKVVYVPLHPPKTGATKNSSAADWTIDFEELEKAFTPRTKMIVINTPHNPVGKVFSKEELQGIADLAVKHQVIILSDEVYDKLYYVPFTRIANLSPEVEKLTLTVGSAGKNFYATGWRVGWLIGPQELIQYVTAAHTRICFSTPAPFQEASAIGFEQAGKNGFWDETIKEMKGKIDRLKEVFEELELPVTYPEGGYFLLVNMAKVKLPEDYPFPPHVASRPRDFKLAWFLIQEIGVAAIPPTEFYTPVNAHLAEDYIRFAVCKNDDILEQAKERLRGLKKYIPE

SEQ ID NO: 86938 - protein, 431 aa, Salmonella enterica subsp. arizonae serovar 62:z4,z23:--
MVSLEKNDRLMLARQLPLKSVALILAGGRGTRLKDLTNKRAKPAVHFGGKFRIIDFALSNCLNSGIRRIGVITQYQSHTLVQHIQRGWSLFSEEMNEFVDLLPAQQRMQGENWYRGTADAVTQNLDIIRRYKAEYVVILAGDHIYKQDYSRMLIDHVEKGARCTVACMPVPIKEATAFGVMAVDESEKIIDFVEKPANPPAMPGDDSKALASMGIYVFDADYLYELLAADDKDDASSHDFGKDIIPKITREGMAYAHPFPLSCVQSDPDAEPYWRDVGTLEAYWKANLDLASVTPELDMYDQNWPIRTHMESLPPAKFVQDRSGSHGMTLNSLVSGGCIISGSVVVQSVLFPRVRINSFCNIDSAVLLPEVWVGRSCRLRRCIIDRACIIPEGMVIGENAEEDARRFYRSEEGIVLVTREMLRKLQVKQER

SEQ ID NO: 86939 - protein, 598 aa, Vibrio parahaemolyticus RIMD 2210633
MNNVIFSQKLYDTAQMIVDGCMGDADPACQTACPMHTDVKQYVRMAGEGNFQGALDLIRSKLFLPQTLGRICAHPCEASCRRNTEFGQPISVAGIKRFVAEKMDNQDHWDLNIAPLTNKHIAIVGAGPAGAQAAIELRRQGHEVTIYEKLDVYGGMMRVGIPEYRLPRDVIDFEYSYLAMLGIKTQFGVEIGKDISFDTLRSEHDAVILAHGAHVGSIIPLPGHDNDGVFSAVEYLKEISETRQFPRACKRVMVIGGGDVAMDCARSSWRIGASDVYQCSLESLESLPASQIEIDESLEEGVEFNAGWGPVAIEHENGKVTGITIKKVLSIFDEQGNFAPQYSEESKTISVDTVVFATGQIVADITDGALEQTRGGRYVVDKQTLASSLEDVFVAGDACGGNIVIEAMALGRKAAMSVERFLTARPLTEDRDFEQEYSYSSRLDVPLPKGTVDTPRLHGELRDAEERKQDFAQVDLGFTEEQIKQEASRCLQCSCKLCMTECIMMNDFSDCPKTIFSDFVNNKSMDPLLAYSCNACDQCTIVCPKDFPMKEMFLGARTDFVKANNGESPMPGHKAINMHQKLGFSKIFTMAKRAVSTK

SEQ ID NO: 86940 - protein, 526 aa, Populus tomentosa
MQISPAGGGDSQSHPGKEQQAAGVGILLQIMMLVLSFVLGHVLRRHRFYYLPEASASLLIGLIVGALTNISNTETSIRAWFNFHEEFFFLFLLPPIIFQSGFSLSPKPFFSNFGAIVTFSILGTFIASVVTGVLVYLGGLIYLTYRLPFVECLMFGALISATDPVTVLSIFQELGIDTNLYALVFGESVLNDAMAISLYRTMSSLKSHAPGQNFFMVIFRFLETFVGSLSAGVGVGFISALLFKYAGLDIDNLQDLECCLFVLFPYFSYMLAEGLGLTGIVSILFTGIVMKHYTYSNLSENSQRFVSAFFHLISSLAETFVFIYMGFDIAMEQHSWSHVGFIFFSIIFIGVARAANVFSCAYLVNLVRPVPRQIPVKHQKALWYSGLRGAMAFALALQSVHDLPEGHGQTIFTATTAIVVLTVLLIGGSTGTVLETLQVVGDDHDGPLSESLDGNNGYVAPSYNEDATSGNRLKMKLKEFHKSTASFTALDRNYLTPFFTSQSGDDEEEHDDPMPSSRGRGFLGHN

SEQ ID NO: 86941 - protein, 502 aa, Salmonella enterica subsp. arizonae serovar 62:z4,z23:--
METKDLIVIGGGINGAGIAADAAGRGLSVLMLEAQDLACATSSASSKLIHGGLRYLEHYEFRLVSEALAEREVLLKMAPHIAFPMRFRLPHRPHLRPAWMIRIGLFMYDHLGKRTSLPGSTGVRFGADSVLKPEIVRGFEYSDCWVDDARLVLANAQMVVRKSGEVLTRTRATAARRENGLWIVEAEDIDTGKKYAWQARGLVNATGPWVKQFFDEGMHLPSPYGIRLIKGSHIVVPRVHNQKQAYILQNEDKRIVFVIPWMEEFSIIGTTDVEYKGDPKAVKIEDSEINYLLKVYNAHFQKQLGRDDIVWTYSGVRPLCDDESDSPQAITRDYTLDIHDENGKAPLLSVFGGKLTTYRKLAEHAMEKLAPWYPGIGPAWTKTCVLPGGDIDGSREDYAATLRRRYPFLTESLARHYSRTYGSNTEWILGEAASLLDLGEDFGHEFYEAELKYLVDHEWVRRTEDAIWRRTKEGMWLTAEQQSRITQWLAEYIGKRQLSLAS

SEQ ID NO: 86942 - protein, 199 aa, Gossypium arboreum
LKQKLHENAPLAQLEGTQKELNIALSKYPKALEKTLNPDISKAYRNIEFDSHTVNQIIASHFYRQGMFDVGDCFITEAREAEAAAAVRSLFQEMYQILEALKSRNLEPALKWAAANSDKLKENGSDLLLGLHQLQFVKILQKGSRDEALKYARTNFVPFAGNHMAEIQKLMGCLLYSDRLSESPYAHLLSPTNWDIVAD

SEQ ID NO: 86943 - protein, 162 aa, Thermus thermophilus HB27
MPETDFEEKMILIRRTARMQAGGRRFRFGALVVVGDRQGRVGLGFGKAPEVPLAVQKAGYYARRNMVEVPLQNGTIPHEIEVEFGASKIVLKPAAPGTGVIAGAVPRAILELAGVTDILTKELGSRNPINIAYATMEALRQLRTKADVERLRKGEAHAQAQG

SEQ ID NO: 86944 - protein, 297 aa, Brassica napus
KTKSQKSSAREEKKMASTLQPEMDNDSMASSPRSEYDNQPRVRFMCTFGGRILPRPPDNQLSYVGGDNRMIAVHRNTSFASLLNKLAKLSGKSNISVKYQLPNEDLDALISVSTDEDVENMMDEYDRVAQNQNPRSSRLRLFLFTNNIAGEDDNDSRASSISSLLDSSVNREQWFLDALNLGSSAVSNGGSGKGFERVRSEVSSIVSEVPDYLFGLDTFDETAPPHELRDRDPRAKIRREVSTLSDPGSPRRDVPSPYGSTSSAPVMRSSTPELQPVQTKPDSPEPVSTPKSDPQPE

SEQ ID NO: 86945 - protein, 450 aa, Oryza sativa Japonica Group
MDDRRGKGLEVDIRGTKHYASYGVINMSDISALSYLKVFMDAHCQLGNDQSEQTSLSFGRYFLSNASPYQPWTRSFASKNGDLVDAVVPFMGESITDGTLATFLKKPGDRVEADEPIAQIETDKVTMDVASPEAGIIEKFVASEGGIVTPGVKVAIISKSAAQSKTHTQSSEDTSQKHSTKPPSTKENKVEAKPPKVESSTTHESKLTSSSEPQLPPKERERRVPMPRLRKRIANRLKDSQNTFAMLITFNEVDMTNLMKLLSDYKDQFVEKHGVKLGLMSCFVKAAVSALQNQPIVNAVIDGDDIIYREYIDISVAVGTSKGLVVLVIHDIDAMNFADIEKGINNLAKKATEGAQSINNMAGGTFTISNGGVYGSLISTPIINSPQSSILGMHSIVQRLVVVNGSVLARPMMYLALMYDHRLIDGREAVLFLRRIKDVVEDPRRLLLDI

SEQ ID NO: 86946 - protein, 529 aa, Pseudomonas syringae pv. syringae B728a
MPFPCTLFISLSNQHRVGSMTATPKPLVLIILDGFGHSESHKGNAILAAKMPVMDRLYQTMPNGLISGSGMDVGLPDGQMGNSEVGHMNLGAGRVVYQDFTRVTKAIRDGEFFENPTICAAVDKAVSAGKAVHIMGLLSDGGVHSHQDHLVAMAELAVKRGAEKIYLHAFLDGRDTPPRSAKKSLELMDATFARLGKGRTATIVGRYFAMDRDNRWDRVSSAYNLIVDSTADFHADSAVAGLEAAYARDENDEFVKATRIGEAARVEDGDAVVFMNFRADRARELTRVFVEDDFKDFERARQPKVNYVMLTQYAASIPAPSAFAAGSLKNVLGEYLADNGKTQLRIAETEKYAHVTFFFSGGREEPFPGEERILIPSPKVATYDLQPEMSAPEVTDKIVDAIEHQRYDVIVVNYANGDMVGHSGIMEAAIKAVECLDVCVGRIAEALEKVGGEALITADHGNVEQMTDDSTGQAHTAHTSEPVPFVYVGKRQLKVRQGGVLADVAPTMLHLLGMEKPQEMTGHSILVAE

SEQ ID NO: 86947 - protein, 1434 aa, Gibberella zeae PH-1
MVAHDEEAYALLDEHDLCSEDSSVRDDRALSSAYTAPFSHRFKRPCVVRWVVALILVSLLSPFGAIIYHALEQSSETGQDTPLGYRLHAQEHTSRPPKTLIYNWNITAGFRSPDGVEKRVYLINGPIIEARSSDTVVVHVHNGLSQEGLSIHWHGLRMKNQNGMDGAVGFTQSPILPGDSFNYIFTIGDDEYGTFWWHSHSDVQRADGLWGGLVVHSPDESNQQPEDYLIMISDWFHRNQTEVLSWFADASSRGNEPVPDSLLVNGQGRFDCSMAVPARPVVCSQATMNELKPLFRQTNDRRARIRVVNTGSIAGLTIRIDAAMMRPVRVDGGFDVHSEATEAVGILYPGERVDIDVEWKDDHAPNRWLTVYMDDENFSYPNEALNPVQDFPIFDHGNKIPSRKDLESNETQILDPRNLKAAAKIVDIPLVADHTILLYAKIEKLAHMDYEPVGFINHTSWKPQDPPLISQSRSGWDDNQLIPFIATTREKPTRVDIIINNLDDGAHPFHLHGHSFYVLSTHRDEGRVGWGSYNSYSGEAPPNGLDLDFPLRKDTNLISETRSAYKSPDGYPKVVNDLSTVINDLADVSHRIRHVIDVSVSQANNASDNTLIRLCRESQDIAGEMNSALLSLQAKGTSKLGQAKSSVIVALKAMWSKDKLAKLEQRLQQIRSEMTMAMLVVLWEKERRRDDKGDSELKNQIEEISKAVNRNNGMLDDFLRELDATASDDDKLGPIIRSLHFPGIEARERLIPEPYAKTYQWIYRDEMRYKQASTTMRVQSLPQWLQDSTNKVYWITGKPGSGKSTLMNFVIHNPLTKQYLKDWAAPFPLVQAQFYFWEAGQSSMQRSQQGMMQTLLWQCLRQKPDLIPRVTPRRWMVHQVLRGLETPAPPWTWEELRTAFTIIASQNDHSFKLVLFLDGLDEFAGDPAVVVSFVKDLVASYGVKICVGSRPWTDFADAFDQYPMLIMQSQTRNDISEYITGKFEACRAFRERKAVFPDQAKRLLQDISNKAQGVFLWVFLVVRDLIHSLSRGRSLSDLQMIVDDLPTDLEALYTKMRERVEPKDMENSARYYQLIVSALKPLHMVTIWMIDGEALPDGDTFTKEMEDNIRKILQRRLDSSTKGLLELDDNGFINFLHRTARDWVIQGSQSAQFKAQAPRSFDPNLALVQVLTKQLPHEKIYQHIGHSHISFWSFAVLGFLYAGQVGSSPHTDHLLIQAIEEFDAALCQRATYLGNKGFVFTSNTIKPQPGVVDTRLADKTHPWYFFGRRNREDMTPPDPCFDHWTCTQYGASNFLFTHSTILGTIGIAAQFGIVPYVLEMMRRDKNLLKGGALSALLQDSLFGWQLYKYRTYEDVSEFYNIDEQAQERMENQRIGILMTILGHGKSLYTPCYDALALIEKLDNAFKIRIGSKSYWEKATMILDTSMRRRGSKKK

SEQ ID NO: 86948 - protein, 248 aa, Alkaliphilus metalliredigens QYMF
MRKPIIAGNWKMNKTVAETLQFINEIRDQAETTDVEVVLCCPFTALSEAKKALGASKIKLGAQNMHWEDNGAFTGEISAEMLKELGVDYILIGHSERRQYFNETDETVNKKIKKALEQKLMPILCVGETLQEREAAQTFDVIKNQITIDLEGILPDSMKDIVIAYEPIWAIGTGKTASSQDANHVIAYIRQLIQEKYDDGISETVRIQYGGSVKPENATEIMNEEDIDGALVGGASLKADAFLGIVNF

SEQ ID NO: 86949 - protein, 216 aa, Magnaporthe grisea
MSSTDPTTTGQTAQDASRQQPTAAASSSSELASAKITLYKVLRRFADFPIEGIVFIDIMPIFIDPKAHLALLRALELQVLSSFAPATAKPDVVVGLDARGFLFGPSLALKLDASFVPVRKKGKLPGPCVTATYEKEYGQDFFQMQEGAIKPGQKVLLVDDIIATGGSAAAAGELVKKLGGELMGYLFLLEIAPLKGREKLGGVPVVTLLEEADYPH

SEQ ID NO: 86950 - protein, 399 aa, Alkaliphilus metalliredigens QYMF
MSMLNKKSVKDQVIEGKKVLVRCDFNVPMDKEGKITDDIRIRGAMPTVEYLLENKAAVILMSHLGRPKGEAQAKFSLKPVADRISQLLGKEVIFADDDVVIGERTKELAKQLAPGQVLLLQNVRYRKEEEKNEEAFSKELASLADLYVNDAFGTAHRAHASTAGVAKFLPATMGFLIEKEVDFMGKALEAPERPFVAILGGAKVSDKIGVIENLIDKVDVLLIGGGMAYTFLKAMGYEIGTSLLEAEKVDLAKMLIKKAQANHVDLLLPIDTVVAREFKADATYDTVSIESMPKDMMGLDIGKDTISLFTEKIKTAKTVIWNGPMGVFEMPAFAVGTKEVARAMAENDAITIVGGGDSAAAAEQLGFADQMSHISTGGGASLEFLEGKILPGIDVLENK

SEQ ID NO: 86951 - protein, 336 aa, Alkaliphilus metalliredigens QYMF
MSVKVAINGFGRIGRNAFKIAFAEKRDWEIVAINDLTDAKTLGHLLKYDSLFGKFQGEIEVKEDAIVINGKEVKIYAERDPEKLPWKELGVDIVIEATGIFRTKETASKHITAGAKKVIITAPAKKEDITIVMGVNEENYDATNHHVISNASCTTNCLAPFAKVIDGKFGIKKGLMTTIHAYTNDQNILDLPHEDLRRARAAGESIIPTTTGAAEAVALVLPQLKGKLSGMAMRVPTPTVSVVDLVVELNTETTTEELNKALKEAAETSLKGILAFSEEPLVSIDFKQDSHSSIIDGLSTKVLDGNLAKIIAWYDNEWGYSARTVDLVSYVVAKGL

SEQ ID NO: 86952 - protein, 341 aa, Arabidopsis thaliana
MATWSGFNVSSSPLLRLRSSSVSNVTKLPFLSPICRRRLLAERFGLATVVVTRQNLTVTPSSAAVEARISGKREPMTPPYNILITGSTKGIGYALAREFLKAGDNVVICSRSAERVETAVQSLKEEFGEHVWGTKCDVTEGKDVRELVAYSQKNLKYIDIWINNAGSNAYSFKPLAEASDEDLIEVVKTNTLGLMLCCREAMNMMLTQSRGGHIFNIDGAGSDGRPTPRFAAYGATKRSVVHLTKSLQAELQMQDVKNVVVHNLSPGMVTTDLLMSGATTKQAKFFINVLAEPAEVVAEYLVPNIRAIPASGSMKPTYIRFLTGIKAYTKIFSVKTINSSA

SEQ ID NO: 86953 - protein, 253 aa, Wolinella succinogenes DSM 1740
MPPTLTLYGYGKMALAIAKGLSGRFPLEITGRNPQKIEELIALHGLNASPLFPHDSPLDITDRHLLLCVKPYALSELSFSGEAKGVYSILAGVSIERLREKIPAQSYIRAMPNMAASLGSSCTALCGDESLKALASEIFAPLGTSLWLDKESKIDAATALAGSGPAYLALMAEALMDAGVREGLSREESKALTQGLFSGFADLLEDRHPALIKEEVTSPGGTTAEALALLESKGLRGILIEAVRAALLKAKKL

SEQ ID NO: 86954 - protein, 424 aa, Triticum aestivum
NKFVQKSRLVPVRNSRDIVDPRVRRSSIREFLCSEAMHGLGIPTTRALCLVETGKSVVRDPRVRGNAKEEPGAIVCRVAPSFLRFGSYQLHATRGKEDLEIVRRLADYTIRHHYPHLENIKKSEGLSFEAAIGDSPAIDLTSNKYAAWAVEVAERTAYLIARWQGVGFTHGVLNTDNMSVLGLTIDYGPFGFLDAFDPSFTPNTTDLPGKRYCFANQPDVGLWNIAQFTGPLSAAYLISKDEANYVMERYGTKFMDEYQSIMTKKLGLSKYNKQLISKLLNNLAVDKVDYTNFFRLLSNVKADRDIPETELLVPIKAALLDIGKERKEAWISWVQTYIEELVASGVSDEERKATMNRVNPKYVLRNYLCQTAIDAADLGDYEEVRRLLKVMEHPYDEQPGMEKYARLPPAWAYRPGVCMLSCSS

SEQ ID NO: 86955 - protein, 142 aa, Clostridium thermocellum ATCC 27405
MKVRDKMTKTVAYVSPQSSVVEAAQLMQKHNVGSIPVYDQGVVGIVTDRDIVVRNVAHGKTPKDTKVQDVMTSQVTTVTPDMDVEEVTKLMANQQIRRVPVVENNQLVGMLSLGDIAADTRFEMEASEALCEISKPAKPSRM

SEQ ID NO: 86956 - protein, 392 aa, Triticum aestivum
  misc_feature (224)..(224): Xaa can be any naturally occurring amino acid
CVYPADPDKEIDIKNHKWGHYFMCGYKGVYEYARSKGIDMGEPVALDVVVDGTVPQGSGLSSSAAFVCSATIAIMGILGKNFPKKEVAQFTCKSERHIGTQSGGMDQAISIMAKPGFAELIDFNPIKATDVQLPSGGTFVIAHCLAESKKAETAATNYNNRVVECRLAAIVLAIKLGMDTKKAVTSVTTLSDVEGLCVSFAGKEGSSDPGVAVKKLLHEEPYTXVEIEKITGQSLATVFQSSQTSLDVLRAAKHFKLFQRASHVYSEARRVYAFRDTVLSKLSDEGMLKKLGDLMNDSHHSCSVLYECSCPELEELVKVCRDNGALGARLTGAGWGGCAVALVKEGIVPQFILNLKEKYYKSRIDRGVIKQSDLGLYVFASKPSSGAAILRL

SEQ ID NO: 86957 - protein, 427 aa, Streptomyces coelicolor A3(2)
MTRDLFARHRAVLPDWLALYYEDPLEITHGEGRYVWDAAGNKYLDFFGGILTTMTAHALPEVTKAVAEQAGRIVHSSTLYLNRPMVELAERVAQLSGIPDARVFFTTSGTEANDTALLLATAYRRSNAILAMRNSYHGRSFSTVGITGNRGWSPTSLSPLQTLYVHGGVRTRGPYADLDDRDFIDACVTDLKDLLGHSRAPAALIAEPVQGVGGFTSPPDGLYAAFREVLHERGILWISDEVQTGWGRTGEHFWGWQAHARSGPPDIVTFAKGIGNGMSIGGVVARAEIMNCLDANSISTFGGTQVTMAAGLANLNHLLEHDLQGNARRVGGLLIERLRAVAAQVPHVREVRGRGLMIGVELTRPGTDEAAPEAASTVLEEARAGGLLVGKGGGHSTSVLRIAPPMSLTVAEAEEGAAILERALRSI

SEQ ID NO: 86958 - protein, 1081 aa, Glycine max
  misc_feature (798)..(798): Xaa can be any naturally occurring amino acid
APPPDYKGRVPLRASTGVWKASLFVLTIEFSERVSYFSIASNLISYLTKVMHEDLSTASKNVNYWSGTTTLMPLVGGFVADAYTGRFYMVLFSSFVYLMGLSLLIMSQFIPSLKPCNTKICQEPRKVHEVVFFLALYCISFGTGGYKPCLESFGADQFDDDHLEERKKKMSFFNWWNFALCFALLLGATVIVYVQDFVSWGVATLILAILMALTVIAFCVGKPFYRYRRAEGNPLTPILQVLIAAIRKRNLTCPSNPALLHEVPESERSQGFLDKAAIIEEKHFEQKYNPWRLATVTRVEETKLVLNIIPIWLTSLTVGVCVGQGQTLFVKQAAATNLKISDSFKIPPASMASVAAVGTLIAVPIYDRVVVPILRKVTGNERGISILRRISIGMTLSVLLMVVAALVESKKLRMAAHEVLTVGETRHETMSVMWLIPQYLILGIGDSFSLVGLQEYFYDQVPDSMRSIGMALYLSVLGVGFFLCSFLIIIVEHITGKTGNSWIGKDINSSRLDKFYWMLAVKRNVVRIEENEEKWVHDASVDYKGRVPLRASTGVWKASLFVLTIELSERVSYFGIATNLISYLTKVMHEDLQTAAKSVNYWSGTTTLMPLVGGFVADAYTGRFYMILFSSFVYLMGLSLLTMSQFIPSLKPCNNGVCHRPRKVHEVVFFLALYCISFGTGGYKPCLESFGADQFDDDHLEERKKKMSFFNWWNFAMCFALLLGATVVVYVQDFVSWGVATLIVTILMTLTVIAFCMGKRFYRYRRTEGNPLTPILQVLIAAMRKRNLSSKSTCVLNXLMQINSMNRFLDKAAIIEEKRIEQKYNPWRLATVTRVEETKLVLNIIPIWLTSLTVGVTVGQGQTLFVKQAAATNLKISHSFKIPPASMASVTAVGTLIAVPIYDRITVPIMRKFTGNERGISILRRISIGMALSVIVMVVAALVEGKRLRMATHEVLTVGETRHETMSVVWLIPQYLILGVGDSFSLVGLQEYFYSQVPDSMRSLGMALYLSVLGVGFFLSSFLIIIVDRVTGKTGNSWIGKDINSSRLDRFYWMLAVINALVLCVFLLVIKRYTYKAVQRR

SEQ ID NO: 86959 - protein, 377 aa, Oryza sativa Japonica Group
MRADRAELRELKPPYPLSAPGLPLLDPTICPRHASSRASRLACVRARRAAPSFWSLAPRYFPLVPNPESASASVLALLLWYLCSRLLCLATLLPPPHCLLPWFGSFCSWVDAGCVRACVRAEAMSSAVDAISCSKGIAAPPTEEATKERVAVVGKNGGVEHGGDAATMNGKQCGEAPHCRKESNEEEEDDEEKAPKAIDLGPRVSIKDQLEKDKDDESLRRWKEQLLGSVDLNSVGETLEPDVKIMSLAILSPGRPDIFLPLPVEPNAKGVWFTLKEGSLYKLKFTFSVSNNIVSGLRYTNAVWKTGIKVDSHKEMLGTFSPQPEPYTYVTPEETTPSGMFARGSYSARTKFLDDDRKCYLEINYTFDIRREWPALS

SEQ ID NO: 86960 - protein, 272 aa, Azoarcus sp. BH72
MSITLKTAEEIEKMRLACRLAAEVLDHVEPYVKPGVTTAELDRICHEYMVNVQHTVPAPLNYAPPGYTPYPKSICTSVNHQVCHGIPGDKALKKGDIVNLDITVITEDGFHGDTSRMFIVGGDGAILAKRLCQVTFECLWLGIAAVRPGARLGDIGAVIQKHAEGNGFSVVREFCGHGIGRKFHEEPQVLHYGKAGTGVELKPGMIFTIEPMINAGKAAISELPDGWTIVTKDRSLSAQWEHTILVTETGVEVLTLSAKCPPPPPLVAASFA

SEQ ID NO: 86961 - protein, 394 aa, Magnetococcus sp. MC-1
MMAMQWAKKIAQIQPFYVMEMLAKAKALEAQGRHIVRMEAGEPDFTTPAPVLAAARLALDEDRTRYTPSLGIPELRAAIAQWYQTRYGVAVSPQRVVVTPGTSGAFQLIFGLLLDAGDRVALSDPGYPCYPNMVRFVNGEPVAIPVSPQSHYQLSAELLVEQLAPQHARGLKAAIVTSPSNPTGTLIPDAQMQTLLSAVEGQGGYVISDELYHGITYGCKARTALEFSENAIVINGFSKYFGMTGWRLGWMIVPPSAVRGIEMLSQNLFISAPTIAQYAALQAFDCAGAMDEQVARYDLNRRYLLTALPKLGFGIGVEPKGAFYIYADATQVLSKTGLANGEALCMAALEQAGCAFTPGLDFGRYRSHEHVRFCYAAELAQLKIAMERLAAWLG

SEQ ID NO: 86962 - protein, 456 aa, Agrobacterium tumefaciens str. C58
MICNCINSISMKAQKMDKPVFGWRRNGDDLSLSDVHSSIRIKPDASTFRRAMAFFGPGYLVAVGYMDPGNWATSLAGGSKFGYTLLAVALVSNIMAIVLQSLCARLAIASGRDLAQACRDAYPKPVAMVLWLLAEIAIIATDIAEVIGTAIGLNLIFGIPLELGVLITALDVFLILYLQKLGFRWVEALVITLLGVIAVCFAIQLALADPDWGQVILGFAPTTEIVTNPDMLYLALGILGATVMPHNLYLHSGIVQTREIGPTIAEKREALKFATLDSTIALMFALLINASILILAAATFNKTGQTNVAELGEAHSLLAPLLGLAIAPTLFGVALLCCGINSTVTATLAGQIVMEGFLKMRLAPWLRRLITRAIAIVPAAGVTIFYGDSGTGQLLILTQVVLSLQLSFAVFPLVMFTSDKAKMGELRSPLWLSAIAWLIAVVIAALNVKLLMDFMG

SEQ ID NO: 86963 - protein, 574 aa, Lactobacillus sakei subsp. sakei 23K
MTKLRGIAASDGIATAKAYMLVQPDLSFSKSTISDSEKEINRLHKALQDSTSDLETIRKIAAESLGEEEAQVFDAHMMILADPEFTGAIEGKINDDKVNAEQALKEVADLFVATFESMTNNAYMQERAADIKDVTKRVLSHLLGVTLPNPALIDEEVIVIAHDLTPSDTAQLNGKFVKAFVTDVGGRTSHSAIMARSLEIPAIVGTETVTQDVKAGDLLIVDGINGDVVLDPTDADIAEYDVKAQAFADQKAEWEKLKNEKSVTKDGKTFTVAANIGTPKDLAGVLENGSEAIGLYRTEFLYMDSAELPSEDDQFEAYKSVLEGMDGKPVVVRTMDIGGDKKLPYLPLPEEMNPFLGYRAIRISLDRDDIFRTQLRALLRASNYGKLRIMFPMIATVAEFRQAKGILEDEKAKLIAAGQTVSDDLQVGMMVEIPASAVLANQFAKEVDFFSIGTNDLIQYTMAADRMNERVSYLYQPYNPAILRLIKNVIDASHKEGKWTGMCGEAAGDSIMAPLLVGMGLDEFSMSATSVLRVRSLMKRLDTTELTDLVETAVNVNTSNEENQKLVEDFMKDR

SEQ ID NO: 86964 - protein, 137 aa, Coccidioides immitis RS
MRIREPKTTALIFASGKMVVTGAKSEDDSKLASRKYARIIQKLGFNAKFTDFKIQNIVGSCDIKFPIRLEGLASRHHNFSSYEPELFPGLIYRMMKPKIVLLIFVSGKIVLTGAKVREEIYQAFEMIYPVLTDFRKV

SEQ ID NO: 86965 - protein, 440 aa, Mycobacterium smegmatis str. MC2 155
MDPVSQLEADARHLVRYSGRGGFTPTVIGSARGSLMFTEDGRELIDFTSGQMSAILGHSHPEIVATVQSQIAHLDHLYSGMLSRPVIELSRRLAETLPPTLDKVLLLSTGAESNEAAVRMAKLVTGKHEIVSFARSWHGMTQAAANATYSAGRRGYGPAAPGNFALPVPHRFRPDITDELGELDWRRQLDLGFDLIDAQSVGSLAACLIEPILSSGGIIELPPGYLAALAQKCREREMLLIVDEAQTGLCRTGDWYAFEHDGVVPDILTLSKTLGAGLPLAAVITSSEIEQRAQEREFLFFTTHVNDPLPAAVGLTVLDVLSRDRLDVRARELGQRLRAGLDELAGRHPIVADVRGRGLLLGMELSAEDTPGVSADQLGAVVTRRCFELGLHMNIVQLPGMGGTFRLAPPLTATDNEIDRALEIMDEALAYAREPAVHRS

SEQ ID NO: 86966 - protein, 323 aa, Crocosphaera watsonii WH 8501
MYNPKILCIGEILFDCLADQLGKELNEVTSWIAYPGGAPANVACGLIKLGISAAFIGCVGKDKPGDELVKILDKIGVNSTGIQRHTNAPTRQVYVTRSLTGERQFAGFGQIKTEDFADTRLNSQQLTSSLFTQAKYLVMGTLELAYTQSQQAIFKAIQLAKKYQLHILIDVNWRPVFWQNIETAKPLIIQVLQAADFIKCSEEEAHWLFKTEDPQEIAQQFPKIKGILVTLGEKGCHYYLGKNQGIVAGFSVKVMDTTGAGDSFVAGFLSQCCYYEEEILNNAARAKQTIIYSNAVGALTTTKPGAIAAQPSKEEVEIWLKNH

SEQ ID NO: 86967 - protein, 408 aa, Triticum aestivum
MEMAIDTPSPSPSVSPAPSAAAGRQTRAAESVRLEHQLVRVPLEALRATARTNHRLAEKEIAAVLSSASSAAAAPGESGSAAAVDHLTSLVSRLHGLKRKMEEGARAEELQVQRCRARLDRLAAASAGDDAEWEDIRLKRILVDYMLRMSYYDTATKLAETSGIQDLVDIDVFLDAKRVIDSLRNKEIAPALAWCAENKSRLKKSKSKLEFLLRLQEFVELVKAKNFLQAISYARKYLAPCGSTHMKELQRVTATLVFRSSTNCAQYKVLFEQNQWDSLVDQFKQEFYKLYGMTLEPLLNIYLQAGLTALKTPFCFEGNCPKEDPLSLDGFRKLAEPLPFSKQHHSKLVCHITKELMDTENPPLVLPNGYVYSTKALDEMAKKNGGKIICPRTGEECNYTELVKAYIS

SEQ ID NO: 86968 - protein, 457 aa, Lactobacillus acidophilus NCFM
MNDKQSQNNSGYKRTLSNAHIQLIALGGTIGTGLFLGVGDSIHRAGPSVILIYIIVGVFLFLLMRALGEMIMSDLNKHTYIDFIEQYLGKNIGFITGYLYWISWITLGMAETTALGIYFKYWFPTLKPWIPGIITIVLLLLINLISARVFGNLEFSFAIIKIVTIVAFVILIFYLLITGGKTTFGPVSFENLDDHGGFFARGTKGFLQGFQMVIFSFIGVELIGLTAAEAQNPKVTLKRAINQLPVRIILFYVMAILGILLVIPWSKVSTNSSPFVQALGATGIRNASSIINFVVISAAVSSTNSFLYSAGRLLFSVTYNGKGKWNQTFGHLSKRQLPQNSLILSALLMACAPLITMVIGDQAFNFISSTSTSMFLIIWCLMVLTHISFRKKTPESVYSDFKMPGFPYVDYLILLFFGLMIILLLILPSYRIPMIAAIVTFIILYIISKIWSNEKTV

SEQ ID NO: 86969 - protein, 509 aa, Xanthobacter autotrophicus Py2
MMRRRGEAGMEETTRVFDLAIIGGGINGAGIARDAAGRGLSVVLFEQADLASGTSSASTKLIHGGLRYLEHYAFRLVREALAEREVLWGIAPHIIWPLRFVLPHHAGLRPAWMLRLGLFLYDHLGGRRLLPPTRTLDLRHDPAGLPLRPGLGTAFEYSDCWVEDARLVVLNARDAADRGASIRPRTKVVGAHRVDGLWEIEAEGMAGRESVRARALVDAAGPWAGQVLDVLQVKASARLRLVKGSHIVVHRLFAHDRCYLFQNGDGRIVFAIPYEGDFTLIGTTDLDYEGRPEDVAASPEEVAYLCAAASEYFAAALAPEQVVWAYSGVRALYDDGAGKAQEATRDYVLALDAPDGEAPLLSVFGGKITTYRRLAEATLARLAPHLPVLGPSFTGKVPLPGGDFPRQGFDHLLKSLRRTFPALDPALLKRLARAYGTSTFRLLEGVMHEDDLGDWFGAHLCRREVDWLMDQEWAMTAEDVLWRRSKLGLRTRHEEARTLDAYMAARRGG

SEQ ID NO: 86970 - protein, 137 aa, Wolinella succinogenes DSM 1740
MEQTLSIIKPDAVAKNVVGKIIDRFESNGLKVAAAKRLQLSRADAEQFYAVHKERPFFKDLVDFMVSGPVVAMVLEGENAVLKNRDLMGATDPKKAAPGTIRADFADSIDANAVHGSDSLENAKIEIAFFFSGREIN

SEQ ID NO: 86971 - protein, 330 aa, Thermoanaerobacter tengcongensis MB4
MKIAVLGAGSWGTAIAIHLNKLNHQVRLWMRSKEQFEELIATRHNSRYLDVDLPSSILLYNDLDKAVEDSEVVVIAVPSHAVREVSEKLKGKISKNAIVVNLAKGIETSSLKRMSEVIKEYLLNPVVVLSGPSHAEEVVRQIPTACVLASEDVKACEFIQEAFMNETFRLYVNTDVIGVELGGALKNIIALGAGISDGLGFGDNTKAALMTRGLAEITRLGVAMGSDPLTFLGLAGVGDLIVTCTSNYSRNRRAGILIGKGKSLKEALKEIGMVVEGVNTTKSAYRLSQIYGVEMPITKEIYSIIFENKNPFEAVYNLMTRDKKHELHGI

SEQ ID NO: 86972 - protein, 446 aa, Cytophaga hutchinsonii ATCC 33406
MLFQDLKLIDPILKALSEEGYTTPTPIQSQAIPYVLQGKDLLGCAQTGTGKTAAFSIPILQLLSVKKSTDRKRPIRSLIVTPTRELAIQIGESLQAYGKYTGLTSTVIFGGVNQSRQVTALQNGIDVLVATPGRLLDLMNQGFISLRHIEIFVLDEADRMLDMGFVHDVRRLLLALPAKRQSLFFSATMPPEIVKLADNILVNPSKVEVTPVSSTADTIKQFMYFVDRGNKNNLLVEVLQDPKIKTCLVFTRTKHVADKVVKMLAEHKIKAEAIHGNKSQNARQNALTNFKAQTTRILVATDIAARGIDVDNLEFVINYEIPNIPETYVHRIGRTGRAGAKGTAFSFCDAEEKAYLKDIEKLISKKIPVIDEHPYPLMDHNPPKTPQGRQQRPASSSRPKAASGANSGSSRAGNAGGSQRSSGSSSRSGSSTGKKKWYGKSGSNTK

SEQ ID NO: 86973 - protein, 273 aa, Vitis vinifera
MGILMKCRTSHQLQNFNSLWTVRLLLVLFISFWAVNELLRIPFFRRRYPYPFLPALTLAQQAGLCKVHVVLSLGLYEPGFLVTFLFLVNVSVKKHSRDNKWGVVIVFALCLPIFLLQLFFTYFSPPEVPIPGFMTIKDEYGNDAVLCMYPLVNTLVFCAFAIVYAVCFLLSCWRVVSLVINKGLRVRIYALASAVLFPLLVQLLFLGISVVFSPADTFYGGAALMVFLSVLCCTVVGESILIIRPITEALSAGGDCCLWIRDVGPGKQVADEG

SEQ ID NO: 86974 - protein, 755 aa, Hyphomonas neptunium ATCC 15444
MPYNLPATRVLMNNLRQVMAEEGDARSRLDQVVRIIASTMVADVCSIYHREADETLLLIATEGLKEEAVNKTRMGANEGLVGYVARTAEPIAIEDAPRHPAFSYRPETGEDPFHAFLGVPILRTGGVLGVLVVQNRTERTYRDEEIETLQTIAMVLAEIVHRIEEDQSTPQPDRRFRGQSSENLRGRIFCEGLGYGRAVLHDPVVPAARFFAADQKQETLRLTQGLKDLRTSIDRMMLIDGAALGEDPRDVMEAYRLLAHDNSWAEKLQEGVRSGLSAEASVDRARREHRAKMQAARDPYLRERLHDLEDLDNRLLRILGGDENKPQITDESSVLVARRLGPAELLEYAKTGLKGILMEEAAASSHAAIVARALSIPAIGGIEGLTTLIEQGDYVIVDAEQGQAHIRPDDAVYDAYKSRVALRSERQAVYASLKGLPAQTKDGETLSLMLNAGLDLDLDMLDQAGADGVGLFRTEFQFLVSESLPRLEDQISLYRRVLDRAAGRPVIFRTLDLGGDKVLPILNQLREENPALGWRSIRFALDHKGLFRRQLRALVRAAGEGPLTVMFPMVTTPEEFREARALLEEEVAWTLKRTGKTPSKLEIGVMLETPALAFSLSDLAGEVDFLSVGTNDLLQFFFAADRMTPSVSDRYALISPAALRFLRMVAETCKTAGIRLSVCGEATATPLAAFCFAAFGYSSLSMSASSIGPVKQALRSIDLAGFRKGLDAALEKPNGAFRNQVLGIAIEHGADIPDT

SEQ ID NO: 86975 - protein, 295 aa, Saccharomyces cerevisiae YJM789
MSLRTPKRSRTGDEQEQEQEQEQVQNPDTHVNNEHQQRPGPTTLLSTPVRLKNGFGTPSPPSPPGITKSITKSRRRPSTTSLQGIFMSPVNKRRVGITAHGRVYDHNDDGHESESEDDENEEENENQKKYDGHVSMPLLPPTTPKSRRSEVFLSPSPRLRSPPTAARRSTGERPIREISHTLRTRLNYALVKLQNGWTDKTLPELETELAPAVQTPPRRYHNRFPDSADAGTSAHTAFLQALGGHPPREEATAVETLMLLSSPTKKQQHRPVPATSAGEPTDETEPESDTEVETS

SEQ ID NO: 86976 - protein, 269 aa, Vibrio vulnificus YJ016
MGKEKKMTQPSLNPLVIKLGGAALSCSQTLSQLFGAIASYQQKEQRQIVIVHGGGYLVDELMEKLQLPTVKKNGLRVTPYDQIPLIAGALAGTANKLLQGQAMADGLNAIGLSLADGGLCQVEELDPELGAVGKATPGDSRLLQTILNAGALPIISSIGLTAQGQLMNVNADQAAVAVAGALDAQLVLLSDVSGVLDGKGHLIKSLNQQEADALIAGKVITDGMIVKVQAALEAANDLGRAIEVATWRYPENLEKLFAGESIGTQFLPA

SEQ ID NO: 86977 - protein, 550 aa, Schizosaccharomyces pombe
MSYRDNEYSGNYNGKEDGYNSRGRYGGGYRNNYSRGGGRGGFNDGASYGYDQRGQGRNFYESDGPGANLVKKDWKNETLIPFQKDFYKEHENVRNRSDAEVTEYRKEKEIVVHGLNVPKPVTTFEEAGFPNYVLKEVKQLGFEAPTPIQQQAWPMAMSGRDMVGISATGSGKTLSYCLPAIVHINAQPLLSPGDGPIVLVLAPTRELAVQIQQECTKFGKSSRIRNTCVYGGVPLGPQILDLIRGVEICIATPGRLLDMLDSNKTNLRRVTYLVLDEADRMLDMGFEPQIRKIVDQIRPDRQTVMFSATWPKEVQRLARDYLNDYIQVTVGSLDLAASHNIKQIVEVVDNADKRARLGKDIEEVLKDRDNKVLIFTGTKRVADDITRFLRQDGWPALAIHGDKAQDERDWVLNEFRTGKSPIMVATDVASRGIDVKGITHVFNYDFPGNTEDYVHRIGRTGRAGAKGTAYTYFTSDNAKQARELVSILSEAKQDIDPKLEEMARYSSGGRGGNYRRGGYGRGGFRRGGGYGNRNRGFTGSNSAPLARSRW

SEQ ID NO: 86978 - protein, 464 aa, Corynebacterium glutamicum ATCC 13032
MVSVLIVGMSHRSAPVSLLERLSMDDSVRGETTQALLGRASLSEALIVSTCNRLEVYTVTSSFHTGVNDVVEVLHEASGVDIETLRGYLYVRYADAAAEHMLVVTSGLDSMVLGEQQIIGQVRTAYQAANEYGSVGPALHSLTQTALHTGKRVHSETAIDDAGASMVSFAVDRALVQMGLDSEAEAPLSGKTALVLGAGAMSSLAATHLGRAGISNLIMANRTLERAERLAEHSLEAGVPAEVVEYDQRASAYNRVDLVVSATGADDFTVKPEDIPEGASLMLVDLSMPRDIDDACADLPGVDLVNIERLHKASREGGSGMAPSEEEALAIVREELDSFTSEQRIRDIVPAVSALRRQAASVGSDELDRLRQRAPGISEVEWGEVEKTVRRVVDKLLHEPTVRVKELAARSGSISYDSALQELFGLESLASTAAPATTSVNASELPDAGIVAFVNAPSATQTRE

SEQ ID NO: 86979 - protein, 234 aa, Brassica napus
  misc_feature (207)..(207): Xaa can be any naturally occurring amino acid
MGEEEDAVSLDQNSSGGGEDSSLRRNRHSSPLPPHLSSKVLTLPTVLTLGRVAAVPILVATFYVDCWWGRTATTSIFIAAAITDWLDGYIARKMRLGSAFGAFLDPVADKLMVAATLILLCTKPMDAIVLGPVPWLVTVPSIAIIGREITMSAVRGWAASQNGKLSQAVAVNSLGKWKTATQMIALTILLASRDSSLERLWPSGMGXLYVSAGLSVWSLVVYMRQIMRVLLKKK

SEQ ID NO: 86980 - protein, 336 aa, Methanosarcina mazei Go1
MKVNTWFGVLELDSNGKTLSSEVFPKDIRELALRSLSLRESRQNLPPEGFDLKTAALECGFTESLSEYYSLLHKVTLETVKLQVSQALTPDQRIIQAVEALDDINETTNSLSERLFEWYGGYFPESGLSGEELAVFISRYGSRENLPPEDPHYLKAKNSMGAKLEAADEVLLKGLAESVCSLYERRKQIEAYIESSMEILAPNLALLAGPMLGARLISIAGSLEKLAAFPSSTIQVIGASKALFKHLRSRAPSPKHGIIYSHPLINTSPWWVRGKVARALAAKLSLAARIDFYSAKRNPSLENELEEKIRKIRAENPRPPQKRQEIRAKPKKKRRK

SEQ ID NO: 86981 - protein, 485 aa, Azoarcus sp. BH72
MQLKDQSLLLDAAFIDGEWIAADDGARFDVRNPADGSLVATVPDMGAAETRRAIAAADAALPAWRARTAKDRALILRKWFDLILAHQEDLAQLMTAEQGKPLAEARGEVAYGASFIEWFAEEAKRIYGDVIPGHGPDKRIIVIKQPIGVVAAITPWNFPIAMITRKCGPALAAGCTVVVKPAEDTPLCALAIAELGRRAGLPAGVLNVVTTSRAPEVGTELATNPIVRKLSFTGSTAVGKLLMAQCAGTVKKVSLELGGNAPFIVFDDADLDAAVAGAIASKYRNAGQTCVCANRLLVQDGIYEAFAARLAEAVAKMKVGPGVEADVQQGPLINDKAVAKVEELLADATAKGAQVVLGGERHALGHGFFQPTVLTGVTPAMRLAREEIFGPVAPLFRFSTEDEAVRLANDTEYGLAAYFYAGNIARVWRVAERLDYGIVGINEGIISTEVAPFGGVKESGIGREGSKYGIEDYVEIKYLCLGGIR

SEQ ID NO: 86982 - protein, 660 aa, Burkholderia pseudomallei K96243
MSAAPVALPDAAPPAGLPDPATLARLASEFLAALPGQPAAPNAGAGSGAVGGVPSALPAAAPMLASVSNPAPPGSPLAGPGGTGTGVPGIGVPPGKVPGANLVPAPTHVLSLGNRTPALVGHAAAQNGWPDSAVAIAPALEPRAGGVALGVPPVPEPDAVRRAGDASAAAAPSPWSYYFVEPASDDWWRDAARTPIDVPRDGVASPRAFGLPDENAWRDLLSIGWPAADRHRASRYFVDDAQPTNAHAPGAGAHPPFDIAAIRRDFPILAERVNGKPLVWFDNAATTHKPQAVIDRLAHFYAHENSNIHRAAHALAARATDAYEHARATVQRFIGAASPDEIVFVRGATEAINLIAKTWGVGNVGEGDEIVVSHLEHHANIVPWQQLAASVGAALRVIPVDDAGQVLLGEYRKLLNDRTKIVSVTQVSNALGTVVPVKEIVELAHRAGAKVLVDGAQSISHMRVDVQALDADFFVFSGHKIYGPTGIGVVYGKRALLDGMPPWQGGGNMIADVTFERTVFQPPPNRFEAGTGNIADAVGLGAALDYVARIGIERIARYEHDLLAYAAGVLAPVPGVRLIGTARDKASVLSFVLKGYETEEVGRALNAAGIAVRSGHHCAQPILRRFGLEATVRASLAFYNTRDEVDAMVDVVRELAARRI

SEQ ID NO: 86983 - protein, 415 aa, Pasteurella multocida subsp. multocida str. Pm70
MQSKVVIPQGEKIQLDAKGALIVPDHPIIPFIEGDGIGVDVTPAMRTVIDAAVEKAYGGKRKISWMEIYAGGKANEVYGENTWLPDETMTFIRDYHVAIKGPLMTPVGGGIRSLNVAMRQGLDLYNCLRPIRYYDGTPSPVKHPELVDMVIFRENSEDIYAGVEWVAGSAEANKVIAFLQQEMGVKKIRFTEDCGIGIKPVSKQGTQRLVRAALQYVIDNDRKSLTLVHKGNIMKFTEGAFKEWGYQVAQEFGAELLDGGPWMTLKNPKTGREIIIKDSIADAFLQEILLHPTEYDVIATLNLNGDYISDALAAQVGGIGISPGANIGAEAAIFEATHGTAPKIAGQDKGNPGSLILSGEMMLRHLGWLEAADLVVKAVSKTIADKTVTFDFAEMLEGAKLRSTSEFAQDIVANM

SEQ ID NO: 86984 - protein, 330 aa, Magnetococcus sp. MC-1
MAKIDVFGIGNALVDQVYAVEESFLTQIGEEKGRMSLVDPQRQAELSRALASTPALRACGGSAANSLIALTQLGGSAFHACRVAEDETGHFFAQDLTANGVQHQLHTLPAGSSGSCMVFITPDAERTMCTFLGASADLQPEDVPDAILTTAQWCYVEGYLVTAPNTLAAALKGLQQARANGVKTALSFSDVNMVKFFRDGFSQMLGESGVDLIFCNAEEALAFAETDDMAQATAALKKQSRTFVITLGAEGALLWDGQQEIQVAGQPAKAIDTNGAGDMFAGAFFYGITQGWDFTKAAQLACRCCAVLVTHAGARLPKSRTQEILAQFVP

SEQ ID NO: 86985 - protein, 329 aa, Burkholderia pseudomallei K96243
MAVFDIDDIVQSLQTVRQRWREVQRRSLEPGGRELPAREALAGIVETFKGVLFPMRLGPPDLRQESENFYVSHALDDALHALLAQARLELRYKGRHDADAPAEAAIDAKADAAVRAFAARLPDIRALLDSDVLAAFHGDPAAGSVDEVLLCYPGVLAMIHHRLAHALYRLELPLLARIVAEHAHAQTGIDIHPGAQIGGGFFIDHGTGVVIGETAVIGERVRVYQAVTLGAKRFPRDASGHLEKGLARHPIVEDDVVVYAGATILGRVTIGKGAVIGGNVWITQDVPPGSHVTQAVTRSDPARPADAAASSPRPAGAHDATLSAAQALR

SEQ ID NO: 86986 - protein, 397 aa, Streptococcus agalactiae NEM316
MAFSPIKKLLQDIKSGKMVVLMDDENRENEGDLICAAEMVTKESINFMAKFGKGLICLPLSNYYAEKLELAQMASHNTDNHETAFTISIDHLSTSTGISAEDRALTAKMVANDSSKAKDFRRPGHLFPLLAKEGGVLARNGHTEATVDLCRLAGLKECGLCCEIMAEDGSMMRKDELLAFAQKHDLAIATIKQLQDYRRQEEGGVVREIEIQLPTQFGHFTAYGYSEVVANKEHVALVKGDISSGEDVLCRLHSECLTGDVFHSLRCDCGEQLANALQQIEAEGRGVLLYMRQEGRGIGLINKLKAYHLQEEGLDTLEANLALGFEGDERDYGVSAQLLKDLGINSINLLTNNPDKIQQLEAEGICVKNRVPLQVAATAYDLNYLKTKKEKMGHLLD

SEQ ID NO: 86987 - protein, 158 aa, Pasteurella multocida subsp. multocida str. Pm70
MIRIGHGFDVHAFGGEGPIIIGGVAIPYEKGLLAHSDGDVALHALTDALLGAVALGDIGKLFPDTDMQYKGADSRGLLREAYTQVQAKGYKVGNVDVTIIAQAPKMRPHIDAMRAAIAEDLACDIEQVNVKATTSERLGFTGRGEGIACEAVALVVKS

SEQ ID NO: 86988 - protein, 555 aa, Kluyveromyces lactis NRRL Y-1140
MSSSLQFKKVAGSDGSSAWNTNDQQYNAFVHEGDTDTPTYVKTFQNCVRILKKYARFVGPGLMVSVSYMDPGNFSTAVAAGSAHRYKLLFSVLVTNILAAFWQCLCAKLGAVTGLDLAQNCKKHLPPTLNLVLYVLAEVAIIATDLAEVVGTAISLNILFKIPLPLGVILTVVDVLVVLLAYKPNGSLKLVRWFEAFVSLLVFATVVCFAIELFSVHIDSVGEVFKGFLPSKAVFESDGLYLSLAILGATVMPHSLYLGSGVVQPRLRDYDIKQGHYIPSQNDEDNNHDNYKPSIDAIHDTLNYTMAELLVSLFTVALFVNCSILIVAGATLYGVTSNNAHEADLFSIYNLLSETLSKTAGTIFVLALLFSGQSAGIVCTLSGQMVSEGFLNWTVAPALRRALTRVVAITPCLILVLVAGRNGLSGALNASQVVLSLLLPFVSAPLIYFTSNKNIMRVPWAIDCSQEPSNLFALQNLSSSNLATDDATVIAHDTDDEVDAHLINSPEPLSDESVHYKDFSNSIFTTVVAVIVWIFISGLNFYLLISFANGQDVHL

SEQ ID NO: 86989 - protein, 350 aa, Oryza sativa Japonica Group
MAFRRTLARGIWAGKNANAAAACPAAAAPKPPARRPLPAVDDCPTLAYLRPRPGTIRYTTASVPLPAHCFPALPVGDQLFNRLRLDGLVPPTTAVTRPPEEEGVGVTVEEARKVARAAEMEVARARLRSNAQSVVSGSEFAALCVDIAGGAEGGRRLARALDDSGVVIVLGDAVFLRPDMIAKAIGSMIPATAHATRAAASVVEVRKKREEEEELRAMEEEKAGIDAAAAAQVRRELWCGLGLLAAQTLGFMRLTFWELSWDVMEPVCFYVTSLYFMSGYAFFMRTSTEPSFEGFYRSRLASRQRRLMRARSFDVARYEALKEQVGGGARYGVAARDAIVLRQQHVTHVH

SEQ ID NO: 86990 - protein, 363 aa, Mycobacterium smegmatis str. MC2 155
MPQTVRGVISRSKQQPVELVDIVIPDPGPGEVVVDIIACGVCHTDLTYREGGINDEFPFLLGHEAAGTVEAVGEGVTNVAPGDFVILNWRAVCGQCRACKRGRPHLCFDTFNATQKMTLTDGTELTPALGIGAFADKTLVHEGQCTKVDADADPAVAGLLGCGVMAGIGAAINTGAVTRDDTVAVIGCGGVGDAAIAGAALVGAKKIIAVDMDNKKLDWAREFGATHTVNAKDLDAVETIQDLTDGFGADVVIDAVGRPETWKQAFYARDLAGTVVLVGVPTPDMKLEMPLIDFFSRGGSLKSSWYGDCLPERDFPTLISLYLQGRLPLEKFVSERIGLDGIEDAFHKMHAGEVLRSVVVLDR

SEQ ID NO: 86991 - protein, 245 aa, Kluyveromyces lactis NRRL Y-1140
MSRFEIYSPEGLRVDGRRWNELRSFNCSINTHPNAADGSSYLEQGNNKIITLVAGPQEPSSRSQVNTKQATLSVTINLTKFAKMERSKSSHKNERRTLEWQASLVRTFEKNLMLHLYPRTSIDVQVHALQLDGGILGAMLNGITLALIDAGIAMYDFVSGVSVGLYDTTPLLDLNSLEENAMSSVTIGTIGKSEKLSLLMVEDKVPLDRLESVMAIGIAGTHRIRDLMDKELRKHGKTRVENSSN

SEQ ID NO: 86992 - protein, 293 aa, Listeria innocua Clip11262
MQDLMLFLDHYKKVLDESLFKEINMRNIEPKLKESMLYSVQAGGKRIRPMLVFATLQALNIEPMRGLKTATALEMIHTYSLIHDDLPAMDDDDYRRGKWTNHKIYGDATAILAGDALLTLAFSILAEDENLSFETRIALINQISYSSGAEGMVGGQQADMEAENKQVTLEELASIHARKTGELLIFAVTSAAKIAEATPEQTKRLRIFAENIGIGFQISDDILDVIGDETKMGKKTGVDAFLNKSTYPGLLTLEGAKRALNEHVSIAKSALSGHDFDDEILLKLADLIALREN

SEQ ID NO: 86993 - protein, 198 aa, Wolinella succinogenes DSM 1740
MLVTNKAPNFVATAVLGNNEIVSDFELYKNFGKSGTVVFFYPLDFTFVCPSEIIAFDKRLEEFQARGINVIGVSVDSQFSHFAWKNTAVKEGGIGQVRFPLVADLTKQIARDFDVLFNESVALRGSFLIDKDGTVRHAVINDLPLGRNIDEMIRMVDTMLFVNEHGEVCPAGWQKGDEGMKADTKGVAEYLAKNSEKL

SEQ ID NO: 86994 - protein, 619 aa, Wolinella succinogenes DSM 1740
MNLKGKTLKELEEVSLSIRERILEVVSHNGGHLSSTLGAVELIVGMHAVFDSSRDPFIFDVSHQAYAHKLLTGRWEEFATLRQFEGVSGFTKPSESEHDYFIAGHSSTSISLAVGAAKAISLSLEKNRMPVVLIGDGSMSAGLCYEALNELGDRKYPMVILLNDNEMSIAEPIGAISKYLSQAIAGRFFQSIKGKVEKLLAHLPEGASYMAKRFEESLKLITPGILFEELGLEYIGPIDGHNLKEIIETLRIAKAMNKPVIIHAQTLKGKGYKIAEGPREHWHGVGPFDLSSGEPLKKPCSSSPTDIFSRTLLELAKEDEKVVGVTAAMPSGTGLSALVHEFPNRFWDVAIAEQHAVTSMAALAKEGYKPFVAIYSTFLQRAYDQIIHDVGIMKLPVKFAIDRGGIVGEDGETHQGILDIGYLRLIPHMTLMAPRSNESLKEAVKFAKDFSLGPIAFRYPRKSFVLQEGIFSESPFLYGKAERLMEGKDEVLFVGFGNGVGRAYEVSKVMASEYEVGLVDLRFVKPLDHETLWELSKEYRYWLVFSDASKVGGVASALLEWKAEVGAEVEILSMELEDEYIQHGKVEQVEEEIGFDVKGLSQKVRERLERIANSQRLLV

SEQ ID NO: 86995 - protein, 626 aa, Oryza sativa
  misc_feature (559)..(559): Xaa can be any naturally occurring amino acid
MASISGAAAPPSSSAACRLRLRRQLLLRPSHLRLRAPHSIADLSRSSSSSSEQQPSSTPAAPLASRPGQNGSTRGAVEKDPIKLWERYVEWLYQHKELGLFVDVSRMGFTEEFLRRMEPRMQRAFAAMRELEKGAIANPDEGRMVGHYWLRDPGLAPNSFLRTKIETTLDRILAFSQDVVSGKIKPPSSPAGRFTQILSIGIGGSALGPQFVSEALAPDNPPLKIRFIDNTDPAGIDHQIAQLGPELASTLVIVISKSGGTPETRNGLLEVQKAFRDAGLDFSKQGVAVTQENSLLDNTARIEGWLARFPMFDWVGGRTSEMSAVGLLPAALQGIDIKEMLVGAALMDEETRNTVVKENPAALLALCWYWASEGIGNKDMVVLPYKDSLLLLSRYLQQLVMESLGKEFDLDGNRVNQGLTVYGNKGSTDQHAYIQQLREGVHNFFVTFIEVLRDRPPGHDWELEPGVTCGDYLFGMLQGTRSALYSNDRESISVTVQEVTPRAVGALVALYERAVGIYASLVNINAYHQPGVEAGKKAAGEVLALQKRVLTVLNEASCXKDPAEPLTLDQIAERCHCPEDIEMIYKIIQHMAANDRALIAEGSCGSPRSIKVYLGECNVDEDMLAA

SEQ ID NO: 86996 - protein, 593 aa, Zea mays
MDTAIGSVPAASDAARHPAPSASAPRDATLGRHLARRLAEVGARDVFTVPGDFNLTLLDELEAEPGGVRLVGCCNELNAAYAADGYARARAGGVGACAVTFTVGGLSAINGVAGAFSENLPVVCIVGGPNSNDYGSNRILHHTIGLPDFTQELRCFQNVTCYQAVVNNLEDAHEQIDTAISTAIKESKPVYISISCNLPSIPHPTFSRHPVPFFLSPRLSNQMNLEAAVEAAAAFLNKAVKPVLVGGPKMRVSKAWEALAELADACGYPVAVMPSAKGLVPVHHSRFIGTYWGAVSTPFCAEIVESADAYLFAGPVFNDYSSVGYSLLLKKEKAIIVQPERVVVGHGPAFGCVLMKDFLHALATRLKKNTVAYENYRRIYVPPGEPLSSEPGEPLRVNVLFKHIQAMLSGDMAVIAETGDSWFNCQKLKLPEGCGYEFQMQYGSIGWSVGATLGYAQAAKDKRVIACIGDGSFQVTAQEVSTMLRWGQNSIIFLINNGGYTIEVEIHDGPYNVIKNWNYTGLVEAFHNGEGACYTAKVRTEEELTEALEAALGPKKDCLCFIEVIVHKDDTSKALLEWGSRVSAANSRPPNPQ

SEQ ID NO: 86997 - protein, 356 aa, Alkaliphilus metalliredigens QYMF
MLKKLFIPGPVTVSEDVLEKMGTQMIGHRSKDASVLQRSVSDKMRQLMYTKNEILLSTSSGSGLMEGAIRSCTQKRAAVFSVGAFGDRWFKMAKANGVPADKFSSEMGQPTTPEMVEAALSTGKYDLITITHNETSTGVMNPVAEIAEVIKRYPDVIFCLDTVSSLAGTKIPVDELGVDICIASTQKCLGLPPGLAVCSFSQKALDAARKVENRGLYFDLVELYDYIQKKDYQYPSTPSISHMYALDYQLTKILDEGLDKRFARHLEMAKYVREWAAENFALLPEEKYASNTLTTIKNTKEISIKDLNGKLGEKGYAISNGYGDLKDKTFRIAHMADTTLDEIKELLTIIDEIMKE

SEQ ID NO: 86998 - protein, 255 aa, Photobacterium profundum SS9
MQRDKLLAGKVALISGITSGIGEATARLFSQQGASLVLVARNENKGQMLAEELNAQYPTLFIKADITQANQVDQVFEQTMAEFGGIDCAFNNAGIDGSKQPISETSDEIWNQIINTNLNGTWNMLNRQLSIMSKQGHGTIVNMASICSVLARPNRAAYNTSRHAVLGLTRSAAVEYAKQGVRVNAVAPGAIDTPIFERSTQKDPQLIAKYHQAHPIGRIGQPREVAEAALWLCSDLSSFVVGHTLMVDGGFSISG

SEQ ID NO: 86999 - protein, 472 aa, Crocosphaera watsonii WH 8501
MTKIAKLLIFIFCLNITPIKVTAQDTPIYDYRAIFHPVISKNGMVASQEDLATQSGLEVLKEGGNAIDAAVTIGFTLAVTLPRAGNLGGGGFMLIHLADQQKTVALDYREKAPLAANSDMFLDENGEVDQQKIKFSHQAVGVPGTVAGLAMALEKYGTISLERALQPAIKLAEDGMIVDEDLYNSLVFAKRNLQKSPASLAIFYKADGSPYQIGENFKQPDLANSLKLIANQGIKAFHQGEIADKIVRDMEANNGLITKEDLAKYKPIIREPIEGKYRGYKVYSMPPPSSGGVHLVQMLNILEKFPIQSLGHNTSSTLHLMVETMKFAYADRFKFMGDTDFVDVPIKRLISKKYADQIGEKIDLEKVIPSQNILPKPVFQSNESTETTHYSIMDRYGNAVANTYTLNFSYGSGLTVPGTGILLNNQMDDFTAKLGVSNAYQLIGGQNNSISPEKRMLGSMTPTIVLKEGKLW

SEQ ID NO: 87000 - protein, 242 aa, Zymomonas mobilis
MEKVSFGFSDVSPQEKTHLVGDVFRRVASRYDLMNDAMSGGLHRLWKDDFVRLVQPKASEHILDMAGGTGDIAFRLAKYGTNVTIADINPAMLEVGKKRAIARSIENLTWKEENAEALSFNDNVFDAYTIAFGIRNVTHIQKALDEAWRVLKVGGRFFCMEFSQTKWSGFSNLYKMYSTHIVPKIGQLLANDEDSYRYLIESIETFPNIEKFSDMIKSAGFVQIRARPILGGLVAIHSGWKV

SEQ ID NO: 87001 - protein, 256 aa, Arabidopsis thaliana
MCVEVYHHLKSVIKKKYGQDATNVGDEGGFAPNIQENKEGLELLKTAIEKAGYTGKVVIGMDVAASEFYSEDKTYDLNFKEENNNGSQKISGDALKDLYKSFVAEYPIVSIEDPFDQDDWEHYAKMTTECGTEVQIVGDDLLVTNPKRVAKAIAEKSCNALLLKVNQIGSVTESIEAVKMSKKAGWGVMTSHRSGETEDTFIADLAVGLSTGQIKTGAPCRSERLAKYNQLLRIEEELGSEAIYAGVNFRKPVEPY

SEQ ID NO: 87002 - protein, 307 aa, Zymomonas mobilis subsp. mobilis ZM4
MAKINTILEAIGNTPHLRLNKLFPDHEVWIKVEKSNPGGSIKDRIALAMIEDAEKSGKLKKGGVIIEPTSGNTGIGLAMVAAVKGYKLILVMPESMSIERRRLMLAYGAEFDLTPKEKGMAGAIERARQLAEETEGAWIPQQFENPANINIHATTTGQEILKDFADTPIDALVSGVGTGGHLTGIGESLRKKWPDIQIFAVEPATSPVLAGGKPGAHAIQGIGAGFVPKNLHRNILNGIVEIENDEAKKWALRAAKEEGLLVGISTGATLAAIAKKIKELPENSRILGVNYDTGERYLSVPDFLPEA

SEQ ID NO: 87003 - protein, 568 aa, Gibberella zeae PH-1
MSLAQHSESASPVPIIETDDQGNPIKSSNGYFPSKGKSSTLVDNMAHLSVVGGAHRGDDSDAASVRSTSSRASRRPEMKLASYQDEYTTSVYGSRFAGMDLPRHHMPENEMPRDIAYRMIKDDLSLDNNPMLNLASFVTTYMEDEAEKLMAESFSKNFIDYEEYPQSADIQNRCVNMIGDLFHAPPGSSVGTSTVGSSEAIMLGVLAMKRRWKNRRIAEGKSTEHPNIVMSSAVQVCWEKATRYFEIDEKLVYCTPDRFVMDPEQAVDLCDENTIGMCAILGTTYTGEYEDIKAINDLLVERNLDVPIHVDAASGGFVAPFVVPDLEWDFRCEKVVSINVSGHKYGLVYPGVGWVIWRSPEFLPQELVFNINYLGADQSSFTLNFSKGASQVIGQYYQLIRLGKHGYRAIMSNLTRTADYLTETLENMGFVIMSERSGAGLPLVAFRFKTVDEGGDPERHYDEFALAHHLRSRGWVVPAYTMAPNSGVKMLRVVVREDFTKSRCDQLICDVKLCHGLLKETDQESIKKREEYIKNHIVTMGRGKHSHPVYKDEQHSLQGKHGKTHAIC

SEQ ID NO: 87004 - protein, 388 aa, Vitis vinifera
MGETRFLQELVLYAASAALSCLVLFAGLRHLDPNRESSKKALEHRKEIAKRLGRPLIQTNSYEDVIACDVINPDHIDVEFDSIGGLETIKQALVELVILPLRRPELFSHGKLLGPQKGVLLYGPPGTGKTMLAKAIAKESGAVFINVRISNLMSKWFGDAQKLVAAVFSLAYKLQPAIIFIDEVDTFLGQRRTTDHEAMANMKTEFMALWDGFTTDQNARVMVLAATNRPSELDEAILRRLPQAFEIGIPDRRERVEILKVVLKGEKVADDINYDRIASLCEGYTGSDILELCKKAAYFPIRELLDDEKNGKPSPAPRPLSQLDLEKVLATSRKTKVAASEYTGLNPQSSGWSGNREPDDYQVQSAIGELSKLVLSQIMNLQSDAQDP

SEQ ID NO: 87005 - protein, 422 aa, Streptomyces coelicolor A3(2)
MTALSPHLRQATPVVAVRGEGVHIEGEDGRRYLDFTAGIGVTSTGHCHPRVVAAAQEQVATLVHGQYTTVMHPPLRRLVDKLGEVLPQSLDSLFFTNSGSEAVEAALRLARQATGRPNVLVCHGGFHGRTVAAASMTTSGTRFRSGFSPLMSGVVVTPFPTAFRYGWDEETATRFALQELDYTLQTISSPADTAAVIVEPVLGEGGYVPANRAFVEGLRERADRHGFLLILDEVQTGVGRTGRFWGHEHFGVAPDILVTAKGLASGFPLSAIAAPEELMRKAWAGSQGGTYGANAVACAAACATLDVVRDEKLVENAEAMGARLRHGLEAVASRNPAVGDVRGMGLMLASEFVTADGEPDPETAARVQRAAVDEGLLLLLCGAWNQVVRMIPALVIDETAVDEGLRAWAAAVEAGTSGAAGR

SEQ ID NO: 87006 - protein, 479 aa, Streptomyces coelicolor A3(2)
MTDTPTQLFLGGAWADAADGAVMPVDDPATGEILAHVADAGPKDARLAEEAAVQAQEEWARAAPRARSEILRRAYEIVLERTDALARLMTSEMGKPLAEARGEVAYAAEFFRWFSEEAVRIDGGHGVLPDGRNRMLLSRRPVGPCLLITPWNFPLAMGTRKIGPAVAAGCTMVLKPAPQTPLSSLALAAILKEAGLPDGVLNVVTTSRAGEVCEPLLRGGRIRKLSFTGSTAVGRLLLAQCADTVVRTSMELGGNAPFVVFDDADLDAAVDGAMVAKMRNMGEACTAANRFFVHRSVAGEFADRLARRMGALVVGPGTGDGVDVGPLIDAAGRAKVEELVADAVERGARVLVGGTTPEGPGCFYPPTVLTDVAPESRLMATEIFGPVAAILTFDDEDEVVRRANDTPWGLVGYVFTEGLDRALRVSERLDVGMVGLNTGLVSNPAAPFGGVKQSGLGREGGRVGIEEFLEYQYVALPTG

SEQ ID NO: 87007 - protein, 425 aa, Vibrio vulnificus YJ016
MSDDNSQQMTPEEVLRQQALDYHALPTAGKIAVALTKPAETAKDLALAYSPGVAEPVREIAQNPDNVYKYTSKGNMVAVISNGTAILGLGNLGPLASKPVMEGKALLFKRFAGLDSIDIEVKHRTIDEFVDTVANIADTFGGINLEDIKAPDCFEIEKRLIERCDVPVFHDDQHGTAIVTAAGMLNAIELQGKKLNECIIVCLGAGAAAVACMELLIKCGAMREKIYMLDRKGVIHTRRDDLNEYKQLFANNTDKRTLEDVISGADLFLGVSGPNLMPAEALKLMADKPVVFACSNPDPEIKPELAHEVRSDLIMGTGRSDYPNQVNNVLCFPFIFRGALDVRASEINDEMKLAAVEAIRQLAKEPVPEAVLKAAGVESLSFGPQYIIPKPMDSRLLPRVAKAVAQAAVDTGVARIPMPENYMAG

SEQ ID NO: 87008 - protein, 488 aa, Streptomyces coelicolor A3(2)
MSRAARCSLGDMNESPRTPFPTPSHWIDGRAVTGSGPLIDVVNPADESVIAHLHEATADDVDMAVDAAVAAIPGWAATPPRHRADVMRRLAEGLQKRSEELAATITLEMGAPIAFSRQAQVGFPVASTLAAIAAAERFEWSERIENSLVVREPVGVVGAITPWNFPLQQLVTKVVPAMLAGNTVVLKPSELSPLSARMFAEIATEAGLPNGVFNVVQGTGPVVGEALSRHPKIDMISFTGSTRAGKSVSSAASVTVKRVALELGGKAAHIVLPEADLDSAVARGLAFAWANAGQACGAYVRMLVPEDLQTAVVDRLRTAAQEYVVGDPADEATRIGPLASETQRRRVDDYIRRGIADGATLVTGGPGRPEGFETGAYVRPTIFSDVAPESVIAQEEIFGPVLVVIPYTDDEHAVEIANGTVYGLNAAVTGDEDHAMAIAVRLRVGQVDVNGGRHNFQAPFGGYKQSGNGREMGRAGLEEFLETKAITS

SEQ ID NO: 87009 - protein, 126 aa, Methanosarcina acetivorans C2A
MYNKKVMDHFMNPRNVGEIEDADGIGEAGNPHGDQMKIFLKIRDNRIEDVKFKTFGCAAAIASSSMATELIKGKTLEEAWELTNEDVAEALEGLPPGKLECSVVSREATHMAINDYRKKQGLEPLK

SEQ ID NO: 87010 - protein, 545 aa, Pseudomonas syringae pv. phaseolicola 1448A
MSELIRVPDIGNGEGEVIELMVKVGDRIEADQSILTLESDKASMEIPAPKAGVIKAMKVKLGDRLKEGDELFELEVEGEAAAAPAPAAESAAAPAAAEKPAEAAPAPAAAAPAPAASASVQDIHVPDIGSSGKAKIIELMVKVGDSIQADQSLITLESDKASMEIPSPAAGVVESIEVKLDQEVGTGDLILKLKVEGAAPAAAPAPAASAPAAAPAKAEAAAPAAAPAPKAEAAPAPAKDGAKVHAGPAVRQLAREFGVELSAVSATGPHGRVLKEDVQVYVKTMMQKAKEAPAGGASGGSGIPPIPEVDFSRFGEIEEVPMTRLMQLGASGLHRSWLNIPHVTQFDQADITDLEAFRVAQKGAAEKAGVKLTVLPLLLKSCAHLLKELPDFNASLAPSGKAVIRKKYVHIGFAVDTPDGLLVPVIRDVDQKSLLQLAAEAAALAEKARNKKLTANDMQGACFTISSLGHIGGTGFTPIVNAPEVAILGVSKATIQPVWDGKAFQPKLMLPLSLSYDHRVINGAAAARFTKRLSELLADIRTILL

SEQ ID NO: 87011 - protein, 443 aa, Arabidopsis thaliana
MGSAARQPLFSFGVIADVQYADISDGRSFLGVPRYYRNSILVLQRAVETWNQHGNLKFVINMGDIVDGFCPKDQSLAATKKLVHEFEKFNGPVYHMIGNHCLYNLPREELLPLLKIPGRDGNAYYDFSPTPEYRVVVLDGYDISAVGWPQEHPNTIAALKILEEKNPNTDKNSPAGLEDVARRFVKYNGGVGEKQLQWLDSVLQDASNSNQRVIVCGHVPMSPGVASKAALLWNFDEVMNIIHKYDSVKVCLSGHDHKGGYFVDSHGVHHRSLEAALECPPVLEAGKDMVTITWKLKSSSAKVDTDTAFKTIQVKLCYAPISQVDRPWRKTDNKLFKDRSCPHEIVSKAYDKTPQSLDWTIGLDIPTGTYFVRAYGIDGDGHEVAYGQSTDEGRTTNLFSVHAISGHHVGLDIASTFFSVFSVVSLFVFFVMEKRKAKLEQRE

SEQ ID NO: 87012 - protein, 489 aa, Burkholderia pseudomallei K96243
MSVYGLQRLYIAGAHADATSGKTFDTFDPATGELLARVQQASADDVDRAVASAREGQREWAAMTAMQRSRILRRAVELLRERNDALAELEMRDTGKPIAETRAVDIVTGADVIEYYAGLATAIEGLQVPLRPESFVYTRREPLGVCAGIGAWNYPIQIACWKSAPALAAGNAMIFKPSEVTPLSALKLAEIYTEAGVPAGVFNVVQGDGSVGALLSAHPGIAKVSFTGGVETGKKVMSLAGASSLKEVTMELGGKSPLIVFDDADLDRAADIAVTANFFSAGQVCTNGTRVFVQQAVKDAFVERVLARVARIRVGKPSDPDTNFGPLASAAQLDKVLGYIDSGKAEGAKLLAGGARLVNDHFASGQYVAPTVFGDCRDDMRIVREEIFGPVMSILPFETEDEAIARANATDYGLAAGVVTENLSRAHRAIHRLEAGICWINTWGESPAEMPVGGYKQSGVGRENGITTLEHYTRIKSVQVELGRYQPVF

SEQ ID NO: 87013 - protein, 530 aa, Laminaria digitata
MSASALSDVGLYGLAVMGQNFALNMASHGFSVSVSNRSPEKVDATVARAKEEGNLPLRGFKDPKSFVDSLSKPRKIVLLVQAGAAVDATIATLSELLEEGDILVDGGNEWFPNSQRRAKELEPKKIMFVGMGVSGGEEGARNGPSLMPGGPREAYDALSPIISKCAAQVDGPCTTYLGSIGSGNYVKMVHNGIEYGDMQLIAEVYDVLKHVAGLTNDELSATFTDWNQGELQSFLIEITAVIFSRKDDLTSSGHVVDKILDKTGMKGTGRWTVQEAAERSTAAPTMAAALDARYMSGRKGERVEAAKTLKGPSTIPQVPKAQLIEDMKAALYCSKICSYAQGMNLIKAASEHFEWGVDLGECARIWKGGCIIRAAFLDDIKNAYIKNADLDNLLVDPFITSQILERQAAWRRVVTLCVASGIAAPAMTASLSYFDSYRRARLPANLVQAQRDFFGAHTYERVDKEGVFHCLWDDTHKEIATSPAHGGRTLIGSLPNLFRPLCMGCLNWSSTVVSVAYCGMKYYIGSLSFT

SEQ ID NO: 87014 - protein, 417 aa, Neptuniibacter caesariensis
MGYDKISVPQGEKITVNGDYSLNVPDNPIIPYIEGDGIGVDVSPAMLKVVDAAVSKAYGGEKKIAWMEVYAGEKATSVYEQDTWLPEETLEAFKEFAVGIKGPLTTPVGGGIRSLNVALRQELDLYVCQRPVRWFKGVPSPVINPQDVDMVIYRENSEDIYAGVEWKAGTEEADKVIRFLKEEMGVTKIRFDQNCGIGIKPVSEEATKRLVRQALQYCVDNDRRSLTLVHKGNIMKFTEGAFKDWGYELAKEEFGADLYAGGPSLSFKNPKTGNEIIVKDVIADAMLQQILLRPAEYDVVATLNLNGDYLSDALAAEVGGIGIAPGANLSDEVAIFEATHGTAPKYAGQDKVNPGSVILSAEMMLRHMGWTDAADLIIKGMDGAITAKNVTYDFERLMDDATLLSCSEFADAIIDRM

SEQ ID NO: 87015 - protein, 463 aa, Pseudomonas syringae pv. syringae B728a
MSSTANSSELEQGLKPRHITMLSIAGVIGAGLFVGSGHAIAEAGPAVLLAYAAAGTLVVLVMRMLAEMAVASPDTGSFSTYADRAIGHWAGFTIGWLYWWFWVLVIPLEANAAATILHAWFPNIAIWVFTLVITLVLTATNLFSVKNYGEFEFWFALIKVVAIIAFVVLGVAAIFGLLPTSNVSGVSHLFDTGGFLPNGMGAVLAAMLTTMFSFMGTEIVTIAAAESKNPGKQITKATNSVIWRIFLFYLVSIFIVVSLVPWNDPRLAEVGSYQTVLDAMGIPNAKLIVDLVVLVAVTSCLNSALYTASRMLFSLGKRGDAPAVSKRTSKGGTPHWAVIMSTAAAFLTVFANYIAPAAVFDFLLASSGAIALLVYLVIAVSQLRMRQKRIAAGEAIDFKMWLFPWLTWAVIAFIVAVLTIMLLQEEHRLEIIATGVLSLLVIGAGMIVSRRRKDGRVGAAALG

SEQ ID NO: 87016 - protein, 238 aa, Pasteurella multocida subsp. multocida str. Pm70
MQVFNLTTCLPVRSMMKPYLIAPSILSADLARLGEDVEQVLTCGADVIHFDVMDNHYVPNLTFGPAICQALRHYGITAPIDVHLMVKPVDRLIPDFAKAGANYITFHPEATEHIDRSLQLIRDCGCKSGLVFNPATPLSYLDYVMDKVDVILLMSVNPGFGGQSFIPSTLDKLREARQRIDESGFDIRLEVDGGVKVSNIADIARAGADMFVAGSAIFDQPDYQKVIDEMRQQLATVE

SEQ ID NO: 87017 - protein, 107 aa, Laminaria digitata
ANMPIQSELDLSYGERYPDLYNPDAYTRLVLEVLRGKQATFVRTDELLEAWKIFTPVLKQIEAGEIPPVPYVFGSRGPKESDELVSKMGYKYNKNYDWQTAHMENKE

SEQ ID NO: 87018 - protein, 632 aa, Listeria innocua Clip11262
MSCFYLDLLKIKDPSFMKQLDIQELEALAADIRAFLITSTSKSGGHIGPNLGVVELTIALHYTFNSPNDKFIWDVGHQSYVHKILTGRASQFDTLRQHGGLDGFPKRKESIHDVFETGHSSTSLSAAVGMVIARDIKKEDFYVIPIIGDGALTGGMAFEALNHIGDMGKDMIVILNDNDMSIAPNVGALHNVLGKLRTSNTFQQTKTNIDKLMRKIPTAGEKLADTAEKAKDGIKHLLVEGTFFEELGFMYLGPIDGHNLEDVITNLEIAKRTKGPVLLHIITKKGKGYQPAELDSRGTWHGTGPYKVETGSFIKPAKTVASWSSVISNELMRLAANDERIVAITPAMPVGSKLEKFAKTFPERFFDVGIAEQHATTMAAGLATQAMKPFLAIYSTFLQRAYDQLVHDVCRQKLNVVIGIDRAGLVGADGETHQGIFDISFLNSIPNMIITMPKDEEEARQLMDTAFAYDDGPFAIRYPRGNGPGKELSESSKLIPIGEWETIIQPVDAVILTFGPTLEQALKAAEQLEDLGQRVGVINARFIKPLDEALLHRIFKQKIPILTVEESLLKGGFGASVLEFMEENNYTDVTIHRIGLPDEFIGHGSVPLILESYGISPTGIVLKINEMLAQSE

SEQ ID NO: 87019 - protein, 293 aa, Cytophaga hutchinsonii ATCC 33406
MDYYKILGIEKNATEADIKKAYRKMARKYHPDLNPNDKVAEQKFKEVNEANEVLSNAENRKKYDAYGENWKQGNAYANADQQRYQRPPNQGGGGNPFDGDFSDFFGSMFGAGGARGGRGGTKFKGADLFAELQLDLKEVFVTHKRELNVNGKNIRITIPAGIKDGQTIKIAGYGGDGLNGGPKGDLQIEISVTNNTKFKIDNNDLHNTVELDLYKALLGGDLIVDTFDGKAKLKVAPETQNGTKVKLKGKGLPVYKKEGVFGDLYITYNISLPTNLTEKEKELFTELSKLRNA

SEQ ID NO: 87020 - protein, 442 aa, Glycine max
EWFPLSDAEGDPDCPSKGYSSIERALNALRQGKFVIVVDDENGDIEGNLIMAASLTSPKDIAFMIKHGSGIVSVGMKEEDLQRLNLPLMSPETEDEDSSAPTFTITVDVKSGTSTGVSAADRAKTVLALSSPESKSEDFRKPGHVFPLKYRNGGVLRRAGHTEASLDLVALAGLPPISVLSALVDENDGSMQSLLNLRKLASEYTLPIVSITDLIRYRRKREKLVERTSVSRLPTKWGLFQAYCYSSKLDGTEHVAVVKGDMGDGQDVLVRVHSECLTGDIFGSARCDCGNQLDLAMRLIEEAGRGVVVYLRGHEGRGIGLGHKLKAYNLQDQGHDTVQANIELGLAVDAREYGIGAQILRDIGVRTMRLMTNNPAKFVGLKGYGLAVVGRVPVLTPITEENKRYLETKRTKMGHIYGSDLQGSLPGFNGSTVNNGDSLENT

SEQ ID NO: 87021 - protein, 371 aa, Oryza sativa Japonica Group
MPRRGGAAKKPAGGGELSRFLQSHLQTINDTFQMMAEAAPGGLERTEWSEVVKLGEQVSRQATVAGMVWSGDLPDVETLKENIVAYFNILQGFLLGCHGSTVGAGPTLHKSICSSAKNVVDSSFSLFNQAVSAYESRSPDRKTTIPQVTGTVWEACLALNKVPTTNCVAIGRAMTQIGVYLKDILREMKELPIGDSNGTAEKSSNGAVDTTSCSDRDGSSSDLELDEDFTEEEVAVAKLVVTVASDALVVVKETIRFITCLLKISGNRSGANEEKVETMEQLLSCCRQAADQINDLGASVYPPQDLSEMKSSVKRLYGGANAMRREIRSLGGSPEGAFVALERFEKSLGALEVEIADDVANEMENLTISSS

SEQ ID NO: 87022 - protein, 513 aa, Pasteurella multocida subsp. multocida str. Pm70
MVNNLHSAHPTGAEYLKAVLSSKVYDVAQVTPLQDMAKLSERLGNKVFIKREDRQPVHSFKLRGAYAMIAGLSAEQKASGVIAASAGNHAQGVALSAKHLGLRALIVMPQNTPSIKVDAVRGFGGEVLLHGANFDEAKAKAIELAESKNMTFIPPFDHPAVIAGQGSIAMELLQQNSQIDRIFVPVGGGGLAAGIAVLIKQLMPEIKVIGVESKDSACLYRALKAGKPIDLDRVGLFADGVAVKRIGDETFRVCQQYIDDVVLVDGDEICAAVKDIFENVRAIAEPSGALSLAGLKKYVKEHNIQGETLVNVLSGANLNFHTLRYVSERCEIGEQHEALLAVTIPEQPGSFLKFCHILGHVPVTEFKYRYADDKQACIFVGVRITGQEEKQTIINQLQQNGYDLIDLSNDDIAKTHVRYMIGGRSNSPLKERLYSFEFPEQKGALLKFLETLGQTHWNISVFHYRAHGADYGNVLAGFQLNDEDLDAFNQHLEKLGYVYQDVTESPAYRYFLV

SEQ ID NO: 87023 - protein, 115 aa, Oryza sativa Japonica Group
MATVTRAHLEQRLALAKRCSREANIAGVKAAAVATIASAVPTLASVRMLPWAKANINPTGQALIICTAAGMAYFVAADKKILSLARRHSFENAPEHLKNTSFQGTGRPHPAFFRP

SEQ ID NO: 87024 - protein, 475 aa, Listeria innocua Clip11262
MATEYDVVILGGGTGGYVAAIQAAKNGQKVAVVEKGKVGGTCLHRGCIPTKALLRSAEVLQTVKKASEFGISVEGTAGINFLQAQERKQQIVDQLEKGIHQLFKQGKIDLFAGTGTILGPSIFSPTAGTVSVEFEDGSENEMLIPKNLIIATGSKPRTLNGLTIDEENVLSSDGALNLETLPKSIIIVGGGVIGMEWASMMHDFGVEVTVLEYADRILPTEDKEVAKELARLYKKKKLTMHTSAEVQAASYKKTDSGVEIKAVIKGEEQTFTADKMLVSVGRSANTENIGLQNTDIATENGFIQVNDFYQTKESHIYAIGDCIPTIQLAHVAMEEGTIAANHIAGKETEKLGYDLVPRCIYTSTEIASVGITEEQAKERGHDVKKGKFFFRGIGKALVYGESDGFIKIIADKKTDDILGVSMIGPHVTDMISEAALAQVLNATPWEVGNTIHPHPTLSESFREAALAVDGNAIHG

SEQ ID NO: 87025 - protein, 465 aa, Dehalococcoides sp. BAV1
MAKAGLNRIDMPKQAVAKRIQNFSEVATGYTPSDAHIEAARCLQCKKRYCVEGCPVNIDIPEFILALREGDMPEAARILKKTNSLPGVCGRVCPQETQCEQACILNKKEVPIAIGRLERFVADWEREHSAEVNLPKSLKPKSGKKAAVVGAGPAGLTASAELARLGHDVTLFESLHTAGGVLMYGIPEFRLPKDIVQGEVEYVKSLGVKIELNSVAGRLFSLDDLFKQGFQAVFLATGAGLPLFLNVQGENLNGVYSANEFLTRINLMKAHSFPEYDTPVKKGKKVAVIGGGNVAMDAARCALRLGAEEVSIIYRRSEVELPARKEEVENAREEGIKFHFLTSPVRFLANEQGKVRAMDCQKMELGEPDASGRRRPIPVDGSEFEMDIDLAIIALGTRPNPLVMQSAPDLQVNPNGTVAAGISGQTSHRAVWAGGDIVTGSDTVISAMGAAKRSALVMDEYLRSL

SEQ ID NO: 87026 - protein, 251 aa, Zymomonas mobilis
MILTDNQLDRYARHIVLPEIGGKGQKKLLSAHVAIVGAGGIGSPVIQYLAAAGVGRLTIVDNDEVSLSNLQRQTLFATRDIGAHKVAMAANVVQRLNPDVKVLPYDQKLDAENAKKLIGQADIIVDGSDNFGTRLVVSDVATELKIPLVSAAVIRFEAQLAVFKGYEASKPYRCFVGDDPGEPEMTCSSQGVLGALTGTIGSLAAIETIRLITRFGSESGDKLLLIDAKDFRFRTVSLSKDPNCRCKHSAE

SEQ ID NO: 87027 - protein, 297 aa, Wolinella succinogenes DSM 1740
MDVAIIGGGAWGSALYKALLEKSSVALVSRSGREGIHQCSLQEALEARFLVLAIASSALRGWLNEANLPPKTKILVACKGIEEGSGALVSEILEEFLPRENLAYLAGPSFAKEVREGLPCALVIHSHHLELAQEMSQFFPSWIRLYVENDVVGGEVCGAYKNVIAIAGGICDGLGLGYNAKASLVARGLVEMARFGQYFGAKIETFLGLSGAGDLFLTSGSTLSRNYRVGLGLAQGKSLEEILIELGEVAEGIKTARAITQIAQREGIHAPIAHEVNAILQGKNPKESLKDLLSHGR

SEQ ID NO: 87028 - protein, 416 aa, Listeria innocua Clip11262
MAVEKITMPKLGESVTEGTISSWLVKPGDTVEKYDAIAEVLTDKVTAEIPSSFSGTIKEILAEEDETLEVGEVICTIETADAGSSEPAEEVEQTETKAPEKQETKQVKLAEAPASGRFSPAVLRIAGENNIDLSTVEGTGKGGRITRKDLLQVIENGPVATKTEEPTNRAQEKAPTPAPVRSAAGDKEIPINGVRKAIAKHMSVSKQEIPHAWMMVEVDATGLVRYRNTVKDSFKKEEGYSLTYFAFFIKAVAQALKEFPQLNSTWAGDKIIEHANINISIAIAAGDLLYVPVIKNADEKSIKGIAREISELAGKARNGKLSQADMEGGTFTVNSTGSFGSVQSMGIINHPQAAILQVESIVKRPVIIDDMIAVRDMVNLCLSIDHRILDGLLAGKFLQAIKANVEKISKENTALY

SEQ ID NO: 87029 - protein, 478 aa, Desulfococcus oleovorans Hxd3
MQTKLIATIGPRSRDRAVIEKLVAVGVTIFRLNFSHAGPGDFADVIQSVREIEQQTGTILTLMGDLSGPKIRIGEVAGAPLSVATGQLVRLGPARAKGAFGDALYLPLELAEILEQLKPGAPVILSDGIPVFRVRKRLDTEAGPVFELETQNSGLVSSNKGISFPGLAIDLPALTAKDRSDVAAALDVGIDALALSFVQKSQDVVDLKKEMEHHGRQVPVIVKIERMNAIDHFQEIVAEADVIMVARGDLGLECSLPALPVIQKRIIDMCAEHQKPVVVATQMLLSMVHNPLPTRAEVADVANAIMDGADAVMLSEETAVGEYPVEAAGMLAQVAEHTERFMAEKMGGPRRPRGKEQVGKHLAYSACLVADHAGSRALACHTVSGHTAATLSACRPARTVYALSPHLEALRYANFLWGVKPVHVDDRIADHLDRVEHFISTSGAFVPGESIVITSGQPTPGQRHNDTNQIKIYYKGNT

SEQ ID NO: 87030 - protein, 101 aa, Triticum aestivum
  misc_feature (5)..(5): Xaa can be any naturally occurring amino acid
  misc_feature (11)..(11): Xaa can be any naturally occurring amino acid
  misc_feature (13)..(14): Xaa can be any naturally occurring amino acid
  misc_feature (17)..(17): Xaa can be any naturally occurring amino acid
  misc_feature (19)..(20): Xaa can be any naturally occurring amino acid
  misc_feature (26)..(26): Xaa can be any naturally occurring amino acid
  misc_feature (28)..(29): Xaa can be any naturally occurring amino acid
  misc_feature (33)..(35): Xaa can be any naturally occurring amino acid
  misc_feature (43)..(43): Xaa can be any naturally occurring amino acid
  misc_feature (46)..(46): Xaa can be any naturally occurring amino acid
  misc_feature (49)..(49): Xaa can be any naturally occurring amino acid
  misc_feature (55)..(55): Xaa can be any naturally occurring amino acid
  misc_feature (57)..(57): Xaa can be any naturally occurring amino acid
MVRVXTFFRMXFXXFLXRXXMDKVHXWXXLHQXXXQERMEREXDIXKMXADLIAXAXESESSRQWFQALSYFPDPWLMYAHLQTKLLELCIQQALMGKKKK

SEQ ID NO: 87031 - protein, 647 aa, Zea mays
MDYLSQEEDLQFFDANEEMMALNPSGFGFDVWNDSPGSVVERRRKFLEWMGVEEEGRVETKDSVSGSSVESCFDGGEENSVEAEERSGECSSSSSEVSLSGSSVEVSEELSLRVDRNVGGCDVTRRQSSSMASCSSSRYCQVKETEKQRNIAGLVTSFKKGWLSRLRSMGCTADTNIESGGRMRASSGYGDVISRVKVKHCKKQAKELSALYQSQDIKAHDGAILAMKFSNDGKFLASSGEDGIVRVWKVVEDKKSRLRRDCLNEIDPSCMYFEVNDLSQLKPVLVNEEKPKKTTESFRKTSDSACVVFPPKVFRIMEKPLYEFRGHTGEVLDISWSKDNYLLSASMDKTVRLWKVGSNDCLGVFAHNSYVTSVQFNPVNENYFMSGSIDGKFLPQEPTKVLVVSADSKVRILQGNNVVRKYKGVCKTRSLTSASLTSDGKHIVSASGENRENGEGVKKSLFPLKELGSIACAALCACTLTIASPVIAANQRLPPLSTEPDRCEKAFVGNTIGQANGVYDKPLDLRFCDYTNDQTNLKGKTLSAALMVGAKFDGADMTEVVMSKAYAVEASFKGVNFTNAVIDRVNFGKSNLKGAVFRNTVLSGSTFEEANLEDVVFEDTIIGYIDLQKICRNESINEEGRLVLGCR

SEQ ID NO: 87032 - protein, 377 aa, Bacillus cereus ATCC 10987
MKAVTYQGPNQVQVKQVDDAKLEKKDDIIVKITSTAICGSDLHLYQGNMPLPQGYIIGHEPMGIVEEVGPDVTKVKKGDRVVIPFNVACGHCFYCQHEMESQCDNSNPHYDSGGYFGYTEKFGNHPGGQAEYLKVPFGNFTPFVIPESCELEDESLLFLSDVLPTAYWSVINAGVKRGDTVIVLGCGPVGLMTQKFAWMQGAKRVIAVDYLDYRINYAKKINNVEVFEFTKFPDMGEHLKEITHGGADVVIDCVGMDGKKSPLEFLEQKLKLQGGTLGPIQIATKAVRKYGTVQMTGVYGGNYNAFPLGAFWVRNINLKMGQAPVIHFMPELFEKITNKEFDPKEIITHKIPLEEASYGYQIFNNREDDCIKVILKP

SEQ ID NO: 87033 - protein, 425 aa, Fusobacterium nucleatum subsp. vincentii ATCC 49256
MSKETLNPLASGQQQVKKACDALGLDPAVYELLKEPQRIIEITIPVRMDDGSIKTFKGYRSAHNDAVGPFKGGIRFHQNVNADEVKALSLWMSIKCQVTGIPYGGGKGGITVDPSELSQRELEQLSRGWVRGLWKYLGEKVDVPAPDVNTNGQIMAWMQDEYNKLSGEQTIGVFTGKPLSYGGSQGRNEATGFGVAVTMREIFKALGKELKGATVAVQGFGNVGKYSVKNIMKLGGKVVAVAEFEKSKGAFAVYKEAGFTFEELEAAKAAGSLTKVAGSKEISMDDFWALNVEAIAPCALENAIKEHEANLIKAGIICEGANGPITPEADEILYKKGTVVTPDVLTNAGGVTVSYFEWVQNIYGYYWTEKEVEEKEERAMVDAFNPIWALKKEFDGKGQPISFRQATYMKSIKRIAEAMKIRGWY

SEQ ID NO: 87034 - protein, 130 aa, Saccharomyces cerevisiae YJM789
MAKTLKANTPKVTSTSSAVLTDFQETFKTSKRAYFAQIEKYPKLKLIDTFCFFLVLLGVIQCTFIILIRDNFPFNAFLAGFIICVGQFVLLMSLRLQLCNSFPGISKNRAFAEFIVASLILHFVCLHFIN

SEQ ID NO: 87035 - protein, 478 aa, Burkholderia pseudomallei K96243
MPAAPAVPSRAARASAAARLERLPFSGYHKLIFVIIAIAFFFDSVDLGTMTFVLGSIKREFGLSTATAGLVASASFFGMVLGAAVAGLLADRFGRRPVFQWSMVLWGAASYLCSTAQSVDALIVYRVLLGIGMGMEFPVAQTLLSEFVPAAKRGRLIALMDGFWPLGFITAGIVSYFVLPLFGWRTVFALLALPAVFVLVVRRLVPESPRWLEHRGRLAEAGRVLAHVEAKVMKSARVASLPAPSRLAESACAQGRGAFGEIWSAAYRRRTTMVWLLWFFALLGFYGLTSWLGALLQQAGFAVTQSVFYTVLISLGGIPGFLCAAWLVERWGRKPTCIASLVGGGAMAYVYGQSALFGGSVTLLVGTGLAMQFFLFGMWAVLYTYTPELYGTGARATGSGFASAIGRVGSLIGPYAVGIVLPVFGQGGVFTLGALSFVVAALAVGVLGIETQGLALEALASTHAADDDARDPAGAAAN

SEQ ID NO: 87036 - protein, 425 aa, Hordeum vulgare subsp. vulgare
MAAAMAATTMVTKNNGGSLAMDKKNWFFRPAPEVAFSWSSQPESRSLEFPRRALFASVGLSLSHDGKARPADDVAHQLAAAGDAGVQQAQKAKKAKKQQLGLRKVRVKIGNPHLRRLVSGAIAGAVSRTFVAPLETIRTHLMVGSSGADSMGGVFRWIMRTEGWPGLFRGNAVNVLRVAPSKAIEHFTYDTAKKYLTPEAGEPAKVPIPTPLVAGALAGVASTLCTYPMELVKTRLTIEKDVYDNLLHAFVKIVRDEGPGELYRGLAPSLIGVVPYAAANFYAYETLRGAYRRASGKEEVGNVPTLLIGSAAGAIASTATFPLEVARKQMQVGAVGGRQVYKNVLHAMYCILNKEGAAGLYRGLGPSCIKLMPAAGISFMCYEACKKILVDDKQDGEPQDQEETETGHTQGQAAPKSPNANGDRP

SEQ ID NO: 87037 - protein, 225 aa, Salmonella enterica subsp. arizonae serovar 62:z4,z23:--
MKQYLIAPSILSADFARLGEDTAKALAAGADVVHFDVMDNHYVPNLTIGPMVLKSLRQYGITAPIDVHLMVKPVDRIVPDFAAAGSSIITFHPEASEHVDRTLQLIKEHGCKAGLVFNPATPLSYLDYVMDKLDVILLMSVNPGFGGQSFIPQTLDKLREVRRRIDESGYDIRLEVDGGVKVNNIGEIAAAGADMFVAGSAIFDKPDYKQVIDEMRSELAKVSHG

SEQ ID NO: 87038 - protein, 358 aa, Laminaria digitata
ASIPTVEYLLSKGARVALSSHLGRPKDDGDKFSLGPVAERLTELIGKECKMAPDCIGDEVAAIANGLGDGEVMLLENVRFYPAETKNDPAFAKKLAAPFDLFVNDAFGTAHRAHGSTEGVTKFLSPSVAGFLLQKELDYLEGAVKVPASPFAAIVGGSKVSSKIGVIESLLAKCDKLIIGGGMVFTFLKARGQGVGSSLVEEDKLELAKELEVKAAAAGVQIILPSDLIVADAFAADAKTQVVRADAIPDGWMGLDNGPEATKEIQAALKECKTVVWNGPMGVFEYEAFARGTFAIAETLAEITSEGCTTIVGGGDSVAAVEKAGLAPKMSHISTGGGASLELLEGKVLPGVAALNDA

SEQ ID NO: 87039 - protein, 547 aa, Acinetobacter junii
MTQNSYKIPIQGMTCTGCEEHVTEALEQAGAKDVSADFRRGEAIFELSDDQIEKAKQNISAAGYQPGEEESQPSENSVDFNRDGDYDLLIIGSGGAAFSAAIKANENGAKVAMVERGTVGGTCVNIGCVPSKTMLRAGEINGLAQNNPFTGLQTSTGAADLAQLTEQKDGLVSQMRQEKYIDLIEEYGFDLIRGEASFIDDKTIQVNGQNITSKSFLIATGASPAVPEIPGMNEVDYLTSTSALELKEVPQRLAVIGSGYIAAELGQMFHNLGTEVTLMQRSERLFKTYDPEISEAIDESLTEQGLNLITGVTYQKVEQNGKSTSIYIEVNGQEQVIEADQVLVATGRKPNTETLNLESAGVKTGKKGDVLTNEYLQTSNNRIYAAGDVTLGPQFVYVAAYEGGIVANNALGLAKRKIDLRFVPGVTFTNPSIATVGLTEQQAKEKGYDVKTSVLPLDAVPRALVNHETTGVYKLVVNAQTQKLIGAHIVSENAGDVIYAATLAVQFGLTIEDLTDSFVPYLTMAEGLKLAALTFDKDVSKLSCCAG

SEQ ID NO: 87040 - protein, 204 aa, Pisum sativum
MATTEPLVEGSTAEEVAAVPVPAPEVGLKHKLERRWTFWFDNQSKPKQGAAWGTTLRKVYSFDTVEEFWCLHDQIFKPSKLPGNADFHLFKDGVEPKWEDPLCASGGKWTLTSKGKGNLDTMWLETLMALIGEQFGDSEDICGVVASVRQWQDKLSLWTKTAANESVQMSIGRKWKEIIDVSDKMTYNFHEDAKTRGAKARYTV

SEQ ID NO: 87041 - protein, 226 aa, Vitis vinifera
MSFLFGKKKTPAELLRENKRMLDKSIREIERERQGLQAQEKKLIVEIKKSAKQGQMGAVKVMAKDLIRTRHQIEKFYKLKSQLQGVALRIQTLKSTQAMGQAMKGVTKAMGQMNRQMNLPSLQKIMQEFERQNEKMEMTMEVMGDAVDDALEGDEEEEETEELVSQVLDEIGIDIKSELLNAPSGAVAAPAAKNKVAQAEATGTTGNDDSGIDNDLQARLDNLRRM

SEQ ID NO: 87042 - protein, 144 aa, Laminaria digitata
MIGGSEHEAEIHWVHVKAGTDDQLLVIGVLFDTTQYGSNVEIEHLWDVLDIGKPTTDEVFVTRVYDIMPSNPVFSHYMGSLTTPPCTEGVKWIVMSDPVTMGKMQLDEFRTSVALFDNSKVDEMGNTNRPRQSLNNRDIFFVNY

SEQ ID NO: 87043 - protein, 408 aa, Phaeosphaeria nodorum
MLNKLHGQPDSYDRKSRYRFGKTLGAGTYGIVREADCPEGKVAVKIILKKNVKGNEQMVYDELEMLQRMKHPHIVKFHDWFESRDKYYIVTQLATGGELFDRICEKGKFTEKDAAETIRQVLEAVNYLHENNVVHRDLKPENLLYLTRDAHSSLVLADFGIAKMLDSKSEVLTTMAGSFGYAAPEVMLKKGHGKPVDMWSMGVITYTLLCGYSPFRSENLADLIEECKNGRVVFHERYWKEVSKEAKEFITLLLQPDPNKRPTSKDALKHVWLSGATASDHNLLPEIRAYVAKARLKRGIELVKLANRIEALKMQEDEEEDAPGQADMPANAREAAGEAVAAHHPDKVPAAKEETPDAGTGKGPGRLSRIAKGAIFREVVLAKVREMKEAEARAEFEKKATESGTKKA

SEQ ID NO: 87044 - protein, 472 aa, Listeria innocua Clip11262
MAKQEIGVIGMGVMGRNLALNIESRGHTVSIFNRSTEKTKAVMEENADKKLVPTYSLEEFVESLEVPRRILIMVKAGDATDMMIEAVKPFLNEGDILIDGGNAFFKDTIRRNKELSEEGFNFIGTGVSGGEEGALKGPSIMPGGQRKAYDLVAPILREIAAVADGEPCVTYIGPDGAGHYVKMVHNGIEYGDMQLIAEAYTILKEIGGLSHDELADVFEEWNNGELDSYLIEITKNILKVKDEETGKPIVDVILDKAGQKGTGKWTSQSALDLGVPLSLITESVFARYISALKDERVYASTVLSGPSNYRFEGDKKAFVESVRRALYFSKIASYAQGFAQMRAASEENDWDLQYGEIAKIFRAGCIIRARFLQKITDAYNKDKNLKNLLLDPYFKDIAHNYQGDLRTVVAEAVKAGIPVPTFTAAISYYDSYRSEVLSANLIQAQRDYFGAHTYERVDKPGVFHTEWPQVED

SEQ ID NO: 87045 - protein, 394 aa, Phaeosphaeria nodorum
MASNGASGAQTPQTQAQVQPCRYKTGKTLGAGSYSVVKECVHIDTGRYYAAKVINKRLMAGREHMVRNEIAVLKRVSMGHRNILTLVDYFETMNNLYLVTDLALGGELFDRICRKGNYYESDAADLIRATLSAVAYLHDHGIVHRDLKPENLLFRTPEDNADLLIADFGLSRIMDEEQFHVLTTTCGTPGYMAPEIFRKTGHGKPVDIWAIGVITYFLLCGYTPFDRDSNLEEMQAILVADYSFTPLEYWRGVSLTAREFIRRCLTVDPASRMTSHEALSHPWVADLGRPGEGEEDLLPTVKKNFNARRTLHAAIDTIRAINQLRAGGGAAMMDGLRSNEPRRGAPPANIPQPAEDEDPMEIDSRGNGHGQTEEMIKEQERRIRETQQGLWSKR

SEQ ID NO: 87046 - protein, 511 aa, Zea mays
MEMVPWLLGFLGRYPELMVSLACFLLLFRRLNQRDGLPTNWPVVGALPAITVNAGRMHEWVTEFLRAAGLSYVMKGPWGSPVDVIMTADPANVAHVFTSNFGNYPKGQEFAALFDVLGDGIFNADGESWAFQRRKAHALLSDARFRAGVAASTARKLRDALVPLLDGIAASGAVVDLQDVFVRLTFDLTAMFVFGIDPGCLAPDFPYVPFAAAMDTVEEVLFYRHVAPVPWLMLQKYLRTGHSKKMWNARRVLDASIAEFISLRRERAAEAEAEADLLTSYLACHDEIGKSGAELERFLRDTTLNLMVAGRDTTSSALTWFFWLLTKHPDVEAKVLEELRAHPPLSGAGGHRTAAELKQLVYLHAALSESLRLYPPVPFEHKAAARTDTLPSGARVGPSRRVIVSFYSMGRMEAVWGKDCSEFRPERWLTAAGRFRHEPSYKFVAFNVGPRTCLGRDLAYSQMKAVVAAVLPRFRVEVDAGAVVRPKLSIILHMKDGLKVRVPKREEDGLC

SEQ ID NO: 87047 - protein, 307 aa, Mycobacterium smegmatis str. MC2 155
MSTFDVVALGEPLIEVSTRGKITHGVDCGFAVSGDVVNTATAAVAAGARVAVVARVSDDELGTAVIDHLAGLGVHTGHIRRDRGFQGIYVQHSDPKGDRQFCYARSGSAGSRLAPEDLPDDVLESAGAVVVSGITASLSSTTRATVLAAAGRATRFVYDPNFRPRLTTAEDARALLLEIAPRCALITPSAPHECAALLGTSEAAEAAARLRTAGAAAVAVTCGAAGVHVDAETTYWQGAFAAPSVVDQTGAGDVFTGTVAARLALGDETSDAVRIGAAAASLAVGGVGGSGGIAPLEAVRAHAEVLA

SEQ ID NO: 87048 - protein, 461 aa, Burkholderia sp. 383
MVSGNESDGLKRGLKNRHIQLIALGGALGTGLFLGIAQTIKMAGPSVLLGYGVAGIIAFFIMRQLGEMVVDEPVAGSFSYFADKYVGHFTGFLSGWNYWVLYILVSMAELSAVGIYVQYWWPGVPTWVSALVFFVAINLLNLASVKSYGETEFWFSIIKVAAIVGMIGFGGWLLASGHAGPEASVRNLWQHGGFFPNGVSGLVMSMAAIMFSFGGLELIGITAAEADDPKRSIPRATNQVIYRILIFYIGALAVLLSLYPWEKVVTGGSPFVLIFHALSSNLVANVLNVVVLTAALSVYNSGVYSNSRMLFGLAKQGNAPKVLCSVNKRGIPLAALGASALATGVCVLVNYFMPGKAFEVLMGLVVSALIINWAMITLIHLKFRQAKRAAGEETSFRSLGYPFTNYLCLAFMAGILVVMYLTPDLRLSVYLIPVWLAVLAVGYRFRQKNAGYAVHDSASAR

SEQ ID NO: 87049 - protein, 524 aa, Aspergillus nidulans FGSC A4
MATPQELVPRTESIAEVYATDNASATTASPEHVKRFNNLVSHFHKQYNHSPDFVARSPGRVNIIGEHIDYNLYDVLPTAVSVDVIIAVKVVPTESSESAVKIANVLPDKFPTREFSVPKDSDVEIDPKKHEWVNYFKAGLVGALKVLRKGAADGSFAPASMEVLVDGNVPPGGGISSSAAFVCSSALAVMKANNHDVSKQDLLDLAVVSERAVGVYSGGMDQAASIFSRRGYLLYTQFFPNFSVQHVAIPKAAEEITFLMAQSFVTSNKAETAPRHYNLRVAECTLASVVLAKANGLTLPKDNSSLGYSLRTFHNELMRKEGRLGDPLEYQIDSVIQATLDILTQEQGYTREEIAQLLSISVPELETTYLSSFPVQAERFLLRQRALHCFKEARRVLDFKACLANASTLDDKRIHYLGQLLNESQDSCRDVYECSAPQVDEICNIARKAGTWGSRLTGAGWGGCTVHMLPQSKVEAVTKALTEEYYLKYFPDISEEKLKEAMVISKPSNGSFLITGAAISQVDV

SEQ ID NO: 87050 - protein, 470 aa, Photobacterium profundum SS9
METLQYTNGWLNLNEERINEINYFCEDYKHFLNKGKTERQCVALCVKQAEEKGFRPISEFKQLNPGDKVYFVNRKKNVALVVVGKQPISDGIRYVVSHIDSPRLDLKPSPLYEKSELALMRTHYYGGIKKYQWASRPLALHGIVATKSGRNVDIVIGEDPQDPVFTIPDLLPHLDKKVQRERTATEVLKGEELQIIVGSIPMEVNDDKIKDKVKHHILTKLFEKYEISEPDFISAELMLVPAGEARDVGIDGGLLGAYGQDDRICAFTSLEAIFDIAVPEQTAVCFLVDKEEIGSSGSTGLESRYLEYFTGELLIRQLGNQYNDQMMRRCLWQSYALSSDVNAGLNPLFESVHDVQNASKLGYGLVLTKYTGHGGKAGSNDADAEYVAVLRRMFDDKEIKWQSGLLGKVDEGGGGTVAKYLAHYGINTIDAGAALISMHSPFELSSKFDIHELYKAYKVFFIDSIKPTEY

SEQ ID NO: 87051 - protein, 151 aa, Xanthobacter autotrophicus Py2
MPNPAPSPAAEGHGDAKVVKSESEWRSCLTPEQFRITREHGTERAFTGPYWDEKRAGLYSCVACGTPLFRSEAKYDSGTGWPSFFAPISPDSVVTHEDTSHGMRRIEVRCASCESHLGHVFPDGPAPTGLRFCLNGTALKLAPDDGDTRGA

SEQ ID NO: 87052 - protein, 586 aa, Ralstonia solanacearum GMI1000
MPFTLHGIPVSRGIAIGRAHMLARAALDVSHYLVDEDKLDAEVERLRAARTAVRAELVLLKRELPTDAPEEMGAFLDVHRMILDDALLAQAPETLIHQRRYNAEWALTTQLEELMRQFGEIEDEYLRERKADIEQVVERILKALAGTPVLAPAPVAAGGDPDAGMIVVAHDIAPADMLQFRGQTFAGFVTDLGGRTSHTAIVARSLDIPAAVGVHNASTLIRQDDRIIIDGDNGIVIVDPSLAILEEYRHRRSESELQKKRLERLRHTPTVTLDGTQIDLLANIEMPEDAAAALAAGAVGVGLFRSEFLFMNRRGALPDEEEQFAAYRTAVESMNGLPVTIRTIDIGADKPLDVRDGRDDLFETAPNPALGLRAIRWSLSEPAMFLTQLRALLRASAFGPVRMLVPMLAHAREIDQTLELIERAKASLDADGMAYDPTIKVGAMIEIPAAVLILPVFLRRMDFLSIGTNDLIQYTLAIDRADNAVAHLYDPLHPAVLQLIARTIQEGQRAGRPVSVCGEMAGDATMTRLLLGMGLTEFSMHPSQLLSVKQQILRADRPRLMREVDRLLHACEPTEVQDVLGALARA

SEQ ID NO: 87053 - protein, 400 aa, Vitis vinifera
MAPNSLSREPKKKARETLSLALTLKYRPPTLHTQSHTSLSFSLPTAMASSQTRTLRRRRTQASKPISQSPLKSLSKSQIDDYYSDAVCEECGSGDAADELLLCDKCDRGFHLFCLRPIIVSVPKGPWFCPSCSSQKKLKYFPLVQTKIVDFFRIQRSTESTQKLNYDSQKRRKRSSSLVVSKKKRKLLPFNPTEDPLRRMEQMASLATALTATRTEFSNELTYIPGMAPKSANRAVLEHGGMQVLSKEDTETLNLCKSMMGRGEWPPLMVVFDPKEGFTVEADRFIKDLTIITEYVGDVDYLKNRENDEGDSMMTLISANEPLRSLVICPDKRGNIARFINGINNHMPDGKKKQNVKCVRFEVNGECRVLLIASRDIPKGERLYYDYNGYENEYPTQHFV

SEQ ID NO: 87054 - protein, 580 aa, Pseudomonas syringae pv. syringae B728a
MDATTINSLFLIGALLVAASILVSSLSSRLGIPILVIILAVGMVAGVDGGGIIFDNYATAYLVGNLALAVILLDGGLRTRVASFRVALWPALSLATVGVLITTVLTGMMAAWLFNLSVIQGLLIGAIVGSTDAAAVFSLLGGKGLNERVTASLEIESGSNDPMAVFLTVTLIGMLASGQTGLHWGLLGHLIQEFGIGSFIGLGGGWILLQLVNRINLAAGLYPILVIAGGLAIFALTNAIHGSGFLAVYLCGLVLGNRPIRSRHGILHMLDGMAWLAQIGMFLVLGLLVTPHDLLPIAIPALGLALWMILVARPLSVMVGLLPFKAFHDREKAFIAWVGLRGAVPIILAVFPLMAGLPNAQLYFNLAFFIVLVSLLLQGTSLPWMAKLLKVTVPPDPAPISRAALEVHVTSEWELFVYRLGAEKWCIGAALRELKMPEGTRIAALFRGQQLLHPSGSTTLEVGDLLCVIGHEHDLPALGKLFSQAPQRGLDLRFFGDFVLEGDARLGEVAALYGLKLDGIDPGMPLSQFIVQKNRGEPVVGDQVEWNGTIWTVAVMDGNKIQKVGVKFPEGTRPGPGLFL

SEQ ID NO: 87055 - protein, 732 aa, Vitis vinifera
MMSSLSENEDEQYQYFDAHDDMDAASLSDSSSDCNDNPNSSSGFNNYASRAFQYDVWAGSPGSVKERRNKFLNWMGLSLDRFSCDNSVDVCSDSLGGGVDRVRESSGAVLRTLGFEDEFCSSRSSMSRWSNEQDESGLQEKFVCRIGNLDVGAEFDVDEMGEGSEVSEFREVGLDRLVTINECQNISDSLLSSSVQQVIQREIEEASNPVGAAKRVKKGWLSRLRSMSCIMDRHGEIHNLTTNDTNPIPGARIQRVRVRQCRKQMKELSALYKGQDIQAHEGSILSMKFSPDGKYLASAGEDGIVRIWQVVEDERSNDHDIPEIDPMCIYFTVNHLSELTPLFAEKEKLSKLRSLRKTSDSACVIFPPKVFRILEKPLHEFHGHSSEILDLSWSNNNYLLSSSIDKTVRLWRVGCDHCLKIFSHNNYVTCVQFNPVDDNYFISGSIDGKVRIWAIPGCQVVDWTDIREMVTAVCYRPDGQGGIVGSMTGTCRFYNVSDNHLQLESQMCLHGKKKSLCKRITGFQFSPQDPSTVMVTCADSQVRILHGTNVIGKYKGLRNAGNQMSASFTSDGKHIVSACDDSNVYVWNCSNEGEPALSQSKSIRAFEHFLTNASVAIPWCGMKYGNPENGWQFHALDESSPNTLPFPSPASFSLSQEFFSESFPKGSATWPEEKLPTSSLVSVPSKIHKSEHKFLKACQSTSSSHAWGLVIVTAGWDGRIRSFHNYGLPAPL

SEQ ID NO: 87056 - protein, 396 aa, Rhizobium leguminosarum bv. viciae 3841
MFDDLIMPPADKILSLMPIFRQDSRSNKIDLGVGVYRDASGTTPIPRAVREAEKRIHTAQTTKAYVGPAGDPVFCDLIGRLVFGEAAPWERIRGIQTPGGAGALTVLAGLISLARPGAAVHVPDPTWVNHVSILEDNGLRVVTYPYLDRRTGEVDFDTLLDHFSRSERGDIVLLHGCCHNPTGADPSRSQWQALAEIIAERGLVPLVDIAYQGFGEGLEDDAFVVRLLAGMVPEMLVSSSCSKNFGIYRERTGAAFILARNADRADAAKAQLTVRARVVYSMPPDHGSAIVRTVLEDPALAADWRAELDDMRSSILSLRQGLAASFRRFTNGSDYDFLAKNKGMFSLIGLTPGEAVMLREQHAIYIVEDGRINVAGLQASQIDTFAEAVLAVRGKR

SEQ ID NO: 87057 - protein, 221 aa, Vitis vinifera
MVYLYDFQFIVLINDLCLLFLSAASWDSPELKASSSQFKELKNVAFGILAVCAVTAASPVIAASQRLPPLSTEPNRCERAFVGNTIGQANGVYDKPIDLRFCDYTNEKSNLKGKSLAAALMSEAKFDGADMSEVVMSKAYAVGASFKGVDFTNAVLDRVNFGKANLQGAVFKNTVLSGSTFDQAQLEDAVFEDTIIGYIDLQKICTNTSINADGRAELGCR

SEQ ID NO: 87058 - protein, 306 aa, Photobacterium profundum SS9
MNKLVVLGSVNADHVLQVASFPRPGETLHGHSYCVIPGGKGANQAVAAARLGADIAFIASVGDDSFGHQMLEAFANEGMNTEAVMVEENMPTGIAMIQVAATGENSICISAEANACLTAERIKPHHALIANANTLLMQLETPIETIEAAATIAKQSGTKVVLNPAPAQPLTDDLLQLVDMITPNETEAELLTGIKVEDMASAQQAADTLHAKGIKCVMITLGSKGVWISQDGKGQQVEGFRVDATDTTGAGDTFNGALLTGLQAGRKMDDAIRFAHAAAAISVTRMGAQTSIPHLSEVERFLTEHS

SEQ ID NO: 87059 - protein, 458 aa, Zea mays
MECARELRVRSTFTAAAMASKKQVGPGGAVPAQEQMNGGDAARLVRKPMDTFPQPAAARGRRALVDVGNLMNGRPSLVNHQKQAVAAAATSHKPLNVGNKKPLVPQAAARGLRPLADVTNLMINDRAAPANRQKPLDAVFNRNGKAVKLKECKVKPEVIVSIPDSEKEKKSKFPGGQKVCRRVPTLFDNLTKCSRASDGITTPKKKNPYDIDAPDSCNELAVVEYVEDIYRFYKSTEGTCLPLSSYMSSQAEISERMRAILIDWIIEYLSMESVPRKELQLVGISAMLIASKYEEIWAPLVKDLMCLCDNAFTRDQILTKEKAILDMLHWNLTVPTMYMFIVRYLKAAMCDAELENMAFFYSELALVQYAMLVYPPSVTAAAAVYAARSTLGMNPPWTDILEHHTGLAEPQLLDCARRLISFHALAPESKQKAVYRKYSKPKLGSVALQSPDKKLLSG

SEQ ID NO: 87060 - protein, 177 aa, Brassica napus
MIQNEFEIDNSTVVRCPMAEENLKTLISFMASLPVQFSRNHHLSTPNLSSRFRRSTEQRSFVALVHCSARENGDDDVRGIKKSLFPPVKELGCLACAALSAFTLTLASPVIAANQRLPPLSTDPARCEQAFVGNTIGQANGVYDKPLDLRFCDYTNDQSNLKGKTLSAALMSGAKFD

SEQ ID NO: 87061 - protein, 177 aa, Prosthecochloris aestuarii DSM 271
MASVLPYQGIYPKIHESVFLAEGACVIGDVEIGEGSSVWFNTVIRGDVCPIRIGCRTSVQDNATLHVTHDTGPLSIGSDVTIGHGAVLHACNVRDHVLVGMGAVLLDDAVIEPFSIVAAGALVRQGFRVPSGMLAAGVPAKLIRPVSDAERQTIKESPQNYVRYVNTYREGGYEGRG

SEQ ID NO: 87062 - protein, 436 aa, Moorella thermoacetica ATCC 39073
MSLAPDLTSYRQRLAGATLWRRGGKVTRVTGLTIEARGLKAAIGELCRIYNNGSGPIVAEVVGFREEVTLLMPLGELEGIGPGCRVIATGRGHYIRVGEELLGRVLDGLGRSLDGTVLVSGDPQPVNNRPPNPLSRRRIKEVLATGVKAIDALLTCGCGQRVGIFAGSGVGKSTLLGMIARHSTADINVIALIGERGREVRDFIEGDLGPEGLARSIVVAATSDQPALVRIKGAFTATAIAEYFRDQGKNVLLMMDSLTRFAIAQREVGLAIGEPPTTRGYTPSVFASLPKLVERAGNGERGSITGLYTVLVEGDDMNEPVADTVRGLLDGHIVLSRRLAAANHYPAIDVLQSISRLMPEITSREQQEQAGKLRDLLAAYQEAADLIEIGAYQAGSNPRVDAALKYHEAIQSFLRQGKDEYFAFQDTLAALAGILA

SEQ ID NO: 87063 - protein, 162 aa, Brassica napus
  misc_feature (159)..(159): Xaa can be any naturally occurring amino acid
PIVPCGLVAWSLFNDTYDFTRNNQKLSVNKKDISWKSDRDSKFGKNVFPKNFQKGFPIGGKSLDPKIPLSEQEDLIVWMRTAALPIFRKLYGKIETDLEAGDTIKVLLQNNYNTYSFNGKKKLVLSTTSWLGGRNDFLGIAYLTVGSICLSLAVFFSVXYLA

SEQ ID NO: 87064 - protein, 528 aa, Streptococcus agalactiae NEM316
MKFTELNLSQDILSAVEKAGFVEPSPIQEMTIPLALEGKDVIGQAQTGTGKTAAFGLPTLNKIHTEDNTIQALIIAPTRELAVQSQEELFRFGRDKGVKVRSVYGGSSIEKQIKALRSGAHVVVGTPGRLLDLIKRKALKLNHIETLILDEADEMLNMGFLEDIEAIISRVPETRQTLLFSATMPDPIKRIGVKFMKDPEHVKIKATELTNVNVDQYYVRVKENEKFDTMTRLMDVDQPELSIVFGRTKRRVDELTRGLKLRGFRAEGIHGDLDQNKRLRVIRDFKNDHIDILVATDVAARGLDISGVTHVYNYDIPQDPESYVHRIGRTGRAGKSGQSITFVSPNEMGYLTIIENLTKKRMTGMKPATASEAFQAKKKVALKRIARDFEDQELVSKFDKFKADALELATQYTPEELALYVLSLTVQDPESLPEVEITREKPLPFKPSGGGFKGKGGRGNGRGGDRRRNDRGDRRGNRDRDDRGGRCDFKRRDDKFKKDNRRQENKKPHKNTSSEKQTGFVIRNKGDK

SEQ ID NO: 87065 - protein, 405 aa, Salmonella enterica subsp. arizonae serovar 62:z4,z23:--
MATEQTAITRATFDEVILPVYAPADFIPVKGKGSRVWDQQGKEYIDFAGGIAVTALGHCHPALVEALKSQGETLWHTSNVFTNEPALRLGRKLIDATFAGRVLFMNSGTEANETAFKLARHYACVRHSPFKTKIIAFHNAFHGRSLFTVSVGGQPKYSDGFGPKPADIVHVPFNDLHAVKAVMDDHTCAVVVEPIQGEGGVQAATPEFLKGLRDLCDEHQALLVFDEVQCGMGRTGSLFAYMHYGVTPDILTSAKALGGGFPVSAMLTTQEIASAFHVGSHGSTYGGNPLACAVAGAAFDIINTPEVLQGIHTKRQQFVQHLQAIDEQFDIFSDIRGMGLLIGAELKPKYKGRARDFLYAGAEAGVMVLNAGTDVMRFAPSLVVEEADINEGMQRFAQAVGNVVA

SEQ ID NO: 87066 - protein, 368 aa, Pseudomonas syringae pv. syringae B728a
MTTLNSTPRADGFHMPAEWAPQTQVWMVWPERPDNWRLGGKPAQAAHVAIAKAIARFEPVTVAVSAAQYDNARARLDMPNIRVVEMSSNDAWVRDSGPTFVINDRGEVRGVNWEFNAWGGFDGGLYAPWNLDSQLGGKVLEIERCPRYVTEGFVLEGGSIHVDGEGTLITTEECLLNRNRNPHLTREQIETILGDYLAVDKVIWLPEGLFNDETDGHVDNFCCYIRPGEVLLAWTDDPEDPNYSRCHAALSILENTLDAKGRAFIVHKMPIPGPLFATEEECAGVDQVHGSQERNPSVRLAGSYVNFLIVNGGIIAPSFDDPMDEKAREILQKLFPEHEVVMAPGRELLLGGGNIHCLTQQQPAPHKN

SEQ ID NO: 87067 - protein, 970 aa, Pseudomonas syringae pv. syringae B728a
MPLATLIRRSSLPCPEVSADQALQLLAQHYGLSGTLKALGSQQDRNFLLDTGTRRYVLKICHGAYSTSELNAQHAALHHLAGHSTVKVPGVIRAIDTEQLLSVDIDGQAVHVRLLEFIDGQSLGHVEHLGRDLVVELGELCAHVDIALADFDHPGLQRILQWDPRHAHALIKHLLPVIKDADARACLIEAGEQAHRRLLPLIAALPIQAVHLDISEHNAVWRREAGHPWHLQGLIDFGDLLSTWRVADLSVTCAALLHHAEGDPLYILPAIAAYHALNPLKIEELQALWPLIVARSAVLVLSSEQQASVEPGNAYIQANLAGEWNIFDVATSVPMALMEAAILRAVGLDLPPVEQPAYSPLLPSLAGLQPVLVDLGVLSEHFVAGNWEQSGIDEYLLSQAAGDSGLAASRFGEYRLSRTLPDCASEPETFALHVELHVPAATPLHAPFEGTLRLTADAAVLLVGERISLKLWGVLPEASLQGQVAAGSLIGQGGGSLLLQLCTAPDLSPPLFSTPAWADAWRAVCPSPSALLGFDCDAPALQDAGQLLARRDASFARSQKHYYQAPPHIERGWRNHLIDMQGRSYLDMLNNVAVLGHGHPRMAHEAARQWSLLNTNSRFHYAAIAEFSERLLKLAPEGMDRVFLVNSGTEANDLAIRLAWAYSGGRDMLSVLEAYHGWSVATDAISTSIADNPQALSTRPDWVHPVTAPNTYRGPFRGADSAPEYVRSVDQALATLAEQQRQVAGFICEPVYGNAGGISLPPGYLQQVYQKVRAVGGVCIADEVQVGYGRLGHHFWGFEEQGVVPDIISMAKGMGNGHPLGAVITRREIAEALEAEGYFFSSSGGSPVSCRIGMAVLDVMEEEKLWDNARIVGDHFKARLQALADIHPLVGAVHGMGFYLGMELVRDRHTLEPATEETARLCERLRELGIFMQPTGDYLNILKIKPPMCTTRQSVDFFVDNVSKVLRELE

SEQ ID NO: 87068 - protein, 433 aa, Desulfitobacterium hafniense DCB-2
MTDWNNMLHKMSDLDLIVSHGRVAKIVGLMIESDGPRVSVGEYCRIHTQQGKEIPAEVVGFRNSTTLLMPLAELEGIAPGDRVVPQQHKLEVGVGQALLGRILDGLGRPLDGRPMVTQRDYPLQNAPPSAFLRPRIRDPLSVGVRTVDGILTIGRGQRIGIFAGSGVGKSTLLGMMARNTTAGVNVIALVGERGRELRDFIEKDLGEEGLERSVLVVATSDQPALVRLKAAFTATAIAEYFRDQGQDVLLMMDSVTRFAMAQREVGLTAGEPPATRGYPPSVFAMLPKLLERSGMSEIGSITGIYTVLVDGDDHNEPIADTVRGILDGHIVLTRELAMQNHYPAIDTLQSVSRVMNDIIAPEHKELAGKLREHLAVYHDAKDLIDIGAYVTGSNPRIDAAIRHIEGINGFLRQDVEEKVSFDQMLRQLQQALR

SEQ ID NO: 87069 - protein, 501 aa, Kluyveromyces lactis NRRL Y-1140
MSLYETVNIPQLNITYEQPLGLFINNEFVKSSDGKKIESINPSTEESIVSFFAASEKDVNSAVTAARDAFENNWSKTSGEQRGILLSKLFDLIERDKLLLAAIETLDSGKPYHSNSLADLEQILQLTRYYAGGADKFTGGEYIPLNQDKYAYTMKVPYGVVAQIVPWNYPLAMASWKIQSCLAAGNTIVIKPAENTSLSLLYFAQLVKEAGFPPGVLNILPGYGSVTGTAMASHTDIDKIAFTGSTAVGQKVMSLAAQSNLKAVTLECGGKSPCLIFADANLDEAIPWVAGGIFYNSGQNCTANSRIYVHEDIYEEFLTKFEEYAKSNWKFGAKFDPFDKDCTLGPVISKVQYDRIQSYVEHGKASEKLGFKEFAEYPSKGYFIPPTIFSDVPNSSKLSQEEIFGPVGVVASFSTYEEAIKLANDSSYGLASCVFSENARTTAQFARDIRAGTVWINSSNDEEISVPFGGFKMSGIGRELGRNGVDSYLQTKAVHVNIAKL

SEQ ID NO: 87070 - protein, 252 aa, Mycobacterium smegmatis str. MC2 155
MTGSDTTAYSTARTVEDFTRNLQAVNTRIGAALQRAGREPGEVRLLPVSKTVDEDRLRVAAAAGCTMFGENKVQEAMRKWRNLSDLDVEWSVIGHLQTNKAKDVAEFAAEFQALDNPRAAAALDRRLQALGRQLDVYVQVNTSGEESKYGLAPDDVIPFLKTLPAYTALRVRGLMTIAVFSTDPERVRPCFRLLRSLRDQARDLDLIGPGELSMGMSGDYELAIAEGSTCVRVGQAIFGARPTPDSQYWPGN

SEQ ID NO: 87071 - protein, 503 aa, Kluyveromyces lactis NRRL Y-1140
MSFTSIKLADGTEYQQPLGLFINNEYVEAHGSETLTSYNPSSGEEICKVQCADPKIDVDLAVKAARDAFPGWKATPAIEKRDLFYKLAGLLERDIDILSKIESLDTGKPIANNAKYDILEVVEVLKYYAGWIDKAGGQSFAPSSEKLAYTLHQPLGVVGCIIPFNYPLAMMSWKWTAIATGNTTVFKSADQTPLSILYFAKLVKEAGFPAGVFNVLSGTGASVGSAIVKHTGVDKIAFTGSTAVGQIIQQQSAVNLKPITLECGGKSANMIFEDCDLEQAVKWSAWGIFNNMGQICSGTSRVFVQESIYEEFVAQLADHVKKTYIVGAPSDDAVIVGPQVSKKQQERVLEYIKIGIEEGCKVPLGGLGAPEPIANDPALANGYYVKPTILADVKASYRIAKEEIFGPVIVVGSFKDYKEALDIANDSDYGLGSAIFSKDIVTCHKFAQDVEAGMVWINSSNDVDINVPFGGVKMSGHGRELGEYGLANFTNVKSVHVNLGRKL

SEQ ID NO: 87072 - protein, 176 aa, Glycine max
MSAFTSKFADELIANAAYIGTPGKGILAADESTGTIGKRLASINVENVETNRRALRELLFTAPGALPCLSGVILFEETLYQKSSDGKLFVDILKEGGVLPGIKVDKGTVELAGTNGETTTQGLDGLGERCKKYYEAGARFAKWRAVLKIGENEPSEHSIHENAYGKNPVPPQRKGF

SEQ ID NO: 87073 - protein, 334 aa, Glycine max
MTASLTELDDDLVRSMAIGAVFSDFGGMIHSIDFHRKDDLLVTASGDDSVRLYDIANAKLLKSTYHKKHGTDRICFTHHPSSVICSSKYTLESTGESLRYLSMYDNRCLRYFKGHKQRVVSLCMSPINDSFMSGSLDHSVRIWDLRVNACQGILHLRGRPAVAYDQQGLVFAVAMEGGAIKLFDSRSYDKGPFDTFLVGGDTAEVCDIKFSNDGKSMLLTTTNNNIYVLDAYGGEKRCGFSLEPSPGTPIEATFTPDGKYMVAGSGSGTMQVWSIETKNEVACWTSHIGVPSCLKWAPRRAMFAAASSVLTFWIPNNDSKLETQYGGTDAEAGP

SEQ ID NO: 87074 - protein, 351 aa, Vitis vinifera
MEGEWQQLIQSVFFGLVFSYLFAKLISIVISFRDENLSLTRDSKPESQGGAASADDDSAGSQKSGGSEGEESLLAEKGSGSSGSLLDDDDDWEGVESTELDEEFSAATAFVAATAADRLSQKVSNDVQLQLYGLYKIATEGPCSAPQPSALKMTARAKWQAWQKLGAMPPEEAMQKYIAIVTELYPTWATGSTNKSKDEGGSSAPSGDAKGPMGPVFSTFVYEEECGTELKMDAIHAFAREGEVDNLLKCIDNGVSVDLKDSEGRTPLHWAVDRGHLNLTELLLNHGADVNAKDHEGQSPLHYAVVCEREAIAEFLVKQNADINAMDNDGASPFELCESNWPWMQGAAKQA

SEQ ID NO: 87075 - protein, 267 aa, Ralstonia solanacearum GMI1000
MTQRVPATAQVFSLLIMAVMHKLVLIRHGESTWNLENRFTGWVDVDLTDTGIAQARQGGRLLREAGFTFDLAYTSVLKRAIRTLWHVQDEMDLMWIPTRTEWRLNERHYGGLSGLNKAETAAQYGDQQVLVWRRSYDTPPPALEAGDERDAYGNPRYAGLPREQVPLTECLKDTVARVLPLWETSIAPDIKSGKRVVIAAHGNSIRALVKYLDNISDDDIVGLNIPNGTPLVYELDANLKPIRHYYLGDQEAIAASLAAVAGQGKAK

SEQ ID NO: 87076 - protein, 468 aa, Burkholderia sp. 383
MAMMSESTGTLQAAPATEDAPRALSQTLSVRDAVMITVSGVTPASSIFVIAPFAIQQAGSGAVLSFLLGGVLALAFALCYAELSAAHRSAGGEYVMAKRVFGTLPGYLTFITVLSVSVFIPAVLASGAAPYLNNALGTHFSNQSVALTIVLLSYLLGMLNIKTNAWITGAFLVVEIGVLMLIAGLGFGSPHRGADALIAPVVASGNALVPATLAAIVPAIGTAIFCYNGFGSAAYLAEDLRGGNRNVAKAVIYSLLVILVVELIPLTAIVLGAPSLTELTKSADPIGYVVRSLSNPAVSRVVSGGIFLSVFNAIIAIVITMGRLLYSSGRHALWSRTCNRAFSTIHPRFESPWLATIALAVPSAGLVFVSSLDELTAFTVDLLLLIYLVVGLAALASRFVRRDVEHHYRMPLWPVTPLVAVVGAAYTLYTTLATATKPTDLIIIAGLLIAALVMYAVWARHSEAFRTL

SEQ ID NO: 87077 - protein, 338 aa, Ralstonia solanacearum GMI1000
MRISVLGAGAWGTALASHAAQSHDVVLWGRDAALVAQMAATRANERYLPGIPLHASLRFEAEMSAALDHATGEDALVVIASPVAGLADLTRGVAAHGGVRNVIWLCKGFDPESGALPHAIVAGVLAQTGRADLATGALSGPSFAKEVAQGLPCAMTVASASTALCTRTQRAFHHHAMRVYASDDLVGVEVGGAVKNVLAIATGAADGLGLGLNARAALVTRGLAEMTRLGTALGGRPETFMGLTGMGDLLLTATGDLSRNRTVGMQLAQGRSLDEILAHLGHVAEGVRCARAVAALARAKGVDMPITFAVCEVLFDGLAPSRAVDRLLQRDAKAESVR

SEQ ID NO: 87078 - protein, 432 aa, Burkholderia sp. 383
MSRDLLGTLAGWQRTYGDVVHLRVRPEHAVVVTDPALVRELLVTHHDALGRWERAIRVFAQVHGHSVLVAEGDAWRDKRQALQPNFMPKPVQAFVPSIAATAGHALAQWPARDPDWPIESALTSLAMDVIMRTMFSDAIGDDARAAEEAVRTVSAAANADFYWPASTPDWVPWKRGKARAMAVLNGLIDRQLHARLDLPARAWPDDLLSRLLRLHRDDARRWPLQAVHDECMTAFLAGHETTAGALTWWAWCMATNPAAQAAARDEVSRVLGGCAPSAETRSSLRYLTHTLEETLRLYPSAPILISRRASRPIVLGPWQFPARTLFMLPLQLMQRDARWFAEPDVFRPERFADGAPAAPRGTYMPFGTGPRVCLGQHLAMTEMTVVAAMILQRYELSAQPGMMPPRPVLNVTLRPERLLHLAIAPAADGGTV

SEQ ID NO: 87079 - protein, 363 aa, Thermoanaerobacter tengcongensis MB4
MEIGIVGLPNVGKSTLFNAITKAGAECANYPFCTIEPNVGIVSVPDERLDFLAKIENPQKVVPATIKFVDIAGLVKGASKGEGLGNKFLSHIREVDAILNVVRCFEDSNIVHVEGSIDPVRDVEIINLELILADLETVERRMQKTSKLARNDKKAAFELEVLEKIKNTLEEGKPARAVQFDEEEKAVVNQLMLLTSKPVMYVANISEEDLILREENLHVKKLREYALKEGSEVLVISAKIEEELAALPDEERNELLKEYGLKEPGLNNIIRHGYSLLGLITFFTAGPKEVHAWTIKRGTKAPQAAGKIHSDFERGFIRAEVISFEDLVKAGSQAAAREMGLLRLEGKDYVMQDGDVVVFRFNV

SEQ ID NO: 87080 - protein, 286 aa, Triticum aestivum
  misc_feature (20)..(20): Xaa can be any naturally occurring amino acid
  misc_feature (36)..(36): Xaa can be any naturally occurring amino acid
  misc_feature (47)..(47): Xaa can be any naturally occurring amino acid
PCPGQWKPHEVKVKDSRTLXFVRRSFLFGCRNPERXPMGCCCAEYVXESTGVFTDKDKAAAHIKGGAKKVIISAPSKDAPMFVCGVNEKEYKSDIDIVSNASCTTNCLAPLAKVINDRFGIVEGLMTTVHAMTATQKTVDGPSSKDWRGGRAASFNIIPSSTGAAKAVGKVLPELNGKLTGMAFRVPTVDVSVVDLTVRLAKPATYDQIKAAIKEESEGNLKGILGYVDEDLVSTDFQGDNRSSIFDAKAGIALNDNFVKLVSWYDNEWGYSTRVVDLIRHMHSTK

SEQ ID NO: 87081 - protein, 289 aa, Salmonella enterica subsp. arizonae serovar 62:z4,z23:--
MSAKHPVIAVTGSSGAGTTTTSLAFRKIFAQLNLHAAEVEGDSFHRYTRPEMDMAIRKARDAGRHISYFGPEANDFGLLEQTLIEYGQTGKGQSRKYLHTYDEAVPWNQVPGTFTPWQALPEPTDVLFYEGLHGGVVTPQHDVARHVDLLVGVVPIVNLEWIQKLIRDTSERGHSREAVMDSVVRSMDDYINYITPQFSRTHINFQRVPTVDTSNPFAAKGIPSLDESFVVIHFRNLEGIDFPWLLAMLQGSFISHINTLVVPGGKMGLAMELIMLPLVQRLMEGKKIE

SEQ ID NO: 87082 - protein, 110 aa, Oryza sativa Japonica Group
MDANRRQSGIQQLLAAEQEAQQIVNAARAAKSARLRQAKEEAEREIAEYRAQMEAEFQRKVAESSGDSGANVKRLEQETAEKIAQLKQQAASISPEVIQMLLRHVTTVKN

SEQ ID NO: 87083 - protein, 390 aa, Picea sitchensis
MFMMDRGSNPQEEKEDEKGGANSSRKSNEFEIKGKAGRSPNKSEFFRADQIDLTNLDRHLSRVWTKAEARRPKEEWEIDLKKLDIKSIIAQGTFGTVYRGVYDGQDVAVKLLDWGEQGTKTESEIAQIRVSFEQEVAVWHKLDNQNVTKFIGASMGTSELRIPAQNSLNGDLIQVPSRTCCVVVEYLAGGTLKNYLIKNRRKKLAFKVVIQLALDLSRGLSYLHSKKIVHRDVKTENMLLDKSRTVKIADFGVARVEAQNPKDMTGETGTLGYMAPEVLDGKPYNRKCDVYSFGICLWEIYCCEMPYPDLSFAELTSAVVRQNLRPEIPRCCPSSLANVMKKCWDANSDKRPEMDEVVRLLEAIDTSKGGGMIPVDQSQGCLCFGKSRGP

SEQ ID NO: 87084 - protein, 478 aa, Prosthecochloris aestuarii DSM 271
MSRGITLINDDNSFNPLPYRRMLQQNIFSMNAQVPMVAIKRLAAHIQPEIVARLEYLNPSGTHYWSVASVIIENAEKEGLISPGMTLVDWTYGSSGIALAMAAIAKGYKVLLVVPDKISREKQQVLKAMGAEVVITPSDALPGAPRSCVNVAQNLVQNLKHAYFTNMYENPLSFSVHAETTGPMIWEQTGGEVTHLFVPVTSGAMISGIGQFLKSKRQNIRIIGVEPEGSIYRELLQHRKLSAPALFELEEIGGLWESKYWDASVIDDIVQVSDFDAFNCGRELLRSEAIFSGGSSGAAMFAALRAGAHLGRDARIVVMMSDFGGYYLSKMYSDEWMKLKGFYRKAPSSRDEITAEDILGLKTRRDLIFALPEHTLSEVFEMMRQNDVSQLPIVSYGTAIGSISENKILSILIENDDAMNSKVVGYMEQPFPVCPPHATISELSEKLQENASGVLISLSDGRLQLLTKSDLIEALTHK

SEQ ID NO: 87085 - protein, 335 aa, Candida albicans SC5314
MAIKIGINGFGRIGRLVLRVALGRKDIEVVAVNDPFIAPDYAAYMFKYDSTHGRYKGEVTASGDDLVIDGHKIKVFQERDPANIPWGKSGVDYVIESTGVFTKLEGAQKHIDAGAKKVIITAPSADAPMFVVGVNEDKYTPDLKIISNASCTTNCLAPLAKVVNDTFGIEEGLMTTVHSITATQKTVDGPSHKDWRGGRTASGNIIPSSTGAAKAVGKVIPELNGKLTGMSLRVPTTDVSVVDLTVRLKKAASYEEIAQAIKKASEGPLKGVLGYTEDAVVSTDFLGSSYSSIFDEKAGILLSPTFVKLISWYDNEYGYSTRVVDLLEHVAKASA

SEQ ID NO: 87086 - protein, 453 aa, Bacillus licheniformis ATCC 14580
MKVVKFGGSSLASGAQLEKVFQIVTSDPERRAVVVSAPGKRHPEDTKVTDLLIECAQQYLLSKEATGLVEAIVGRYADIALELGLADDVINRIRADLLQLLEGDKTNPERFIDAIKASGEDNNAKLVAAYFRHRGVEAHYVSPKDAGLFVTSEPGNAQVLPESYDNLFQLRQQKGIIIFPGFFGFSQEGEVMTFSRSGSDITGSILANGLKAELYENFTDVDAVYSVNPAIVSNPKEIRELTYREMRELSYAGFSVFHDEALIPAFRARIPVQIKNTNNPDAEGTRVVATRDNTNGPVVGIAGDSGFCSIYISKYLMNREIGFGRRVLQILEDEGLTYEHIPSGIDDITIILRQNQMDQAAEKRMIKRIKEELDADEVAIEHNIALIMVVGEAMRHNVGTTARASKALSEAGVNIEMINQGSSEVSMMFGVKEAQEKQAVRALYQEFFAKVLV

SEQ ID NO: 87087 - protein, 186 aa, Glycine max
GLLGHGSDVSHWIPKRIAGPLEGLQIAFVACGPWHTALVTSTGQLFTFGDGTFGVLGHGDRQNVSYPREVESLLGLRTIAVACGVWHTAAVVEVIATHSSTSISSGKLFTWGDGDKNRLGHGDKEARLKPTCVAALIDSNFHKIACGHSLTAGLTKSGRVFTMGSTVYGQLGNPQSDGKVPCLVGD

SEQ ID NO: 87088 - protein, 474 aa, Pseudomonas aeruginosa UCBPP-PA14
MQTKLLINGALVAGESESHAVYNPSQGNVLVRITEASGAQVHAAVQSADAAFDAWSQTPPKDRAALLLKLAERIDAQAHVFARLEADNCGKPFNAVLLDELPAVSDVFRFFAGAVRCLQGSAAGEYVAGHTSMIRRDAVGVVASIAPWNYPLLMAAWKLGPALAGGNTVVLKPSEHTPLSTLKLGELLAEIFPAGVVNIVHGRGASVGEPLTSHAQVRMVSLTGSVRTGSRIIEGTAESVKRMHMELGGKAPVLIFDDADIDAAVEGIRAFGFYNAGQDCTAACRLYVQKGVYQEFVRKLGEAVSSIRCGLPDDPATEMGPLITKEHLERVEGFVNRARELPHIEVVTGGKRAEGAGFFFEPTVLAGATQEDEVVRREIFGPVVTVSSFEDEAQALAWANDSDYGLASSVWTADVGRAHRLAARLQYGCTWVNTHFMLVSEMPHGGVKLSGYGKDLSMYGLEDYTVVRHVMFKH

SEQ ID NO: 87089 - protein, 277 aa, Salmonella enterica subsp. arizonae serovar 62:z4,z23:--
MRDDRSFIELKARQRAQALLDDGSYRELLDPFEGIMSPWLGAQGIVPQADDGMVVAKGTINGKPAVVVAIEGAFQGGSMGEVSGAKMAAALELAAEDNRNGIPTQAVLSLETGGVRLQEANLGLAAIADIHAAIVDLRRYTPVVGIVAGTVGCFGGMSIAAALCSYLIVTREARLGLNGPQVIEQEAGIEEYDSRDRPFIWSMTGGEVRYQSGLVDALVGDGVNAVKAAMNEALAKGVPAKHRTDNYDWYLDRLTNFDTRKQADSEQIKALFSREVK

SEQ ID NO: 87090 - protein, 174 aa, Zea mays
RDRSTSVGQVVFTAEDAEAWHSQGKAAILVRAETSPEDVGGMHAAVGILTERGGMTSHAAVVARWWGKCCVSGCSGIRVNDAEKLVTIGSHVLREGEWLSLNGSTGEVILGKQPLSPPALSGDLGTFMAWVDDVRKLKVLANADTPDDALTARNNGAQGIGLCRTEHMFFASDE

SEQ ID NO: 87091 - protein, 404 aa, Thermus thermophilus HB27
MDLSALREDFPLFAQRPELVYLDSAATSQKPRRVIEALRRYYETLNANVHRGAYRLSAEATEAYEEARRRLARFLNAEPKEIVFVRNTTEAMNLVAYAWGLRNLKEGDEVLVTEMEHHAGLVPWHLVAGLTGAKVKAIPLTEEGRLDLSALEDLLTERTKVVSLVHMSNVLGTINPVAEIARRAKEAGALVVVDGAQSAPHLPVDVKALGADFFALSGHKMLGPTGAGVLWGRYEVLEGMMPFLGGGEMILEVHVDRSTYAPPPQRFEAGTPPIAEAIALGEAACYLMEVGMDKVFAHDRALLEYALKRLEEVPRLRVYGPRGEDRGGVIPFTLGRLHAHDLATFLDQEGIAVRAGHHCAQPLHRKLGLAATARASFYLYNTKEEVDRFVEALLRIEAKYRAWL

SEQ ID NO: 87092 - protein, 309 aa, Kluyveromyces lactis NRRL Y-1140
MTSPSGEFPSLKLNTGASIPQLGFGTWPSSHADAYTAVITALKTGYRHIDAAAMYGNEAAVGKGIRDSGIPREEIFVTTKLWNTQQRDPASALDESLERLGLDYVDLFLIHWPVPLKPVGGPENLLKYPTPGIKPQIDTEDWSFIKTWELMQTLPKTGKTRAVGVSNFSIKNLEDLLNSSPDVLVPAVNQFEIHPQLPQTELINYCKSKGIVVEAYCPLGSSSSAMLSDPTIAEIADKYHVKPANVLINWGISRGYCVLPKSFTPARIASNKTPVHLSREDTERITKLSETLGVKRYVHPDFEPYPLFE

SEQ ID NO: 87093 - protein, 142 aa, Triticum aestivum
MATVLSSLRLPFSICPAAPAAPMAASRVALPLSSTAARGMRLRAQATYKVKLITPEGEVDLEVPDDVYILDHAEEEGIDLPYSCRAGSCSSCAGKVVSGQLDQSDQSFLDDDQIEAGWVLTCAAYPTSDLVIETHKEEELTA

SEQ ID NO: 87094 - protein, 124 aa, Mycobacterium smegmatis str. MC2 155
MSTLDITAEQFNDTVNDNEIVLVDFWASWCGPCKAFAPTFAASAEKHPDVVHAKVDTEAEQALAAAADIRSIPTLMAFKKGKLVFNQAGALPPAALEDLVQKIKEFDIDAAMREQAAQGGAEEV

SEQ ID NO: 87095 - protein, 426 aa, Xanthomonas campestris pv. vesicatoria str. 85-10
MASAKEISQYLKRFSQLDAKRFAVVKVGGAVLRDDLDALTSSLSFLQEVGLTPIVLHGAGPQLDAELAAAGIEKHTVNGLRVTSPEALAIVRKVFQASNLKLVEALQQNGARATSITGGVFEAEYLDRDTYGLVGEVKAVNLAPIEASLQAGSIPVITSLGETPSGQILNVNADFAANELVQELQPYKIIFLTGTGGLLDADGKLIDSINLSTEFDHLMQQPWINGGMRVKIEQIKDLLDRLPLESSVSITRPSDLAKELFTHKGSGTLVRRGERVLRATSWDELDLPRLKSLIESSFGRTLVPEYFETTTLLRAYVSENYRAAVILTDEGQFGAGRLTYLDKFAVLDDAQGEGLGRAVWNVMREETPQLFWRSRHNNQVNIFYYAESDGCIKQEKWKVFWYGLENFEQIQHCVAHCATRQPTLLG

SEQ ID NO: 87096 - protein, 305 aa, Alkaliphilus metalliredigens QYMF
MNEQLQKILDTNRHHIQGGQLPTYIPELSKANKEALGIYVADLDGNEYGVGDYEYPFTIQSISKVVTLLLALSDRGEKYVFDKVGMEPTGDPFNSMMKLEVVRPSKPFNPMINAGAIAVTSMIKGDSQKERLERILGFFRQLTENPNLQVNQSVYRSEKITGDRNRSMAYFMKDVGIMQNDIESDLDLYFNQCSIEVTCKDIAKIGRFLANGGVLFETGQQLIDEKYIKMAEAFMVTCGMYNASGEFAIKVGIPAKSGVGGGIMASVPKKMGIGVVGPSLDEKGNSIAGVRVLQKMAEDYGLSIF

SEQ ID NO: 87097 - protein, 390 aa, Methanothermobacter thermautotrophicus str. Delta H
MDSEEIIELERKFIMQTYTRQPIVLSHGKGATVWDIEGNSYIDCFAGVAVNSIGHAHPKVALAICHQAQRLIHSSNIYYTREQVELAKLLTAISPHDRVFFANSGAEANEGAIKLARKFTGKSEIIAAENSFHGRTLATVTATGQKKYSEPFRPLPEGFKHVPYGDIGAMADAVGDETAAIILEPVQGEGGVIIPPEGYLKDVQELARQNDVLLILDEVQTGFGRTGAMFASQLFGVEPDITTVAKAMGGGYPIGAVLANERVAMAFEPGDHGSTFGGNPWGCAAAIATIEVLMDEKLPERAAKMGSYFLGRLRQVLHGCDAVRDIRGVGLMIGIEIDGECAGVVDAAREMGVLINCTAGKVIRIVPPLVIKKEEIDAAVDVLGHVISDL

SEQ ID NO: 87098 - protein, 770 aa, Oryza sativa Japonica Group
MAAAAILPELAAQVVIPVAAAVGIAFAVLQWALVSKVKLTAEPRRGEAGGAAGGKSGPSDYLIEEEEGLNDHNVVSKCAEIQTAISEGATSFLFTEYKYVGLFMSIFAVLIFLFLGSVEGFSTKSQPCHYSKDKTCKPALANAIFSTIAFVLGAVTSLVSGFLGMKIATYANARTTLEARKGVGKAFITAFRSGAVMGFLLAASGLLVLYIAINLFGIYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGINHEFTPMVYPLLVSSVGIIACLITTLFATDFFEIKAVSEIEPALKKQLIISTAFMTVGIALVSWLGLPYTFTIFNFGAQKTVQSWQLFLCVAVGLWAGLIIGFVTEYYTSNAYSPVQDVADSCRTGAATNVIFGLALGYKSVIIPIFAIAFSIFLSFSLAAMYGVAVAALGMLSTIATGLAIDAYGPISDNAGGIAEMAGMSHRIRERTDALDAAGNTTAAIGKGFAIGSAALVSLALFGAFVSRAAISTVDVLTPKVFIGLIVGAMLPYWFSAMTMKSVGSAALKMVEEVRRQFNTIPGLMEGTTKPDYATCVKISTDASIKEMIPPGALVMLTPLIVGILFGVETLSGVLAGALVSGVQIAISASNTGGAWDNAKKYIEAGASEHARTLGPKGSDPHKAAVIGDTIGDPLKDTSGPSLNILIKLMAVESLVFAPFFATHGGILFKLF

SEQ ID NO: 87099 - protein, 343 aa, Xanthomonas campestris pv. vesicatoria str. 85-10
MSLKHFLNTQDWSRAELDALLTQAALFKRNKLGSELKGKSIALVFFNPSMRTRTSFELGAFQLGGHAVVLQPGKDAWPIEFNLGTVMDGETEEHIAEVARVLGRYVDLIGVRAFPKFVDWSKDREDQVLKSFAKYSPVPVINMETITHPCQELAHALALQEHFGTQDLRGKKYVLTWTYHPKPLNTAVANSALTIATRMGMDVTLLCPTPDYILDQRYMDWAAQNVAESGGSLQVSHDIDSAYAGADVVYAKSWGALPFFGNWEPEKPIRDQYQHFIVDERKMALTNNGVFSHCLPLRRNVKATDAVMDSPNCIAIDEAENRLHVQKAIMAALASQAGIGNRD

SEQ ID NO: 87100 - protein, 269 aa, Populus trichocarpa
MASLLLLLLLSPLSTTAASSGAYPTIPGSIDTSFPASQDSKLIPIRREVYGDGRIFDITHRYTSDMPSMGSENGLGQFLRLPESMKNGSFANISEMKLITHTGTHVDAPGHYYDHYFDAGFDVDTLDLEVLNGPGLLIDVPRGTNITAEVMKSLHIPKGARRVLFRTENTDRRLMFKNQIDTSFVGFTTDGAKWLVDNTDIKLVGIDYLAVAAWSDLVPAHLVLLESREIIIVEGLKLDDIQPGVYSIHCLPIRLLGAEGSPTRCILIK

SEQ ID NO: 87101 - protein, 505 aa, Burkholderia sp. 383
MKHDSNVTSTVGHLIDGKRVDGGSRVQPVFDPATGESHKSVALADKLTVEAAIASAQAAFPAWRNTPPLKRARVMSRFKTLLEEHADELCALITAEHGKVLADAMGELQRGIENVEYATYVPELLKGEHSKNVGPAIDSWSEFQALGVAAGITPFNFPVMVPLWMWPMAVACGNTFVLKPSERTPSSTLRMAELALEAGLPPGVLNVVNGDKEAVDTLLTDPRVKAVSFVGSTPIAEYIYSTGCAHGKRVQALGGAKNFAVVMPDADIGNAVNALMGAAYGSCGERCMAIPLVVAIGDETGDQVVAGLKAEIEKMKVGPGNGAGVDMGPLVTQQHFEKVTGFVEAGVEAGATLVVDGRSVKVDGHDGGYYLGPCLFDNVKPGMPIYQHEIFGPVLGVIRLKSLDEAMALIDAHEYGNGTCLFTRDGEAARYFGDNIQIGMVGINVPLPVPVAYHSFGGWKRSLFGDLHAYGPDAVRFYTKRKTITQRWPSAGVREGTVFSFPSNR

SEQ ID NO: 87102 - protein, 451 aa, Burkholderia sp. 383
MTDITTAQQDETNLRTDAAWLDAHWMPFTANRQFKADPRMIVSGKGAYYTDGEGRKIFDGLSGLWCTGLGHGRTEIVEAVSRQVAQLDYAPAFQFGHPKSFELANKIKDLTPAGLDYVFFTGSGSEAADTSLKLARAYWRAKGKGTKTRLIGREKGYHGVNFGGISVGGIGPNRKLFGQGLDADFLPHTQLAENKFSRGMPEHGAELADRLLELIALHDASNIAAVIVEPFSGSAGVVVPPKGYLKRLRDICTAHDILLIFDEVITGFGRAGAMTGADAFGVVPDIMNFAKQVTNGVQPLGGVIATKEIYDTFMAAGGPEYMLEFPHGYTYSAHPVACAAGVAALDLLVKEDAVARVRDLAPHFEAAVHGLKGQRHITDIRNYGLAAGLTIAALPGEPARRPYEIAMRCWAKGFYVRYGGDTIQLAPPFISEKREIDNLVNALSDALNEVD

SEQ ID NO: 87103 - protein, 411 aa, Picea sitchensis
MNALAATSRNFKRAARLLALDSKLERSLLIPFREIKVECTIPKDDGTLASYVGFRVQHDNARGPMKGGIRYHPEVDPDEVNALAQLMTWKTAVANIPYGGAKGGIGCDPRSLSISELERLTRVFTQKIHDLIGVHIDVPAPDMGTNPQTMAWILDEYSKFHGYSPAIVTGKPVDLGGSLGRDAATGRGVLFATEALLAEYGKSISDQRFVIQGFGNVGSWAAELIHEMGGKIVAVSDISGAIKNSKGLDIPALMKHTKTNGGVKGFEAADSVDPKTLLLEDCDVLIPAALGGVLNRENASEVKAKFIIEAANHPTDPEADEILYKKGVIVLPDIYANSGGVTVSYFEWVQNIQGFMWDEEKVNAELKKYMTSSFQHLKEMCKTHDCDLRMGAFTLGVNRVARATLLRGWEA

SEQ ID NO: 87104 - protein, 219 aa, Thermoanaerobacter tengcongensis MB4
MDTMRRTISQRMKKSWTEIPHVTEDIKVDVTELVNLRENLNKSGEHKFTYTDLIAKACVIALKKNPVLNWSIEGDEIIKNPNINLGIAVALEDGLIVPVVKNAENKSLLELSKEIKELSEKARENKLTPDEITGGTFTITNLGMYEIDSFTPIINPPESAILGVNKIYKEPVVIEDNIVIRHTMKLSLSFDHRLIDGATAAKFLLDLKKILENPVSMLI

SEQ ID NO: 87105 - protein, 327 aa, Rhizobium leguminosarum bv. viciae 3841
MSENIAVVGSGAFGTALAAVIALAGRSAVTLVGRDPSLIADLKAERLHDAVLPGILLPDTLEFSAEADAITGASIVLFAMPSQAQADAARQYGPYLCKDAVVVTCAKGIERATGNLLTDMLERELPDHSIAVLSGPGFAADIAKGLPTAMAIAAADMETAERLAQAISGRTFRLYASNDRIGVQLGGALKNVLAIACGIVEGRGIGDSARAALIARGLAEMSRFVVAKGGQADTVRGLSGLGDLVLTATSHQSRNLRFGIALGRGEKTDPLQGALVEGAFAASVASRLAAELKVSMPITDAVSAIIDGKLDISEAIEQLMTRPITTE

SEQ ID NO: 87106 - protein, 425 aa, Prosthecochloris aestuarii DSM 271
MNNRDIIHDDIASGTFHNDTMQNGIRVITNRVSHVQSVTLGIWINAGSREDPDTTPGLAHFVEHAIFKGTSSRDYETIARCIEDVGGYIDAWTTKENTCIYIRCLKEHIALAFSLLSDLCCNPSFPDEEIEKEKEVVIEEIHSINDAPEELIFDEFDLHAFPRHRLGSTILGTEESIESITGDDLRQFMQNNYTPDNLLVTAVGNVTHTEIMELAVRSFASLQEGTPAKRSTREFELRDYTPFNLQLQKPVYQAQLLFGTAATRKNEHFYSLLLLNTILGSGMSSRMNLELREKNALAYNVYSSLTLFDDATMFNVYAGTDNSNIVKALAIIDQILSPESLCSIDQSELETAKSRLLGAMIMGMEKMTRRMSRAARDLFYFGRIIPLEEKINAIRQVTQNDIRHAVMHLLQSAPASTLIYEAEEE

SEQ ID NO: 87107 - protein, 280 aa, Pseudomonas syringae pv. phaseolicola 1448A
MRSFHFKQLDVFSDQPLLGNPLAVVLGADGLSDEQMAAFARWTNLSETTFLLKPTDPRADYRVRIFTTLEELPFAGHPTLGSCHAWLESGGAAQGEEIIQECGIGLVRIRREGSGLAFTAPPLLRSGTVDPELIEQIRLGMNLGAGEILDARWVDNGPGWVAIRLADRASVLSLQPDYTLLSGLILGVVAPWDPAVDGDEAQFEVRAFIPGDGMAEDPVTGSLNAGIARWFLEEGLAPDNYIVSQGTALGRKGRVSIQRVGEDIWVGGSTVTCIEGRVSL

SEQ ID NO: 87108 - protein, 129 aa, Prosthecochloris aestuarii DSM 271
MSNYRSSCIRLINVTFYAHHGVHREEHFIGAKYEVDAELRCNFTRAAAEDDISQTIDYGIVYEKIRNVLTQKKYYLIEAVAYTIAEELLGDLSMLDSATIKVRKRNPPIGGVCDYAEAEYCAARKPVLP

SEQ ID NO: 87109 - protein, 371 aa, Arabidopsis thaliana
MSNFTYTSAFNLSDNSPFNPAIGSSSSSSSALVVASDDDNNTDDACSICLEPFTLQDPSTVTSCKHEYHLQCIIEWSQRSRECPICWQLFVLRDPASQELLAAVEKERLLKTRNISSSSPISIHHSHDDFHSEEEESQFSSFDEQFLRHLTEAAHRRCLLRRRDGQISSSLVSSSDPTTIHPTDLVNLYRLSAISHVEHQNSNPCPSPGSMTPSPVSGHSSIPADSNNGSRISPGPSPSRSSQSPKSPEASSLPEAIKSKLAAASAKYKESISKSKQGLKEKLLARNNSVKELSKGVQREMNAGIAGVARMIERMDFSSKRFGGSAHVSTSTATASGFNFSFKGKRVEANSKSNNNGDKTEPQKLQGGETC

SEQ ID NO: 87110 - protein, 418 aa, Streptomyces coelicolor A3(2)
MTQLPGLLDTEAIRKDFPILDRQVHDGHKLVYLDNAATSQKPRQVLDALSEYYERYNANVHRGVHVLAEEATALYEGARDKVAEFINAPSRDEVIFTKNASESLNLVANMLGWADDPYRVDHETEIVITEMEHHSNIVPWQLLAQRTGAKLRWFGLTDDGRLDLSNIDEVITEKTKVVSFVLVSNILGTQNPVEAIVRRAQEVGALVCIDASQAAPHMPLDVQALQADFVAFTGHKMCGPTGIGVLWGRQELLEDLPPFLGGGEMIETVSMHSSTYAPAPHKFEAGTPPVAQAVGLGAAIDYLNSIGMDKILAHEHALTEYAVKRLLEVPDLRIIGPTTAEERGAAISFTLGDIHPHDVGQVLDEQGIAVRVGHHCARPVCLRYGIPATTRASFYLYSTPAEIDALVDGLEHVRNFFG

SEQ ID NO: 87111 - protein, 634 aa, Salmonella enterica subsp. arizonae serovar 62:z4,z23:--
MIVFSSLQIRRGVRVLLDNASATINPGQKVGLVGKNGCGKSTLLALLKNEISADAGSFALPGTWQLAWVNQETPALPQPAIEYVIDGDREYRYLEAQLNDANERNDGHAIAAIHGKLDTIDAWTVRSRAASLLHGLGFSNDQLERPVSDFSGGWRMRLNLAQALICRSDLLLLDEPTNHLDLDAVIWLEKWLKNYPGTLILISHDRDFLDPIVDKIIHIEQQTLYEYTGNYSAFEVQRATRLAQQQAMYESQQERVAHLQSYIDRFRAKATKAKQAQSRIKMLERMELIAPAHVDNPFHFSFRAPESLPNPLLKMEKVSAGYGERIILESIKLNLVPGSRIGLLGRNGAGKSTLIKLLAGELEPLHGEIGLAKGIKLGYFAQHQLEYLRADESPLQHMARLAPQELEQKLRDYLGGFGFQGDKVTEETQRFSGGEKARLVLALIVWQRPNLLLLDEPTNHLDLDMRQALTEALIDFDGALVVVSHDRHLIRSTTDDLYLVHDKKVEPFDGDLEDYQQWLSDVQKQENQSDEPVKENANSAQSRKDQKRREAELRTLTQPLRKEIARLEKEMEKLNAQLAQAEEKLGDSSLYDPSRKAEMTECLQLQASAKSGLEECEMAWLEAQEQLEQMMQND

SEQ ID NO: 87112 - protein, 601 aa, Salmonella enterica subsp. arizonae serovar 62:z4,z23:--
MEGADLLMAGTLFLFAAVVAVPLAARLGIGAVLGYLLAGIAIGPWGLGFISDVDEILHFSELGVVFLMFIIGLELNPSRLWQLRRSIFGVGAAQVLLSAAVLAGLLMLADFLWQAAIVGGIGLAMSSTAMALQLMREKGMNRSESGQLGFSVLLFQDLAVIPALALVPLLAGSADEHFDWFKVGMKVLAFAVMLIGGRYLLRPVFRFIAASGVREVFTAATLLLVLGAALFMDALGLSMALGTFIAGVLLAESEYRHELENAIDPFKGLLLGLFFISVGMSLNLGVLYTHLLWVAASVVILVVIKMLALYLLARLYGIRSSERMQFASVLSQGGEFAFVLFSTASSQRLFQGDQMALLLVAVTLSMMTTPLLMKGIDKWLSRRLNGPEEHDEKPWVEDDKPQVIVVGFGRFGQVIARLLMANKVRITVLERDIGAVNLMRKYGYKVYYGDATQVELLRSAGAEAAESIVITCNEPEDTMKLVELCQQHFPHLHILARARGRVEAHELLQAGVTQFSRETFSSALELGRKTLVSLGMHPHQAQRAQLHFRRLDMRMLRELIPEHTDTGQISRAREARRELEEIFQREMQQERRQLDGWDEFE

SEQ ID NO: 87113 - protein, 318 aa, Streptococcus agalactiae NEM316
MGLLVDGKWVDQWYDTASTGGKFVRTVTQFRHWVTKDGSAGPSGDAGFKAESGRYHLYVSLACPWASRVLIMRKLKNLESHISISIVNPLMLENGWTFQEYKGVIPDMINQSQYLYQIYQASQSDYTGRVTVPVLWDKKCHTIVNNESSEIMRMLNTAFNHITGNTDDYYPDSLQGQIDEMNNFIYPKINNGVYKAGFATSQNVYQKEVETLFTALDQLEKHLSDNHYLVGEQFTEADIRLFTTLVRFDTVYYGHFKCNLKALHDYPHLWHYTKRIYNLPGIAETVNFDHIKKHYYGSHKTINPTGIIPAGPNLDWTI

SEQ ID NO: 87114 - protein, 322 aa, Thermus thermophilus HB27
MRVAVLGAGAWGTALAVLLASKGVPTRLWARRKAQAEALKAMRENRDYLPGVALPAYLYPTHDPEEALEGAELAVLAVPSKALRETVAGLPPAPWYVSATKGLFYGEEGVRTPAEVVEALTQRPVVALSGPNHAEEVARFLPTASVAAGPEDLARRVQALFSGPTFRVYTSRDRRGVELGGAVKNVLALAAGMVDGLRLGDNAKAALLTRGLKEMVRFGTALGGEEATFYGLAGLGDLLATAYSLHSRNRMAGESLVRGVDREALEARGVVEGLYAVKAMVAWGKEQGVELPVAEAVHRVAHEGLDPLAALKALMAREPKEE

SEQ ID NO: 87115 - protein, 525 aa, Coccidioides immitis RS
MAELVPHTQSIADIYPSDVAGDRKVAPDQQDRWISLIKAFRRLYAQSPDFVARSPGRVNIIGEHIDYSLYDVLPTALRVDVLIAIKAVQTNGQDGFVQLSNVYDAKFPATEFQIPHDRDVEIDASKNDWANYFKAGLLVAIKFLRKKSNRSSFVPSSIKALVDGNVPPGGGLSSSAAFVCASALAIVKAHGCDISKQELLDISLVSERFVGVYSGGMDQAASIFSRHGYLLYVRFFPRFHTQYVPIPKTEPELTFLVAQSFITSNKAETAPKHYNLRVAECTLGALVLAKLHGIELPKDSSSLGYSFRTYHHELMQKEGRLEDPLEYQLDSIILGVTELLTQEQGYTREEIAKILGLTVPELESKFLSAFPVQADRFLLRQRALHCFKEARRVLDFKACLSRSNHLDEHGIRYLGQLMNESQESCRTLYDCSCPEVNSICEIALQAGSFGSRLTGAGWGGCTVHMIPQSKVEAVTSALKREYYNKRFPELNEEELKHAMVISKPSNGSFVISGAAITDVGYENGV

SEQ ID NO: 87116 - protein, 159 aa, Kluyveromyces lactis NRRL Y-1140
MSRRIRKTSLFSKDVGSLMYAFGDVAQPLPETIQCVDELVVSYLSDICANAYYSAQTVKRNKIKVEDFRFVLRKDEVKLGRAEELIKMNKVITDARKQFDNSEGKSLKRVKDDGDDDHISADEDEETTTVPEPVPTSRPVGRPRKKGNEPPKKKKRETS

SEQ ID NO: 87117 - protein, 625 aa, Zea mays
  misc_feature (215)..(215): Xaa can be any naturally occurring amino acid
  misc_feature (449)..(449): Xaa can be any naturally occurring amino acid
MPHRVAALLLLLPLAAASEEAPGPAAEAALLERHAAQLAKLEEVAESLARSVHALESALARSADPDPSQPVAPAAAVGDRRSPQGVAVTKRRPVWSERFHFTAAARLGEGAYVAAAAALPYEDAEGLTKYFAVGDSRGRVFVFSAAGDALLELEAAASGGECRVTALLAYLSPRRTDCLLFTGHADGSIAAHRLIESSPHGDDWLTLAAASSRLXVRGLDAAPVVHLEAHHAGRARYVLSCDAGGRIRVFTENGTLYGTAIASSTPLAFVKQRLLFLTEAGAASLDLRSMSVRETPCEGLAEMLNGTSVKAYSFDPSERFKAYGFTEAGDLVHVLLLGDVSSLKCRVRSVKKSEMDNPVAIQTIKGYLLVASHDKILVFNTSSQYYGRVGAPRPLFATSIKDIKSVFAGSGGVLPTEPAGKPVIAADREKLVILGLGDGHIAIYRSNFXVYKPESNAVVWSGPALLFLLFLIGIWQVYVKKKDSLGWTPEETFNTSVTAPTGSLLNHPTSDRAFADSTARSGDRGYVDGTSRASDRSYVDATTRTTDRGYSDATRAVDLRGGALRSAPRRYVSPTRYAGTSGIQYRPSAEPGLRGTPEIKYRGPGPLNFGLILKVLRDASGLHVL

SEQ ID NO: 87118 - protein, 132 aa, Desulfococcus oleovorans Hxd3
MSVDSVFVHKMWNDNELTKMVKGGIPFPMLSDGGGKVGTAYGVYDEDAGVENRGRFIIDPDGVIQAYEVLTPPVGRHVAETLRQIQAFQLVRKSKGSEATPSGWKPGKLTLKPSPDLVGKVWEVWETKMESE

SEQ ID NO: 87119 - protein, 130 aa, Glycine max
MPTFTAIAFDRLIEPGASKPAYKSAPVPMPVPKKIERRTSEPTIRKKPRPRPQLKPALYATPEVTPLPDAPSSFPPSPYIINHKRRGPRLLKSYSEANVQAKQENLDNENANVKSNDGVITSLDGDLQVT

SEQ ID NO: 87120 - protein, 443 aa, Arabidopsis thaliana
MMVFVVFVMCRYKILEELGDGTCGSVYKAVNLETYEVVAVKKMKRKFYYWEECVNLREVKALRKLKHPHIIKLKEIVREHNELFFIFECMDHNLYHIMKERERPFSEGEIRSFMSQMLQGLAHMHKNGYFHRDLKPENLLVTNNILKIADFGLAREVASMPPYTEYVSTRWYRAPEVLLQSSLYTPAVDMWAVGAILAELYALTPLFPGESEIDQLYKICCVLGKPDWTTFPEAKSISRIMSISHTEFPQTRIADLLPNAAPEAIDLINRLCSWDPLKRPTADEALNHPFFSMATQASYPIHDLELRLDNMAALPNLELNLWDFNREPEECFLGLTLAVKPSAPKLEMLRNVSQDMSENFLFCPGVNNDREPSVFWSLLSPDENGLHAPVESSPLSLSFSPMQQHTVGPPQSSGFTMTSSMQPNMLDRPWMAVSAPFQQSHYL

SEQ ID NO: 87121 - protein, 529 aa, delta proteobacterium MLMS-1
MQLAGSKILVVDDDSFVREMLTSILEAAGYRVTTAEDGLDALAKYEADQQIELIISDVNMPRLDGIQLIQELQSRRLDVPIIMVTSVNSISVAVDALSSGAIDYVLKDEGVQETIEITVKRALEKDKIKQQNKQLVAELAAKTREQENTLSYLNAIIGNIPDGLLVTNDRARITMANPALGGMFREAAGGNLVGRDCREVFADSLGPMLAAISTSQQQAVTVQVELAGGRIGSAIGTAIYRGGAGQEEFIGYLIVVRDITHQKEIERMKDDFVSAVSHELRTPLTSVLGFARLIAKKLEGVILPVVPRQDPRVERAVRQVGDNINIIVTEGERLTKLINEVLDLSKMEAGKVEWQLEPVTAEEIVKRALDATTGLFGEGAPELLSEVEPELPVLCCDRDRIMQVLINLIANARKFTDHGRVTVRARRAAGEEAVLFEVSDSGCGITPENLQSVFEKFKQVGDTLTDRPKGTGLGLPICKEIVEYHGGTVTAESTPGAGSTFRFTLPTAAVVGSTAERERTDPGLEVADE

SEQ ID NO: 87122 - protein, 427 aa, Coxiella burnetii RSA 493
MTELTGVSIVTYQHIKVPSQGEKITVNKAVLEVPDRPIIPFIEGDGIGIDIAPVMKNVVDAAVEKSYAGKRKIEWMEIYAGEKATKVYGKDNWLPDETLEAIKEYQVAIKGPLTTPVGGGIRSLNVALRQQLDLYVCLRPVRYFTGVPSPVKTPEKVNMVIFRENSEDIYAGIEWPAGSPEAVKLINFLQNEMGVKKIRFPETAGIGIKPVSKEGTSRLVRRAIQYAIDNDRDSVTLVHKGNIMKFTEGAFKDWGYEVAVKEFGAKPLDGGPWHVFENPKTGQKITIKDVIADAFLQQILLRPAEYSVIATLNLNGDYISDALAAEVGGIGIAPGANLSDTVGLFEATHGTAPKYAGQDKVNPGSLILSAEMMLRYLGWKEAADLVVQGIEGAIESKTVTYDFARLMTGAKEVSTSQFGKAIIKHIL

SEQ ID NO: 87123 - protein, 442 aa, Desulfococcus oleovorans Hxd3
MTRSDRCAELIAKIEARTARIAVIGLGYVGLPLALTFAKKGFSVLGFDTDQEKCDHIANGRTYIRHIPLEPVKDLIGNKSFEATSDFSRLAEADCILICVPTPLTDKRVPDLSALVNTAQTIARFLRKGQLVVLESTTYPETTEEELLFRFASNTMKPGIDFFLAFSPEREDPGNKGFSVTNIPKIVGGITPACLEAADTLYSTITRTVPVSSARVAEFAKILENTFRSVNIALVNELKILAHRMNIDIFEVIEAAATKPFGFMPFYPGPGLGGHCIPIDPFYLTWKAKEYGFATKFIELAGEINTLMPDYVVTKTADALNRMGRCVRNSTILVLGVAYKKDVDDDRESPAYPIMKKLTDQGAAVSYNDPWIPRLRPTRKYDFTMASVPLAPETLAAADAVLILANHSDYDMQFIIRHARLVIDTRNATAGMKSDTCTIVPA

SEQ ID NO: 87124 - protein, 459 aa, Fusobacterium nucleatum subsp. vincentii ATCC 49256
MEKIYDLLVIGWGKAGKTLSAKLGAKEKKVAIIEENPKMYGGTCINVGCLPTKSLVHSAKILSEAKKYGIDGDYSFKNNFFKEAMKKKEEMTTKLRNKNFGILDTNENVDIYNGRASFISDNEVKVVSSDNKEIILKADKIVINTGSVSRTLNIEGIDNKNIMVSEGILELKELPKKLLIIGAGYIGLEFASYFANFGSEVSIFQFDDSFLVREDEDEAKIIKEILEKKDIKFFFKTSVKKFEDLGNSVKAICVQNGKEFIEEFDKVLIAVGRKPNTDNLGLKNTSIQLGKFGEILVDDYLKTDAPNVWAVGDVKGGPQFTYVSLDDFRIVFPQILGENNGRKLSDRILIPTSTFVDPPYSRVGINEKEAQRLGIKYTKKFALTNTIPKAHVINEIEGFTKILINENDEIIGASICHYESHEMINLLTLAINQKIKSKVLKDFIYTHPIFTESLNDILG

SEQ ID NO: 87125 - protein, 112 aa, Oryza sativa
  misc_feature (59)..(59): Xaa can be any naturally occurring amino acid
MEPMLARLPPTAARASELAAKHGRACYPDAMENNEAPVLQPPAVEKCRELSPPLFYTRXAACPAAVYGIWKEFDGVQHVWNNTRELSEEDLAIATLFGAEFYAWVCTSQIDG

SEQ ID NO: 87126 - protein, 437 aa, Bacillus licheniformis ATCC 14580
MSRNTKAFTTEDWQAKRDQFVARGVSNGNRHLAAKGEGAVLYDIDGRRFIDFAGAIGTLNVGHSHPKVVEAVKRQAEQLIHPGFNVMMYPAYLELAEKLCRLAPGAHEKKAIFLNSGAEAVENAVKIARKYTKRQAVVSFTRGFHGRTNMTMSMTSKVKPYKFGFGPFAPEVYQAPFPYYYRKPEGMTDESYDDMVIQAFDDFFVSSVAPETVACVVMEPVQGEGGFIIPSKRFVQHVAAFCQKHGIVFVADEIQTGFARTGKYFAIEHFDVVPDLVTVSKSLAAGVPLSGVIGRAEMLDAADPGELGGTYAGSPLGCVAALAVLDIIESEQLNKRSEEIGKAIEERALEWKMKYPQIGEVRRLGAMAAIEIVRDEKTREPDKAAAAKIAKYANEHGLLLLTAGINGNIIRFLSPLVITDELLEEGFGIIEEALEQL

SEQ ID NO: 87127 - protein, 274 aa, Saccharomyces cerevisiae YJM789
MVAPTALKKATVTPVSGQDGGSSRIIGINNTESIDEDDDDDVLLDDSDNNPAKEEVEGEEGSRKMHESKTVVVDDQGKPRFTSASKTQGNKIKFESRKIMVPPHRMTPLRNSWTKIYPPLVEHLKLQVRMNLKTKSVELRTNPKFTTDPGALQKGADFIKAFTLGFDLDDSIALLRLDDLYIETFEVKDVKTLTGDHLSRAIGRIAGKDGKTKFAIENATRTRIVLADSKIHILGGFTHIRMARESVVSLILGSPPGKVYGNLRTVASRLKERY

SEQ ID NO: 87128 - protein, 500 aa, Chlamydomonas reinhardtii
MEEEEAHRLYTLFQRTNDAAKTKKGLGFSSSEPPARGAYAAPTAAAGGFMSSFVRSTTAFGAEQTKAPPVQAPTLGGSYDSDDAGERAAKRQRQQRASAYNAVADERDDDPRFWGRGADHPGRGGLGGRRRHPEEEAEEPEEAEDEAEVRRRLQAKEKQRREREAAAWERHRAEGGGDEGRSGRHVGASGGGSGSRRDVAPAGAGGKTRGKDQPPDYSALIPGYEAMNPAEKLRARTRLSLAQAETRVASRAAAAAAGSDDEDGSGGAGGKGNWTRFAFNADAVPEDGMAFGRRGGGGGGGEDEPREPKQYNSHGLGADLDRGELEMLVGRRTADVERQQRAEQKAQAAHEDAIFGSRLPPPPPLPTARAEPGRDEREQPPPLAPPPPAVYAAAAAPTAAVGAAAAAPTAAVSGMHAGDDEGPQVVLLDEMELVAAERAAAGLASASCGAGSSVAGAGSTAGDGEPADGVLEGTLHETVLSNQKMSWRERAIQARRKAAG

SEQ ID NO: 87129 - protein, 463 aa, Bacillus licheniformis ATCC 14580
MGKQQMKKTMSQTDVLFLAIGAMLGWGWVVLSGDWISTAGFLGSTIAFIIGGILVILIGLTYAELSSAIPETGGGLIFVYRAFGRKTAFVAAWGVLFGYVSVITFEAVALPTVIDYVLPVEHQGFLWSLSGWDVYVTWVLIGSGGAVVLTALNYFGVKPAAIFQSVFTIAIIATGFLLLGGALVNGDFEHVQPLFKDGFSGMMSVLVMIPFLFVGFDVIPQVAAEINAPKKIIGKILIISIISAVVFYLLIVFGVTMGLSESELATTSLATADAMVNLLGNQLFGTVLVLGGVAGIITSWNAFIIGASRILFAMSEKGMVPKWFGFIHPKYKTPTNAILFLGALAFFAPLLGRPALVWIVNAGGTGIIVGYLIVSIAFMKLRKTEPDLHRPYKINKWKTTGISAILLSVIFLAFYLPGMPAALTWPYEWLILAGWTLIGFLLYNSSSKRKGEEIQHDQHARSI

SEQ ID NO: 87130 - protein, 464 aa, Bacillus licheniformis ATCC 14580
MTSMLEVYNPATGEKIKSVPQQSAKEVEEAVVRSHEAFQKWSKTSAAERAGLLKKWFDLIVEQKDELAKLITLENGKPYAEAQGEVLYSAGYIEWYAEEAKRIYGRTVPASVTNKRIIVTRQGVGPVAAITPWNFPAAMITRKAGPALAAGCTFIIKPAPDTPLTALELVRLGHEAGIPKDVLQCVIGDGQEIGSIFTSHPLIRKITFTGSTPVGKHLMKNSAETVKHVSMELGGHAPLIVDEDANIDLAVKQTMLSKYRNAGQTCVCANRLIVHESVKDEFAEKLRAEVAKLKVGNGLEEGVSIGPIINKNGFQKIVDQINDAVNKGAKVLIGAEYESDDEKSCYFVHPTVLTDVDPSMTIMHEETFGPVAPITSFKTLDEAVKLANDTPYGLAAYFFTENYRRGIYLSENLDYGILGWNDGGPSTVQAPFGGMKESGIGREGGLEGIEPYLETKYLSIGLDE

SEQ ID NO: 87131 - protein, 606 aa, Physcomitrella patens subsp. patens
MNLFLGCGRHYYASERNLLHYMGFRSLDVANLQEGLASSGLSGLEGCEAHTLASLNTLGTILFSLLTNSQNNCSWTSATDVVLNGTEHISYEAGNFMLSKHAEALLGSSPPERNTVIMVTLPSEAAEDDKLIRHLLLSGMNVARINCAHDSPEVWKKMVQKVRFFAELLEMPCRVSFDLTRPKLRTGPMQPGPSVLKIKPTKDSLGHVVAPACVWIAEEGVRPSGQRIPDVCVPIIPSPGWTKKIQSGDAIKFKDARGRSRELRVMEKGSDPSRAGIFAECRAVSYIEPGCALTVLGYDGQRLNLNVGQLPEVEQAILLRPGDKLLLKRDHVLGSPAQVDKAGKVVVPASVTCTLDKVFDVAKLGQPVKFDDGKIGGVIGSVSPSEICVTITEAGGHKGRKLKGEKAINFPESDLSLNGLTVKDAEDLDFVVANADMLALSFVNGPADVRALQDELARRGADEIGIVVKIETELGFQSLPSILLQTMVTMNPVGVMVARGDMAVECGWQRLAEIQDQILLLCEAAHVPTIWATQVLEELAKSGLPSRAEITDAASGSRAECVMLNKGPYILQAVASLDDILRREASRRRKNRWRMHPLQNLGNLDM

SEQ ID NO: 87132 - protein, 464 aa, Glycine max
MFGVVRRRVASGSPSPWLLGQSAQKIRSGPSVSARASSIVEKEIVFRSGGCGFVQNFSHITPGSWINSKPMRVVIHPEATVRTWGRLFSSESGDTVDVVVPPLAESISDGTLAQFLKRPGDRVNADEPIAQIETDKVTIDVSSPESGVILKLLANEGDTVEPGNKIAIISRSADATHVAPSETISEKAAPQPTQKVSEEKKAPKVETAPAKEKPKTPPATLKSPTEPQLPPKERERRVPMTRLRKRVATRLKDSQNTFAMLTTFNEVDMTNLMKLRSDYKDAFVEKHGVKLGLMSGFVKAAVNALQHQPIVNAVIDGDDIIYRDYIDISIAVGTPKGLVVPVIRNADTMNFADIEKQINTFAKKANDGSLSIDEMAGGTLTISNGGVYGSLLSTPIINPPQSAILGMHSIVSRPTVVGGNIVPRPMMYVALTYDHRIIDGREAVFFLRRIKDIVEDPRRLLLDI

SEQ ID NO: 87133 - protein, 514 aa, Salmonella enterica subsp. enterica serovar Typhi str. Ty2
MSVSKKPMVLVILDGYGYREEQQDNAILNAKTPVMDALWAKRPHTLIDASGLEVGLPDRQMGNSEVGHVNLGAGRIVYQDLTRLDVEIKERTFFANPVLTNAVDQAKNAGKAVHIMGLLSAGGVHSHEDHIMAMVELAAERGAEKIYLHAFLDGRDTPPRSAEASLKKFEDKFAALGKGRVASIVGRYYAMDRDNRWDRVEKAYDLMTLAQGEFQADTAVAGLQAAYARDENDEFVKATVIRAEGQADAAMEDGDTLIFMNFRADRAREITRAFVNADFDGFARKKVVNLNFVMLTEYAADIKTAVAYPPASLANTFGEWMAKNDKTQLRISETEKYAHVTFFFNGGVEEPFAGEERILINSPKVATYDLQPEMSSAELTEKLVAAIESGKYDTIICNYPNGDMVGHTGVMEAAIKAVEALDNCIEQVTKAVESVGGQLLITADHGNAEQMRDPATGQEHTAHTNLPVPLIYVGEKNVKAVEGGKLSDIAPTMLSLMGMEIPQEMTGKPLFIVE

SEQ ID NO: 87134 - protein, 129 aa, Arabidopsis thaliana
MMNSCGIQQNAFEEMRRNAAVSDRRDAVICPKPRRVGALNHHSSRSLRWQLNHQMELCESNSGSEILDFILTKGGGGGGEQDQTRTVMTPPLFFTGSPPSRVSNPLTKDSLFREELLMGASPSPSTPRA

SEQ ID NO: 87135 - protein, 177 aa, Rhizobium leguminosarum bv. viciae 3841
MRIDAISIGNNPPEDVNVIVEVPVGGHPIKYEMDKEAGTLVVDRFLYTPMTYPGNYGFVPHTLSEDGDPIDVLIASTRPLVPGCVINVRPIGVLKMEDNSGKDEKIIAVPSPKLTLRYEKVKDYTDLPEITLKQIEHFFEHYKDLEPGKWVKIFGWGDSKEAGELILEAVERAKKKG

SEQ ID NO: 87136 - protein, 271 aa, Mesorhizobium loti MAFF303099
MTNRLVLAGCGNMGYAMLSGWLKSGKLAPSAVFVIEPNAELRQRAATLGCATSADAGEIPADAVPDLVVIAVKPQVIRDVTAAYKRFGDGRTTFVSIAAGTPVATFEDILGNRAPVVRCMPNTPASIGKGMMVVFSNPLVSDDTKRFVADLLSASGEVATIDDEGLMDAVTAVSGSGPAYIFHFIEALTVAAEKAGLPSATARLLAMQTVYGAASLAAESQEEPGVLRQQVTSPNGTTAAALAVLMGEDRLTNLLTQAVEAARLRSIELGK

SEQ ID NO: 87137 - protein, 489 aa, Neptuniibacter caesariensis
MSGSDKLNIFSFTGKMKILHMSWIAFFITFFVWFNHAPLLGAIAESLGLTKAEVKTLLILNVALTIPARIIIGMLTDKYGPRITYASLLFIASIPCFAFALSTDFAQAAISRFLLGFIGAGFVVGIRMVSEWFPANELGTAEGIYGGWGNFGSAAAAMSLPTLALIFGGEDGWRYAVGLTGLMSLIFSYIWYKNVSDTPKGSTYFKPKKIGGMEVTSKGDFYFMLVMKIPMYAALSLLTWKLSPAGVSILSESAAIAIYVSLAFILIYDCYSAYNVNKEIFVKPVPEVEQYKFKQVAVLNVLYFATFGSELAVVSMLPLFFSEVFELDMVYAGLLASAYAFMNLMSRPGGGWISDRFGRKKTLLILTAGLAAGYATMSMIDSSWPLFLAVAAAMACSFFVQAGEGAVFAVVPLIKRRLTGQIAGMTGAYGNVGAVFYLTVLSMVDYSTFFTVIAATAVLGFVALLMLEEPKGHMAEVNEDGTVELIKVN

SEQ ID NO: 87138 - protein, 80 aa, Glycine max
  misc_feature (43)..(43): Xaa can be any naturally occurring amino acid
  misc_feature (61)..(61): Xaa can be any naturally occurring amino acid
HVRDWKCADTSNDNGGVRVRVVEDVARVWFNELGLGRNAPVFXVHEVEDEVLPMLTVEDLXKDMGISVAGSSRKMCPAIQ

SEQ ID NO: 87139 - protein, 313 aa, Pseudomonas syringae pv. phaseolicola 1448A
MIGTPRSLDCEDAMTLQYQTIADCVGNTPLVRLQRMAGNTSNTLLLKLEGNNPAGSVKDRPALSMITRAELRGQIHPGDTLIEATSGNTGIALAMAAAIKGYRMILIMPDNSSAERKAAMTAYGAELISVSKDQGMEGARDLAERMQAEGRGKVLDQFANGDNPEAHYTSTGPEIWRQTGGTVTHFVSSMGTTGTIMGTSRYLKEQNPEVQIVGLQPMEGASIPGIRRWPHEYLPKIYQSDRVDRIIDMGQTEAEDTMRRLAREEGIFCGVSSGGSVAGALRISQEVENAVIVAIICDRGDRYLSTGVYDSPN

SEQ ID NO: 87140 - protein, 337 aa, Thermus thermophilus HB27
MKTYALVMAGGRGERLWPLSREDRPKPFLPLFEGKTLLEATLERLAPLVPPERTLLAVRRDQEAVARPYAHGIRLLLEPLGRDTAGAVLLGVAEALKEGAERLLVLPADHYVGDDEAYREALATMLEAAEEGFVVALGLRPTRPETEYGYIRLGPREGAWYRGEGFVEKLSYTKALEYIRKGYVWNGGVFAFAPATMAELFRRHLPSHHEALERLLAGASLEEVYADLPKISIDYGVMEKAEKVRVVLGRFPWDDVGNWRALERVFSQDPHENVVLGEGRHVALDTFGCVVYADRGVVATLGVSGLVVAKVGDEVLVVPKDRAREVREVVKRLEAQE

SEQ ID NO: 87141 - protein, 157 aa, Triticum aestivum
MLPAAMAAGFGRGRGLLPPHLLLASCRRFVKVPAAMAARLAQLRTKAAQAAEFASKHGGAYYKEAMEKNKQYVVQPPSVEKCQELSKQLFYTRLASLPGRYEALWKEVDGVKQLWKNRKELRVEDLGIATLFGVELYAWFCIGEIAGRGFTLTGYKV

SEQ ID NO: 87142 - protein, 395 aa, Thermus thermophilus HB27
METRTLEDWRALLEAEKTLDSGVYNKHDLLIVRGQGARVWDAEGNEYIDCVGGYGVANLGHGNPEVVEAVKRQAETLMAMPQTLPTPMRGEFYRTLTAILPPELNRVFPVNSGTEANEAALKFARAHTGRKKFVAAMRGFSGRTMGSLSVTWEPKYREPFLPLVEPVEFIPYNDVEALKRAVDEETAAVILEPVQGEGGVRPATPEFLRAAREITQEKGALLILDEIQTGMGRTGKRFAFEHFGIVPDILTLAKALGGGVPLGVAVMREEVARSMPKGGHGTTFGGNPLAMAAGVAAIRYLERTRLWERAAELGPWFMEKLRAIPSPKIREVRGMGLMVGLELKEKAAPYIARLEKEHRVLALQAGPTVIRFLPPLVIEKEDLERVVEAVRAVLA

SEQ ID NO: 87143 - protein, 317 aa, Saccharomyces cerevisiae
MSSSSQFKQLEKLGNGTYATVYKGLNKTTGVYVALKEVKLDSEEGTPSTAIREISLMKELKHENIVRLYDVIHTENKLTLVFEFMDNDLKKYMDSRTVGNTPRGLELNLVKYFQWQLLQGLAFCHENKILHRDLKPQNLLINKRGQLKLGDFGLARAFGIPVNTFSSEVVTLWYRAPDVLMGSRTYSTSIDIWSCGCILAEMITGKPLFPGTNDEEQLKLIFDIMGTPNESLWPSVTKLPKYNPNIQQRPPRDLRQVLQPHTKEPLDGNLMDFLHGLLQLNPDMRLSAKQALHHPWFAEYYHHASMGGSRSHHHHHH

SEQ ID NO: 87144 - protein, 465 aa, Ustilago maydis 521
MAHLRLATSAATLAATINNTRITINNTRSVFASFPSQTQSGVAQVWVSTRVAARTFSCSVNRTAKSYRLNKMPPKKQAVVEKIRLGRPSNNLKMGIVGLPNVGKSSLFNVIAKCDLGKSANFPYATIEPEEARVPVPDDRFTWLANHYKPKSEVPAFLTCIDIAGLTAGASTGAGLGNAFLSNVRSVDGIFQVVRAFDDAEVIHVEGDVNPIRDMEIISTELRLKDIDWIEKALDNSKKNARSAGNVSLEDKKRKEEVGIIEKLLKHVQEDNKDIRKGDWTNNEVEVINNLQLLTAKPVIYLVNLSERDYVRKKNKWLAKIKAWIDENNPGDLLIPFSVALEERLLALGSPEAEAAELATLGDNITGALGKITKAGYDGLDLVRYFTAGPDEVRAWTFRKGLKAPEAAGIIHTDFQKKFVCGEVFSIDDIKEHGTEAAVKAAGKYKQIGREYKVQDGDICYWKHG

SEQ ID NO: 87145 - protein, 233 aa, Triticum aestivum
MDQQEEEASVSVSSVPPEEEEEQDEEEEEQEEEEEDMGAVKMALGPQVPLKDLLHLHLHKEEEGEEDYSLRRWKEQLLGPDAVHTTNLLLALGAETVEPEVAILNLTILAPGRPDLVLPIPFVPDDKGHAFTLKDGTAYSFRFSFTVSNNIVSGLNYSHTVWKTGVKVENQKVMLGTFSPQQEPYTYKAEEDSTPSGIFARGSYSARLKFVDDDGKVYLDMRYSFEIRKDWPA

SEQ ID NO: 87146 - protein, 464 aa, Mycobacterium smegmatis str. MC2 155
MTHFDVVVLGAGPGGYVAAIRAAQLGLNTAIVEPKYWGGVCLNVGCIPSKALLRNAEIAHMFNKEAKTFGISGEATFDYGAAFDRSRKVADGRVAGVHFLMKKNKITEIHGYGKFTGPNSLEVALNDGGTEKVEFSNAIIATGSSTRLVPGTSLSENVVTYETQILSRELPGSIIIAGAGAIGMEFAYVLKNYGVDVTIVEFLPRALPNEDAEVSKEIEKQYKKLGVKILTGTKVEGIADDGSTVKVTVSKDGKTEELKADKVLQAIGFAPNVEGYGLEAAGVELTDRKAIGIDDYMRTNVGHIYAIGDVTGKLQLAHVAEAMAVVAAETIAGAETLPLGDYRMMPRATFCQPQVASFGLTEEQARDEGYDVKVAKFPFTANGKAHGLADPTGFVKLIADAKYGELLGGHLIGPDVSELLPELTLAQKWDLTVNELARNVHTHPTLSEALQECFHGLAGHMINF

SEQ ID NO: 87147 - protein, 116 aa, Brassica napus
MSSSNCPSPLPTVTKLQVDSVTFPPSVISPASSNPLFLGGAGVRGLDIQGKFVIFTVIGVYLDPVSVTSLSVKWKGKTTEELTESVPFFREIVTGSFEKFIKVTMKLPLTGQQYSE

SEQ ID NO: 87148 - protein, 629 aa, Salmonella enterica subsp. enterica serovar Typhi str. Ty2
MAEFETTFADLGLKAPILEALTDLGYEKPSPIQAECIPHLLGGRDVLGMAQTGSGKTAAFSLPLLNNLDPELKAPQILVLAPTRELAVQVAEAMTDFSKHMRGVNVVALYGGQRYDVQLRALRQGPQIVVGTPGRLLDHLKRGTLDLSKLSGLVLDEADEMLRMGFIEDVETIMAQIPEGHQTALFSATMPEAIRRITRRFMKEPQEVRIQSSVTTRPDISQSYWTVWGMRKNEALVRFLEAEDFDAAIIFVRTKNATLEVAEALERNGYNSAALNGDMNQALREQTLERLKDGRLDILIATDVAARGLDVERISLVVNYDIPMDSESYVHRIGRTGRAGRAGRALLFVENRERRLLRNIERTMKLTIPEVELPNAELLGKRRLEKFAAKVQQQLESSDLDQYRALLAKIQPSAEGEELDLETLAAALLKMAQGERPLILPPDAPMRPKREFRDRDDRGPRDRNDRGPRGDREERPRRERRDVGDMQLYRIEVGRDDGVEVRHIVGAIANEGDISSRYIGNIKLFASHSTIELPKGMPGEVLQHFTRTRILNKPMNMQLLGDAVPHAGGERRGGGRSFSGERREGGRNFSGERREGGRGDGRRFSGERRESRGPRRDDSTGRRRFGGDA

SEQ ID NO: 87149 - protein, 207 aa, Brassica napus
  misc_feature (190)..(190): Xaa can be any naturally occurring amino acid
MDSHSSHLNAANRSRSSQTPSPSHSASVSSSLHKRKLAASEDHAPPSSNDDLESISAARGADSGSDPDESEDAVHDGYEEDFAPEPDQDSSIRTFTAARLDPISGVNGSSRNAKIKTEEISTVELEAGTGTAGAIVPKDESAKILTCGAYIAREEALRIEEDAGRLKFVCYSNDGVDDHMMCLIGLKNIXARQLPNMPKEYMFASHG

SEQ ID NO: 87150 - protein, 150 aa, Physcomitrella patens subsp. patens
ASESDDETEARSPPTEKVQRLAEDISKLSLLEVSDLTTLLRRKLGLPEGMGMMSMGMMPGMQMGGASVAPAAVEEAKAEKTAFDVKLEKFDAGSKIKIIKEVRTFTNLGLKEAKELVEKAPIVLKSGVGKEEAEQIVEKLKSVGATALME

SEQ ID NO: 87151 - protein, 507 aa, Streptomyces coelicolor A3(2)
MSSSNPLRDPADRRLPRIAGPSGLVIFGVTGDLSRKKLMPAVYDLANRGLLPPGFSLVGFARRDWEHEDFAQVVHDAVKEHSRTPFREEVWQQLIQGMRFVQGTFDDDDAFERLRGTIEELDKAQGTGGNFAFYLSVPPKSFPVVIQQLKKHGLADQTNGSWRRAVIEKPFGHDLKSAEELNAIVHEVFGSDQVFRIDHYLGKETVQNILALRFANTMFEPIWNRSYVDHIQITMAEDIGIGGRAGYYDGIGAARDVIQNHLLQLLALTAMEEPASFDADALAAEKTKVLGAVRLPKDLGRDTVRGQYAAGWQGGAKAVGYLEEDGIDPKSKTDTYAAIKVGIDNRRWAGVPFYLRTGKRLGRRVTEIAVVFQRAPHSPFDTTATEELGSNAIVIRVQPDEGVTVRFGSKVPGTSMEIRDVSMDFAYGESFTESSPEAYERLILDVLLGDANLFPRTEEVELSWKILDPIEEYWDEHGTPAQYPAGTWGPVEADDMLERDGRSWRRP

SEQ ID NO: 87152 - protein, 468 aa, Salmonella enterica subsp. enterica serovar Typhi str. Ty2
MIHGPLELILNRLPSSASALACSAHALNLIEKRTLNHEEMKALNREVIDYFKEHVNPGFLEYRKSVTAGGDYGAVEWQAGSLNTLVDTQGQEFIDCLGGFGIFNVGHRNPVVVSAVQNQLAKQPLHSQELLDPLRAMLAKTLAALTPGKLKYSFFCNSGTESVEAALKLAKAYQSPRGKFTFIATSGAFHGKSLGALSATAKSTFRRPFMPLLPGFRHVPFGNIDAMSMAFSEGKKTGDEIAAVILEPIQGEGGVILPPQGYLTEVRKLCDEFGALMILDEVQTGMGRTGKMFACEHENVQPDILCLAKALGGGVMPIGATIATEEVFSVLFDNPFLHTTTFGGNPLACAAALATINVLLEQNLPAQAEQKGDTLLDGFRQLAREYPNLVHEARGKGMLMAIEFVDNETGYRFASEMFRQRVLVAGTLNNAKTIRIEPPLTLTIELCEQVLKSARNALAAMQVSVEEV

SEQ ID NO: 87153 - protein, 551 aa, Streptomyces coelicolor A3(2)
MNADGRTRLHQTPEWAALVKHREQLGEVRLREMFAADPGRGTGWTLRVGDLHVDYSKHLVTDETLALLQELAAATGVSGLRDAMFRGERINITEDRAVLHTALRAPRDAVIEVDGENVVPQVHAVLDKMAGFADRVRTGEWTGHTGRRIRNVVNIGIGGSDLGPAMAYEALRAFTDRSLTLRFVSNVDGADLHEAVRDLDPAETLFIIASKTFTTIETITNATSARSWLLAGLGGDEKAVAKHFVALSTNAEKVADFGIDTANMFEFWDWVGGRYSFDSAIGLSLMIAIGPDRFREMLDGFHLVDEHFRTAPAESNVPLLMGLLGVWYGSFLGAQSHAVLPYSHYLSKFTAYLQQLDMESNGKSVDREGKPVQWQTGPVVWGTPGTNGQHAYYQLIHQGTKLIPADFIGFARPVDELSEELKSQHDLLMANFFAQTQALAFGKTPDEVRAEGVPEELVPHKTFPGDHPTTTILARELTPSVLGQLVALYEHKVFVQGAIWNIDSFDQWGVELGKVLAKRVEPALTEGADVPGLDPSTGALVAAYRELRGRR

SEQ ID NO: 87154 - protein, 489 aa, Mesorhizobium loti MAFF303099
MTSQIIPVDPFDFIIFGGTGDLSERKLLPSLYYRQRDHQFSEPTRIIGTSRSKMSDEEFRAFASQAISDHVKPADIDAKELKTFLARLSYISADATSGAGFDKLKKAIGESESIRAFYLAVAPALFGDISHKLKENKLITPNSRIVLEKPIGRDLASARALNDLVGDDFHESQIFRIDHYLGKETVQNLMALRFANALYEPLWNSAHIDHVQITVAETVGLEDRVTYYDKAGALRDMVQNHMLQLLCLVAMEAPSSMDADAVRDEKLKVLRALKRINGNEAPKHTVRGQYRAGASAGGPVKGYVEELGKDSNTETFVAIKAEIGTWRWAGVPFYLRTGKRLATRVSEIVIEFKPIPHSIFGDSAGPIFANQLVIRLQPDEGVKQFIMIKDPGPGGMRLRQISLDMSFAQSFDGRAPDAYERLIMDVIRGNQTLFMRRDEVEAAWKWIDPIQNAWEGAKQEAQGYTAGTWGPSASIALIERDGRTWHESN

SEQ ID NO: 87155 - protein, 330 aa, Vitis vinifera
MASFSRIGVSSEVGGVRSSSGGDDGVGTLMEFVGKRGVDVGDELVVLFHHIQYACKRIAALVASPFNSTLGKHSGLGGGGGAGGSDRDAPKPLDIVSNEIILSSLRNSGKVAVMASEEDDFPVWISDDGPFVVVTDPLDGSRNIDASIPTGTIFGIYNRLVELDHLPKEEKTMLNSLQSGLKLVAALLFMMMASVLSGQIYSVNDARYFDWPQGLRQYIDTVRQGKGKYPKKYSARYICSLVADFHRTLMYGGVAMNPRSHLRLVYEANPLSFLVEQAGGRGSDGKIRILSIQPVKLHQRLPLFLGSPEDIEELESYGNVQQKVNPGYEV

SEQ ID NO: 87156 - protein, 577 aa, Streptococcus agalactiae NEM316
MTEMLKGIAASDGVAVARAYLLVQPDLSFETVTVEDTNAEEARLDVALQASQDELSVIREKAVESLGEEAAAVFDAHLMVLSDPEMINQIKETIRAKQVNAETGLKEVTDMFITIFEGMEDNPYMQERAADIRDVAKRVLAHLLGVKLPNPATINEESIVIAHDLTPSDTAQLNKQFVKAFVTNIGGRTSHSAIMARTLEIAAVLGTNDITERVQDGQLIAVNGITGEVIIEPTEAQISAFKAAGEAYAKQKAEWALLKDAQTVTADGKHFELAANIGTPKDVEGVNENGAEAVGLYRTEFLYMDSQDFPTEDEQYEAYKAVLEGMNGKPVVVRTMDIGGDKELPYFDLPKEMNPFLGFRALRISISETGDAMFRTQIRALLRASVHGQLRIMFPMVALLKEFRAAKAIFEEEKANLLADGVAVAEGIEVGIMIEIPAAAMLADQFAKEVDFFSIGTNDLIQYTMAADRMNEQVSYLYQPYNPSILRLINNVIKAAHAEGKWAGMCGEMAGDQTAVPLLVGMGLDEFSMSATSVLRTRSLMKKLDTAKMEEYANRALSECSTMEEVIELQKEYVDFD

SEQ ID NO: 87157 - protein, 475 aa, Streptococcus agalactiae NEM316
MTKEYQNYVNGEWKSSVNQIEILSPIDDSSLGFVPAMTREEVDHAMKAGREALPAWAALTVYERAQYLHKAADIIERDKEEIATVLAKEISKAYNASVTEVVRTADLIRYAAEEGIRLSTSADEGGKMDASTGHKLAVIRRQPVGIVLAIAPYNYPVNLSGSKIAPALIGGNVVMFKPPTQGSVSGLVLAKAFAEAGLPAGVFNTITGRGSEIGDYIVEHEEVNFINFTGSTPVGQRIGKLAGMRPIMLELGGKDAGIVLADADLDNAAKQIVAGAYDYSGQRCTAIKRVLVVEEVANELAEKISENVAKLSVGDPFDNATVTPVIDDNSADFIESLVVDARQKGAKELNEFKRDGRLLTPGLFDHVTLDMKLAWEEPFGPILPIIRVKDADEAVAIANKSDFGLQSSVFTRDFQKAFDIANKLEVGTVHINNKTGRGPDNFPFLGLKGSGAGVQGIRYSIEAMTNVKSIVFDMK

SEQ ID NO: 87158 - protein, 442 aa, Oryza sativa Japonica Group
RVADSCGLLCGRRSRPFRAMASRRQWGAGAGAVDVPAQERKGEAAKIARRPKTTTVVAQQPPRIRRALADVSNLVNGRAALPVVNRQKAAAAAADKCRKPIKQRNENNKAAKPEVIVISSDSEKHKKNPAQRAASRRAPIQTLTSILTKCSRASDGVISPKKELIYDIDASDSHNELAVVDYVEDIYRFYRNTENTYRPLCTYMVSQTEINERMRAILTDWLIEVHYRLMLMPETLYLTVYIIDQYLSLENVPRKELQLVGVSAMLIACKYEETWAPLVKDFLVISDNSFSRQQVLSTEKSILNKLQWNLTVPTMYMFILRYLKAALGDEELEHMTFFYAELALVQYSMLFFAPSVIAAAAVYAARCTLGLSPLWSDLLEYHTGLAEPQLLECARRLVSLHAAAPESRQKVVYKKYASPKLGAVSLHSPAKKLLPPPSPVAA

SEQ ID NO: 87159 - protein, 479 aa, Oryza sativa Japonica Group
MNVLASKIFPSRSNVASEQQQSKREKATIDDAKNSSKNKNLDRSVDESVLGIILGGGAGTRLYPLTKKRAKPAVPLGANYRLIDIPVSNCLNSNISKIYVLTQFNSASLNRHLSRAYGNNIGGYKNEGFVEVLAAQQSPDNPNWFQGTADAVRQYLWLFEEHNVMEFLILAGDHLYRMDYEKFIQAHRETDSDITVAALPMDEKRATAFGLMKIDEEGRIVEFAEKPKGEQLKAMMVDTTILGLDDVRAKEMPYIASMGIYVISKNVMLQLLREQFPGANDFGSEVIPGATNIGMRVQAYLYDGYWEDIGTIEAFYNANLGITKKPVPDFSFYDRSAPIYTQPRHLPPSKVLDADVTDSVIGEGCVIKNCKIHHSVVGLRSCISEGAIIEDSLLMGADYYETEADKKLLGEKGGIPIGIGKNCHIRRAIIDKNARIGDNVKIINVDNVQEAARETDGYFIKSGIVTVIKDALLPSGTVI

SEQ ID NO: 87160 - protein, 209 aa, Streptococcus agalactiae NEM316
MRKKPIIIGVTGGSGGGKTSVSRAILSNFPDQKITMIEHDSYYKDQSHLTFEERVKTNYDHPLAFDTNLMIEQLNELIEGRPVDIPVYDYTKHTRSDRTIRQDPQDVIIVEGILVLEDQRLRDLMDIKLFVDTDDDIRIIRRIKRDMEERDRSLDSIIEQYTEVVKPMYHQFIEPTKRYADIVIPEGVSNIVAIDLINTKVASILNEAK

SEQ ID NO: 87161 - protein, 538 aa, Desulfococcus oleovorans Hxd3
MPVIESAVDVTSEAFAQNREAMESLVADLKREIDRAHHERSPKAMDRLKEVDKLPADKKLDLLLDKNTPFLEIAPLAAKDLYDGKVHGAGIRAGIGIVAGREVVVSVNDATIKGGSMYPMSVKKTLRLQAICMENRLPAVNLMDSAGAFLPLQSEIFPDLDDGGRVFYNQAMMSKMAIPQITAVMGLCTAGGAYGAAMSDEIIHVKGHGAIFLGGPPLVLAATGEEVTSDELGGPDLHCAQSGVSDYYAEDDAHAIALVREIVANLPRPEKARLTLRPPAPPLYDPKELYGIIPRNISTPYDIREVFARMVDGSEFIEFKEMYGPTLVCGWAHIHGYPVGLLGNNGVLFPQSAQKATQFIQICDNRGIPLVFVQNISGFIVGKQYEQTGVTKDGHKMVNAVATASVPKFTLLAGASFGAGNYAMCGRAYSPRFLWMWPNAEIGVMGGQQAADVLVTITNDQNARLGKPPLTPEEEAFIRQPIIDKARQEGNAYYSTANLWDDGILDPAKTRDVLGMAISAALNAPLRDDRYGFGVFRM

SEQ ID NO: 87162 - protein, 263 aa, Cladonia mitis
  misc_feature (1)..(1): Xaa can be any naturally occurring amino acid
  misc_feature (6)..(6): Xaa can be any naturally occurring amino acid
XEHGAXKVVAVNDPFIEPHYAAYMLKYDSQHGQFKGTIEVEGSDLIVNGQKVKFYTEKDPGAIPWKDTGAYYIVESTGVFTTTEKAKAHLKGGAKKVVISAPSADAPMFVMGVNEETYKSDIEVISNASCTTNCLAPLAKVMHDNFTIIEGLMTTIHSYTATQKTVDGPSAKDWRGGRTAAQNIIPSSTGAAKAVGKVIPSLNGKLTGMSMRVPTSNVSVVDLTCRLEKSVTYDEIKEAMKKASDGELKGIMAYSEDDLVSTD

SEQ ID NO: 87163 - protein, 497 aa, Coxiella burnetii RSA 493
MRTSHQNQPSSPFLLPPDVLPLIFYGLTPVDLARLFVVAKGARPWFETFFASDTDYKAYLQLNIPQLFMVIGNNLFFDYSLVWIARAGVWGWGNNYTGQLDFGNIHEMTKPARIPLDSFIPEMAPDDYVVQFASADFLSGKARSLVATRQGQLHEYYWERISNTRSEFIQHRHYELNVTIVQLLSDYRHAFILTEEGGIYGWGFNISGELGLGDRFERSQPTELPQNFFPYLLERGDRIVQLNFADRYLVARTAQGHVYVWGFNYRGRLGLDDEQDRLHPVELSWDFFPEWHPDDYIIQVVVGDRHTLALTQLGYIYAWGKNSYGQLGFRDQQDRNRPALLPWNRFPGLLERNDRIIELIAGGARSLARTEQGFIYIWGARWLLVRGDPEFRHHPMLLTENYFPGLRRRGDHLVELIAGPDHTLARTEQGYIYAWGRNYYGQLGLGDRRIQRQPALLDPNAIPPLSQWRNAFSFIKSFREEKIEDTDSFSYAPFSRK

SEQ ID NO: 87164 - protein, 278 aa, Cladonia mitis
VEHGAVKVVAVNDPFIEPHYAAYMLKYDSQHGQFKGTIEVEGSDLIVNGQKVKFYTEKDPGAIPWKDTGAYYIVESTGVFTTTEKAKAHLKGGAKKVVISAPSADAPMFVMGVNEETYKSDIEVISNASCTTNCLAPLAKVMHDNFTIIEGLMTTIHSYTATQKTVDGPSAKDWRGGRTAAQNIIPSSTGAAKAVGKVIPSLNGKLTGMSMRVPTSNVSVVDLTCRLEKSVTYDEIKEAMKKASDGDLKGIMAYSEDDLVSTDLNGDNHSCIFDAKAG

SEQ ID NO: 87165 - protein, 517 aa, basidiomycete PM1
MAKFQSLLTFITLSLVASVYASIGPVADLTISNGAVSPDGFSRQAILVNDVFPSPLITGNKGDRFQLNVIDNMTNHTMLKSTSIHWHGFFQHGTNWADGPAFVNQCPISTGHAFLYDFQVPDQAGTFWYHSHLSTQYCDGLRGPIVVYDPQDPHKSLYDVDDDSTVITLADWYHLAAKVGPAVPTADATLINGLGRSINTLNADLAVITVTKGKRYRFRLVSLSCDPNHTFSIDGHSLTVIEADSVNLKPQTVDSIQIFAAQRYSFVLNADQDVDNYWIRALPNSGTRNFDGGVNSAILRYDGAAPVEPTTTQTPSTQPLVESALTTLEGTAAPGNPTPGGVDLALNMAFGFAGGRFTINGASFTPPTVPVLLQILSGAQSAQDLLPSGSVYSLPANADIEISLPATSAAPGFPHPFHLHGHTFAVVRSAGSSTYNYANPVYRDVVSTGSPGDNVTIRFRTDNPGPWFLHCHIDFHLEAGFAVVMAEDIPDVAATNPVPQAWSDLCPTYDALSPDDQ

SEQ ID NO: 87166 - protein, 393 aa, Streptococcus thermophilus CNRZ1066
MTKLSNRVLQMEESVTLAASARAKALKAKGRDILSLTLGEPDFVTPKNIQEAAIASIENGKASFYTVASGLPELKDAVSTYMENFYGYTVKHSEIVVGTGAKFILYAFFATVINPGDEVIIPTPCWVSYVDQVKMVEGVPVTFQTTEANHFKATVEQLEAARTEKTKVVLLNSPSNPTGMIYSKEELQSIGDWAVEHDILILADDIYGRLVYNGNTFTPISSLSDAIRKQTIVINGVSKTYAMTGWRVGFAVGEPEIISGMAKIISQTTSNLTSVSQYAAIEALTGDQSSIEEMRKAFEERLNTIYPLLAEVPGFEVIKPQGAFYLFPNVKKAMEIKGYTDVNDFTNAILEEAEVALVTGAGFGAPENIRLSYATDLDILKEAVRRIKAFMEK

SEQ ID NO: 87167 - protein, 309 aa, Coxiella burnetii RSA 493
MSQSHQRTAIIGECLIELTPKNGKDFSLNFAGDTLNTAVYLVRSLSKTTMVTVDYVTALGADTFSHEMLNQWLGEGIGVSLVRQIPDKLPGLYLIRNDEKGERYFYYYRSQSAARALFEREEGDRLCQKLLEFDNLYLSGITLAMLYETGCDKLLDCLKVAHKKGKTICFDTNFRAHLWPNLDSARAIIEEILKLTTIGLPSFSDEKTLFGDKSPKETAERFHRYGVKEVVVKQGENGYWLSDETGEKQVAIERATKVIDTTGAGDAFNGAYLAARFEGLNSETASQKAAHLAATVVAYRGAIIPITRQ

SEQ ID NO: 87168 - protein, 259 aa, Zea mays
  misc_feature (247)..(247): Xaa can be any naturally occurring amino acid
SSRLLPPPPSSQGPSSPRRRQSPSPAASAVLQGKKKEGNAAKYITRTKAVKYLQISLAVFRKLCILKGVFPREPKKKVEGNHKTYYHMKDIAFLAHDPLIEKFREIKVHRKKVKKAMAKKNRDLADRLLNRPPTYKLDRLIIERYPSFVDALRDLDDCLTMVHLFAALPAIEGERVQVQRIHNCRRLSHEWQAYISRTNSLRKTFISVKGIYYQAEVQGQKITWLTPHALQQVLTDDVDFNVMLTFXEFYETLLGFVNF

SEQ ID NO: 87169 - protein, 196 aa, Vitis vinifera
MAGALLGTCFSSASLSINTREFRIGSSASTPPSKPNFTCFRVRAIKEKTEEIRTPSPSPSSSPSAQEITEKFGLEAGLWKIFSSKDEEKEGGKREKSKGEEAKELLAKYGGAYLATSITLSLISFSLCYALINAGVDVQALLQKVGISVDATGEKVGTFALAYAAHKAASPIRFPPTVALTPIVASWIGKIVDKEN

SEQ ID NO: 87170 - protein, 316 aa, Bacillus licheniformis ATCC 14580
MNEAANVELDAVEMRQAYSSAVYELAQENTDIVALEADLMSSISMDKVKRRIPEQVINCGVMEANMIGIAAGLSLTGRIPFVHTFAQFATRRCFDQLFVSGAYAKTNIKILGSDSGITAEHNGGTHMAFEDLGLARLIPNAFVYEASDAAMLKFLIKKAAAEYGIHYIRTIRKKAVRLYDEHETFADGKAKVLKDGSDAALFASGIMVAEALQAAELLKEKGIDAAVIDMYCIKPIDQETVVRYAQKTNAIVTAENHNVIGGLGSAVAEVLSEHYPAPLKRIGVHEAFGQVGTIDYLKKSYRLTAEHIALAAEQLV

SEQ ID NO: 87171 - protein, 488 aa, Artemisia annua
MALSLTTSIALATILLFVYKFATRSKSTKKSLPEPWRLPIIGHMHHLIGTTPHRGVRDLARKYGSLMHLQLGEVPTIVVSSPKWAKEILTTYDISFANRPETLTGEIVLYHNTDVVLAPYGEYWRQLRKICTLELLSVKKVKSFQSLREEECWNLVQEIKASGSGRPVNLSENVFKLIATILSRAAFGKGIKDQKELTEIVKEILRQTGGFDVADIFPSKKFLHHLSGKRARLTSLRKKIDNLIDNLVAEHTVNTSSKTNETLLDVLLRLKDSAEFPLTSDNIKAIILDMFGAGTDTSSSTIEWAISELIKCPKAMEKVQAELRKALNGKEKIHEEDIQELSYLNMVIKETLRLHPPLPLVLPRECRQPVNLAGYNIPNKTKLIVNVFAINRDPEYWKDAEAFIPERFENSSATVMGAEYEYLPFGAGRRMCPGAALGLANVQLPLANILYHFNWKLPNDVSYDQIDMTESSGATMQRKTELLLVPSF

SEQ ID NO: 87172 - protein, 258 aa, Streptomyces coelicolor A3(2)
MTTRTPLMAGNWKMNLNHLEAIAHVQKLAFALADKDYDAVEVAVLAPFTDLRSVQTLVDGDKLKIKYGAQDISAHDGGAYTGEISGPMLAKLKCTYVAVGHSERRQYHAETDEIVNAKVKAAYKHGLTPILCVGEELDVREAGNHVEHTLAQVEGGLKDLAAEQAESVVIAYEPVWAIGTGKVCGADDAQEVCAAIRGKLAELYSQELADKVRIQYGGSVKSGNVAEIMAKPDIDGALVGGASLDSDEFVKIVRFRDQ

SEQ ID NO: 87173 - protein, 223 aa, Populus trichocarpa
MTKQQARFEPYDFNGGTCVAIAGADYCVVAADTRMSTGYNILTRDYSKICKLADKCLMASSGFQADVKALQKVLGAKHLIYQHQHNKQMSCPAMARLLSNTLYYKRFFPYYTFNVLVGFDEEGKGCVYTYDAVGSYEKVGYSAQGSGAKLIMPVLDNQLKSPSPLLLPALDAVTPLTEAEAIDVVKDVFASATERDIYTGDKLEIVIVNADGIRREYAELRKD

SEQ ID NO: 87174 - protein, 403 aa, Streptomyces coelicolor A3(2)
MKTIDELLSEGVAGKRVFVRADLNVPLDGTTITDDGRIRAVVPTVKALADAGARVIVASHLGRPKGAPDPAFSLAPAAARLGELLGADVAFAEDTVGSSAEAVVTGLADGGVAVIENLRFNAGETSKDDAERAAFADKLAGLADVYVGDGFGAVHRKHASVFDLPKRLPHYAGYLIATEVGVLKKLTDEVKRPYVVALGGAKVSDKLAVIDQLLGKADRLLIGGGMAYTFLKAKGYEVGISLLQEDQIPAVKEYIERAEKNGVELVLPVDVLVAPEFPDLKTKAPANPTTVAADAIPADQEGLDIGPETRKLYASKLADAGTVFWNGPMGVFEHPDYAEGTKAVAQALVDAPGFTVVGGGDSAAAVRTLGFDENAFGHISTGGGASLEYLEGKTLPGLAALED

SEQ ID NO: 87175 - protein, 336 aa, Streptomyces coelicolor A3(2)
MTIRVGINGFGRIGRNYFRALLEQGADIEIVAVNDLGDTATTAHLLKYDTILGRLKAEVSHTEDTITVDGKTIKVLSERNPADIPWGELGVDIVIESTGIFTKKADAEKHIAGGAKKVLISAPAKDEDITIVMGVNQDKYDPANHHVISNASCTTNCVAPMAKVLDENFGIVKGLMTTVHAYTNDQRILDFPHKDLRRARAAAENIIPTTTGAAKATALVLPQLKGKLDGIAMRVPVPTGSATDLVVELQREVTKDEVNAAFKKAADDGDLKGILFYTEDAIVSSDITGDPASCTFDSSLTMVQEGKSVKILGWYDNEWGYSNRLVDLTVFVGNQL

SEQ ID NO: 87176 - protein, 166 aa, Betula platyphylla
AGVISFTTRLLVPTSRIGCLIGKGGAIVTEMRRLTKANIRILSKENLPKVASEDDEMVQISGDLDVAKDALMQVVTRLRANLFDREGAVSTFLPVLPYLPVSADGSDGFNYESRDSKRHGRGHSYSSGYGGSSDLAAADSYGSYGGSQIGGSGSAYGAYGGHPSGR

SEQ ID NO: 87177 - protein, 809 aa, Saccharomyces cerevisiae YJM789
MSSVEELTQLFSQVGFEDKKVKEIVKNKKVSDSLYKLIKETPSDYQWNKSTRALVHNLASYVKGTDLPKSELIVNGIINGDLKTSLQVDAAFKYVKANGEASTKMGMNENSGVGIEITEDQVRNYVMQYIQENKERILTERYKLVPGIFADVKNLKELKWADPRSFKPIIDQEVLKLLGPKDERDLIKKKTKNNEKKKTNSAKKSSDNSASSGPKRTMFNEGFLGDLHKVGENPQAYPELMKEHLEVTGGKVRTRFPPEPNGYLHIGHSKAIMVNFGYAKYHNGTCYLRFDDTNPEKEAPEYFESIKRMVSWLGFKPWKITYSSDYFDELYRLAEVLIKNGKAYVCHCTAEEIKRGRGIKEDGTPGGERYACKHRDQSIEQNLQEFRDMRDGKYKPGEAILRMKQDLNSPSPQMWDLIAYRVLNAPHPRTGTKWRIYPTYDFTHCLVDSMENITHSLCTTEFYLSRESYEWLCDQVHVFRPAQREYGRLNITGTVLSKRKIAQLVDEKFVRGWDDPRLFTLEAIRRRGVPPGAILSFINTLGVTTSTTNIQVVRFESAVRKYLEDTTPRLMFVLDPVEVVVDNLSDDYEELATIPYRPGTPEFGERTVPFTNKFYIERSDFSENVDDKEFFRLTPNQPVGLIKVSHTVSFKSLEKDEAGKIIRIHVNYDNKVEEGSKPKKPKTYIQWVPISSKYNSPLRVTETRVYNQLFKSENPSSHPEGFLKDINPESEVVYKESVMEHNFGDVVKNSPWVVDSVKNSEFYVEEDKDSKEVCRFQAMRVGYFTLDKESTTSKVILNRIVSLKDATSK

SEQ ID NO: 87178 - protein, 395 aa, Ananas comosus
MEKGSAESVLSCVHCGKPAHLQCPKCVELKLPREGAAFCSQDCFKVAWSSHKSVHAKLATAASDVSSEQSDEGWQYCLRKGQMRTSKLPYFDWTGPLRPYPISKMREVPEGIEKPDWAVDGIPKIEPNSDLQTRVEIKTPEQIERMRETCRIAREVLDAAARVIQPGITTDEIDRVVHEATIAAGGYPSPLNYHFFPKSCCTSVNEVICHGIPDARKLEDGDIVNVDVTVYYKGVYGDLNETYFVGKVDEASQQLVRCTYECLEKAISIVKPGVRFREVGEVINRHASMSGLSVVKSYCGHGIGELFHCAPNIPHYGRNKAVGVMKAGQTFTIEPMINAGVWRDRLWPDGWTAATADGKRSAQFEHTLLVTETGVEVLTARLPSSPNVFPWLNSS

SEQ ID NO: 87179 - protein, 301 aa, Azoarcus sp. BH72
MKKVTKAVFPVAGMGTRFLPATKASPKEMLPVVDKPLIQYAVEEAVAAGITDMIFITGRTKRAIEDHFDKAYELETELEARGKKELLEVVAKTVPKGMNCVYIRQSEALGLGHAVLCASAVVGDDEPFAVILADDLLDNHGGKPVMAQMSEVYNYHRCSVLGTMNVPRQETRQYGIVSTESQSGNIQRVTGIVEKPKPEEAPTTQAVVGRYILTPRIFEHLRALKPGAGGELQLTDAIASLLKEEAVLSYQYEGVRYDCGSKLGYLKAAVEFGLRHHEVGAEFAAYLNDRFPGELAKKKEK

SEQ ID NO: 87180 - protein, 105 aa, Brassica napus
  misc_feature (26)..(26): Xaa can be any naturally occurring amino acid
  misc_feature (60)..(60): Xaa can be any naturally occurring amino acid
  misc_feature (67)..(67): Xaa can be any naturally occurring amino acid
GRGTPTRTGDHSECATIKDVWNKKRXWEEYSEEEKQDTDPYVEIDENTIQHFSHINHYIXRIHVNGXSCMNEQKRCYACIHPIGVYSFLNSMKWKGIILTGRSVL

SEQ ID NO: 87181 - protein, 230 aa, Xanthomonas axonopodis pv. citri str. 306
MTNLDSPITNPELLPMSEAKRLAAEKAIDYVEDGMIVGVGTGSTVAYFIDALGRIGHRIKGAVSSSEQSTARLRQHGIEVLDLNHTGNLSLYVDGADECDPNRCLIKGGGAALTREKIIAEASERFICIVDPSKQVPVLGKFPLPVEVIPMARSLVARQILALTGGQPVWRDGVVTDNGNVVLDVHHLQVTDPVGLERSLNQIPGVVCVGLFARRPADVVIVGGEPPQVI

SEQ ID NO: 87182 - protein, 424 aa, Azoarcus sp. BH72
MITSSPFSTAPRRAFAGVNCSKVNPDLDRLQTYPFEKLRELFRGVTPPAALAPIRLSIGEPQHPTPAFIKEALVSNLDGLSVYPNTPGSDALRGSIASWLQRRYGLPAFNAATQVIPVNGTREALFAFAQCVVDRSRAGAKVLCPNPFYQIYEGAALLAGADPIFLNNLPENRFGSDFDSVPEQVWREVQLVYVCSPGNPTGRVLGFDEWKRLFELSDRYGFVIAADECYSEIYFDDEARPIGGLEAAHRLGRSDFRNVVMFSSLSKRSNVPGLRSGFVAGDAAILNKFLLYRTYQGCQMNPAVQAASVAAWNDEAHVAENRRLYREKFDRVTPMLAPYLSVELPDAGFYLWARVPPSLCGGSDTVFARDLLDQYNVTVLPGSFLARESGGVNPGAGFVRIALVADTAECVEAAERIIAFCQKH

SEQ ID NO: 87183 - protein, 345 aa, Magnaporthe grisea 70-15
MAGAEYEFYQFRTPSSDPAASSAPSTAAYLRENPPHSLPALTEGMFGYSLTRPVHNQDYFYDIFDTCEKFNCNIEGWHTESGPGVFEAALEFGEITGMADRASLFKYAVKSVATKYGITPCFMAKPKQGLPGNSGHMHISLVDNSGKNLFARETPDENAPWPDVAQLSDIGRHFLAGLLEGLPDVMPIVAPTINSYKRLVENFWAPVTVSWGLEHRAASIRLIAPPTSKPGATRFEVRVPGADTNPSLVLAAILALGWRGVQKKLEIPCPPLGKGEQVGGESDTGIRLAKSLREATDRFMRKESVAREAFGDAFVDHYGGTREHEIRQWDEAVTDWEMKRYIETV

SEQ ID NO: 87184 - protein, 512 aa, Saccharomyces cerevisiae
MTNMAEDKTSISKVHSEFSNSSNTTGSEEESRSHQESFDGESSSGESKSKSKLNLEYSADIEPLKFRMTKTNNTNDKLKYSNNGNATDSFMRLKEHLQRGNTLNSNLRVNEFYPFNSIDTEQFENYLREPKYIKMLKRRKNLKQFRRLFLAQELMAYEGETVTSTSKSSEPTSKAIWSTKFSRDGKFMATGSKDGKIRIWKVIGSPVERAELDSSAESNKEARAKSMRIKQQVSSLNNPKEKQFLDSATEKYEEKEKLLNLYAPVFHPTPLRLYKEHVQDVLDINWSKNNFILSASMDKTVKLWHPDRKNSLKTFIHPDFVTCVEFHPTDDRFFISGCLDHKCRLWSILDDEVSFEYDCQDLITSVTLSPEEGKYTIIGTFNGYVHILMTRGLTPVSSFHVADRQTQEQNAHVMVTETDSKIRHGPRVTGLQAFRSQLDNSFRLVVTSNDSRIRIFDLEQRKLLEVLKGFHSGSSQHKAQLSIWHGQPIVVNSSDDHWVYGWRLKSSDREND

SEQ ID NO: 87185 - protein, 164 aa, Zea mays
MMLRQAAKKALGLTSRQSTPCSVGISRSYHENVIDHYDNPRNVGSFDKNDPSIGTGLVGAPACGDVMKLQIKVDEKTGQIVDARFKTFGCGSAIASSSVATEWVKGKAMEEVLTIKNTEIAKHLSLPPVKLHCSMLAEDAIKAAVKDYKEKRVKTNGAGETSQA

SEQ ID NO: 87186 - protein, 313 aa, Streptococcus pyogenes MGAS10394
MTKIYKTITELVGQTPIIKLNRLIPNEAADVYVKLEAFNPGSSVKDRIALSMIEAAEAEGLISPGDVIIEPTSGNTGIGLAWVGAAKGYRVIIVMPETMSLERRQIIQAYGAELVLTPGAEGMKGAIAKTETLAIELGAWMPMQFNNPANPSIHEKTTAQEILEAFKEISLDAFVSGVGTGGTLSGVSHVLKKASPETVIYAVEAEESAVLSGQEPGPHKIQGISAGFIPNTLDTKAYDQIIRVKSKDALETARLTGAKEGFLVGISSGAALYAAIEVAKQLGKGKHVLTILPDNGERYLSTELYDVPVIKTK

SEQ ID NO: 87187 - protein, 554 aa, Bdellovibrio bacteriovorus
  misc_feature (545)..(546): Xaa can be any naturally occurring amino acid
  misc_feature (549)..(549): Xaa can be any naturally occurring amino acid
  misc_feature (551)..(551): Xaa can be any naturally occurring amino acid
MQHLPAMIHDLALILGTAGLVTLLFKKLNQPIVLGYLVAGFLVGPKISIFPTVIGVASINLWAEIGVIFLLFALGLEFSFKKLLRVGGSASFTALFEVSLMILFGFTTGRLLGWSTMDSLFLGGILSISSTSIIIRTVEELGMKNMKFVGMVFGVLVIEDLVAVLLMVLLTTVALTRDFSGTEMLGAVLKLSFFLSIWFVAGIFLLPSFLKRTQKLLSEETVLVVAVGLCLMMVVFASNVGFSSALGAFITGSILAETIEGERIHHLIAPIKNLFSAVFFISVGMLIDPQVISIYWKEVLLLSAVVVVGKTLSVTLGSVLSGQTFKSSLQSGMSLAQIGEFSFIIATLGLSLKVISEKIYPIAVAVSVLTAFTTPYMARSAEKTYAWLEKILPARFIQSIDSYSVLSFSMSGNREWREQVRAYVLKVLLNAVVVVAVFLTMARVFLPFLLERQMEEGPAKFLTLSATLVMSAPFLWALAFGRTKQFEALLVEQGKGSHNYVFLVSRIMLAVGLLGAMVGQFVPLMWAVAITLWMVVVVGYVLSQXXLFXHXRVT

SEQ ID NO: 87188 - protein, 511 aa, Torenia hybrid cultivar
MTVATTLVVVLSRELLLYVLVVYILVSKSLSTIIVVSRKRLPPGPTGFPVVGALPLLGSMPHVALAKMAKKYGPVMYLKTGTLGMVVASTPSSARAFLKTLDSNFSNRPANAGATHLAYGAQDMVFAPYGPRWRLLRRLSNLHMLGGKALDGWANVRASELGHMLEAMNRASREGEVVVVPEMLVYAMANMIGQVILSRRVFVTKGEEVNEFKDMVVELMTSAGYFNIGDFVPILAWMDLQGIERGMKALHKKFDKLITRMLEQHEASAHKPDFLDAIIAASLDDYSSEEERLSTSNIKALLLNLFTAGTDTSSSTIEWALSEMLKKGKILKRAQEEMDRVVGRERRLVESDIEKLGYLKAICKETFRKHPSTPLNLPRISSEACVVNGHYIPKGTRLSVNIWAIGRDPEVWEDPLEFNPDRFLHSKMDPRGNDFELMPFGAGRRICAGTRMGIVLVEYILATLVHSFDWKAADQDNNIMNMEEAFGIALQKATPLKALVTPRLPLHCYLP

SEQ ID NO: 87189 - protein, 470 aa, Streptococcus pyogenes MGAS10394
MEESMDAKLKYKAKKIKMVFFDIDDTLRVKDTGYMPESIQRVFKALKAKGILVGIASGRARYGVPQEVQDLHADYCVKLNGAYVKDDAKTIIFQAPIPADVVVAYKKWADDMGIFYGMAGRHEAVLSARNDMISNAIDNVYAQLEVCPDYNEYHDVYQMWTFEDKGDGLQLPAELAEHLRLVRWHDNSSDVVLKGTSKALGVSKVVDHLGLKPENILVFGDELNDLELFDYAGISIAMGVSHPLLQEKADFITKKVEEDGILYALEELGLIDKELQFPQLDLENHTGPKVTIKTNHGDMTLVLFPDHAPKTVANFLGLAKEGYYDGIIFHRIIPEFMIQGGDPTGTGMGGQSIYGESFEDEFSDELYNLRGALSMANAGPNTNGSQFFIVQNSKIPYAKKELERGGWPTPIAAAYAENGGTPHLDRRHTVFGQLVDETSFQVLDLIAGVETGAQDKPKEDVIIETIEVFD

SEQ ID NO: 87190 - protein, 370 aa, Triticum aestivum
  misc_feature (289)..(289): Xaa can be any naturally occurring amino acid
MHPTRWELSHMVDLQAAAVVISVVAAEVGAAADASQPPPRRQTSQREGAMDRYQRVEKPREEVPIKENEIRITTQGRMRNYITYATTLFQDKGCDEVVFKAMGRAINKTVMIAELIKRRIVGLHQNTATESTDITDTWEPLEEGLLPLETTRHVSMITITLSKKELDTSSVGYQSPLPADKVKPFVEYENEEDAHSPPGRGRGRGRGRGRGMGRGRDARGNGYMEYADGGWENEHAPTYAGNGYADHGPAYEGNGYARGRGRGFRGRGRRGGYGGQPDYQHDGGYYDEXAPAPPRGGGRGFRGRGRRGGYGGGQPDYQQDGGYYEEAPFPAPAGGRGQRPWPWERRPSSGQRARWPMPMGNMVYAAASGA

SEQ ID NO: 87191 - protein, 458 aa, Xanthomonas campestris pv. vesicatoria str. 85-10
MNEFSALPLSPALAPGIDALGYTVLTPIQAQSLPPILQGLDVIAQAPTGSGKTAAFGLGLLQKLDPAVTRAQALVLCPTRELADQVGKQLRKLATGIPNMKLVVLTGGMPLGPQLASLEAHDPQVVVGTPGRIQELARKRALHLGGVRTLVLDEADRMLDMGFEEPIREIASRCDKHRQSLLFSATFPDSIRTLARELLKEPVEITVEGADSAPEIDQQFFEVDPTYRQKAVAGLLLRFNPESSVVFCNTRKEVDEVAGSLQEFGFSALALHGDMEQRDRDEVLVRFVNRSCNVLVASDVAARGLDVEDLSAVVNYELPTDTETYRHRIGRTARAGKHGLALSLVAPRETARAQALEAEQGQPLKWSRAPLATARPAQLPQAAMTTLRIDGGKTDKLRAGDILGALTGEAGLSGAAIGKIAIYPTRSYVAIARAQVAKALAHLHAGKIKGRRFRVSKL

SEQ ID NO: 87192 - protein, 404 aa, Lactobacillus plantarum WCFS1
MDTMKKVAAALAALKRGELIIVADDETREAEGDMVGLAAKATTATVNRMITSARGLLCVPMAPSIATRLHLTPMTSEHDAFGTAFTVSTDHHTTSTGISAADRATTIQALANPNSQAADFYHPGHVFPLIARTGGLLARRGHTEAAVTLAQLAGVTPAAYICEVIKKNGLMARRRDLKALAEGLQLPLITIEDITTYVIQTGAAQLTTTPSVNLPTKDGQFTMTGFEVPGHTALPVALQAGDISGDEPVLVRLHSECFTGDVLGSRRCDCGDQLHAALQKISQAQRGVFVYLRQEGRGIGLANKLAAYALQEHGVDTYDANVQLGFQPDERRYDIAALVLRQMGITRVRLLTNNPDKVEQLRAAGIDVVERVPLEIPANQYDQAYLKTKRDRFHHQLTLTEGHE

SEQ ID NO: 87193 - protein, 521 aa, Stylosanthes guianensis
MDFLSLPTIFLVTLALVLIYNTWKINKSVDESNKNLQQAPKLPESLPLIGHLLLLGAKTPLAKILASFADNHGPIFRIRLGAYPALVISNKKAIKKCFTTNDVVLASRPKSSHGIHLGYNFAGFGFAPYGPYWTKLRKLAMLELLSPRRIESLRDVYESEIDTMINDLLSYLGGDSGVKVVISEWLERLTFNIIIKMIAGKRYFSYLKDADDEESNRIVKLIKEFMHISGELVPSDLIPIVGWVPIQGQVLKNMKRIAKDLDAIVGSWVEEHDVKSDEDQKNKNNSSSSEKQYFIDFMLSVIEDDPTSGHTRDNIIKANIMNLMLAGSDTTSTTMTWILSMLLTNKHALKRAQEEIDLRVGKDKSVKASDIKNLVYLQAIFKETLRLYPPGPLLVPHEAREDCYIQGYYVPKGTRVFANVWKLHRDPSIWSEPEKFSPERFINGNGELNEDHNFEYLPFGSGRRACPESTFAIQVSFITLALLLQKFDLDVPMCETVDLREGLGITLPKLTPLQITLTSRI

SEQ ID NO: 87194 - protein, 186 aa, Xanthomonas campestris pv. vesicatoria str. 85-10
MTDCSRCAGTTTSGPNHWSERIRDIADFPKQGIVFKDITPLLSDGPDFASALDEMAQPWRTTPLDAVLGIEARGFILGAALARELRTGFVPVRKPGKLPGRTLIQEYALEYGTDRIEMHEDALPRGARVLIVDDVLATGGTLRAALGLAAQLELEVVGAAVLVELQVLQGRQKWANDVPLLATLSY

SEQ ID NO: 87195 - protein, 557 aa, Xanthomonas campestris pv. vesicatoria str. 85-10
MCRTSPLGTRQASEDTVRTQRRMRLRPCQVHRRWPRLAGMTHLHFDNRLRQQLPGDPEEGARRREVGAAWSSVLPTPVAAPYLIAHSAEMAQVLGLEAAEIASAQFAQVFGGNALYPGMQPWAVNYGGHQFGHWAGQLGDGRAISLGEAIGTDGGRYELQLKGAGPTPYSRGADGRAVLRSSIREFLCSEAMHHLGVPTTRALSLVGTGEAVVRDMFYDGHPQREPGAIVCRVAPSFIRFGNFELPSARGDIALLKQWVDFTIARDFPALAGAGEALYADWFAQVCERTAVMVAHWMRVGFVHGVMNTDNMSILGLTIDYGPYGWVDDYDPDWTPNTTDAQGRRYRFGTQPQVAYWNLGRLAQALAPLFADQALLQYGLDRFRDTYLACDRRDTAAKLGLAECRDEDLQLIDALRALMRESEMDMTLTFRGLIDLSPEHPDPAQLRDAFYDEDKRLVDAPQLQQWLQRYAARLQQDPLSPEERRARMRLANPRYVLRNYLAQQAIDRAEQGDPSGVQELLEVMRRPYDDQHGRDAFAARRPDWARDRAGCSMLSCSS

SEQ ID NO: 87196 - protein, 488 aa, Artemisia annua
MALSLTTSIALATILFFVYKFATRSKSNKNSLPEPWRLPIIGHMHHLIGTIPHRGVMDLARKYGSLMHLQLGEVSTIVVSSPKWAKEILTTYDITFANRPETLTGEIVAYHNTDIVLAPYGEYWRQLRKLCTLELLSVKKVKSFQSLREEECWNLVQEIKAAGSGRPVNLSENIFKLIATILSRAAFGKGIKDQKEFTEIVKEILRQTGGFDVADIFPSKKFLHHLSGKRARLTSIHMKLDNLINNLVAEHTVNTSSKTNETLLDVLLRLKDSAEFPLTADNVKAIILDMFGAGTDTSSATIEWAISELIKCPRAMEKVQAELRKALKGKEKIHEEDIQELSYLNLVIKETLRLHPPLPLVMPRECRQPVNLAGYNIPNKTKLIVNVFAINRDPEYWKDAETFIPERFENSSTTVMGAEYEYLPFGAGRRMCPGSALGLANVQLPLANILYHFNWKLPNGASYDQIDMAESFGATVQRKTELLLVPSF

SEQ ID NO: 87197 - protein, 797 aa, Arabidopsis thaliana
MPCTTYLPLLLLLFLLPPPSVQSKVIIKGNQTILSFKAIFRLGFFSTTNGSSNWYLGISYASMPTPTHVWVANRIRPVSDPDSSTLELTSTGYLIVSNLRDGVVWQTDNKQPGTDFRFSETGNLILINDDGSPVWQSFDNPTDTWLPGMNVTGLTAMTSWRSLFDPSPGFYSLRLSPSFNEFQLVYKGTTPYWSTGNWTGEAFVGVPEMTIPYIYRFHFVNPYTPTASFWYIVPPLDSVSEPRLTRFMVGANGQLKQYTWDPQTQSWNMFWLQPEDPCRVYNLCGQLGFCSSELLKPCACIRGFRPRNDAAWRSDDYSDGCRRENGDSGEKSDTFEAVGDLRYDGDVKMSRLQVSKSSCAKTCLGNSSCVGFYHKEKSNLCKILLESPNNLKNSKGNISKSIIILCSVVGSISVLGFTLLVPLILLKRSRKRKKTRKQDEDGFAVLNLKVFSFKELQSATNGFSDKVGHGGFGAVFKGTLPGSSTFVAVKRLERPGSGESEFRAEVCTIGNIQHVNLVRLRGFCSENLHRLLVYDYMPQGSLSSYLSRTSPKLLSWETRFRIALGTAKGIAYLHEGCRDCIIHCDIKPENILLDSDYNAKVSDFGLAKLLGRDFSRVLATMRGTWGYVAPEWISGLPITTKADVYSFGMTLLELIGGRRNVIVNSDTLGEKETEPEKWFFPPWAAREIIQGNVDSVVDSRLNGEYNTEEVTRMATVAIWCIQDNEEIRPAMGTVVKMLEGVVEVTVPPPPKLIQALVSGDSYRGVSGTSCSEGHGCSDLNTGLSSPGSRSSFGRPSP

SEQ ID NO: 87198 - protein, 567 aa, Legionella pneumophila subsp. pneumophila str. Philadelphia 1
MHSLYLGVVKVMAKIILVYANCVNSTAKGDFALAGQIAKDLVREKTSDDIDVVLTSTLDGIARFESLYGKAVDGRVIIEGTSVGLCALELFESVDNEVVAFIEANRCKYAPSDILKRVLSPDSKFLFIGAANQKAIATGDKFTKSWLYISHKGDQPNVYEHFDEDDSLIQSVGLGDDRLGLPSLPKVDELPEMNSTQSQKIPSGEYGFMYLAAVHGIDDVYLMNQYMSLTEMGQYVLVGEYAKQSKEVQMVLHSLQYKGSSVSLTMPQIFFHDSVDNCLMRNMVSKSSGPLVVSTGVMSSIEAMQDGKLTYYQTMSNNTQFVASYLIAVKSICSSDTTLFGSMPKLIIDLSNLLFAEKPLKESQMKEIKSLLGMSSVTSRLGEMNKRIIAKANGTVAGELLSFIGKPKTTQSHKQCISVCMSLRKSGETTSPIFDQALRRAAAWGRLFELKVLIASMSTSDLNKKDKTGNQYTALHWAVMQGHLDCARLLVKSGASVDIQDKSGKSPLHYAIKRGDKETIKLLVQAGASLEIMDDSGAKPCDGSESWVPEYIKSCYEKSGHKSSSLF

SEQ ID NO: 87199 - protein, 270 aa, Helicobacter hepaticus ATCC 51449
MQTLTLNNGVKMPILGLGTYSLTGKAGQKAMSEAIEVGYRLFDSAQMYNNEAELGAAINAAVKGGIKREEFFIQTKLLESSSEDLAKKSIEKSLKTLGLDYIDSLLIHMPYSQSKAMYRAMESFYKQGILRVIGISNFGAKAYSEFVKSCEVIPAINQCETHLLLQQKPLREAMKSKKTLLQSWSPFIAGKGSILENPTLKSIAQKYNKTPAQVVLRFLIEQGISVIPKTSKRARMQENLNVFDFSLSAQDTQILKELDTNKSAFSWTNY

SEQ ID NO: 87200 - protein, 245 aa, Glycine max
  misc_feature (77)..(77): Xaa can be any naturally occurring amino acid
MGGRGAMRSAAKIAGIGVSKAALRPSALPTEQTTVRNASRPTAVSGVSSQSAKSAEVAPLHTAAAWDDWDFAEDGEXRPRCSVLSPLSMIAERQDAIDHASDFILVYLSPESSQYSSRGGQVSALSPTGGQVSALSPTLYEPVNRSCVVDAISDSSAPKHAIQAFHLLSTSREAQAVVASLACDPNVWNAVMENPAVSSFFQSQQSVADLGAAGNTEELDKFSSCTSETVESPEKLGVSAESHPG

SEQ ID NO: 87201 - protein, 159 aa, Burkholderia xenovorans LB400
MDFRIGQGYDVHALVPGRPLIIGGVTIPYERGLLGHSDADVLLHAITDALFGAAAMGDIGRHFSDTDAKFAGADSRVLLRECFARVTAAGFSIANVDSSVVAQAPKLAPHIEGMRANIAADLGLPVERVNVKAKTNEKLGYLGRGEGIEAQAAVLLIRN

SEQ ID NO: 87202 - protein, 316 aa, Prosthecochloris aestuarii DSM 271
MGFLSKLFGKKEVELKRPQVREDENLIRTLEGHQDRVLGVRFSPDGKKLVSGSFDEKVMLWDVATGAPLHTMSGHDTWVECVDYSPNGDRVASGSTDSTVRIWDPAPGKCVHLCKGHDTAVRMVAFSPDGKTLASCSRDTLIKLWDVETGRELKTLSGHISYIECVAWSNDGKRLVSCGEETVIRIWDVASGKNTASYATGDSLSHTACFSPDDSLIALCGRDAKVKILDAASGEIKHTLEGHDDGARSVCFSPDGTKAASVANDEKVILWDVVTGRLIHTYRGHVLEVQSVDISPDGTTIVSSSDDRKIKLWKLV

SEQ ID NO: 87203 - protein, 302 aa, Streptomyces coelicolor A3(2)
MIVVAGEALIDLVPQGTGALAALRPALGGGPYNTAVALGRLGSPVAFCSRVSYDGFGEALLDRLRETGVDVSPVQRGAEPTTLAVASLDADGSAAYSFYVEGTADRMFALPAALPSGTRAVSFGTCSLVLEPGASAYEELLRETAARGVFTALDPNIRAGLIPDPDAYRARFKSWLPSVSLLKLSAEDAEWLGGTPREWLAAGPAAVVVTRGGDGLTAFTRDGGEYTVPGERVEVVDTIGAGDTVNAALLHGLAARGALRDADLAALGPDGWAGLLGFAARAAAVTCSRAGAEPPYAHEVAA

SEQ ID NO: 87204 - protein, 182 aa, Burkholderia xenovorans LB400
MKTVGDKVEAFTVTAAKPGFNHHEENGVSAFEEITEQSFPGKWKIIYFYPKDFTFVCPTEIVEFAKLAKDFEERDAVLMGGSVDNEFVKLAWRREHKDLDKLNHYAFGDVKGELIDQLGVRDKEAGVALRATFIVDPDNTIQHVSVNNLNVGRNPEEVLRILDGLQTDELCPCNRAVGGATL

SEQ ID NO: 87205 - protein, 69 aa, Fusobacterium nucleatum subsp. vincentii ATCC 49256
MLDKVKEIIVEQLGVDADQIKPESNFVDDLGADSLDTVELIMSFEEEFGVEIPDTEAEKIKTVQDVITT

SEQ ID NO: 87206 - protein, 363 aa, Triticum aestivum
  misc_feature (77)..(77): Xaa can be any naturally occurring amino acid
  misc_feature (86)..(86): Xaa can be any naturally occurring amino acid
  misc_feature (124)..(124): Xaa can be any naturally occurring amino acid
  misc_feature (143)..(143): Xaa can be any naturally occurring amino acid
  misc_feature (223)..(223): Xaa can be any naturally occurring amino acid
  misc_feature (234)..(234): Xaa can be any naturally occurring amino acid
  misc_feature (330)..(330): Xaa can be any naturally occurring amino acid
  misc_feature (352)..(352): Xaa can be any naturally occurring amino acid
MSAYCGKYKDELIKNAAYIGTPGKGILAADESTGTIGKRFASINVENVEDNRRALRELLFCTPGALQYLSGVILFEXETLYQSTKXGKPFVDILKAGNVLPGIKVDKGTIELAGTNGETTTQGXDDLGKRCAKYYEGWVPRFXAKWRAVLKIGATEPSQLSIDQNAQGLARYAHHLPGEWGWVPIVEPEILVDGPHDIDRCAYVTEIVLAACYKALNDQHVLXLRGTLLKPNMXSPLGSDAKKVAPEVIAEYTVRTLQRTVPAAVPAIVFLSGGQSEEEATLNLNAMNKLQTKKPWNLSFSFGRALQQSTLKAWSGKTENEEKARTAFLXKCKAIRGTLGTYKGDATLGEGXSESLHVKDYKY

SEQ ID NO: 87207 - protein, 632 aa, Pinus taeda
LDSDSLENLNVKNNNAISDYITGGGAGHSGVSNVPATIVGEHPYGEHPSRTLFVRNINSNVEDSELRTYFEHYGDIRTLYTACKHRGFVMISYYDIRAARNAMRALQNKPLRRRKLDIHFSIPKDNPSDKDINQGTLVVFNLDPSVSNDDLRRIFGAYGEVKEIRETPHKRHHKFIEFYDVRAAEEALRALNKSDIAGKRIKLEPSRPGGARRSLMQHLSQELEQDVGSPLMNSPPAIGTGSSGSFGHLSSSSGVNGTLSGHQYLWGSPSPYSHHITWPGPPLGHSVNANGSQPYSGRQSPYVSSAIAPHHHHVGSAPSGEPSLDRHFSYLTETPDMPFVNPSSLGSMSCANGSPVISIGAHAVLNAGGVSISNNSNIECGSPIGVLSPQRKSRMFSGGGFTGSIANFSEGLNERGRSRRGDNNTSQADNKKQYQLDLDKIMRGEDARTTIMIKNIPNKYTSKMLLATIDEHHRGTYDFLYLPIDFKNKCNVGYAFINMTSPTHIIPFYQAFNGKKWEKFNSEKVASLAYARIQGKAALIAHFQNSSLMNEDKRCRPILFQPGAAGTGDQETFAMGPDVKVHPSENLADGNARESPIIANKDDSVLNSDKILNDADFYEELTSEISKLLDHS

SEQ ID NO: 87208 - protein, 203 aa, Prosthecochloris aestuarii DSM 271
MLQQNDWVYTETLKEHFMNPKNILQGEDTDAFDGVGMEGNLSCGDQMMVVIKVDRDKEIITDCQWKTYGCASAIASTSVLSEMVKGMTLDQAFDVSPKDVTKELGGLPENKIHCSVLGDKALRAAINNYFERNGMADRMRKEQAKIICQCMNVTDAEIEEAVLEGARSFYELQEHTKIGTVCGQCKESAEGLIEQYCHLHFDH

SEQ ID NO: 87209 - protein, 617 aa, Beta vulgaris
YCNGDRHIVGVVGAQNESSLFSSSLSELVNHKLRLSSNKFLSRPSSAVAPQIDEVEPFKSLEETEGQTINNLLPDEEELFSGIVDEMGHLNNANGGDDLDDFDVFTYSGGIELEAEEHLQAGRRNVGYPWGIHQNQQRSMHVMDHAPRMHSSARLSTGALVGDGSPHENSRIFNGFPSPVRMPSVGNEFGHSEASQSFPQVQLDNRCIPNFHPHSPQVPIHSVVNVNSLDSVNGFADDFRPRVSEKVNLDPHHLGLNGHAREFSDSVFGFSPNGLHVHQSMASKSNSYQQHQLRSLLMPNSPSFLNNNHANHLGRLPGSPGAPHLMMNMVSPVHHLQVGSAPVAPVMKASLWDRQQIYAGESHEASGYQMGAIRNVGLPGYSASPAREISSPISFSHVHGTEMSKNAGIQSPQQLSHMFHERNTMNSLPTSFGSPSERVRRSRNETNLSHADRKHYELNIERILRGDDIRTTLMIKNIPNKYTSKMLLATIDEQHRGKYDFIYLPIDFKNKCNMGYAFINMIDPLQIVSFHQTFEGRKWEKFNSEKVASLAYARIQGKGALIAHFQNSSLMNEDKRCRPILFHTDGPNAGDQEPFPMGTNFRGKPGRQPAAGSEDEE

SEQ ID NO: 87210 - protein, 401 aa, Prosthecochloris aestuarii DSM 271
METRRVYLDHNATTPLHPEVKKEMIEAMEMFGNPSSMHAFGREAHANIEHARQSVAGFIGAHEDELVFVGSGSEANNTVLSLFACASNLCIPGFKARQTIITSRIEHPCVLETSQCLAHRGTTVKLLDVDRYGRIDIDQLKEYLSDDVGLVSVMTANNEIGTLQDISEIGRLAHENGSLMHTDAVQAFGKMPLDVDELGVDFLTMSAHKIYGPKGIGALYVRKGTPYCPFIRGGHQEKGRRAGTENTLGIMGLAKAVEMRALEMEDEARRFAAMKEVLVKGIEERIDNALFNGHPELSMPNTVNVSFPGAEGEAILLYLDLAGIAVSTGSACASGSLDPSHVLLATGSSAERAHGSIRISMGRETTMEEIEYVLDVLPGVISRIRSMSTAYIKGEEHVAAK

SEQ ID NO: 87211 - protein, 308 aa, Prosthecochloris aestuarii DSM 271
MNVYESITETVGRTPLVRIRRMADHSYADVYAKLESFNPLSSVKDRVGVAMIEDAERNGLIGPETTIIEPTSGNTGIALAFSCASRGYRLILTMPDTMSVERRRLLKILGAELVLTEGAAGMKGAIAEAERLVDSIPHSLMLQQFNNPANPETHRRTTAREIWDDTDGQVDIFIAGVGTGGTITGVGSVLRELKPGVHIVAVEPDDSPVISGGEPGPHKIQGIGAGFVPGNLDPSVIDEIITVSNQDAAETARKLARKEGILCGISSGAAMWAAMSVAARPAMEGKNIVVLLPDTGERYLSTWLFADE

SEQ ID NO: 87212 - protein, 331 aa, Synechococcus sp. CC9311
MTSFLTAARAEQEKLQHDTRRLRLFSGTSNPALAREIAAYLGVPDGPKVCKRFADGELYVQIQESIRGCDVFLIQPTCAPVNDNLMELLIMVDACRRASARQITAVVPYYGYARADRKTAGRESIAAKLTANLLVKSGVDRVLAMDLHSAQTQGYFDIPCDHIYGSPVLVDYLAAQDLGEVVVVSPDVGGVARARAFAKQMNGAPLAIIDKRRTGHNMAESLTVIGDVSGRTAILIDDMIDTGGTICSGAKLLREQGATGVIACATHPVFSPPAIERLSVEGLFEQVVVTNSIPIASNHAFPQLHVLSVANMLGEAIWRIHEESSVSSMFR

SEQ ID NO: 87213 - protein, 159 aa, Lactobacillus plantarum WCFS1
MTTFNGKINGNGLKIGIAVARFNAFVTQQLLTGAQESLVQHGVNETDIDVAWVPGAFEIPLTVQKMITTKRYDGVIALGAVIRGATAHFDYVCSGVTTGIATVSLATDTPIMFGVLTTDTIEQAMDRAGFKSGNKGADCAVSLLETLDVQRAILKADLA

SEQ ID NO: 87214 - protein, 580 aa, Oryza sativa Japonica Group
MALWWPLLVLAAAYALCRILLFLIPPTVPSIDVDASDAHGSWGLCGIYSNGIGSDRVLLYAVLEDANQNKEDSYIYISNDIGSHIASSFQIPPRKGKGAQTDKVQCYEPATMKYLGYFPALTPDEVKEHVAQARKAQKIWAKSSFKQRRQFLRILLKYILEHQDLICEISSRDTGKTMVDASLGEIMTTCEKITWLLDEGEKWLKPEYRSCGRSMLHKKAKVEFYPLGVIGAIVSWNYPFHNVFNPMLAAIFSGNAAVIKIMNRASDTLIPVTLELGGKDAFIVCEDVDLPSVVQVAVRAALQSSGQNCAGAERFYVHKDIYSTFVSQVVKIIKSISVGPPLSGRYDMGAICMIEHSEKLQNLVNDAVDKGAEIAGRGSFGHLGEDAVDQFFPPTVLVNVNHTMKIMQEEAFGPILPIMKFNSDEEVVKLANDSKYGLGCAVFSGNQKRAIKIASQLHCGVAAINDFASSYMCQSLPFGGVKDSGFGRFAGVEGLRACCLVKAVVEDRWWPYVKTMIPKPIQLMIFIQYPVSENGFEFQELLVETLYGLSVWDRLRSLVNLLKMISEQNNSPANTRKKSR

SEQ ID NO: 87215 - protein, 364 aa, Bacillus licheniformis ATCC 14580
MKRRLILENGTIFEGEAFGSLENTMGEVVFNTGMTGYQEILSDPSYCGQIVTLTYPLIGNYGINRDDFESITPYVKGFIVKELCQLPSNWRSAYTLDEYLKMKNIPGLSGIDTRKLTRMIRTAGTLKGVFAGPEEDAGALVQKLKETNLPTDQVSQVSTKTAYPSPGRGKRIVLVDFGMKHGILRELNKRKCDVIVVPHNITAEEVMQLKPDGVMLSNGPGDPTDVPEAIAMIQNILGKVPLFGICLGHQLFALACGAKTEKMKFGHRGSNHPVKELETGRVSITAQNHGYTVSSVENTPLEVTHVAINDDTIEGLKHKHEPAFTVQYHPEASPGPEDANHLFDQFLDMIETTEKEGEAVCLNA

SEQ ID NO: 87216 - protein, 329 aa, Methanothermobacter thermautotrophicus str. Delta H
MKSMKIAVIPGDGIGVEVMEAALHILNTLDLDLEFIHADAGDACLKRTGTALPEETLEAVGEARATLFGAAGESAADVIVRLRREFDLFANLRPVKSLPGVPCLYPDLDFVIVRENTEDLYVGDEEYTPEGAVAKRIITRTASRRISQFAFQYAQKEGMQKVTAVHKANVLKKTDGIFRDEFYKVASEYPQMEATDYYVDATAMYLITQPQEFQTIVTTNLFGDILSDEAAGLIGGLGLAPSANIGEKNALFEPVHGSAPQIAGKNIANPTAMILTTTLMLKHLNKKQEAQKIEKALQKTLAEGLVTPDLGGKLGTMEMAAEIARHLED

SEQ ID NO: 87217 - protein, 259 aa, Streptococcus pyogenes MGAS10394
MTHTKEVAFITGAASGIGKQIGETLLKEGKTVVFSDINQEKLDQVVADYTKEGYDAFSVVCDVTKEEAINAAIDTVVEKYGRIDILVNNAGLQHVAMIEDFPTEKFEFMIKIMLTAPFIAIKRAFPTMKAQKHGRIINMASINGVIGFAGKSAYNSAKHGLIGLTKVTALEAADSGITVNAICPGYVDTPLVRGQFEDLSKTRGIPLENVLEEVPYPLVPQKRLIDVQEIADYVSFLASDKAKGVTGQACILDGGYTAQ

SEQ ID NO: 87218 - protein, 334 aa, Glycine max
MASSLGRRRTHAPKASSTLNDDVSCEECGGGHSPSKLILCDKCDRGYHLFCLRPILPSVPKGSWFCPSCSNHKPKSFPLVQTKIIDFFRIQRSPEALSNQDTRRKRKRGGGLVVSKKKRKLLAFVPSEDPNRRLEQMASLATALTTTKTEFSNQLTYMLGMAPRSANRPALGRGGMQVLSKEDTETLNLCKRMMERGEWPPLMVVFDPLEGFTVEADRSIKDLTIITEYVGDVDFLKNRENDDGDSIMTLLSASDPSRTLVICPDKRSNIARFINGINNHTPEGKKKQNLKCVRFDVGGECRVLLIANRDITKGERLYYDYNGDEHEYPTEHFV

SEQ ID NO: 87219 - protein, 400 aa, Methanothermobacter thermautotrophicus str. Delta H
MIFMRTEDVRRDIPLLRDHVYLDAASTTPTPLPVVRAMTEYFKEYNANTGRGAYSLVLRATRKLQEAREKVAGFINASSDEIVFTKNTSEAINIVAGGLRFRKGDSVVVPNIEHHSNFLPWLRLRERGVDVRVVKADEGGVVDPGRIEDAVDETTRLVTVTHISNALGTVQDVKEIGRIAHDVGALYLVDAAQSIGHMEVDVRAIGADFAAFPGHKGTLGPVGTGFLYCSTDVQGELEPLMLGGGTVLDVSEDGYVLEDFPAKFEAGTLNIAGFIGLGASIDYMNRIGIRRIQKHGMKMTEELHATVSSIDGIECYGDPQNIYGILSFNINNMDPHDVAKILDETAGICVRSGHHCAIPAMKHLALHETGGTVRASIHYYNTSEEIQLLGETLEEIAGMG

SEQ ID NO: 87220 - protein, 350 aa, Erythrobacter sp. SD-21
MNANTHRGFDQAHRDAADLLVRFGKETRLHLDHYLRSGNDAPYLDALLAEYPKRGGKMLRPGICIANALIFGGELTQAARCAAAVELLHNALLIHDDVQDESDLRRGLPTLHAQHGVALAINAGDALLFTAFQPLLDAIRPLGADLAQRVIEVTIAMARQTAEGQALELGWRDRNVTELTEADYLRMALKKTAWMGMIWPAQLGVLMGGRGRIDPARVVRFGHFLGLAFQIEDDLRNLTDNPGYGKERNGDLYEGKRTLMLIHVRNACEDADRARIDRLMDQPRADRDPAEIDWLARLMNERGSIRHARQVADAMAGVAMLEFKTAYSGLSDSAELAFLEVLPSWVFDRP

SEQ ID NO: 87221 - protein, 382 aa, Zea mays
MGIPVGKLSLYTALGGVRPSACLPITIDVGTNNEALLNDDFYIGLRQRRATGEVTHSHPFHLIVVEYHELVEEFMAAVKQNYGEKVLTQFEDFANHNAFDLLEKYRESHLVFNDDIQGTASVVLAGLLAALKAGTGIAELIALEMSKHTGSPIEECRPKIWLMDSRGLIVASRKESLQAFKKPWAHEHGAVETLLEAVRSLKPTVLIGTSGKGGTFTKDVVEAMASQNERPVVFALSNPTSHSECTAEQAYTWTEGRAVFASGSPFPAVELDGRALVPGQSNNAYIFPGFGLGVVISGAIRVRDDMLLAASEALAEQVTEAHYAKGLIFPPFTNIRAISARIAAKVAAKAYELGLASRLPRPDDLVKYAESCMYTPTYRSYR

SEQ ID NO: 87222 - protein, 358 aa, Bacteroides fragilis YCH46
MKNVTLILDDGSRFHGKSFGYEKPVAGEVVFNTAMTGYPESLTDPSYAGQLMTLTYPLVGNYGVPPFSIEPNGLATFMESERIHAEAIIVSDYSQEYSHWNAVESLADWLKREQVPGITGIDTRELTKVLREHGVMMGRIVFDDEPESAPEAVYSGVNYVDKVSCKEVIRYNEGADKKKVVLVDCGVKTNIIRCLLRRDVEVIRVPWNYDFNHLKFDGLFISNGPGDPDTCDAAVQNIRKAMQNPKLPIFGICMGNQLLSKAGGAKIYKLKYGHRSHNQPVRMVGTERCFITSQNHGYAVDNNTLGTDWEPLFINMNDGSNEGIRHKTNPWFSAQFHPEAASGPTDTEFLFDEFVKLL

SEQ ID NO: 87223 - protein, 357 aa, Helicobacter hepaticus ATCC 51449
MQEHKELLERREFLKTSAKFGAAVSLASLSGFALSACDSKEDLKTDSTQNLQSTEKAGKSQIQNHLQGDTMEFITLNNGVKMPILGYGVYQIDPKETQRCVEDAISVGYRSIDTAQAYFNEAEVGAAIKTALQGGLKREELFITTKLWIDNYPEEKALKACEESLRKLGLEYVDLMLLHQPYNDTYGAWRALSRFYKEGRFKAIGVSNFYPDRIMDFYLNNEIKPMINQIELHPFYQKQAEQKVNTELDIVTQSWASFAEGKNGLFTNEILRNIGEKYNKSAAQVVLRWLIQRQIVVIPKTTRKERMIENFNVFDFSLSGEDMQKIATIDTGKTLFLDHHDPQSAKFLFDYTKIHKA

SEQ ID NO: 87224 - protein, 207 aa, Oryza sativa
  misc_feature (129)..(129): Xaa can be any naturally occurring amino acid
MAGVSAASAAGKIGSFLSKRPYAPPSWASHLSPAPSQTFSLGHFPTPIHKWNLPNLPNGTEVWIKRDDISGMQLSGNKVRKLEFLMADAVAQGADCVITVGGIQSNHCRATAVAAKYINLPTRPGMFTXQLLVDKDPGLVGNLLVERLVGAHIDLVSKEEYGKIGSVALADLLKKKLLEEGRKPYVIPVGGSNSLGTWYCFLFNPNY

SEQ ID NO: 87225 - protein, 272 aa, Triticum aestivum
AFDESVLLWHLATDFCYYDTVVSRSHHGLLCTQDSYPHAYACPSWCKRSSHHKRAIQCREMSNYMMYLLFVNPEMLIAGTRRNLFATAYDELKDIVEEREKIDGISVEGDEEIGLTHMIIAAVHGGRSPPPGCTQQQQGGIVRDAWSIAKVLSNLPEEKMWDVIEGVWVEMLCFSAARCRGYLHAKGLATGVEYLTYVWLLLYYMGMETLAAKLQRADHHYHNNGGEHGDGPSTSHVSTAQEEAGGPSRSDGGAEGQSAGYHDSDDIVEEMV

SEQ ID NO: 87226 - protein, 128 aa, Zea mays
RKKSVDDFEVQPVIHNPHALPLFRDQPSRKRQREKILKDPLKSHKPEAPVNGPGFGGRVGTTKGSLLTQYFLKEGGLIKETWMDEDPREAILKYADAAEKDPKFIAPAYSQTQPKPVFAEFDSDNEEK

SEQ ID NO: 87227 - protein, 510 aa, Physcomitrella patens subsp. patens
MQDPDEAEFMLPVDSEHKARTVKVLSIARPHMRAFHLAWISFFICFLSTFAAPPLIPIIRDNLNMTKPEIGQAAVASVSGSIMSRLMMGTICDLVGPRYGTAFLIMINAPAVFSMALVDDGEGFMICRFFIGFSLATFVSCEYWVSSMFTTKIVGTVNGLAAGWGNLGGGVTQIMMPLIFALFRDSFHNPAFTAWRLAFFVPGTLHVVLGLLILFFGQDLPDGNHSQLQRQGGDVKQGFLRVVYFAATSYRTWVFFILYGYSFGVELTVDNIIAEYFYDRFELNLNTAGLIAAASGLMNIFSRPAGGYFSDLAGHYFGMRGRLWFLWIVQSMGGLMCIVLGKMNSLTPSIIFMIFFSIFVQAACGATFGIVPFVSRRSLGVIIGLTAAGGNVGSVLTQSLFFTSSSYHTEVGLVYMGIMIICCTLPVTLIWFPQWGSMLFPASKGASEEDYYVSEWTAQEQEQGLHFPSLKFATNSRSERGCYGGVTSADPECDQPVAELGLSMWKSYSH

SEQ ID NO: 87228 - protein, 308 aa, Yersinia pseudotuberculosis IP 32953
METGKLVVLGSINADHILNIEQFPRPGETVIGQQYNVAFGGKGANQAVAAGRSGADIAFIACVGDDDIGERVRQQLTADKIDTQPIEAIKGATTGVALIFVNSDGENVIGINAGANSAVTPEYLRRYQQQVIDADALLMQLESPLDTVIAAAKLAKQHQTQVILNPAPARKLPDELLTLVDMITPNETEAERLTGIHIEQDDDAAKAAQILHDKGIATVIITLGSRGVWLSEQGKGKLVAGFKVNAVDTIAAGDTFNGALLTALLEGQSMDAAVRFAHAAAAIAVTRPGAQPSIPWRAEIDSFLQERV

SEQ ID NO: 87229 - protein, 141 aa, Prosthecochloris aestuarii DSM 271
MERTLTILKPDCVRKQLIGAVIDKIERAGFRVVAMKKTKLTAQTAGEFYAVHSQRPFYGELVEFMSSGPCVPMILEKENAVADFRTLIGATDPAEAAEGTIRNLFADSKGENIIHGSDSAENAQIEAGFFFSTEEAVRVNN

SEQ ID NO: 87230 - protein, 869 aa, Aegilops speltoides
MDRSPAPLSPPGFAVPLAVKKRQQAPPGYSSSSSPWGVPPAPPLTNNNPNPPNGLRGGGDTSIFSTSLPVLPHEKLNFSDSAHGTPSMDDASAKLKDFDDDPQGNDYPFDFDLRQIDDLLPDEDELFAGITNEIEPSSQANPAEELEEFDVFGSGGGMELDSDPLDSITAGLGNASIGDGLRANGVNNNFGLSNSPGAVAGEHPLGEHPSRTLFVRNINSNVEDSELRSLFEQFGDIRTLYTATKHRGFVMISYFDIRAARGAMRSLQNKPLRRRKLDIHFSIPKENPSDKDLNQGTLVIFNLDPSVSNEEVRQIFGTYGEVKEIRETPNKKHHKFIEFYDVRAAEAALRSLNKSEIAGKRIKLEPSRPGGTRRSLVQHLGHELEDEPRGYRHSHVGSPMANSPPGAWAQYGSPTDNNLLHAFSNSPTGNGMSPIGMSPSMMSNALKIAPIGKDNNWSKYDQVFSNSNQSLGAAFQHSQSYQDRKSEHMSSSPGTLTGPEFLWGSPKPYPEHSQSSSMWRPPPVGHAMSSSSRPQGQGFLYGSRQASLFGSLDQNRHHVGSAPSGAPFESHFGFLPESPETSFMNQVRFANMGNIGGANRNGGNLMLNMASRASLNPVSALSGSLTDNNSTNFRPVPSPRLGQPPFFGNTTYQGPGYYGLDSSSIERGRNRRVDSSAFQADSKKQYQLDLDKIRKGEDTRTTLMIKNIPNKYTSKMLLAAIDELHKGTYDFFYLPIDFKNKCNVGYAFINMISPVHIVSFYQAFNGKKWEKFNSEKVASLAYGRIQGRNALISHFQNSSLMNEDKRCRPILFHSNGPETGNQEPFPNGICIHMPLDGGAGSSKEPLGFEEDDNPNEMKISGEKSMAGSL

SEQ ID NO: 87231 - protein, 82 aa, Arabidopsis thaliana
MASSRLSSADVVTSPAQATMVAPFTGLKSSAAFPVTRKTNRDITSIAGNGGRVTCMNVWPSVGQKKFETLSHVPDLSDGRIG

SEQ ID NO: 87232 - protein, 919 aa, Hordeum vulgare
MVIASGVIDRGHLSSFGGPPPDSSSSFFSEDLVPTERQVGFWKSESMVDQRGSKPVFASPLEKIHPTGANPEGSLEQTGGQVFKGLDALRVSKAMGQGNASSSPSTSWGDMLTTPGSRFGLSDRETAIAETAGGNPRIMATGVCGQSASFICEGDEPLGSMEEIEAQTIGDLLPTDDDLISGVIDGFELSGLSINQDDADEDIFCTGGGLELENDDSISIKGARNVEGSSKCHFPGEHHISRCPSRSLFVTNINTNIVDSDLRVLFQQYGDVHKLFTCKEHGYVRVSYYDIRVAQNAMRALHGKPLGPVKLDVQFCIPKGNASDKGMNEGILAVSNIDPSVSNDDLLQALTVYGDVKEISRASTSCNKKLVEFYDVRAAEAALYDLNKGAISGPKIKAEVSNPGGANFGLRQQYPREWKLDGSPHQPRNSPPGIIGGPRSHENSSLHNLFSPVSPQLDRSPHGIASSGPQKLSSPIRIEPARQYNNQAAISELGGSLGQGNFGHGMQMFQPHSLPECQNGMCNISKSMTSSGRSAGFRVDGVDYSHLQKVGSGSLHGHSFDQNNEAFGPTGVGSFPLNGHHYSWNSSNAFPQSPSSPMLWSNMQHPGHMHGYPGVVPPHTLNNGAYPMDQHHMGSAPNNGGGFRNARSVHPGSLGSVGFPGSPQMYPSDVPVFTPARGSYRDTMFSPVGAGFPSLQQMCNVMNRRNPMVQVSASYDATNDRMRRSRHDGNAAVQPENKRLFELDIERIAQHEDPRTTLMIKNIPNKYNCKLLLGVIDENHRGTYDFVYLPIDFKNKCNVGYAFINMTDPQHIIPFYKTFNGKRWEKFNSEKVATLAYARIQGRKQLVAHFQNSSLMNEDKGCRPILFGEDGVQEPFPVGNNIRPRSGRNRPLHSSDTRGDASLSTSPNLENSSRRANAV

SEQ ID NO: 87233 - protein, 311 aa, Streptomyces coelicolor A3(2)
MSLAPGGALLVVGDVVTDIVARHRGPLAPGTDTAAAVRRLPGGAGANVACWAAHEGCGDVRLLGRVGTDASAWHERELTACGVRPLLVVDSAAPTGTVICLVDTADSAERTFLTDSGAALRIGPGDWSDTLLDGVGRLHLSGYLLFSEPGRALVSVALAAARARGVPVSLDPASAGFLTELGVDRFLGLVEGVDVLLPSRDEACLLTGLPDVADAAAKLSRHVPLVIVKQGAKGALVARSGTVGARVAAVTAAPRDSTGAGDAFTGAFLAALLAGAEAEEATAAGCRAGARAVERVGGRPPRAAGRGPGDG

SEQ ID NO: 87234 - protein, 818 aa, Sorghum bicolor
MVIASGAVDRSHLSPFVPLSESSSSSFFSQDLVPTERQVGFWKSSGSMVHHKGSEPIFTSPLDKVHPMGSSPAGGLEHQQGQAFKGQMGMLNLGNLVGQQENAPGIPSISWDDVLSSSRSSLGLSTGGTAFVGPTSADQHVHDYGDCPSSSSYTEVFSSKSARLVASGVYGQSADANGSGCEGDEPLGSMKELEAQTIGDLLPDDDDLISGIIDGFEYTGLSNKDDADEDIFYTGGGLELEHDDSNNVDKFREVSFKSQLSGDVNEIYKAPTSCNKKFVEFYNTRAAQETLNDLNKGDMSCSQIKVEHSYSGGAGSCFTEQCSGEQKQNAVPHQLKNSPLGTIGKLDPKSWEGSTVRNLYSPVRPQHDKAQHGFSVNAPQKLSSPIRIESTRQHSNQTALGEPSGSLGHGNFGGGLQAFHPHSLPEYHNGICNGSNSMTLNARNSNFRLTEGMDYNNHKVDHSDLHGHSSDQNEAFRATGIGSCPLHGHHYTWSNSNGFPQSPSAPMLWSNFQQPVHVNCYPVMPPHMRRTAAHPMDQHHLGSAPNSVGGFANAHSFHPGSLESVGFPGSPQLYPDLSVFASARGNYRETMFSPVSAGFPSIQQIFHATNGRNPMVHVSTSYDATNDRIRSRRHDGNAAQSENKKQFELDLDRIAKGEDSRTTLMIKNIPNKYNCKLLLAVIDENHRGTYDFIYLPIDFKNKCNVGYAFINMTDPQHIIPFYKTFNGKKWEKFNSEKVASLAYARIQGRNALIAHFQNSSLMNEEKWCRPMLFHKDGPHAGDQEPFPVGSNVRSRSGRNRPLTGSETTKEGSPSTSPN

SEQ ID NO: 87235 - protein, 335 aa, Erythrobacter sp. NAP1
MSTSIGVIGAGAWGTALAQMLASDGREVLLWAYESEVVDAINSDRRNPQYLPSAQLAKTIRATGDLADFAEIEIALVVTPAQLLGKVLSVLDKSPRDLVLCSKGIEAGTGRLMNDVAREAAPGSEIAVLSGPTFAHEVASGLPTAVTLACEGGREQWERLSPAIARPAFRPYYSDDVTGAEIGGSIKNVLAIACGVVEGLKLGQNARAALIARGYAEMLRFGETMGAQAETLAGLCGLGDLVLTCSSTSSRNFSLGKALGEGEKAADLMADRTTVAEGAHTAPVLASLAKERDIAMPIVIAVNAILDGSAPEAVVAELLSRPLRAETPSDQGDVE

SEQ ID NO: 87236 - protein, 870 aa, Triticum aestivum
MDRSPAPLSPPGFAVPLAVKKRQQAAPGYSSSSSPWGVPPAPPLTNNNNPNPPNGLRAGDTSIFSTSLPVLPHEKLNFPDSAHGTPSMDDASAKLKDFDDDPQGNDYPFDFDLRQIDDLLPDEDELFAGITNEMEPSSQANPVEELEEFDVFGSGGGMELDSDPLDSITAGLGNASISDGIRANGVNNNFGLSNSPGAVAGEHPLGEHPSRTLFVRNINSNVEDSELRSLFEQFGDIRTLYTATKHRGFVMISYFDIRAARGAMRSLQNKPLRRRKLDIHFSIPKENPSDKDLNQGTLVIFNLDPSVSNEEVRQIFGTYGEVKEIRETPNKKHHKFIEFYDVRAAEAALRSLNKSEIAGKRIKLEPSRPGGTRRSLVQHLGHELEDETRGYRHSPHVGSPMANSPPGAWAQYGSPTDNNLLHAFSNSPTGNGMSPIGMSPSMMSNALKIAPIGKDNNWSKYDQVFSNSNQSLGAAFQYSQSYQDRKSEHMSSSPGTLTGPEFLWGSPKPYPEHSQSSSMWRPPPVGHAMSSSSRPQGQGFLYGSRQASLFGSLDQNRHHVGSAPSGAPFESHFGFLPESPETSFMNQVRFANMGNIGGANRNGGSLMLNMASRASLNPVSALSGSLTDNNSTNFRPIPSPRLGQPPFFGNTTYQGPGYYGLDSSSIERGRNRRVDSSAFQADSKKHYQLDLDKIRKGEDTRTTLMIKNIPNKYTSKMLLAAIDELHKGTYDFFYLPIDFKNKCNVGYAFINMISPVHIVSFYQAFNGKKWEKFNSEKVASLAYGRIQGRNALISHFQNSSLMNEDKRCRPILFHSNGPETGNQEPFPNGICIHMPLDGGAGSSKEPLGFEEDDNPSEIKISGEKSMAGSL

SEQ ID NO: 87237 - protein, 260 aa, Arabidopsis thaliana
MASSSDPWMREYNEALKLSEDINGMMSERNASGLTGPDAQRRASAIRRKITILGTRLDSLQSLLVKVPGKQHVSEKEMNRRKDMVGNLRSKTNQVASALNMSNFANRDSLFGTDLKPDDAINRVSGMDNQGIVVFQRQVMREQDEGLEKLEETVMSTKHIALAVNEELTLQTRLIVCLRCCSLLFLLILISYSNEMGLSSMQDDLDYDVDITDSRLRRVQKSLALMNKSMKSGCSCMSMLLSVLGIVGLALVIWLLVKYL

SEQ ID NO: 87238 - protein, 194 aa, Oryza sativa
  misc_feature (89)..(89): Xaa can be any naturally occurring amino acid
  misc_feature (171)..(172): Xaa can be any naturally occurring amino acid
  misc_feature (175)..(176): Xaa can be any naturally occurring amino acid
  misc_feature (188)..(188): Xaa can be any naturally occurring amino acid
MKLNIAYPVTGCQKTLDIDDDRKLRPFMEKRIAQEVDASCLGNEWKGYVLRITGGNDKQGFPMMQGVLTNQRVRLLLDKRHKCYRQRRXGERKRKSVRGCIVDQNLSVLACTITKRGEQDIDGLTNKTIPRRLGPKRANHIRKLFNLSKEDDVRKYVVKRPLTKESKKPRXXAPXXSRLITPRRLQRXRHLISL

SEQ ID NO: 87239 - protein, 1168 aa, Medicago truncatula
MSSNPPPPENDPPPATSSPVSAKSRTLQKFPPIVNRRTATLSSNNVDDECKEENNKNKNHDNEEESEEEEEEEEEEEEDVLVTEREFERAECSYSSSILQASSLGLNQIRTRFSSPLRHSSSAGAPSFPIKDVVNNVAKFRSRVSHPKDLGEKVHWNQSKSLKARSQLLILEGNHAAYAKDFQSPRYQEILRLTSGKKRKNRPDIKSFSHELNSKGVRPFPVWKNRAFGQEIMEEIRAKFEKLKEEVDSDLGGFAGDLVGTLEKIPGSHPEWKEGLEDLLVVARQCAKMTAAEFWINCETIVQKLDDKRQDIPVGILKQAHTRLLFILSRCTRLVQFQKESVKEQDHILGLHQLSDLGVYSEQIMKAEESCGFPPSDHEMAEKLIKKSHGKEQDKPITKQSQADQHASVVIDNVEVTTASTDSTPGSSYKMASWRKLPSAAEKNRVGQDAVKDENAENWDTLSCHPDQHSQPSSRTRRPSWGYWGDQQNLLHDDSMICRICEVEIPILHVEEHSRICTIADKCDLKGLTVNERLERVAETIEMLLDSLTPTSSLHEEFNELSLERNNMSSRCSEDMLDLAPDNTFVADDLNLSREISCEAHSLKPDHGAKISSPESLTPRSPLITPRTSQIEMLLSVSGRRPISELESYDQINKLVEIARAVANANSCDESAFQDIVDCVEDLRCVIQNRKEDALIVDTFGRRIEKLLQEKYLTLCEQIHDERAESSNSMADEESSVDDDTIRSLRASPINGFSKDRTSIEDFEIIKPISRGAFGRVFLAQKRSTGDLFAIKVLKKADMIRKNAVEGILAERDILISVRNPFVVRFYYSFTCKENLYLVMEYLNGGDLYSMLRNLGCLDEDMARVYIAEVVLALEYLHSQSIVHRDLKPDNLLIGQDGHIKLTDFGLSKVGLINSTEDLSAPASFTNGFLVDDEPKPRHVSKREARQQQSIVGTPDYLAPEILLGMGHGTTADWWSVGVILYELLVGIPPFNADHAQQIFDNIINRDIQWPKHPEEISFEAYDLMNKLLIENPVQRLGVTGATEVKRHAFFKDVNWDTLARQKAMFIPSAEAHDTSYFMSRYIWNVEDDEHCAGGSDFYDHSETSSSGSGSDSLDEDGDECASLTEFGNSALGVQYSFSNFSFKNISQLVSINMMHISKETPDDSNPS

SEQ ID NO: 87240 - protein, 328 aa, Zea mays
MATIQHQAKPAVAAAPSTTTGGGQRAMDLYEKLEKVGEGTYGKVYRAREKATGRIVALKKTRLPEDDEGVPPTAMREVSLLRMLSQDPHVVRLLDLKQGVNKEGQTILYLVFEYMDTDLKKFIRGHRSNNEKIPAATVKILMYQLCKGVAFVHGRGVLHRDLKPHNLLMDRKTMALKIADLGLSRAITVPVKKYTHEILTLWYRAPEILLGATHYSTPVDIWSPGCIFAELVTNQPLFPGDSELQQLLHIFKLLGTPNEEVWPGVDKLPNWHVYPQWKPTKLSTLVPGLDADGYDLLEKMLVFEPGKRIPAKKALEHPYFNDVRKEMH

SEQ ID NO: 87241 - protein, 352 aa, Salinibacter ruber DSM 13855
MPTSPSPTTSSSSSTDDLQHILRVDAVSDATWDALRHTAVQHRHDGTLHAGAASGSSLGLVFMNPSLRTRTSMEGAAAHLGARHTTLVPGNGSWALEWELGAVMDGEAAEHVREAIGVLSRYHDALGVRVFASGTDYGADAQDTLIRTVAEHATVPVINLESAWAHPCQGLADAALLTERYGDALADKTFVLSWAPHPKPLPMAVPNTALRTAARCGMDVTVARPDTHALDPGVMAEAEALAETQGGSVSATSDQAAAAEGADVVYAKSWGGPLVYENPKAESEARAARSDWRITADLMARTRNGAFLHCLPVRRNVVVDDAVLDGPHAAHLDQAEYRLHAQKALLQYVWSL

SEQ ID NO: 87242 - protein, 245 aa, Dechloromonas aromatica RCB
MNDDKTHFGYETVAEQEKARRVADVFDSVASRYDLMNDLMSGGMHRLWKAFTIQRSGVREGSRVLDVAGGTGDLSLAFSKKVGKSGQVWLTDINNAMLARGRDRLLDKGYMLPVAQCDAEKLPFPDNWFDCVTVAFGLRNMTHKDAALAEMYRVLRPGGRLLVLEFSQIWKPLAPLYDFYSFKVIPQVGKLVTNDADSYRYLSESIRVHPGQEELKSMMEKAGMEKVEYFNLALGVVALHRGFKF

SEQ ID NO: 87243 - protein, 496 aa, Legionella pneumophila subsp. pneumophila str. Philadelphia 1
MLLKAESKYPCDLILFGTLGDLSCRKLLPALYQLELANLLHEKTRIIGCAREELDFSAYVDLIKNKIQQFLFDEIDEAVWLRFIKKLAYCKLDLNQSDDYQKLTDYVNPSERVVISYLAIPPSLYSQTCRSLARLNLTQKPSRVVLEKPIGHDLPSSVATNEQVACFFAEDQIYRIDHYLGKETVLNLLVLRFANSIFSTNWDNRVIDRVEISVAEEIGVEGRWEYYDKSGQVRDMLQNHLLQILSLVAMEPPLSLSAESIRSEKLKVLKSLRFINKSNVHDHTVRAQYVANTLANGKKIPGYLEEVGANQASTTETFVAIKAYVDNWRWSGVPFYMLTGKRLPKKQSEVVIYFKPQPYNIFHPLNEELYPNQLIIRLQPDEGVEVRIMNKIPGLGERMMLHDSKLDLNFHHSFKTQRIADAYERLLLEVMLGNQYLFVSREEIEQAWQWIDSIVSAWEEDNIPLYTYPACTWGPKEVIRLFNGQAHVWGDHNAVS

SEQ ID NO: 87244 - protein, 255 aa, Zea mays
KGRSRLRSSSTRLFHSRNLYPSSGIVSHTPLPQLRKTLEKRRRRDIAEVEAPAAAVAAATPEVATVTEGGAATEAKGPHKLHRQWTFWYDIQSKPKPGAAWGTSLKKAYTFDTVEEFWGLYDHVFRPSKLPGTADFHLFKAGVEPKWEDPECANGGKWTVPCNRKPTFETMWLETLMALVGEQFDETDDICGIVASVRPRGDKLALWTRTASNEAVQVNIGKKWKDVIDYNDKIIYTFHDDSRRDKPSRGGRYTV

SEQ ID NO: 87245 - protein, 267 aa, Coxiella burnetii RSA 493
MNVITIYQERINHKLGSILPDIRQTPQRLHEAMTYAVMSGGKRIRPLFTYATGFSFEVDPAQIDNAACAIELMHCYSLVHDDLPAMDDDDFRRGKPSCHKAFDEATAILTGDALQCLAFEVLARDKNIRLINVLANACGSLGMAGGQQLDLEFKNKEATPEQIEIVHRLKTGALFSTAIELGALAAGCLDEKRLQKLRKLGATVGLIFQWQDDLADQTVEDEKIPLINRIGVLFNQVEKLLNELEGNNSFLQELIHFLKSSITAVIQ

SEQ ID NO: 87246 - protein, 521 aa, Triticum aestivum
  misc_feature (509)..(509): Xaa can be any naturally occurring amino acid
  misc_feature (515)..(515): Xaa can be any naturally occurring amino acid
MALLLRHSRKLRRVHGVLDCERGSIPRHFSVAAAKEDAVSSSSVHGEYGKKVGRSSIFLDRQSEKDLHAFKVSSREARGSYSSKRMPIAATGVNSLFSCGQVISARHFSSGADLPPHEAIGMPSLSPTMTEGNIARWVKKEGDKVSPGEVLCEVETDKATVEMECMEEGYLAKIVCGDGAKEIKVGEIIAITVEEEGDIEKFKDYKASSSPSAESKPQSEPVEPKEEKKEVSKAPEPTATKTEESSQSGDRLFSSPVARKLAEDNNVPLSSLKASAAKGSKKEAAAAPGLGYVDLPNTQIRKVTANRLLQSKQTIPHYYLTVDSRVDKLIKLRSELNPMQDASGGKKISINDLVIKAAALALRKVPACNSSWMNDFIRQYHNVNINVAVQTEHGLFVPVVRDADKKGLAAIADEVKQLASRAKDNSLKPEDYEGGTFTVSNLGGPFGIKQFCAIINPPQSAILAISSAEKRVIPGAAEGQYEIGSFMSATLSCDHRVIDGAMGAEWLKXFKGYLXDRHMLL

SEQ ID NO: 87247 - protein, 338 aa, Brassica napus
MAGGKIKIGINGFGRIGRLVARVVLQRDDVELVAVNDPFITTEYMTYMFKYDSVHGQWKHHELKVKDEKTLLFGEKPVTVFGIRNPEDIPWAEAGADFVVESTGVFTDKDKAAAHLKGGAKKVVISAPSKDAPMFVVGVNEHEYKSDLDIVSNASCTTNCLAPLAKVINDRFGIVEGLMTTVHSITATQKTVDGPSMKDWRGGRAASFNIIPSSTGAAKAVGKVLPQLNGKLTGMSFRVPTVDVSVVDLTVRLEKAATYDEIKKAIKEESEGKLKGILGYTEDDVVSTDFVGDSRSSIFDAKAGIALSDNFVKLVSWYDNEWGYSTRVVDLIVHMSKC

SEQ ID NO: 87248 - protein, 217 aa, Burkholderia xenovorans LB400
MTFRAQMLDTLTSQSSRDLEAQALGLVPIVVETSGRGERSYDIYSRLLKERIVFLVGEVNDQTANLVVAQMLFLESENPDKDISFYINSPGGSVSAGMAIYDTMQFIKPDVSTLCMGLAASMGAFLLAAGAKGKRFALPNSRVMIHQPLGGARGQASDIEIQAREILYLKERLNHLLAHHTGQPVERIARDTDRDNFMSGDDAQAYGLVDQVAHKRP

SEQ ID NO: 87249 - protein, 535 aa, Fusobacterium nucleatum subsp. vincentii ATCC 49256
MKQRLALHYVFNSPKDKFVFDVSHQTYPHKMLTGRRQAFTDETHYDDVTGYSNQNESEHDHFILGHTSTSISLALGLAKARDVKGEIGNVVAIIGDGSLSGGEALEGLDFAGELRSNFIIIVNDNDMSIAENHGGLYKNLKLLRETEGKAETNLFKAMGLDYIFIKDGNNLEELIETFKKVKDINHPIVVHIFTQKGKGYKLAEIDKEPWHYVMPFNIEDGKPLNTDDSEDYTDVTKEYLIKKMKEDKTVVTITSGTPGAVGFNKKDRDEVGSQFIDVGIAEETAVAIASGMASKGAKPVYTVVSTFLQRTYDQLSQDLCINNNPATIVVYYAGAIGMTDVTHLGWFDIAMMGNIPNLVYLAPTTKEEHLAMLEWSIEQQEHPVAIRIPGGKMVSSGKKVTKDFSKLNTYEVSQKGKKVVIIGLGTFYQLGEKAAKLYEEKTGVKATVINPMYITGVDEKLLEELKKDHSLVITLEDGVLDGGFGEKITRFYGNSDMKVLNYGLKKEFLDRYDIGKLLTKNRLKADLIVEDLLKF

SEQ ID NO: 87250 - protein, 276 aa, Fusobacterium nucleatum subsp. vincentii ATCC 49256
MKNVKLLNGVEMPILGFGVYQIPDLEECERVVSEAIGVGYRLIDTAQIYRNEKAVGNAIKKSGVDRKEFFITTKVWITNSGYEKAKTSIEESLKKLQTDYIDLLLIHQPFGDYYGTYRAMEEYYKAGKLRAIGVSNFYPDRFIDIAHFFEIKPMVNQVETHVFNQQIIPQGIMKEYGTQIESWGPFAEGKNNLFTNETLVEVGKKYNKTAAQVALRYLIQRDVVVIPKTVRKERMIQNFDIFNFELSETDMKEILKLDKKESLFLSHYETLKQLTI

SEQ ID NO: 87251 - protein, 496 aa, Streptomyces coelicolor A3(2)
MADPKGFLTTPREEWPRRPAGERVRDWDEVYVPGALLPIVGRQADRCMDCGVPFCHEACPLGNLIPEWNDLVSRSDWRAASERLHATNNFPEFTGRLCPAPCEAGCVLAINQPAVTIKNVECAIADTAWEEGFVPPLPPERLSGRTVAVIGSGPAGLAAAQQLTRAGHTVAVYERDDRIGGLLRYGIPAFKMEKRHLERRVGQMRAEGTRFRTSAAVGRDVDAAALRTRYDAVVIATGATAWRELTVPGRELAGVHQAMEYLPLANRVCEGDLERSPLSAAGRHVVVVGGGDTGADCLGTAVREGAASVTQLDIYARPGAERDERAEPWPTYPRLYRLSAAHEEARDLRSAPAADADARLFAASTLRFTGDERGHVRALHLVGVDTGRRPLPGSERSLPADLVLLALGFSGPDRHDGLVDGLGLDMEPRGTITRDRGFATNVPGVFAAGDAARGQSLVVWAIAEGRAVAAAVDRHLSGGSTRLPAPVGPYDRPMTA

SEQ ID NO: 87252 - protein, 468 aa, Mycobacterium avium subsp. paratuberculosis K-10
MRIAQHISDLIGGTPLVRLNSVVPDGAGIVAAKVEYLNPGGSSKDRIAVRMIDAAEASGALKPGGTIVEPTSGNTGVGLALVAQQRGYKCVFVCPDKVGEDKRNVLMAYGAEVVVCPTAVPPEHPDSYYSVSDRLVTEIEGAWKPDQYANPEGPASHYATTGPEIWADTDGKVTHFVAGIGTGGTITGAGRYLKEVSGGRVRVIGADPEGSVYSGGTGRPYLVEGVGEDFWPQAYDRTVPDEIIAVSDSDSFNMTRRLAREEAMLVGGSCGMAVVAALRVAEQAGPDALVVVLLPDGGRGYMAKIFNDAWMSSYGFLRTRLDGSTDQSRVGDVLRRKSGELPDLVHTHPSETVRDAIGILREYGVSQMPVVGAEPPVMAGEVAGSVSERELLSAVFEGRAKLADAVSLHMSPPLPMIGAGESVSAAGKALRDWDALMVVEEGKPVGVITRYDLLGFLSEGPRGSGGRR

SEQ ID NO: 87253 - protein, 1065 aa, Bacillus cereus ATCC 10987
MDKKVSAIPQPKTYGPLGNLPLIDKDKPTLSFIKIAEEYGPIFQIQTLSDTIIVISGHELVAEVCDETRFDKSIEGALAKVRAFAGDGLFTSETQEPNWKKAHNILMPTFSQRAMKDYHAMMVDIAVQLVQKWARLNPNENVDVPEDMTRLTLDTIGLCGFNYRFNSFYRETPHPFITSMTRALDEAMHQLQRLDIEDKLMWRTKRQFQHDIQSMFSLVDNIIAERKSSGNQEENDLLSRMLHVQDPETGEKLDDENIRFQIITFLIAGHETTSGLLSFAIYFLLKNPDKLKKAYEEVDRVLTDPTPTYQQVMKLKYIRMILNESLRLWPTAPAFSLYAKEDTVIGGKYPIKKGEDRISVLIPQLHRDKDAWGDNVEEFQPERFEDLDKVPHHAYKPFGNGQRACIGMQFALHEATLVMGMLLQHFEFIDYEDYQLDVKQTLTLKPGDFKIRIVPRNQNISHTTVLAPTEEKLKNHEIKQQVQKTPSIIGADNLSLLVLYGSDTGVAEGIARELADTASLEGVQTEVAALNDRIGSLPKEGAVLIVTSSYNGKPPSNAGQFVQWLEELKPDELKGVQYAVFGCGDHNWASTYQRIPRYIDEQMAQKGATRFSTRGEADASGDFEEQLEQWKESMWSDAMKAFGLELNKNMEKERSTLSLQFVSRLGGSPLARTYEAVYASILENRELQSSSSERSTRHIEISLPEGATYKEGDHLGVLPINSEKNVNRILKRFGLNGKDQVILSASGRSVNHIPLDSPVRLYDLLSYSVEVQEAATRAQIREMVTFTACPPHKKELESLLEDGVYHEQILKKRISMLDLLEKYEACEIRFERFLELLPALKPRYYSISSSPLIAQDRLSITVGVVNAPAWSGEGTYEGVASNYLAQRHNKDEIICFIRTPQSNFQLPENPETPIIMVGPGTGIAPFRGFLQARRVQKQKGMNLGEAHLYFGCRHPEKDYLYRTELENDERDGLISLHTAFSRLEGHPKTYVQHVIKEDRMNLISLLDNGAHLYICGDGSKMAPDVEDTLCQAYQEIHEVSEQEARNWLDRLQDEGRYGKDVWAGI

SEQ ID NO: 87254 - protein, 426 aa, Bacillus licheniformis ATCC 14580
MVSHDLSKHSQISKEAQDALDGKSKGFKRLLPFLGPAFIAAIAYIDPGNFATNIAAGSKYGYLLLWVILFSNIMALLIQSLSAKLGIATGKNLPEVAREEFPKPVSIGLWIQGELVVIATDLAEFIGAALGLYLLFGIPMLEASIIAAAGSFAILELQRRGVRPLEAAITGMLFIVVIAFAFQTFFAKPDIGSVLEGMFVPRFDGADSILLAAGILGATVMPHAIYLHSALTQRRVVGKTEAEKKKIFRFEFIDILIAMLIAGAINASMLIVAAALFYKNGIFVEDLDVAFSHFSSMVSPLSAVLFGVGLLTAGLSSSSVGTLSGDIIMQGFINFRIPLYLRRFITILPPIAIIASGVNPTTALVLSQVVLSFGIAFALIPLILFTSNKRIMGSLKNAKWITAVSWLIAALIVALNIFLIYDTFSG

SEQ ID NO: 87255 - protein, 247 aa, Physcomitrella patens subsp. patens
MKLNIANPTTGCQKKVEIDDDAKLRQFYDKRLAQEVSGDQLGDEFKGYVFKIMGGCDKQGFPMKQGVLTQGRVQLLMHRGVSCFRGYGRRNGERRRKSVRGCIVSPDLSVLNLVIVKQGDNDLPGLTDIEKPRMRGPKRATKIRKLFNLTKEDDVRKYVNTYRRSFVSATGKKRSKAPKIQRLVTPLTLQRKRRRVAIKKARVAKAKSEAAEYQKLLALRIKEQREHRSESLAKKRASRASVAKPEA

SEQ ID NO: 87256 - protein, 246 aa, Rickettsia sibirica 246
MRAAGKLAAETLDFITDHVKPNVTTNSLNGLCHNFITSHNAVPAPLNYKGFPKSICTSINHVVCHGIPNDKPLKNGDIVNIDVTVILDGWYGDTSRMYYVGDVAIKPKRLIQVTYDAMMKGIEVVRPGAKLGDIGHAIQSYAEKHNYSVVRDYTGHGIGRVFHDEPSILNYGRSGTGLTLEEGMFFTVEPMINAGNYDTILSKLDGWTVTTRDKSLSAQFEHTIGVTKDGFEIFTLSPKKLDYPPY

SEQ ID NO: 87257 - protein, 276 aa, Rhizobium leguminosarum bv. viciae 3841
MTAQPIITFHDGHSIPQVGLGVWQTPQDIAAPTVRTAIAAGYRHIDTASGYDNEEGVGEGIRSSGLDRKDIFVTTKLRNTDQGYDNTLRAFDGSLKKLGSEYVDLYLIHWPSPHRGLYTETWKAFARIREEGRARSIGVSNFNPEHLERIIGETGVVPVINQIELHPDFQQKAAQEVHKKLGIATESWSPLGQGKFISNADIGEIAKKHQKTPAQVIIRWHIDTGLVVIPKSVTPARIEENFQVFDFKLDADDVAAIAKLDSAGARMGPDPMTATF

SEQ ID NO: 87258 - protein, 540 aa, Burkholderia xenovorans LB400
MTQNSLPSWSSLQTHYEKIRDAHMRDWFAPENDPAPTRAERFAFAGGGLAADFSKNRITDETLKLLVQLAREAGVEKRRDAMFAGAVVNPTEGRAALHTALRATDPKAPFYDQVQAERARMAAFADQVRSGEWKGYTGKRIRYVVNIGIGGSDLGPKMVVHALHHLATPEITTHFVSNVDGADLYNVMQQIDPEETLAIIVSKTFTTLETMTNARSLRDWFVEKGCPESALAKHFVGVSANPAEVVKFGIAKENVFEMWDWVGGRYSLWSAVGLSIMIAVGPQQFGELLAGANEMDQHFRDAPLEKNLPVLLGMIGIWYRNFFGSQSYLVAPYSEALHFLPSYLQQLEMESNGKSARLDGVMVDYPTAAVTWGEPGTNGQHAFFQMLHQGPTIVPIDFIAVLTPEHPLVSHHPKLLANCFAQSEALMLGRTLEEAKKVAGADKPELAPHLVFPGNRPTSTLLVDALTARSLGALIALYEHKVLVQASVWDINPFDQWGVELGKILGKVVEADLTAPSVDEKKHDSSTSALIARARAALKK

SEQ ID NO: 87259 - protein, 483 aa, Erythrobacter sp. NAP1
MTAYPQVKMLIAGNWVAEGGDGEMPIVNPANEERIGSAPKASKAQLDAALAAADAGFQLWSNTPAIERFRVIRRAAELLRERAEGIARVMTLEMGKPHAQALGETTGAADLIDFLGEEAKRQGGRLVPVRSHNLLEQRVTQEPVGPAVLLTPWNFPINLPAKKIAGALAAGCSAILKPAETTPACAQMLTECFMDAGLPEGVLNLVCGDPAMISEHLIASPITRKVSFTGSTAVGKQLGALAAQGMKRFTPELGGHAPVVIGESADFDRTVAACAATKFRNAGQVCVSPTRFLVARGIYDKFVAEFSARSQKLKIGDASQDDSVEMGPLAHAGRVAAMQDLMGSMGGDQGEIVSGGTALDRPGHFFEPTIIASPSPESRLMTEEPFGPVAGIVPYDDIEEAVRIANSLRYGLAAYAFTASLDESHYLGKSLRAGMVAINHFAVGSPETPFGGIGDSGFGSESGVEGYLGYTETKLVTVAKSAP

SEQ ID NO: 87260 - protein, 365 aa, Photobacterium leiognathi
MTLSSAQEIINDIRLGKMVILMDDENRENEGDLIIAADMITPEAINFMATYGRGLICLTLTKDRCQTLNLPLMVQNNHDKFSTAFTVSIEAAADVTTGISAYDRAKTVQAAIGPNASADDIVMPGHIFPLMAQDGGVLIRAGHTEAGCDVARLAGLEASSVIVEILNEDGTMARRPQLEVFAQKHGLKLGTIADLIEYRTQRESHIERLSESELCTEYGVFNLITYRDTIDNQLHYALCKGDINPDSETLVRVHVKDTLKDILHTGATQWSLQAAMQRIQADGGILVIISQIEPSAMILNQINHLDSEHQASLPLPITPQSRQIGLGSQILSELGLCKIRLLSSQSQQYRSLSGFDLEVVEYICN

SEQ ID NO: 87261 - protein, 278 aa, Cladonia arbuscula
VEHGAVKVVAVNDPFIEPHYAAYMLKYDSQHGQFKGTIEVEGSDLIVNGQKVKFYTEKDPGAIPWKDTGAYYIVESTGVFTTTEKAKAHLKGGAKKVVISAPSADAPMFVMGVNEETYKSDIEVISNASCTTNCLAPLAKVMHDDFTIIEGLMTTIHSYTATQKTVDGPSAKDWRGGRTAAQNIIPSSTGAAKAVGKVIPSLNGKLTGMSMRVPTSNVSVVDLTCRLEKSVTYDEIKEAMKKASDGDLKGIMAYSEDDLVSTDLNGDNHSCIFDAKAG

SEQ ID NO: 87262 - protein, 663 aa, Arabidopsis thaliana
MISLTPSLFLNKTVVPGCSTRLSLRQPRTIITPPASLRVFSSLGSNQDPTGSVLIETTATSSSSLETSAADIVPKSTVSGGVQDVYGEDAATEDMPITPWSLSVASGYTLLRDPHHNKGLAFSHRERDAHYLRGLLPPTVISQDLQVKKIMHTLRQYQVPLQKYMAMMDLQETNERLFYKLLIDHVEELLPVIYTPTVGEACQKYGSIFLRPQGLFISLKENEDTIFNNRGKIHEVLRNWPEKNIQGMGIPVGKLSLYTALGGVRPSACLPVTIDVGTNNEKLLNDEFYIGLRQRRATGEVIGTFHLSVRRSCENYGETEPLILFFLQEYSELMHEFMTAVKQNYGEKVVIQFEDFANHNAFDLLAKYGTTHLVFNDDIQGTASVVLAGLIAALRFVGGSLSDHRFLFLGAGEAGTGIAELIALEISKKSHIPLEEARKNIWLVDSKGLIVSSRKESIQHFKKPWAHDHEPIRELVDAVKAIKPTVLIGTSGVGQTFTQDVVETMAKLNEKPIILSLSNPTSQSECTAEEAYTWSQGRAIFASGSPFAPVEYEGKTFVPGQANNAYIFPGFGLGLIMSGTIRVHDDMLLAASEALAEELMEEHYEKGMIYPPFRNIRKISARIAAKVAAKAYELGLATRLPQPKELEQCAESSMYSPSYRSYR

SEQ ID NO: 87263 - protein, 197 aa, Photobacterium leiognathi
MITVRARVPFKIGQKSQIPAELLSFHGFNSGKEHIAIIFKQADTTTAPLVRLHSECLTGDVFHSSRCDCGEQLNETIEKMHQFGGIILYLRQEGRGIGLYNKIDAYHLQSQGMNTYEANNHLGFADDLRDFSEAAKALMALGINKIRLITNNPKKINELQQHGIEIIDVVNTQVHIKQDNEDYLKTKALHGHHNLSL

SEQ ID NO: 87264 - protein, 366 aa, Zea mays
  misc_feature (2)..(3): Xaa can be any naturally occurring amino acid
  misc_feature (7)..(8): Xaa can be any naturally occurring amino acid
  misc_feature (10)..(11): Xaa can be any naturally occurring amino acid
  misc_feature (19)..(19): Xaa can be any naturally occurring amino acid
  misc_feature (26)..(26): Xaa can be any naturally occurring amino acid
  misc_feature (34)..(34): Xaa can be any naturally occurring amino acid
  misc_feature (38)..(38): Xaa can be any naturally occurring amino acid
  misc_feature (46)..(46): Xaa can be any naturally occurring amino acid
  misc_feature (51)..(52): Xaa can be any naturally occurring amino acid
  misc_feature (64)..(64): Xaa can be any naturally occurring amino acid
  misc_feature (78)..(79): Xaa can be any naturally occurring amino acid
  misc_feature (83)..(83): Xaa can be any naturally occurring amino acid
  misc_feature (88)..(88): Xaa can be any naturally occurring amino acid
  misc_feature (96)..(96): Xaa can be any naturally occurring amino acid
  misc_feature (98)..(98): Xaa can be any naturally occurring amino acid
  misc_feature (145)..(145): Xaa can be any naturally occurring amino acid
  misc_feature (156)..(156): Xaa can be any naturally occurring amino acid
  misc_feature (212)..(212): Xaa can be any naturally occurring amino acid
  misc_feature (220)..(220): Xaa can be any naturally occurring amino acid
  misc_feature (226)..(226): Xaa can be any naturally occurring amino acid
MXXYLSXXKXXKVSEDGEXDKLKFGXSSMQGWRXTMEXAHSALLDXDNDTXXFGVFDGHGGKVXAKFCAKYLHREVLXXEAYXAGDLXAAVHRAYXRXDEMMRGQRGWRELQALGDKINQFTGIIEGLIWSPKASDSNDRHDDWXFEEGPHSDFTXPNCGSTACVALVRNRQLVVANAGDSRCVISRNGQAYNLSRDHKPELEAERERIQSXGGYIKMGXVNGSLXLSRAIGDMELKQNKFLSPDKQILTANPDINIVELCDDDEFIVLACDGIWDCMSSQQLVDFIREHINTEESLSAVCEGVLDRCLAPSTMGGEGCDNMTMILVQFKKPFAQVKDASDAEQLTGDAGCSETHGAEENGSGQQI

SEQ ID NO: 87265 - protein, 427 aa, Salinibacter ruber DSM 13855
MSTSLDNSILTVILGGGKGTRLYPLTKLRAKPAVPLAGRYRLIDVPVSTSINSGITRIFVLTQYNSASLNRHLARAYQFDRFSNGFVSILAAEQTPSSKDWFQGTADAVRRSLPHIEGHRHRHVLILSGDQLYSMDYRKMLAHHRETDADVTLGTIPVAADDATSFGILKTDDEHIITEFHEKPDRDELDGLESPVGPGLEDEGRVYHASMGMYIFDREPLHELLNANPNDHDFGNQIIPKAIDKMRVASYPFSDYWSDIGTIRSFYEANLMLAEPEPPFSLYDPNRPLYTRARMLPPAKVQNSTVQDSLITEGSLVENSQISKSVVGIRSYVGPDTTLKNTVMMGADHFRWHDMEERGFVEGPANPGIGENSYVEGAIIDKNVSIGKRCIIKNRDNVQEAEEDLYHIRDGIVVIPKNTRIPDDTII

SEQ ID NO: 87266 - protein, 321 aa, Candidatus Phytoplasma solani
MKIGIIGLPNVGKSTLFNALTKLQVLEANYPFATIEPNVGTVEVIDPRLKVLSKIFHSKKTIAALIEFRDIAGLVAGASQGEGLGNQFLSHIRHVDAICHVVKCFEDPNIAHVVDKSDPLEEIKIIETELALSDLEQIEKRLQKIAKQKKKGDKDLIIEHALLTKIKNHLTNEIAEKLVLSDEELKMVKNFNLLFLKPSLYLANIKERDLININANPFLQKVLAYAQQKGKKVIPLCLQLEKELSFLKTQDKAIFLQDYGLTQTAFTRLIQESYQLLGLQTYFTAGPQEVHAWAFTKGLKAPECAKIIHTDFQKGSIKAEV

SEQ ID NO: 87267 - protein, 510 aa, Dechloromonas aromatica RCB
MHPDYLEKVLNAQVYDVAIETPLDLASNLSARVGNKIILKREDMQPVFSFKLRGAYNKIASLSAEKLKRGVICASAGNHAQGVALSASKLGCRAVIVMPTSTPGIKINAVKSRGGEVVLHGDSFDEAYAHAVELEKTEKLTFVHPFDDPEVIAGQGTVAMEILRQHSRHNGPITAVFCAIGGGGLAAGVAAYIKRLRPEIKVIGVETFDADAMKQSLAAGKRVRVDQVGLFSDGTAVKLVGEETFRLCKEYLDEVILVDTDAICAAIKDVFEDTRSILEPAGALAVAGAKEYARQHKLKDKNLIAITSGANMNFDRLRFVAERAEFGEQREAVFAVTLPEKPGAYKKFLGLIGHRNVTEFNYRFHTASEAHVFVGVQVADRKESLKLVDSLQKHGYPTLDLTDDEMAKNHIRHMVGGHAPAVCEKGMRELLYRFEFPEKPGALMNFLTQMSAGWNISLFHYRNHGADYGRVLVGMQVPPDDMGKFKEFLTNLGYAHWDESQNPAYKLFLG

SEQ ID NO: 87268 - protein, 588 aa, Zea mays
MYCVWQLDSKRCNSQLMLVISVVAAGSLLNRGQLITSVVTKCGDKVLYVVTILPFLMQMYSEASSEIPSQAAIANSRRKTKIVCTIGPSTNTREMIWKLAETGMNVARLNMSHGDHQSHQKVINLVKEYNAQNTDGNVIAIMLDTKGPEVRSGDVPEPIMLSEGQEFNFTIKRGVSTEDTVSVNYDDFINDVEAGDILLVDGGMMSLAVKSKTADTVKCEVVDGGELKSRRHLNVRGKSATLPSITEKDWEDIKFGVENGVDFYAVSFVKDAKVIHELKDYLKGVNADIHVIPKIESADSIPNLQSIIAASDGAMVARGDLGAELPIEDVPLLQAEIVQTCRNMEKPVIVATNMLESMIDHPTPTRAEVSDIAIAVREGADAIMLSGETAHGKYPLKAVKVMHTVALRTESSIYNPTTSPSVIASAQGLQNEEFSPSQLSKMFGSHATMMANTLRTPIIVFTQTGSMAVLLSHYRPSSTIFAFTNEERVKLRLALYQGVIPIHMEFSDDAEETFSRAISSLLKAQYVKKGDYVTLVQSGVTSIWREESTHNIQVRRAQATTCLARRPKSELFSAETGGRGHCCGVMNS

SEQ ID NO: 87269 - protein, 412 aa, Lactobacillus plantarum WCFS1
MASNFETLRSDFPILNQQVNDERLVYLDNAATAQRPNQVVDALVHFYQHDNANVHRGVHTLAERATSQYEAARAKVQRFINAPKTDEIVFTKGTTDSLNLIASTYGEANIQAGDEIVISVMEHHSNLIPWQQLALRKHATLKYIELTATGELDMADAANKITDRTKIVSVTHASNVLGTVNPIKALARLAHQHGAVMIADGAQAAPHMPVDVQALDVDFYAFSGHKMLGPTGIGVLYGRENLLATMPPYQFGGEMIGFVHRDDSTWAELPWKFEAGTQNIAGAIGLGAAVDYLTQLGMDQVQQHEQQLVNYLLPKLIAMPGVTVYGPQDPQYHTGVIAFNIDGLHPHDAATALDMEGVAVRAGHHCAQPLMAALGLVATARASFYIYNTQADADQLLTSLQATKEFFEHGTV

SEQ ID NO: 87270 - protein, 144 aa, Coxiella burnetii RSA 493
MAIERTLSIIKPDAVAKNVIGQIYSRFEKAGLKIIAAKMCHLSKPQAEKFYAVHKDRPFYPDLVKFMTQGPVMIQVLEGENAIVKNREIMGATNPKEALPGTIRADFADSIDANAVHGSDGPETAKEEIAFFFKPDESFNSIGV

SEQ ID NO: 87271 - protein, 532 aa, Coxiella burnetii RSA 493
MTAFEIIPFILFLVVIGTAIAERINVPYPLVLVVTGLIVGFIPGIPNWHPPSDLVLPLFLPPILFAAARLISWEDIQNNKSEISSLSILLVIASTIVIGVILAWIVPGMPLSASLVLGAIISPTDAIASTSILNRMRIPKHIIRSLEVESLFNDAVSIVLYNMGLMFVFMGAINLLHAGESMLIVGLGGIAVGLMFSYFTSLIVKEFLTESENELPIIMSVILAYVSYLFADRIGVSGVLAVVAAGLFHKRTEKTIKARTRLSEKSVWDTLIFFLNGLIFIVIGMQFPNFLGKVNYLPIGQLILFSTITVLSLILLRFIWVLATNLLVNSLSRLRKHPTKRYVFSWREVLISSWSGMRGLVSLALALALPIMLPDTTPFPYRDLIIFLTIIAILFTLLVQGLTLPYLVKLLKSEKSDAAFIKESSKIYRRLTKEAIQHIDQLDAGEHICSENAKKLVNNYYANRLLQFKVTYETECDTHEVGHEAEALLSKILNYERNRLHEMRSHGEVSEEVYIRILSKIDRDEVGFASYK

SEQ ID NO: 87272 - protein, 278 aa, Cladonia arbuscula
  misc_feature (263)..(263): Xaa can be any naturally occurring amino acid
VEHGAVKVVAVNDPFIEPHYAAYMLKYDSQHGQFKGTIEVEGSDLIVNGQKVKFYTEKDPGAIPWKDTGAYYIVESTGVFTTTEKAKAHLKGGAKKVVISAPSADAPMFVMGVNEETYKSDIEVISNASCTTNCLAPLAKVMHDNFTIIEGLMTTIHSYTATQKTVDGPSAKDWRGGRTAAQNIIPSSTGAAKAVGKVIPSLNGKLTGMSMRVPTSNVSVVDLTCRLEKSVTYDEIKEAMKKASDGDLKGIMAYSEDDLVSTXLNGDNHSCIFDAKAG

SEQ ID NO: 87273 - protein, 202 aa, Corynebacterium efficiens YS-314
MFSFAPKHFLEPQTSETCGRLVGVIVVSMTLKTATAILHTNRGDISIDLFGNHAPETVANFIGLAEGTKEYKTANASGSQEGPFYDGAVFHRVIDRFMIQGGDPTGTGRGGPGYNFGDEFHPELRFDRAYLLAMANAGPGTNGSQFFITTTPTPHLNNAHTIFGEVTDPESQKVVDAIGTTPTDRMDRPIEPVVIESVEIIK

SEQ ID NO: 87274 - protein, 310 aa, Dechloromonas aromatica RCB
MKIANNVTELVGNTPLVKLNRVTAGAGATIAAKLEFFNPGHSVKDRIAVSMLDAAIAAGKVGPDTVILEPTSGNTGIGLAMVCAARGIKCAFVMPETMSRERKLLLKAYGAELILTPGPEGMGGAIAKAKALAESDPKYFVPQQFENPANPEVHRNTTAEEIWRDTDGQVDIFVSGVGTGGTITGVGEVLKAKKPGIKIVAVEPDASPVLSGGQKGPHPIQGIGAGFVPGVLNTAVYDEVIRVKNDDAFAIARQMATEEGLLVGISSGAATWAALELARRPENAGKLIVVIIPSFGERYLSTPLYQHLEV

SEQ ID NO: 87275 - protein, 510 aa, Erythrobacter sp. SD-21
MSANIAEMERRRAAAKLGGGAKRIAAQHVKGKLTARERLDVLLDEGSFEELDTYVEHDCVDFGMQDQKIPGDGVVTGSGTINGRLVYVFSQDFTVFGGSLSKRHAEKICKVMDTAMKVGAPVIGLNDSGGARIQEGVASLGGYAEVFQRNVLASGVVPQISLIMGPCAGGAVYSPAMTDFIFMVEDSSYMFVTGPDVVKTVTNEVVTQEELGGAKTHTTKTSVADNSFENDIETLLTTRDFFDYLPLSNREEVPERPTSDPWDRQEDSLDTLIPDNANQPYDMHEVIRKTLDEGDFFEIQPNHAANIICGFGRVEGRTVGVVANQPMVLAGVLDINSSKKAARFVRFCDAFEIPILTFVDVPGFLPGTAQEHNGIIKHGAKLLFAYAEATVPKITVITRKAYGGAYDVMASKHLRGDLNYAWPTAEIAVMGAKGAVEIIFRQDRDDPDKIAEKTKEYEDRFANPFVAAQRGYIDEVIYPHSTRKRIALGLRKLRTKQLENPWKKHDNIPL

SEQ ID NO: 87276 - protein, 387 aa, Populus trichocarpa
MDLDNKKDQESRSLFDFLSQKAYTPPSWASLLNPIPSHIFSLGHLPTPIHKWNLPNLPTNTEVYLKRDDLSGMQLSGNKVRKLEFLMADAVAQGADCIITIGGIQSNHCRATAVAAKYLNLDCYLILRASKVVVDKDPGLTGNLLVERLVGANVQLISKEEYAQIGSVNLTNDLKEKLVKEGRKPYVIPVGGSNSLGTWGYIEAIREIEQQVQATTGRIKFDDIVVACGSGGTIAGLSLGSWLGTLKAKVHAFAVCDDPDYFYNFVQDLIDGLKAGVDSHDIVNIQNAKGLGYAINTSEELKFVKEIATTTGVVLDPVYSGKAAYGMMKDMAENPKNWEGRKVLFIHTGGLLGLFDKVDQMSSLVENWGRMEVQESVPRKDGIGKMF

SEQ ID NO: 87277 - protein, 133 aa, Zea mays
  misc_feature (83)..(83): Xaa can be any naturally occurring amino acid
  misc_feature (89)..(89): Xaa can be any naturally occurring amino acid
  misc_feature (97)..(98): Xaa can be any naturally occurring amino acid
  misc_feature (105)..(106): Xaa can be any naturally occurring amino acid
  misc_feature (111)..(111): Xaa can be any naturally occurring amino acid
  misc_feature (116)..(116): Xaa can be any naturally occurring amino acid
  misc_feature (122)..(122): Xaa can be any naturally occurring amino acid
ERWSLKAKTVLVTGGTKGIGHAIVEEFAGFGAVIHTCARNEYELNECLSKWQKKGFQVTGSVCDASLRPEREKLMQTVSSMFXAKLDIXINNLGAIXXNPTLDYXXQEDFXFHISXNLKNLXYHPEPALRILL

SEQ ID NO: 87278 - protein, 491 aa, Amborella trichopoda
GSGSGLSTLAEKSVGRIAQIIGPVLDVAFPPGKMPNIYNSLVVKGRDTAGQQINVTCEVQQLLGNNRVRTVAMSATDGLMRGMEVIDTGAPLSVPVGEATLGRIFNVLGEPVDNLGPVDTRTTSPIHRSAPAFIQLDTKLSIFETGIKVVDLLAPHRRGGKIGLFGGAGVGKTVLIMELINNIAKAHGGVSVFGGVGERTREGNDLYMEMKESGVINEQNIAESKVALVYGQMNEPPGARMRVGLTALTMAEYFRDVNEQDVLLFIDNISRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGPDELSEEDRLTVARARKIERFLSQPFFVAEVFTGSPGKYVGLAETIRGFQLILSGELDGLPEQAFYLVGNIDEATAKAINLEVESKLK

SEQ ID NO: 87279 - protein, 405 aa, Alteromonadales bacterium TW-7
MALIVQKYGGTSVGSIERIEAVADLVVKTRQQGHQVVVVLSAMSGETNRLINLAKQIDSRPSNRELDVLISTGEQVSVSLLAMAIIKRGHSAVSLLADQVNIQTDNMFGKARITDIAATRLKHELEHNRIAIIAGFQGRDVEGNITTLGRGGTDTSAVEIAAAIKADECQIYTDVDGVYTTDPRVEPNARRMSQVTFAEMLELASLGAKVLHIRSVEAAGKHNVPLRVLSSFNPDEGTLITFEEDDMPSKVVSGIAFNADECLIKVQGVQSGTQNLVKILKLFADNGIEIDMINQVNHIFEKIDYAFTVHSNDYPQALELLTEQKVSLGAENIIGLTTIAKVSAVGMGMKSHWGVASLFFDALANENINVVLVSTSEIKISVLIDEKYLELAVRALHKVFLTESR

SEQ ID NO: 87280 - protein, 484 aa, Oryza sativa Japonica Group
MQGLGFSRRLLQAAVAPVRAQSSLFAAAAAAAPAPENAFAAAPKMPPFDYTPPPYDGPRAEEISRKRAEFLSPSLFHFYDRPWAYRHPRFGSYRDYHKYLFDEDGRRYLDAFGGIATVCCGHCHPDVVEAMVNQAKRIQHSTVLYLNHAIADFAEALAAKMPGDLKVVFFTNSGTEANELALMIARLYTGCHDIISLRNGYHGNAAGTMGATAQCNWKFNTGVHHALNPDPYRGAFGSDGEKYARDVQEIIDFGTTGRVGGFISEAIQGVGGIVELAPGYLPAVYNMVRKAGGLCIADEVQAGVARTGSHFWGFESHGVIPDIVTMAKGIGNGIPIGAVVTTPEIAQVLTRRSYFNTFGGNPVSTAGGHAVLKVLEKEKLQENAFVVGSYLKERLNKLKEKHDIIGDVRGKGFLLGVELVTDRQKKTPAKVEIGHVMNHMKDMGVLVGKGGFYGNVFRVTPPLCFTKEDSDFFIEAMDISLSKL

SEQ ID NO: 87281 - protein, 75 aa, Zea mays
  misc_feature (15)..(15): Xaa can be any naturally occurring amino acid
  misc_feature (22)..(22): Xaa can be any naturally occurring amino acid
MLCFAELAPPPCGRXSQRVFHXGKGKSVGHKNMKELLGRKGPNLAEMACIALSVPPGFTVSTEACHQYQEASRAL

SEQ ID NO: 87282 - protein, 518 aa, Burkholderia xenovorans LB400
MSFSPSIAGLSGPLSALSDALTTAPESAFASLGSVFLTRLPAAPLSAPYVVGFSAETAALLGLEPGIENDPAFAELFSGNATREWPAEALPYASVYSGHQFGVWAGQLGDGRALGLGEVEHGGRRFELQLKGAGRTPYSRMGDGRAVLRSSIREYLCSEAMHHLGIPTTRALCVIGSDQPVRRETVETAAVVTRVAPSFVRFGHFEHFYSNDRTDALRALADHVIERFYPHCREADDPYLALLNEAVISTADLMVEWQAVGFCHGVMNTDNMSILGLTIDYGPFGFMDGFDAGYICNHSDSQGRYAYRMQPQIAYWNLFCLAQGLLPLLGEKHEESVRGDKAIEDAQRVLGGFKDRFAPALERRMRAKLGLETERAGDDALANRLFEVMHANRADFTLTFRNLARVSKHDASGDAAVRDLFLDRAAFDAWVNDYRARLSEETREDAARAIAMNRVNPKFVLRNHLAETAIRRAKEKDFSEVERLAAVLRRPFDEQPEHEAYAGLPPDWASSLEVSCSS

SEQ ID NO: 87283 - protein, 208 aa, Prosthecochloris aestuarii DSM 271
MPAGLSSMSACGQSPAMKIDSATFYKSCSELKGLPVSSLPEIVFVGRSNVGKSTLLNTLTGRKALAKTSSTPGKTQLINYFTINDRLYFVDLPGYGYAKVAKGQRYEWGRLLGGYISEREEISLVVLLIDSRHPDMESDQQMIEFLEYYQRPYGIVLTKYDKLKQKEKSRVRKALKSFSLKTKFIVNYSALSGEGKESLLEQLENYTG

SEQ ID NO: 87284 - protein, 449 aa, Mycobacterium avium subsp. paratuberculosis K-10
MARLEQTRRLVTEIPGPASLELSKRRAAAVSHAVNVSVPVFVARAGGGIVEDVDGNRLIDLGSGIAVTTIGNSAPRVVDAVRAQVAEFTHTCFMVTPYESYVAVAEMLNRITPGAGDKRSVLFNSGAEAVENAVKVARAYTRKPAVVAFDHAYHGRTNLAMALTAKSMPYKGGFGPFAPEIYRAPLSYPYRDGLLDKELATDGEKAAARAINIIDGQIGADSLAAVIIEPIQGEGGFIVPVEGFLPTLLDWCRRNDVLFIADEVQTGFARSGAMFACEHEGPNGLEPDLICTAKAIADGLPLSAVTGRAQIMDAPHVGGLGGTFGGNPLACAAALATIETIESDGLIERARQLERLITEPLLRLQARDDRIGDVRGRGAMIAIELVKSGTAEPDKDLTQRLSVAAHAAGVIVLTCGMFGNIIRLLPPLTISDELLAEGIDILGGLLADL

SEQ ID NO: 87285 - protein, 372 aa, Prosthecochloris aestuarii DSM 271
MDEAVQHLYAIIMAGGQGSGLWPLSRRDMPRQFVDIFGIGTMIERTVQRLSGIVPPDHIYIVTSSRGQALVSTLLPGFPMSNVLAEPLGRKTAPCIALATAFVKKRDPDAVTLVVPSDHLVEDNATFEKTIREGVQLALQKKELVTIGIRPDRPETTYGYMQVDIPASQRSLSPGQTTTLHHVRAFAEKPDSRTAQEFVDSGDFFWNSGIFIWHIDVICRELEHWMPDLYRDLLYMYEAIGSSKEQEVIEDVYSWQHPVAIDCGVMEKSESVVMLEGQFGWMDLGNWDDMLSAQQVSSIPDASGRVQNLIEVDTVNTIVHKPSSKAVCLVGVTDLIVVETDDALLICRKGDSRGVRKAVDIMRRNDGMEGYL

SEQ ID NO: 87286 - protein, 277 aa, Synechococcus sp. CC9311
MFADLLASTKEPTVTSTGPRIQQRRGVEIKSARELKIMAKASSIVATVLREIMELVEPGQTTGDLDAHAERRIREMGATPSFMGYHGFPASICASINNEVVHGIPSNKRVIHAGDLLKVDTGAYFDGYHGDSCITVCVGDVSEEARKLSRVAQESLMAGLSQIRAGNTLLDIAGAVEDHVKANQFSVVEDYTGHGVGRNLHEEPSVFNFRTNDLPNVKLRPGMTLAVEPILNAGSNACRTLKDRWTVVTKDGSLSAQWEHTIVVTSDGCEILTDRGN

SEQ ID NO: 87287 - protein, 341 aa, Aggregatibacter actinomycetemcomitans
MINLILCGGSGTRLWPLSRVKVPKQFIKLFNHHSLFQLTQSRNAQFSEKTIAVVNDTQFLLAYEQSDNVNQMKFILEPVGRNTAPAIALSCFGLEYNDIVLVTSSDQLIKNQDNYLNMVCKAEKLAEKGFLVTFGLKPKYPETGFGYIETLDEENVLTFREKPDFDTAKKYVESGRYFWNCGIFCFKAGVFLEELLKYSPDIYYKAKEAYEERVINDNIESISLGNMLEIPSDSIDYAVMEKSDKIKVICGDLGWSDIGSFDSLEKEFAKNQDSNNQIEHHISISSSNNFIWSKKKIVTIDVDDLIIVDTDDVLLVVKKGSSQKVKKVVEYLKEIEPNLVN

SEQ ID NO: 87288 - protein, 218 aa, Bacillus licheniformis ATCC 14580
MVYVAPSILSADFARLGEEIRDVEQGGADFIHIDVMDGHFVPNLTIGPLVVEAVRPITELPLDVHLMIEAPDRYIPAFAKAGADILSVHVEACPHLHRTIQLIKEQGVKAGVVLNPHTPVQQIEHVLEDLDLVLLMTVNPGFGGQSFISSVLPKIRQVKEMAEQKGLADLLIEVDGGVNKNTARQCIEAGANLLVAGSAVYNEKDRKKAISDIKGALG

SEQ ID NO: 87289 - protein, 397 aa, Pyrococcus furiosus DSM 3638
MEIGVVGKPNVGKSTFFSAATLVDVEIANYPFTTINANVGVTYAITEHPCKELGCTPNPQNYEYREGLALIPVKMIDVAGLVPGAHEGRGLGNKFLDDLRMASALIHVIDATGKTDEEGRPTDFHDPVEDIEFLEREIDYWIYGILKKGWEKFAKRIKLQKMKIETAIAEHLSGIGVTENDVWEAMHRLGLPDDPTAWSDEDLLSFASEIRKINKPMIIAANKADAASDEDIKRLKREGEKRGYIVVPTSAAAELTLRKAAKAGFIEYIPGSSDFKILKEMSEKQKKALMLIKERVLDRFGSTGVQEVINKAVFELLKLIPVYPVQDENKLTDQFGNVLPHVFLMKKGSTPRDLAFKVHTDLGKGFLYAINAKTKRRVGEDYELQFNDIIKIVAVTK

SEQ ID NO: 87290 - protein, 507 aa, Pseudomonas fluorescens PfO-1
MTHTIRRKSKAEPAPPTTLFLFGAHGDLVKRLLMPALYNLSRDGLLDDGLRIVGVDHNAITDEAFAQKLEDFIRTEVAAKVGKGDQMLDPALWAKLAKGISYVQGDFLDDSTYSALAAKIADSGTGNAVFYLATAPRFFSEVVRRLGSAGLLEETAEAFRRVVIEKPFGSDLQTAEALNACLLKVMSEKQIYRIDHYLGKETVQNILVSRFSNSLFEAFWNNHYIDHVQITAAETVGVETRGSFYEHTGALRDMVPNHLFQLLAMVAMEPPAAFGADAVRGEKAKVVGAIRPWTTEEARENSVRGQYSAGEVAGKPVSGYRDENNVSPDSTTETYVALKVMIDNWRWVGVPFYLRTGKRMSVRDTEIVICFKPAPYAQFRDTEVDELQPTYLRIQIQPNEGMWFDLLAKRPGPALNMANIELGFAYKDFFEMQPSTGYETLIYDCLTGDQTLFQRADNIENGWRAVQPFLDAWQQDASVQTYAAGEDGPKAADDLLTRDGRVWHGLG

SEQ ID NO: 87291 - protein, 355 aa, Aggregatibacter actinomycetemcomitans
MLKNILITGGAGFIGSAVVRYIIENTQDSVVNVDKLTYAGNLESLEAVKNNPRYIFEQVDICDAKALARIFEQHQPDAVMHLAAESHVDRSIDGPATFIETNIVGTYILLEAARAYWSSLNDEKKAGFRFHHISTDEVYGDLDGTNNLFTETTPYSPSSPYSASKASSDHLVRAWLRTYSLPTIVTNCSNNYGPFHFPEKLIPLIILNALDGKPLPVYGNGQQIRDWLFVEDHARALYKVVTEGKIGETYNIGGHNEKANIDVVRTICALLEELVPDKPAGVTKYEDLITYVKDRPGHDVRYAIDATKISRELGWKPQETFESGIRKTVEWYLNNRKWWSRVLDGSYNRERLGSQ

SEQ ID NO: 87292 - protein, 477 aa, Swietenia macrophylla
  misc_feature (38)..(38): Xaa can be any naturally occurring amino acid
  misc_feature (60)..(61): Xaa can be any naturally occurring amino acid
LEKKKMGQIAQIIGPVLDVPFPPGKMPNIYNALVVKGXBTVGQPINVTCEVQQLLGNNRXXAVAMIATDGLTRGMEVIDTGAPLSVPVGGATLGRIFNVLGEPVDNLGPVDTLTTSPIHKPAPAFIQLDTKLSIFETGIKVVDLLAPYRRGGKIGLFGGAGVGKTVLIMELINNIAKAHGGVSVFGGVGERTREGNDLYMEMKESGVINEQNIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFKLILSGELDGLPEQAFYLVGNIDEVTAKATNLE

SEQ ID NO: 87293 - protein, 396 aa, Lactobacillus plantarum WCFS1
MTVEDAQTSTRWRAYLALGLATVAMIVCFMSWSNFAPLAGELAIKFHLSVSQRTLLLATPVLLGSIMRIPVGILSDRYGGKKVYLILMAFILIPLLMITKVHTYGMLLVAALLVGMAGTSFAVGVSYASVWFPPEKQGLALGIVSMGNMGNAVAALTLPSISTSYGFNMVYYFLMVLTVILAVLFAIFCREMPVDKTKTVTGALAVAKESSTWYLSLFYFLTFGLFVSFTNLTPLFLEDIFRVPQVTAGLYAALFAGLCTVVRPIGGAAADKWRPMQMLQWIFIGITVFAVIITLTFSNQSLFIFGIVGAGLIAGFGNGVIFKMVPYVLQGNTGAVTGFVGALGGLGGFFPPLLVGWIHTWTGSYRLGIVLLALTGLVCWYALWRRFIHGDVHIVK

SEQ ID NO: 87294 - protein, 121 aa, Bacteroides fragilis YCH46
MRKLILLVDDKETIAKVASIYLGKDYDIQYFPDPIHALEWLHEGKTPDLIISDIRMPLMRGDEFLHYLKCNELFKDIPVIMLSSEESTSERIRLLQEGAVDYILKPFNPMELKIRVKKIIE

SEQ ID NO: 87295 - protein, 207 aa, Alteromonadales bacterium TW-7
MAQVRARVQLNVGKNSDIPAEIVSFTDLKDGQEHIAMVFNNADTEQDVPLIRMHSECLTGDVFHSSRCDCGEQLNECIEMMHEQGGILLYLRQEGRGIGLYNKIDAYVLQSQGMNTYEANNHLGFADDLRDFSDAVLMLNALNLKHVKLMTNNPKKLNALKDAGIEVDTVIGTHAHIKAGVAGNKAYLETKIKHGAHMLDIKKIKKP

SEQ ID NO: 87296 - protein, 694 aa, Burkholderia xenovorans LB400
MAVDYTTHDGVAVITLNNPPVNGLGLSTRAGIVEGIERAQNDPGIEAIVLTGAGKAFSGGADITEFNTPKATQEPTLATVIKIVEGSAKPVVAAIHSVAMGGGLELALGAHYRVAAPGAQIALPEVKLGILPGAGGTQRLPRAIGLEAALNMIVSGTPVMSEKLADSGLFDELAQGDLAEAALAFARKVGAKEGPHPKLRDRRIEHPNAAGFIQFARNSVAAVAKHFPAPHKCIDAVEAGVQNGFDKGLAFERECFIALVQTPESRALRHAFFGERAASKIPDVPSDTPVRDINQVAVIGAGTMGGGIAMNFINAGIPVTLLETRQEALDRGLATIRKNYEASVRKGKLKPEALEQRMALITPTLSYDDLKNADLIVEAVFEELDVKEQVFRRLDEVAKQGAILASNTSTLDVDRIAAFTKRPQDVVGMHFFSPANVMKLLEVVRGRETAKDVLATVMKLAKKIRKTAVVSGVCDGFIGNRMIEQYIRQALFMLEEGALPAQVDRAIEKFGFAMGPFRMSDLAGNDIGWAIRKRRYQEHPDMHYSKIADRLCETGRFGQKTGGGWYDYKAGDRTAYPSKVVDDMIVAFSKEANAGRRKISDEEIVERLVFSLVNEGAKILEEGIASKASDIDMVYLAGYGFPLYRGGPMLYADTVGLYNVERAIRRYAAQPNGDAWQLASGIAALAAQGRGFNG

SEQ ID NO: 87297 - protein, 376 aa, Saccharophagus degradans 2-40
MTDTFIKSRAAVAWAAGEPLSIEEVDVMMPKAGEVLVKIVATGVCHTDAFTLSGEDPEGIFPAILGHEGGGIVEALGEGVTSVAVGDHVIPLYTPECGECKFCLSGKTNLCQKIRATQGKGLMPDGTTRFYKDGQPIYHYMGTSTFSEYTVLPEISLAKVNQKAPLEEVCLLGCGVTTGMGAVMNTAKVKEGDTVAIFGLGGIGLSAVIGATMAKASRIIAIDINESKFELAKKLGATDCINPKLYDKPIQDVIVELTDGGVDFSFECIGNVNVMRSALECCHKGWGESIIIGVAGAGQEISTRPFQLVTGRVWRGTAFGGVKGRSELPGIVEQYLAGDFKLDDFITHTMGLEDINTAFDLMHHGKSIRSVIHFNK

SEQ ID NO: 87298 - protein, 180 aa, Mycobacterium avium subsp. paratuberculosis K-10
MTDAGEATPVAELIASLTRQVPDFPKPGIQFKDLTPLFAEATAMTAVTGALARHASGADLVAGIDSRGFLVAAAVADRLHTGVLAIRKGGKLPPPVHAERYDLEYGSATLEIPADGIDLRGRRIVIIDDVLATGGTLAAAARLLRRTGATVTAAAVVFELGALGGRAALAPLPVHSLTCQ

SEQ ID NO: 87299 - protein, 321 aa, Burkholderia xenovorans LB400
MPLNPKIEQVLDMIERARRPKFHEMTAQDARASYEKSAPILEIASAPMFAIEDLRIPTRDGATIRARLYHPVEPGWAEPAPALVYYHGGGFTVGSVNTHDALCRMFARDGKCTVLSVDYRLAPEYKFPTAVEDAFDALTWLHAHAAEYGVDASRIAVGGDSAGGTLATVCAVLAREHGIEPVLQLLIYPGTTGHQQTDSHSRFANGFLLSGDTIQWFFEHYVRDRSDRDDWRFAPLDGRHGAPDFRGVAPAWIATAEYDPLSDEGDAYAEKLRALGNRVTLKRYPGMIHEFFKMGGFVPEVGEAHADAAAALRAAFGVDAH

SEQ ID NO: 87300 - protein, 247 aa, Physcomitrella patens subsp. patens
LQLNIANPTTGCQKKVEIDDDAKLRQFYDKRLAQEVSGDQLGDEFKGYVFKIMGGCDKQGFPMKQGVLTQGRVQLLMHRGVSCFRGYGRRNGERRRKSVRGCIVSPDLSVLNLVIVKQGDNDLPGLTDIEKPRMRGPKRATKIRKLFNLTKEDDVRKYVNTYRRSFVSATGKKRSKAPKIQRLVTPLTLQRKRRRVAIKKARVAKAKTEAAEYQKLLALRIKEQREHRSESLAKKRASRASLAKPEA

SEQ ID NO: 87301 - protein, 356 aa, Triticum aestivum
  misc_feature (262)..(262): Xaa can be any naturally occurring amino acid
  misc_feature (271)..(271): Xaa can be any naturally occurring amino acid
FRAAARAGAVVSTQSPDNPDWFQGTADAVRQYLWLFEEHNVMEYLILAGDHLYRMDYEKFIQAHRETDADITVAALPMDEERATAFGLMKIDEEGRIIEFAEKPKGEQLKAMMVDTTILGLDDARAKEMPYIASMGIYVISKHVMLQLLREQFPGANDFGSEVIPGATSTGMRVQAYLYDGYWEDIGTIEAFYNANLGITKKPIPRFSFYDRSAPIYTQPRHLPPSKVLDADVTDSVMGEGCVIKNCKIHHPVVGLRPCISXGAIIEDTCXMGADYYETEADKKLLAEKGGIPIGIGKNSHIKRAIIDKNARIGDNVMIINVDNVQEAARETDGYFIKSGIVTVIKDALLPSGTVI

SEQ ID NO: 87302 - protein, 247 aa, Physcomitrella patens subsp. patens
MKLNIANPTTGCQKKVEIDDDAKLRQFYDKRLAQEVSGDQLGDEFKGYVFKIMGGCDKQGFPMKQGVLTQGRVQLLMHRGVSCFRGYGRRNGERRRKSVRGCIVSPDLSVLNLVIVKQGDNDLPGLTDIEKPRMRGPKRATKIRKLFNLTKEDDVRKYVNTYRRSFVSATGKKRSKAPKIQRLVTPLTLQRKRRRVAIKKARVAKAKTEAAEYQKLLALRIKEQREHRSESLAKKRASRASLAKPEA

SEQ ID NO: 87303 - protein, 501 aa, Oryza sativa Indica Group
MPRRPSGGGGGAGPAAAAVRKVPLRKLLRAASVACGVQFGWALQLSLLTPYVQELGIPHAFASLVWLCGPLSGLLVQPLVGHLSDRIAPAASPLGRRRPFIAAGAASIAAAVLTVGFSADLGRIFGDSITPGSTRLGAIIVYLVGFWLLDVGNNATQGPCRAFLADLTENDPRRTRIANAYFSLFMALGNILGYATGAYSGWYKIFPFTVTPSCSISCANLKSAFLLDIIILVVTTCITVASVQEPQSLGSDEADHPSTEQEAFLWELFGSFRYFTLPVWMVLIVTALTWIGWFPFILFDTDWMGREIYRGSPDDPSITQSYHDGVRMGSFGLMLNSVLLGFTSIVLEKLCRKWGAGLVWGVSNILMALCFVAMLVITYVAKNMDYPPSGVPPTGIVIASLVVFTILGAPLAITYSIPYAMAASRVENLGLGQGLAMGILNLAIVIPQVIVSLGSGPWDQLFGGGNAPAFAVAAAASFIGGLVAILGLPRARIASRRRGHR

SEQ ID NO: 87304 - protein, 575 aa, Rickettsia sibirica 246
MNDHILINVIILLGTAVFIVAILKRLRLSPVLGYLIAGAAIGDHGLKIVTYDQTKLLGELGVVFLLFAIGLELSFERLKAMRRYVFGLGSLQVLTTAIVIAGAMVLIDGNSSAAIITGGGLALSSTALVMQVIEENRSQSTQIGRVSLAILLLQDLAVVPLLVIVPLLAGNNKASLVAALGIALLKAVTALLTIFIVGRVFLRPVFSFISSESNNTSELPISMTLLIVLSAAWATETFGLSLALGAFVAGVLVAETEFRLQAEESIYPFKSLFLGLFFMTVGMNIDALEMYEKISHILTLSIALIGIKTLIITAFCILFGFNKGVAFYSGLLLSQGGEFGFILFSLGKDSGVLEESTADILLLVVTFTMALTPLLAALGQKIAEKVDKGLGKTPTQMIELGARDLTNHIIIAGLGNTGKMVARVLEAEGISYVILDLDDDRVKEELSNGLPVFKGDVSQADTLKALGTERAFAIILTMNNQVTIKKSLKTISGNYQDIPVVVKLKNLKNAREFYDLGATTIIPESYETGLQIGGTVLKNIGISEQEINRIKVQFRLGNYIIAKKEDALSEAEDND

SEQ ID NO: 87305 - protein, 217 aa, Aggregatibacter actinomycetemcomitans
MTKIELVAQANLPTEFGLFKIVGFEFPDTKKEHVALVLGDIRNSDEPVLARIHSECLTGDALHSLKCDCGFQLAAALRQIQQEGLGVLIYHREEGRGIGLINKIRAYSLQDQGMDTIEANLALGFAADERNFGVCADIFDLLGVTQIRLLTNNPNKIKTMKQAGINVVARVPLNVGENRYNTAYLDTKAKKMGHFIVHNGEQHLMECPYCQEEVPKK

SEQ ID NO: 87306 - protein, 195 aa, Bacillus cereus E33L
MILMIDNYDSFTFNLVQFLGELGQDLVVKRNDEVTISDIENMKPDFLMISPGPCSPNEAGISMEVIRYFAGKIPIFGVCLGHQSIAQVFGGEVVRAERLMHGKTSLMHHDEKTIFSDIPNPFTATRYHSLIVKKETLPDCLEVTSWTEEGEIMALRHTTFPIEGVQFHPESIMTSHGKELLQNFIRKYSPSVTSC

SEQ ID NO: 87307 - protein, 437 aa, Vitis vinifera
MSDSLGAAAFMMKPKNFLQNIMKPFKFSSSKEGQKEEDLEKIAAQEQKLFPFETLVAATKNFHQKLGEGGFGPVFKGRLEDGREIAVKKLSQNSNQGKKEFENEAKLLARVQHRNVVNLLGYCTRGAEKLLVYEYISNESLDKFLFNWEEIDSNIDGDCDGLDSETGRREELDWKRRYDIIGGIARGLLYLHEDSHSCIIHRDIKASNVLLDDKWAPKIADFGMARLFPEDQTHVNTRVAGTNGYMAPEYVMHGHLSVKADVFSFGVLILELISGQKNSTFDVNLDAQNLLEWEKRDGMASFCDYCRLLQAWKLYKKGRSLEVLDPSLASSAVAEQVAMCVQIGLLCTQADPQSRPNMRRVVVMLSKKPGTLEEPTRPGYPGSRYRRSRRPTASTSTAGTSGESSHTFESTTNSATATTSGVASPRLDSRGKRPVQG

SEQ ID NO: 87308 - protein, 289 aa, Oryza sativa Japonica Group
MEGKEEDVRLGANRYSERQPIGTAAQGAGDDKDYKEPPPAPLFEPGELKSWSFYRAGIAEFVATFLFLYITILTVMGVSKSSSKCATVGIQGIAWSFGGMIFALVYCTAGISGGHINPAVTFGLFLARKLSLTRAIFYIVMQCLGAICGAGVVKGFQQGLYMGNGGGANVVASGYTKGDGLGAEIVGTFILVYTVFSATDAKRNARDSHVPILAPLPIGFAVFLVHLATIPITGTGINPARSLGAAIIYNKDHAWNDHWIFWVGPFVGAALAAIYHQVIIRAIPFKSRS

SEQ ID NO: 87309 - protein, 275 aa, Cladonia arbuscula
GAVKVVAVNDPFIEPHYAAYMLKYDSQHGQFKGTIEVEGSDLIVNGQKVKFYTEKDPGAIPWKDTGAYYIVESTGVFTTTEKAKAHLKGGAKKVVISAPSADAPMFVMGVNEETYKSDIEVISNASCTTNCLAPLAKVMHDNFTIIEGLMTTIHSYTATQKTVDGPSAKDWRGGRTAAQNIIPSSTGAAKAVGKVIPSLNGKLTGMSMRVPTSNVSVVDLTCRLEKSVTYDEIKEAMKKASDGDLKGIMAYSEDDLVSTDLNGDNHSCIFDAKAG

SEQ ID NO: 87310 - protein, 247 aa, Bacillus licheniformis ATCC 14580
MLENKTAVVTGASRGIGRAIALDLAKNGANVVVNYAGNEAKANEVVDEIKALGRDAFAFKADVSNADEVQAMMKEAVGRFGTLDILVNNAGITKDNLFMRMKEDEWDDVININLKGVFNCSKAVTRQMMKQRSGRIINITSVVGVVGNAGQANYVAAKSGVIGLTKTLAKELASRNITVNAIAPGFISTEMTDKLTKDIQDEMLKQIPLARFGEPSDISSAVVFLASDHASYMTGQTLNINGGMAMV

SEQ ID NO: 87311 - protein, 278 aa, Cladonia arbuscula
  misc_feature (1)..(2): Xaa can be any naturally occurring amino acid
  misc_feature (274)..(274): Xaa can be any naturally occurring amino acid
XXHGAVKVVAVNDPFVEPHYAAYMLKYDSQHGQFKGTIEVEGSDLIVNGQKVKFYTEKDPGAIPWKDTGAYYIVESTGVFTTTEKAKAHLKGGAKKVVISAPSADAPMFVMGVNEETYKSDIEVISNASCTTNCLAPLAKVMHDNFTIIEGLMTTIHSYTATQKTVDGPSAKDWRGGRTAAQNIIPSSTGAAKAVGKVIPSLNGKLTGMSMRVPTSNVSVVDLTCRLEKSVTYDEIKEAMKKASDGDLKGIMAYSEDDLVSTDLNGDNHSCIFXAKAG

SEQ ID NO: 87312 - protein, 77 aa, Bacillus licheniformis ATCC 14580
MADALERVTKIIVDRLGVDEADVTLEASFKEDLGADSLDVVELVMELEDEFDMEISDEDAEKIATVGDAVNYINSKQ

SEQ ID NO: 87313 - protein, 612 aa, Streptococcus pyogenes MGAS10394
MEFSKETRRLALQKMQERDLDLLIIGGGITGAGVALQAAASGLDTGLIEMQDFAEGTSSRSTKLVHGGLRYLKQFDVEVVSDTVSERAVVQQIAPHIPKPDPMLLPVYDEPGSTFSMFRLKVAMDLYDLLAGVSNTPAANKVLTKEEVLKREPDLKQEGLLGGGVYLDFRNNDARLVIENIKRANRDGALIASHVKAEDFLLDDKRQIIGVKARDLLTDQEIIIKAKLVINTTGPWSDEIRQFSHKGQPIHQMRPTKGVHLVVDRQKLPVSQPVYVDTGLNDGRMVFVLPREEKTYFGTTDTDYTGDLQHPQVTQEDVDYLLGIVNNRFPNANLTINDIESSWAGLRPLLSGNSASDYNGGNSGKLSDDSFDHLIDTVKAYINHEDSREAVEKAIKQVETSTSEKELDPSAVSRGSSFERDENGLFTLAGGKITDYRKMAEGALKVIIQVLKEDFGKSFKLINSTTYPVSGGEINPANVDSELEAYAQLGTLSGLSMDDARYLANLYGSNAPKVFALTRQLKAAEGLSLAETLSLHYAMDYEMALKPTDYFLRRTNHLLFMRDSLDALIVPVIEEMAKHFDWSTDEKVKQEEELRRVIAENDLSALKGQQED

SEQ ID NO: 87314 - protein, 504 aa, Salinibacter ruber DSM 13855
MLDSAPTSSIAARAPRSDRRSQLDALRRAFTGLDTEYPLADGTTAPRTYLDSAASTLRCSAADDIVRRALRHYANTHSTLHAGARIMTHLYEQAHEIVGRFVDAPDDYTTVFTGSGVTGGLNRMARVLAERRPERDLVITTLMEHHANDLPHRKHVGEVVHVPLENDPDGEAGRVDLSALRAAIDEHADRLNYVAVTAASNVTGIVNPVHEVARHAHAAGALCVVDAAQSAAHVPISVQGPDAAEALDVVCMSGHKLYAPGSPGVIVAREALFEGLEPQVVGGGIVDRVETDRYEITDALPEREEAGTPNLPGALRLAATLQLLGRIGMDLVAEDERELAQYALERFAAIDGLTIYGSHRLEVADRIGVIAFNLADLPHGLVAAALNDYFGVAVRNECFCAQPFVRELLGRAGNAGGAADGAECGPETQPGMVRASLGLYNTEQDIDAAVEALSDLAARPDWYREQYRPRLDGSGDWVHRSFEHPPEQAFSLEEEVDAWLQSAS

SEQ ID NO: 87315 - protein, 303 aa, Oryza sativa
  misc_feature (225)..(225): Xaa can be any naturally occurring amino acid
  misc_feature (268)..(268): Xaa can be any naturally occurring amino acid
MPDRAITYAVVDAFTDEPFKGNTAAVCLLEESWEEQLDEQWMQSVAAEFNTSITAFLVRADADAANPQFHIRWFTPVRESELCGHGTLAAAHYLISSGLVKCNAIDFLAKSGFLTAKKVVGLKQSSTLISPLQEACTKFLIELDFPLIPVVKCSPLEMPSIPETLNGASVSNVLKTVSDSATDLIVELNSSEEVVNVRPNISELVQSAGRGVAVTGPAPVGSSYXFFSRFFCPKYGLNEDPVCGSVHCALAPYWGKKLGKQCMTASMXASPRSGTLYLQWDEAAQRVQIRGKAVTVMVGNILV

SEQ ID NO: 87316 - protein, 300 aa, Triticum aestivum
  misc_feature (44)..(44): Xaa can be any naturally occurring amino acid
GDVANLKCRVRAVKKAEVDSPVAIQTIKGYLLVASQDKTTRPPXASDTSSQYYGRVGAPRPLFTTAIRDIKAVFVGSSAVMSAAPAGKPLIAADREKLVILGLGDGYIAIYRSNFPVYKPESNAVVWSGPALLFLLFLIGIWQVYVKKKDSLGWTPEETFNTSVTAPTGSILNHPASERAFADSTTRAADRSYVDGTTRASDRSYVDATARSTDRAYAEATRAVDLRGGALRSAPRRYVSPTRYAGAAGIPYRPVSAEPGLRGATPELKYRGPGMEPPGFPKKRETLFSNNQAVVDDHVE

SEQ ID NO: 87317 - protein, 382 aa, Coxiella burnetii RSA 493
MGDFDLLNGRKPAILALADGSVLYGYSIGADGQTVGEVIFNTTLTGYQEILTDPSYAEQIITFTYPHIGNVGVNMDDQESRRIWAAGLIIRELSPIVSNWRAQQALSDYLKSEEIIGIAGIDTRRLVRLIREKGALHGCIVAGDGAQAEQALKKARAYEGLKGKDLAKAVSTTRAQTWQERSWNQASAPHASSRAYQVVVYDFGLKQQILRLLVDQGCLVTIVPAETNVEEVIALKPDGVVFSNGPGDPAACDYAIATIRQFLEKGVPLLGICLGFQLLALACGAKTEKMKFGHHGANHPVQAVETGRVFITSQNHSFSVDENSLPATLRVTHRSLFDGTLQGIAHKTKPAIAFQGHPEASPGPHDMRRVFEEFVKLMRDST

SEQ ID NO: 87318 - protein, 374 aa, Coxiella burnetii RSA 493
MAKRDYYEVLGVNLNATEAEVKKAFRRLAMKYHPDRNPGDKDAEVKFKEAREAYEVLCDSRKRASYDQFGHAGVEQTFGGAGAGGFGFGDLGDIFGDIFGDIFGGARGGQAREQRGADLAYELVLSLEEAVHGLSRTIKVPTWINCKTCNGSGAKGSSPATCPRCNGSGQMRMQHGFLQVQQTCSVCRGRGQVIKDPCTDCHGQGRQQQTKTLSVKIPPGIDTGDRIRLAGEGEAGLFGAPPGDLYVQVRVKPHPLFHREGNDLHSEVPIDFTTAALGGEMEIPTLDGSVRLTIPPETQGGKQFRLRGKGVKALRSGAVGDLICHIVVETPVKLSPEQKDYLKQFAELLKKDEKNHSPRTRNWFDSVKDFFTSK

SEQ ID NO: 87319 - protein, 425 aa, Zea mays
MAMRAAARQAILSPPLGPRSPRPFLCGCSLSIAPRLEPCRAASSTTAPAAGKHLPPLFSVAPMMDWTDNHYRTLARLISRHAWLYTEMVVAETIVHQKDNLDRFLAFPEEQHPIVLQIGGSNLENLAKATELANDYSYDEINLNCGCPSGKVAGHGCFGARLMFDPEFVGDAMSTIAANCDVPVSVKCRIGVDDRDSYEELCEFVDKVISKSPTRHFIIHARKALLSGLSPAENRKIPPLKYEYYFALLRDFPEIKFTLNGGITNVSQVSASMRQGAHGVMVGRAAYNNPWNMLGHVDGEIYGKQTRYISRRQILENYQAYGDSIIDQYGPSRPNVRQLVKPLLNLFHSEPGNSLWKRKADSALRHCKTVKTFLEETLDAISDSVLDKPVNREPSSDEEYFASVDSLLPPKYTTPMHERLVAVST

SEQ ID NO: 87320 - protein, 258 aa, Geobacillus kaustophilus HTA426
MGKTVVIKCGGSVLDELSPAFFASVRTMREQGMDVVIVHGGGPEIGQMLKKLAVPSEFVNGLRKTTKEVLAVVEMVLSGKVNKQLVAMLRQNGLPAVGVSGVDGGLLEAEPIDFAKLGYVGRVKTVRSRLLRTLLEAGYIPVVSPLGIDQNGQTYNINADTAAGAVAAAIGASQLAFVTNVPGILRDGALVAEATAETIERLIEDGVITGGMIPKVKAALSALSDALPEVMIVSGKTTFYQNGTWHGTTIRKEVGVYL

SEQ ID NO: 87321 - protein, 386 aa, Geobacillus kaustophilus HTA426
MSALFPTYNRWKIAVQAAEGTVVTDVNGKQYLDFVSGIAVCNLGHRHPHVQKAIEKQLNQYWHVSNLFTIPIQEEVASLLVAHSAGDCVFFCNSGAEANEAALKLARKHTGRHKVITFHQSFHGRTFATMAATGQEKVHSGFGPLLPEFIHLPLNDVDALKQAMSEEVAAVMLEVVQGEGGVRPVDPAFLQTASELCQQHGALLIIDEVQTGIGRTGKPFAYQHFDVEPDIITAAKGLGSGIPVGAMIGKAFLKESFGPGVHGSTFGGNPIAMAAAKATLEVVFDPAFLQDVQEKGRYLLARLHDALASLDIVKDVRGLGLLVGIECQTDVAPLLPLIHESGLLVLSAGPNVIRLLPPLVVTKAEIDEAVDILTNVLNNANASAVL

SEQ ID NO: 87322 - protein, 1246 aa, Glycine max
PRVRSKLIHELNKACNLRGLLKFKEAAVKVSLDEVEPASEIVKRFCTGAMSYGSISAEAHTALATAMNKIGGKSNTGEGGEQPSRMEPLSDGSKNPKRSAIKQVASGRFGVTSYYLTNADELQIKMAQGAKPGEGGELPGHKVVGDIAVTRNSTPGVGLISPPPHHDIYSIEDLAQLIHDLKNANPAARVSVKLVSEAGVGVVASGVVKGHADHVLISGHDGGTGASRWTGIKNAGLPWELGLAEPHQTLVANDLRGRTVLQTDGQIKTGRDVAIATLLGAEEFGFSTRADSARGCIMMRKCHKNTCPVGIATQDPVLREKFAGEPEHVINFFFMIAEEMREIMSQLGFRTVNEMVGRSDMLEVDKEVIKSNEKLENIDLSLLLRPAAELRPEAAQYCVQKQDHGLDMALDNKLIGLSNAALEKGLPVYIESPIHNVNRAVGTMLSHAVTKKYHLNGLPTDTIHIRFNGSAGQSFGAFLCPGITLELEGDGNDYVGKGLSGGKIVVFPPKESTFDPKQNIVIGNVALYGATSGEAYFNGMAAERFCVRNSGAKAVVEGVGDHGCEYMTGGIVVVLGNTGRNFAAGMSGGIAYVLDMDGKFLSRCNHELVDLDKVEEEEDITTLRMLIQQHQRHTNSVLAKEVLADFENLVPKFIKVFPKEYKRVLASIKSKEASKDAAESASKHGEEQDEIELVEKDAFEELKKLATASVNGKPIEAESFKRPSQVIDPVKHRGFVAYEREGVQYRDPNARINDWNEVMKETKPGPLLKTQSARCMDCGTPFCHQENSGCPLGNKIPEFNELVYQNRWREALERLLETNNFPEFTGRVCPAPCEGSCVLGIIENPVSIKSIECAIIDKAFEEGWMVPRPPARRTGKRVAVVGSGPSGLAAADQLNKMGHTVTVYERADRIGGLMMYGVPNMKADKVDIVQRRVNLMAEEGINFVVNANIGHDPLHSLDRLREENNAIVLAVGATKPRDLPVPGRELSGVHFAMEFLHANTKSLLDSNLQDGNFISAKGKKVVVIGGGDTGTDCIGTSIRHGCSSIVNLELLPQPPQTRAPGNPWPQWPRIYRVDYGHQEGAAKFGKDPRSYEVLTKRFVGDENGVVKGLEVIRVRWEKDETGRFQFKEIEGSEEIIEADLVLLAMGFLGPESTIAEKLGIERDNRSNFKAEYGRFSTSLKGVFAAGDCRRGQSLVVWAISEGRQAAAQVDSFLTNEDLEHNVAGSPDELIKKKQQPRDTVAVANKQ

SEQ ID NO: 87323 - protein, 354 aa, Geobacillus kaustophilus HTA426
MKAYLHVASGKTFSGELAAPLEEKVSGEIVFFTGMTGYQEVLTDPSYKNQIIVFTYPLIGNYGINENDFESKRPHVEAVVVYEASREGFHYGAKYSLAEYLQHWNIPLLTHVDTRALVKEIRTAGTMMAELSLSPISAVGGEEAVFPVRAVSTKTIETYGEGGPHLVLVDFGYKKSILQSLLARGCRVTVVPHDTTPEAIDALKPDGLVLSNGPGDPKQLRHQLPAIRQLIDRYPTLAICLGHQLVALAYGADTEKLRFGHRGANQPVWDAVKQNVMMTSQNHSYVVKEGSLVGKPFDIRFINVNDGSVEGIVHRHKPILSVQYHPEAHPGPHDTGYIFDEFLQTVFKGENVYA

SEQ ID NO: 87324 - protein, 147 aa, Vibrio cholerae O1 biovar eltor str. N16961
MVSEAISKKEIERVKFESKDLHKPDEYWREHLTEEAFYVCRQQGTEAPYSGKLLHNKDTGLYHCTCCQSALFSSENKYDSGCGWPSFDAPINEQVIRFLDDFSHGMVRTEIRCAACDSHLGHVFEDGPKTTGLRFCVNSVSLIFNKK

SEQ ID NO: 87325 - protein, 531 aa, Helicobacter hepaticus ATCC 51449
MVGQNAISQTLSLALDSQHISHAYLFSGLRGSGKTSSARIFARALQCENGPTSTPCGNCASCVAALQNKHMDIIEMDAASSRGIDDIKKVIEQTKYRPSFARFKIFIIDEVHMLSKEAFNALLKTLEEPPEFVKFILATTDPLKLPATILSRTQHFRFKQIPHRLVVEHITQILNKEGVSYEPQALDIIARSGSGSLRDTLTLLDQAIIFCKNHIEVTGVTDMLGVVDPQVLDDYFQSILHKNEQNTHKIMQILQEYECEMILDEMMLFLKDKLLKESVDFPPLLLERFARILSESKSLLNLNTDGAFVLLLCAMKMQEALKVKDIESMIEELEAELFNGASSTSNTHIQQSYTPPSLTSSEVHTPNSSHNNTSPTLNAHLRFSTLVQKIKDRNVGLGEIFERNVVFVDFDGEVLRWRSTAQGEDKEQLKEHFSIIKALVAEIFGSQVSIQVIPQSTSEQNIILSSENTSTNTHIPHSNTSSTLDISTDKAMLDARDAFLTQNKDLISAIKDSVGIKEVIMQDSQTGGSNV

SEQ ID NO: 87326 - protein, 459 aa, Aspergillus oryzae
MADVAIPIFRPQLPAFAALSRYYASKSFPPHTIISMPALSPTMLAGNIGAWQKKPGDSLQPGDVLVEIETDKAQMDFEFQEEGVLAKVLKETGEKEVAVGSPIAVLVEEGTDVSSFESFTAEDAGGDKGAAPAQESKEESKGAADAAPASTPAPEPAAQEPETSGEKLQPSLDREPTISPAAKALALEKGVPIKALKGTGRGGQITKEDVEKYKPSASAAAGPTYEDIPLTSMRKTIASRLQQSTRENPHFFVSTTLSVTKLLKLRQALNASADGKYKLSVNDFLVKACAAALQKVPAVNSSWHEENGQVVIRQHKNADISVAVATPAGLITPVVKNVQGLGLSSISNSIKDLGKRARDNKLKPEEYQGGTFTISNMGMNPAVERFTAVINPPQAGILAVGTTRKVAVPVETENGTEVEWDDQIIVTGSFDHKVVDGAVGAEWIKELKKVVENPLELLL

SEQ ID NO: 87327 - protein, 283 aa, Picea sitchensis
MEAKEGEGIEQAKDYRDPPPAPLLDSLELKRWSFYRAAIAEFVATLLFLYITLTTVVENNRNKVNCSGVGLLGEAWDFGGMIFVLVYCISGISGGHVNPAVTFALFLARKVSLPRAVLYIVAQCLGALCGTALVRGIQGSFYASTGGGSNSVSAGYSKGSALLAEIIGTFVLVYTVFSATDPKRNARDSHIPVLAPLPIGFAVFLVHLATIPITGTSINPARSFGPAVIYGHKKSWDDLWIFWVGPLVGAAIAAAYHQYVLRAGGIGLKSLRSFRSQPTSLAI

SEQ ID NO: 87328 - protein, 331 aa, Vibrio cholerae O1 biovar eltor str. N16961
MTIKVGINGFGRIGRFVFRAAQERNDIEIVGINDLIDVDYMAYMLKYDSTHGRFNGTVEVKDGNLIVNGKTVRVTAERNPADLKWGEIGVDVVAEATGLFLTDETARKHIEAGAKKVVLTGPSKDKTPMFVMGVNHKTYAGQDIVSNASCTTNCLAPIAKVLNDNFGIESGLMTTVHATTATQKTVDGPSAKDWRGGRGASQNIIPSSTGAAKAVGVVLPELNGKLTGMAFRVPTANVSVVDLTVNLQKAASYDDIKAAMKAASEGELAGILGYTEDAVVSTDFNGDTRTSIFDADAGIALTDKFVKVVSWYDNEIGYSNKVLDLIAHISK

SEQ ID NO: 87329 - protein, 1111 aa, Candida glabrata CBS 138
MSQYRRYFDESDPNQSRYSSRNGNGSYYQSRGSQRYNYEGQPDESGYRKDYQKSLGAGNGQYNNRQYSRNDNGSSNNVPQGRYTPTEYSSRRSFHHNDAEIKLPSAPSRVQYSYKARNSETKDPNAYRPNHTDQSYIRGRNSNGKSYGPVNIPTGPQQSRIVSNRNHNQHNVSLRPKATVKYKNIEQLTCKYHYFDPVEKVLTHRTEMKKWTEVNKDMPEVGFVVQQETINGQVKSVIKSRKPDEKSTDPRKTTIPNTGNSSTKKKQRTARKCRKELTLVPRISYDKFSLGPPPSTEVVVFAENFSNTQMANIPDISIKNYFRKFGELAHFASYSDPKTALPLHLYLVKYTHPSGKINDSAKAAYQAVKSCQEQKCCILGCNFNVLLNKNNELENIMNKRITVLSKETEKVKLQMEQEKKSALKKSAELNKEEKGILKPLKTIPGDLRPIVNNRPALYISRRFISVMGLRLIDFKSKLKAYKCSRFLEHATGFYIIFNNLEHAKLCMDAESGKLTMASRRKRTTVPINFILIEPFTSRFSKKYKDVPSDSKEKVEIVRYNNKEELIDAASKYIIEDLAKTLHTEIRKTMIGPAVFDTLQPSNFPQLVQKRKEQEELKKADMEKKKAEQAKSKDFNIFNLYASYTNKPKRRQKRYLSDEEAEEELPQKKIKPLAHLLDEVREDSPTSGLESTDDPTEGDNMSTSSSSEDEDDIMDDFQNEDKKDDMFSTPETNEEMDYHHKIDYRTENLIDKEIDDASQVNERYLPSATQFPVTVYPENTYDSEYIDTVSLFDLQDAIKDEEDMEFLKECLPAGEDLEFDDDNGLLEYRIWKIKQMADISQSSTNNELRLNNQTLDKTLFEKNIPFIASEFKHIPEKLKSSYLPHKRRVHEPLNTVSHHNESKEQSPDIAIKEKSVNKADTGEGSLAEISSSRDNRASNRRFQQNIEAQKAATGTESELLSLNQLNKRKKPVTFARSAIHNWGLYALEPINAKEMVIEYVGERIRQPVAEMRERRYIKNGIGSSYLFRIDEHTVIDATKKGGIARFINHCCEPSCTAKIIKVGGKRRIVIYALRDIAANEELTYDYKFERETDAEERLPCLCGAPSCKGFLN

SEQ ID NO: 87330 - protein, 478 aa, Streptomyces coelicolor A3(2)
MRRAKIVCTLGPATDSYDQIKDLVDAGMDIARFNFSHGTHAEHEERYHRVRKASDETGRSVGALADLQGPKIRLGHFGEGPVLLERGDSFTITVEEGVEGDRYICGTTYAGLAEDVTPGERVLVDDGKVCLEVTGVDGTRVRTRVIEGGMVSDHKGLNLPGVAVSVPALSKKDEDDLRWALRAGFDVVALSFVRSGRDILDVHRIMDEEGRRLPVIAKVEKPQAVENIEDIVAAFDGIMVARGDLGVEMPLEQVPTVQKRAVKLAKRNAKPVIVATQMLDSMIDNARPTRAEASDVANAVIDGTDAVMLSGETSVGKHPTDTVRTMARIVEAAEEDILAKGLPPLTERNKPRTQGGAVARAAAEMGDFLGAKFLVAFTQSGDTVRRLSRYRSPIPLLAFTPEPATRSQLSLTWGVETFLGPHADSTDAMVDQVDELLTRYGRCEKGDVVVITAGSPPGVSGTTNLVRVHHIGEDDIPK

SEQ ID NO: 87331 - protein, 459 aa, Triticum aestivum
  misc_feature (221)..(221): Xaa can be any naturally occurring amino acid
  misc_feature (232)..(232): Xaa can be any naturally occurring amino acid
  misc_feature (383)..(383): Xaa can be any naturally occurring amino acid
TPNSSLCRRNHPTRERRIKRARRRRSRSQRPRPRPRRQRRNRRNHPTQVLDCCKGFDRPSPIQALAWPYLLDGRDCIGIAATGSGKTIAFGVPALMHVRKKLSEKGAKKGLPRCLMLAPTRELAQQIADVLTEAGAPCGINSVCLYGGTSKGPQISSLKSGVEIVIGTPGRMKDLIEMGVCRLNEVSFVVLDEADRMLDMGFEPEVRAILSQTSSVRQMVXMFSATWPFCCXHQLAPEFMDPNPIKVVVGSEDLAANHDVMQIVEVLDDRARDSRLVALLDKYHRAQSNRVLVFVLYKKEAGRVEAMLNKRGWKAVSVHGDKAQHDRTKALSLFKEGKCPLMIATDVASRGLDIPDVEVVINYSFPLTTEDYVHRIGRTGRAXGKKGVAHTFFTQADKGLAGELVNVLREADQVVPPALTKFGTHVKKKESKIYGSHFKEITADAPKSTKITFGDSDEE

SEQ ID NO: 87332 - protein, 250 aa, Synechococcus sp. CC9311
MSSSASLDGQTALVTGASRGIGRAVALALAAEGAEVVVNYASSSDAAEAVVAEIQAKGGSAYALQADVADEASVDDLIKTVLKRSERIDVLVNNAGITRDGLLMRMKTEDWQAVINLNLTGVFLCTRAVTRPMLKQRSGRIINITSVVGLMGNAGQANYAAAKAGVVGLTRSSAKEMASRGITVNAVAPGFIATDMTKDLEADAILSAIPLGRFGSPDQVAGAVRFLAADPAAAYITGQVLQVDGGMVMS

SEQ ID NO: 87333 - protein, 459 aa, Rickettsia sibirica 246
MEQYDVAVIGGGPGGYVAAIRAAQLKKKVVLVEKEHLGGVCLNWGCIPTKSLLKSAEVFEYIKHAKDYGIDAKGAEINIKKIVERSREISNKLAGGVKLLLKKNKVTVIDGVASLAGNKVININDKPTVKAGNIIIATGARSRVLKGFKPDGKQIWTSKEAMIPQHVPKSMIIVGSGAIGIEFASFYNSIGVDVTVIEAHNRILPAEDMEISGIAHKNFEKKGIKIITNAKLIKQTKSKDKIEVELELADKTQKLQAEILLMAVGITANTENLGLEKTKIKVENGYITTNGLMQTAASGIYAIGDVAGVPCLAHKASHEGIIAAESIAGLKPHTINKHNIPGCTYSSPQIASVGLTEEEATTLGYELKIGRFPFIANGKALVSGDSDGLIKTIFDAKTGELLGAHMIGSEVTELIQGYVVSKNLEGTELDLINTIFPHPTLSEMMHESVFSAYDRAIHI

SEQ ID NO: 87334 - protein, 223 aa, Candida glabrata CBS 138
MSEYINENPDVLDESDLPKRAEDASNQLLLNGISNKTTLERKKMLLQIENSTDSSLQKNIELFDKLLSLNQVPDLVSDSGDDCVSNEEDGEDYDPVDEQEIYDLIAYIQDPEHPLTLAQLSIVNLQDIKVVDSGNPADIAEVLIKITPTITHCSLATLIGLGIRVRLERSLPPRFRITIMVKEGTHNSENQVNKQLNDKERVAAACENEQLLSVVSKMLLTCK

SEQ ID NO: 87335 - protein, 280 aa, Streptococcus pyogenes MGAS10394
MMVTTVKMTSGYEIPVLGFGTYQAADGEEAYQSTLAAIKADYRHIDTAAIYKNEESVGRAIKDSGVLREDLFITTKLWNDAHSYEGAKDALAASLDRLGLDYVDLYLIHWPNPKALRNTWKEANAQAWQYMEEAVEAGLIKSIGVSNFMVHHLEALQETAKITPAINQIRLAPGCYQKEVVDYCKANEILLEAWSPLGQGEIFDNETMQQLANKYDKTVAQVALAWSLAEGFIPLPKSVHDERIKENMAIFDVSLTPEDKKTIRYLSGMSAIPNPDTTSF

SEQ ID NO: 87336 - protein, 134 aa, Vitis vinifera
MIFILFLLIVIFPIIILLGRLIAKKFNYLCNKCKRLGHFARDCPNVTVCNNCGLPGHIAAKYNSTTICWNCKESGHLASQCPNDPVCHMCGKMGHLAQDCSCPGLPAHDARLCNNCYKPGQVYLLMFDRVVRRY

SEQ ID NO: 87337 - protein, 300 aa, Streptomyces avermitilis MA-4680
MTESHPRITKAVIPAAGLGTRFLPATKATPKEMLPVVDKPAIQYVVEEAVSAGLDDVLMITGRNKRPLEDHFDRNYELESALQKKGDASRLAKVQESSDLATMHYVRQGDPKGLGHAVLCAAPHVGREPFAVLLGDDLIDPRDPLLARMVEVQEQRGGSVIALMEVAPEQIHLYGCAAVEATDEGDLVKVTDLVEKPDPADAPSNYAIIGRYVLDPHIFDILRKTEPGRGGEIQITDALQQLAADEKVGGPVHGVVFKGRRYDTGDRGDYLRAIVRLACEREDLGPEFRTWLRSYVAEEM

SEQ ID NO: 87338 - protein, 468 aa, Burkholderia vietnamiensis G4
MSLFRKKNVDRMIAGAHAAGLKKALGAIDLTFLGIGAIIGTGIFVLTGTGAVQAGPALMLSFVIAAIACGLAALSYAEFASTIPVAGSIYTYSYATLGELVAWIIGWDLMLEYGLAASAVSVGWSGYLQSLLQGFGLSLPTVLTAAPGAIPGTVTWFNLPAFLVMLVITTLLSIGIRESTRINNVMVFIKVSVVLLVIAVGLFHVTPANWKPFMPHGWNGVFGAAAVMFFAFIGFDAVSSAAEEVKNPKRDLPIGIIASLAVCAVLYVTVAAVATGIVPSAQYANVSHPISYALQIAGEKWVAGFIDLGAVLGMLTVILVMSYGQTRIIFAMSRDGLLPAMLSRVHPRYATPFLTTWLVGLFFGLIAALVPLNVLAELINIGTLAAFSMVSIAVLVLRRTHPELPRAFRCPGVPVVPILAVGACLFLMLNLQPITWAAFGIWLVIGLVIYFLYSRHHSKLARGQHDAH

SEQ ID NO: 87339 - protein, 254 aa, Erythrobacter sp. SD-21
MVVTGAGQRTMMFAHGFGCDHTMWELVARTFEQDFRVVLFDYVGHGQSDLTAYSAERYSSLSNYADDVVEIGQALGLRDAVFVGHSVSGMIGALASSKAPGMFSDLVMVGPSPRYIDAEGYRGGFSRAQIDELLEFLADNHLGWSAAMAAPIMGNPDRPELGKRLENSFCRTDPEIARDFARVTFLSDNRDDLAAVSVRTLVLQCSDDIIAPVEVGEYVHAGLANSEYRLLEATGHCPHLSAPDEVIAAIRSFV

SEQ ID NO: 87340 - protein, 523 aa, Streptomyces avermitilis MA-4680
MLGSKRSHRSARLARREQPLTVHHLNQLLLVCSLVLLIAVAAVRISSRSGLPSLLVYLGIGIAMGQDGVGDIHFNNAELTQVIGYAALVVILTEGGLGTKWKEIRPALPAASSMALAGVAVSVGVTAAGAHWLIGLEWRQALIIGAVVSSTDAAAVFSVLRKIPLPARVTGVLEAESGFNDAPVVILVVAFSTAGPVEHWYALLGEIALELAIGAAIGIAVGWLGSWGLRHVALPASGLYPIAVMAIAVTAYAAGALAHGSGFLAVYLASMVLGNAKLPHWPATRGFADGLGWIAQIGMFVLLGLLVTPHDLGDDIWPALLIGLVLTMVARPLSVVISLAPFRVPWQEQVLMSWAGLRGAVPIILATIPMVNGVEDSRRIFNIVFVLVIAYTLVQGPTLPWLARKLHLDTSAGQAADLGIESAPLERLRGHLLSVAIPEGSKMHGVETNELRLPAGAAVTLVVREGKSFVPLPTTVLRRGDELLVVTTDPVRDAAEARLRAVGQGGKLAGWLGTGAPDDRPGR

SEQ ID NO: 87341 - protein, 159 aa, Erythrobacter sp. SD-21
MTIAVGDRLPDVKLVKATAEGPEQVQSSDYFAGKTVALFAVPGAFTPTCSAKHLPGFVDKADELKAKGVDEIVATSVNDAFVMGAWKQSAGSDDITMLADGNGEFAKETGLDADFTGFGMGHRSQRYSMLVEDGVVKQLNVEAPGDFSVSSAEHMLGQM

SEQ ID NO: 87342 - protein, 312 aa, Geobacillus kaustophilus HTA426
MNAVMSLKGRDFLTLLDFSTEEILDLLALAADLKAKQKAGVSYTPLSGKTMAMIFEKPSTRTRVSFEVGMIQLGGQAMYLNGNDLQLGRGETIADTARVLSQYVDVIMIRTFAHQKVEELAEYASVPVINGLTDDDHPCQALADLLTIYEVKKTFQGVKLAYVGDGNNVANALLVAAAKVGMDVAIACPPGYEPKKEYVEAACRIGEQTGAAVTVTHDPLVAVAGADAIYTDVWTSMGQESESAERLQVFQPYQVNEELVKAAKPDYLFLHCLPAHRGEEVTAGVMDGPNSVVFEQAGNRLHAQKAILLSVL

SEQ ID NO: 87343 - protein, 470 aa, Bacillus subtilis subsp. subtilis str. 168
MNSAHNKNETTFQRSMKSRHLFMLSLGGVIGTGLFLSSGYTIQQAGPAGTILAYLVGAGIVYLVMLCLGELSVAMPVTGAFHTYAAKYIGPGTGFTVAWLYWLTWTVALGSEFTAAGLLMQRWFPHTSVWMWSAVFALFIFLLNAFSVKFFAESEFWFSSIKVLAIVLFILLGGSAMFGIIPIKGGEAAPMLSNFTAEGGLFPNGFVPILMTMLSVNFAFSGTELIGIAAGESVDPDKTIPKAIKTTVWRLSLFFVGTIFVLSGLIPIQDAGVIKSPFVAVFDRVGVPYAADIMNFVILTAILSAANSGLYASSRMLWSLSKEKTLHPTFAKLTSKGTPFNALVFSMIGGILSLLSSVFAPDTVYVVLVSISGFAVVVVWMGIAASQFMFRKRYIEAGNKVTDLKYRTPLYPFVPIAAFLLCLASVVGIAFDPNQRIALYCGVPFMAICYAIYYVKNRKSQPAADMTHSK

SEQ ID NO: 87344 - protein, 612 aa, Streptococcus pyogenes M49 591
MEFSKETRRLALQKMQERDLDLLIIGGGITGAGVALQAAASGLDTGLIEMQDFAQGTSSRSTKLVHGGLRYLKQFDVEVVSDTVSERAVVQQIAPHIPKPDPMLLPVYDEPGSTFSMFRLKVAMDLYDLLAGVSNTPAANKVLTKEEVLKREPDLKQEGLLGGGVYLDFRNNDARLVIENIKRANRDGALIASHVKAEDFLLDDNGKIIGVKARDLLSDQEIIIKAKLVINTTGPWSDEIRQFSHKGQPIHQMRPTKGVHLVVDRQKLPVSQPVYVDTGLNDGRMVFVLPREEKTYFGTTDTDYTGDLEHPQVTQEDVDYLLGVVNNRFPNANVTIDDIESSWAGLRPLLSGNSASDYNGGNSGKVSDDSFDHLVDTVKAYINHEDSREAVEKAIKQVETSTSEKELDPSAVSRGSSFDRDENGLFTLAGGKITDYRKMAEGALTGIIQTLKEEFGKSFKLINSKTYPVSGGEINPANVDSEIEAYAQLGTLSGLSMDDARYLANLYGSNAPKVFALTRQLTAAEGLSLAETLSLHYAMDYEMALKPTDYFLRRTNHLLFMRDSLDALIDPVINEMAKHFEWSDQERVAQEDDLRRVIADNDLSALKGHQEG

SEQ ID NO: 87345 - protein, 572 aa, Pseudomonas fluorescens PfO-1
MPSTTSRRTFVKGLAAGSLLGGLGLWRTPVWALNSPGQVNELSGTDFELFIGETPVNFTGQPRTALTINGSLPGPLLRWREGDTVTLRVRNRLKDSTSIHWHGILLPANMDGVPGLSFKGIEPGGVYVYQFKVRQHGTYWYHSHSGLQEQAGVYGPLVIDAREPEPFQYDRDYVVMLSDWTDEDPASLMKTLKKQSDYYNFHKRTVGDFVHDVGEKGWGATVADRTMWAQMKMNPTDIADVSGATYTFLMNGHAPDDNWTGLFRPGEKLRLRLINGSAMSYFDVRIPGLKMTVVAADGLHVKPVSVDELRIAVAETYDVIVEPAADAYTLFAQAMDRTGYARGTLAARAGLSAPVPALDPRPLVTMDDMGMGGMGSGGMNHGSMDMSGMDHSSMNMGPMQSHPDSEKDNPLVDMQAMTTAAKLDDPGLGLRNNGRRVLTYADLRSTFEDPDGRDPSRTLELHLTGHMEKFAWSFNGIKFSDAEPLLLKYGERIRLVLVNDTMMTHPIHLHGMWSDLEDENGNFQVRKHTIDMPPGTRRTYRVTADALGHWAYHCHLLYHMEMGMFREVRVEE

SEQ ID NO: 87346 - protein, 511 aa, Oryza sativa
  misc_feature (58)..(58): Xaa can be any naturally occurring amino acid
MAAMDLRVAAPASVAAAARCGTSLARPWPARAVGGGGGGGGRGRRLSVRTSVATTEVXAAAVGASEDAALEARDSKTVVAVILGGGAGTRLFPLTKRRAKPAVPIGGAYRLIDVPMSNCINSGINKVYILTQFNSASLNRHLSRAYNFSNGVAFGDGFVEVLAATQTPGSEGKRWFQGTADAVRQFDWLFDDAKAKDIDDVLILSGDHLYRMDYMDFVQSHRQRGADISICCLPIDDSRASDFGLMKIDDTGRVIAFSEKPKGDDLKAMQVDTTVLGLPQDEAKEKPYIASMGVYIFKKEILLNLLRWRFPTANDFGSEIIPASAKEINVKAYLFNDYWEDIGTIKSFFEANLSLAEQPPRFSFYDANKPMYTSRRNLPPSMINNSKITDSIISHGCFLDSCRIEHSVVGIRSRIGSNVHLKDTVMLGADFYETDLERGELLAEGKVPIGIGENTKIQNCIIDKNARIGKNVTISNSEGVQEADRTSEGFYIRSGITIVLKNSIIADGLVI

SEQ ID NO: 87347 - protein, 495 aa, Oryza sativa Japonica Group
CTPCVILLLSSLYLLRLFVDARRNLPPGPRPQPLIGNILDLGSQPHRSLARLAGRYGPLMTLRLGTVTTVVASSPGAARDILQRHDAAFSARSVPDAARACGHDGFSMGMLPPSSALWRALRRVCAAELFAPRSLDAHQRLRRDKVRQLVSHVARLARDGAAVDVGRAAFTASLNLLSSTIFSADLADFGDARAESSVGDLRDLISEFTIVVGVPNVSDFFPAVAPLDPQRLRRRVARVFERLQAVFDGHIERRLRDRAAGEPPKNDFLDALLDYRSPEDGRGFDRPTLQFLFTDLFSAGSDTSAVTVEWAMAQLLQNPPAMAKAREELARVIGSKQEIEESDISQLKYLEAVVKETLRLHPPAPFLLPHQAETTTQVGGYTVPKGTRVLVNVWAIGRDSKVWSDPDKFMPERFLQSEVDLRGRDFELIPFGSGRRICPGLPLAVRMVYLMLASLLHRFEWRLLPEVEKNGVDMAEKFGMILELATPLRAVAIPV

SEQ ID NO: 87348 - protein, 476 aa, Lactobacillus sanfranciscensis
  misc_feature (378)..(378): Xaa can be any naturally occurring amino acid
MADKKANIGVIGMAVMGKNLALNIESRGYTVAIYNRSASKTEQVMKDHSDKHLVPAYNVKDFVDSIEQPRTILMMVKAGKPTDAVINEILPLLSKGDTLIDGGNTNFHDTIARNEELAKSGINFIGMGVSGGELGALQGPSLMPGGQKEAYDRVAPILEKIAAKAEDGKPCVAYIGSNGAGHYVKMVHNGIEYGDEELIDEVFNILRNAAGYSVDDLAKIFSDWNKGELNSYLIEITADILTRKDDLGDDKNKPIVDMILDRGANKGTGKWSSEDALDEGAPQSVITESVYARFVSMLKDERVAASKVLHGPAKKPKFGSDDIVEDMRQALYFGKIMSYAQGFEQMRMASDNHKWGLKYGELAQIWREGCIIRAQFLXEITKAFEKNPSLDNLLMDPFFGDIANKYQDSARRVVAFATEYGIPVPSLAAALSYFDSYRAEVLPANLLQAQRDYFGAHTYERTDRPGNFHYPWYVEQ

SEQ ID NO: 87349 - protein, 481 aa, Vibrio cholerae O1 biovar eltor str. N16961
MSSTLRRTKIVATLGPSTESPEILEAIIRAGANVVRMNFSHGTAEDHKNRAQKVREIAAKLGRHVALLGDLQGPKIRVSTFKEGKIILNEGEHFILDAELAKGEGTQESVGIDYKKLPQDVCNDDILLLDDGRVQLQVMRVEGNKIHTKVLVGGPLSNNKGINKKGGGLSADALTEKDKNDIRLAAEIQVEYLAVSFPRNGEDMKFARRLAQESGLYARMVAKVERAETVSCDENIDDIVRASDVIMVARGDLGVEIGDPELIAVQKKLISRAKKLNRVVITATQMMESMISNPMPTRAEVMDVANAVLDGTDAVMLSGETAAGKYPVETVKAMAEVCIGAEKMIESNEQNYRIKSVFRTEEEAIAMSTIYAANHLEGVKAMVTLTESGRTALMTSRLNSVFPIFAMSANQATLNRCALLRGVIPFYFDTKQASGLEAAIAALDALKERNLLEEGDLVIITQGDIMGVEGSTNCMRILPVY

SEQ ID NO: 87350 - protein, 373 aa, Lactobacillus buchneri
  misc_feature (271)..(271): Xaa can be any naturally occurring amino acid
KNLALNIESRGYTVGIFNRTGSKTEAVMKDHGDKKLVPSYKIEDFVKSLETPRRIILMVKAGKPTDAVIDELLPLLDKGDVLIDGGNTNFHDTMARNARLDKSGINFIGMGVSGGELGALQGPSLMPGGQKEAYDLVEPILKQIAAKAPADGEPCVTYIGPNGAGHYVKMVHNGIEYGDEELIDESYNILRNLAGYSVDELADIFKDWNKGELDSYLIEITADILTHKDDIGADKTKPIVDMILDRGANKGTGKWSSQDALEVGVDQSVIXEAVYARYISMIKNERVAASKVLPKPEGKVDFDKKEIVEKVREALYFGKVMSYAQGFAQLKAASDQYKWDIQLGEMAKIWRAGCIIRARFLQNITDAYDKNPD

SEQ ID NO: 87351 - protein, 213 aa, Saccharophagus degradans 2-40
MAKIHFRTAQFLISAPSIRQCPTEEGTEVAFAGRSNAGKSSAINTLTGNGKLARTSKTPGRTQLINFFNFPAAPDQRIVDLPGYGYAKVPMAVKKKWQADLSEYLQQRDALRGLVIVMDIRHPLQDFDTMMINWAVEGEMPVHLLLTKADKLKPGAAKSTLLAVQKHMRDAQVDDLVSAQMFSALKKQGINQLEDVLNGWLLPQHDEPEAAQE

SEQ ID NO: 87352 - protein, 450 aa, Lactobacillus brevis
INIESRGYTVGIYNRSANKTEQVMKDHSEKKLVPSYTVEDFVKSLETPRRILLMVKAGKPTDAVIHELLPLLDKGDVLIDGGNTNFHDTMARNAELDKSGINFIGMGVSGGELGALQGPSLMPGGQKEAYDLVAPILEKIAAKAPQDGKPCVTYIGPNGAGHYVKMVHNGIEYGDEELIDESYNIMRNVAGISVDDMADIFKEWNKGELDSYLIEITADILTRKDDLGDDKNLPIVDAIKDRGNNKGTGKWSSEDALDVQVPQSVITESVYARYISMLKDERVKASKVLPAAEKQGKADIADKDKFVEEVRQALFFGKLMSYAQGFEQLRFASEANDWDLKFGELAQIWRGGCIIRAQFLQNITDAFDKDPKLSNLLFDDYFKDIAGKYQQSIRDVVAMAVQAGIPVPSLSAAITYYDSFRAEVLPANLLQAQRDYFGAHTYERNDREGN

SEQ ID NO: 87353 - protein, 517 aa, Burkholderia xenovorans LB400
MTAPVTATSADTRSTQVKSLNVKLKVHPVILAGGSGTRLWPMSREQHPKQLIGLLGDDSLLQSTTRRLEGLEAGYPLTEQLIVVANEEQRFTTAEQLRTSGKPTRLILEPTGRDTAPALTVAALSVAAQDEDGIMVVMPADHAVTDIAGFHAAVATGVQHAAAGHIVTMGIVPTRAETGYGYIRIGAALGTTNDMQQAGTQAAGRIGAHKLDRFVEKPHLELAQRYIESQEYWWNSGIFIMRASTWLKAIRYFQPAIYEACDAAFAGGKADGDFFRLQRDAFSASPSNSIDYAVMEQLGTDQSAATGIVVPLQAGWSDVGSWDAIWDISDKDADQNVGRGRVMFEGAVSTFAHSEGRLIACVGTQDLVVVETADAILVADKSRVQDVKKIVGRIRSDGGLEAANHRKVHRPWGNYDSVDTGERFQVKRIVVKPGARLSLQMHHHRAEHWIVVRGTALVTRGEERFIVSENESAYIPLGVTHRLENPGKIPLEMIEVQSGSYLGEDDIVRFDDTYGRQ

SEQ ID NO: 87354 - protein, 345 aa, Bacillus subtilis
MKKVTMLGAGSWGTALALVLTDNGNEVCVWAHRADLIHQINELHENKDYLPNVKLSTSIKGTTDMKEAVSDADVIIVAVPTKAIREVLRQAVPFITKKAVFVHVSKGIEPDSLLRISEIMEIELPSDVRRDIVVLSGPSHAEEVGLRHATTVTASSKSMRAAEEVQDLFINHNFRVYTNPDIIGVEIGGALKNIIALAAGITDGLGYGDNAKAALITRGLAEIARLGTKMGGNPLTFSGLTGVGDLIVTCTSVHSRNWRAGNLLGKGYKLEDVLEEMGMVVEGVRTTKAAYQLSKKYDVKMPITEALHQVLFNGQKVETAVESLMARGKTHEMEDLVNTFENQVK

SEQ ID NO: 87355 - protein, 324 aa, Caulobacter crescentus CB15
MSKAPIIVTGAAGFVGYHVAERLLDRGETVIGVDVFNAYYDPALKEARAARLDGRDGFTMLRMDIADHEALADLVKASGAQKVIHLAAQAGVRYSIENPFAYERSNLAGHLSVLEACRHAGVEHLVYASSSSVYGDRPLNGDGFRESDPAETPVSLYAATKRSCELLSQSYAKLYGFPQSGLRFFTVYGPWGRPDMAYFSFTEKMLKGETIEVYGEGKMARDFTYIDDIVDGILGVLDNPPAKGGHEVYNIGDNDPVGLMDMINTLEAALGIEANKVFRPMQPGDVTATYANIDKLHALCGYKPKVKLAEGLARFVDWRRGARV

SEQ ID NO: 87356 - protein, 435 aa, Caulobacter crescentus CB15
MRVAMIGTGYVGLVSGACFADFGHVVTCIDKDPSKIERLERGEIPIFEPGLDDLVARNVREGRLFFTLEGAQAIKDADAVFIAVGTPTRRGDGHADLSYVYAAAEEIAGLIDGFTVVVTKSTVPVGTGDEVEAIIRKTNPNAQFAVVSNPEFLREGAAIEDFKRPDRVVVGTDDERAQAVMRDLYRPLSLNETPIVFTGRRTSELIKYAANAFLAMKITFINEMADLCEKVGADVQSVAKGIGLDKRIGAKFLNAGPGYGGSCFPKDTIALVKTAQQYGAPTRLIETTVEVNTARKKAMAEKVAEAMGTRELTGKTIGVLGVTFKPNTDDMRDAPSLDILPALQAMGAKVQAFDPEGAKEAAHMLAGVEFKSGAYDAAEGADALVILTEWDQFRALDLDRLKSLLKTPVVVDLRNVYKPAEMERHGFTYASIGRG

SEQ ID NO: 87357 - protein, 461 aa, Photorhabdus luminescens subsp. laumondii TTO1
MQNNETQLKRGLTGRHIRFMALGSAIGTGLFYGSAAAIQQAGPAVLLAYLIGGAAVFMVMRALGEMAVHHPVAGSFSHYASHYLGPLAGFLTGWNYIFEMLIVCLADVTAFGFYMKLWFPHVEQWIWVLSIVCFIGAINLCHVKIFGEMEFWLSIVKVTAIIAMIIGGMIIMIYGFGQETDHATGIASLWEYGGFMPNGISGVIASLAIVMFAFGGIEVIGITASETKNPEKTIPKAINAVPFRILLFYVLTLFILMCIYPWNQIGQEGSPFVQIFSSLGINSAANILNIVVITAAISAINSDIFGAGRMMYGMAQEGQAPKSFTKLSRNGVPWMTVIVMSAVLLIGVILNYMIPEEIFVIIASIATFATVWVWLMILLSQVAMRRKMSKEEVKTLKFPVPMWPIAPALTIIFMVFVIVLLGYFEKTRIALIVGITWVILLSITYFFSKKKNISQIHQINK

SEQ ID NO: 87358 - protein, 576 aa, Photorhabdus luminescens subsp. laumondii TTO1
MNDKQHGPFIVEGKLADSERMKQESNFLRGTISEDLTNGLTGGFEGDNFLLIRFHGMYQQDDRDIRAERAEQKLEPRHAIMLRCRLPGGVITPQQWLGIDKFAEENTLYGSIRLTNRQTFQFHGILKGKVKLAHQLLNQVGLDSLATANDVNRNVLCTSNPIQSELHQQAYEWAKKISEHLLPRTRAYAELWLDKEKVATTDEEPILGSTYLPRKFKTTVVIPPQNDVDLHANDLNFIAIAEGSKLVGFNVLVGGGLAMTHGDKNTYPSMASEFGYIPLEHTLAIAEAVVTTQRDWGNRTERKNAKTKYTLERVGVETFKAEVERRAGVKFEAIRPYEFTGRGDQIGWLKGIDDKWHLTLFIENGRLLDYPGKPLKSGVAEIAKIHKGDFRLTANQNLIIAGIPESEKQRIETIACRHGLIDDKTTVQRKNSMACVSFPTCPLAMAEAERFLPEFVTHVEQLMNKHGIGDEHIVLRVTGCPNGCARAMLAEVGLVGKALDRYNLHLGGNRIGTRIPRMYKENISSQAILSIMDELIGRWATGRQPNEGFGDFLIRTDIIKPVLDSARDFYDWQEAV

SEQ ID NO: 87359 - protein, 575 aa, Lactococcus lactis subsp. lactis Il1403
MTTMLKGIAASSGVAVAKAYLLVQPDLSFETKTIADTANEEARLDAALATSQSELQLIKDKAVTTLGEEAASVFDAHMMVLADPDMTAQIKAVINDKKVNAESALKEVTDMFIGIFEGMTDNAYMQERAADIKDVTKRVLAHLLGVKLPSPALIDEEVIIVAEDLTPSDTAQLDKKFVKAFVTNIGGRTSHSAIMARTLEIPAVLGTNNITELVSEGQLLAVSGLTGEVILDPSTEQQSEFHKAGEAYAAQKAEWAALKDAETVTADGRHYELAANIGTPKDVEGVNDNGAEAIGLYRTEFLYMDAQDFPTEDDQYEAYKAVLEGMNGKPVVVRTMDIGGDKTLPYFDLPKEMNPFLGWRALRISLSTAGDGMFRTQLRALLRASVHGQLRIMFPMVALVTEFRAAKKIYDEEKAKLIAEGVPVADGIEVGIMIEIPAAAMLADQFAKEVDFFSIGTNDLIQYTMAADRMNEQVSYLYQPYNPSILRLINNVIKAAHAEGKWAGMCGEMAGDQTAVPLLMGMGLDEFSMSATSVLQTRSLMKRLDSKKMEELSSKALSECATMEEVIALVEEYTK

SEQ ID NO: 87360 - protein, 337 aa, Pseudomonas fluorescens PfO-1
MRYSPAQQALLEQYVKKILAAPVYELAVRTPLQPAPALSEALDNRILLKREDLQPTFSFKIRGAYNKLVQLSDEQKARGVITASAGNHAQGVALAARELGIAATIVMPATTPELKVLGVSSRGAEALLHGESFPFALAHALQLAEQTGRTFVSPFDDPDVIAGQGTVAMEILREHQGTLDAIFVPVGGGGLIAGIAAYVKYLRPEVRIIGVESEHSACLKAAMLADERVVLPNVGTFADGVAVAQIGAYGFEVCRFCVDEVITVSNDELCAAIKNIYDDTRSITEPSGALAVAGIKKYVAQSGARSQTLIAIDSGANINFDSLRHVAERAAACGVVA

SEQ ID NO: 87361 - protein, 327 aa, Bacillus subtilis subsp. subtilis str. 168
MKELIKEHQKDINPALQLHDWVEYYRPFAANGQSANYIPALGKVNDSQLGICVLEPDGTMIHAGDWNVSFTMQSISKVISFIAACMSRGIPYVLDRVDVEPTGDAFNSIIRLEINKPGKPFNPMINAGALTIASILPGESAYEKLEFLYSVMETLIGKRPRIHEEVFRSEWETAHRNRALAYYLKETNFLEAEVEETLEVYLKQCAMESTTEDIALIGLILAHDGYHPIRHEQVIPKDVAKLAKALMLTCGMYNASGKYAAFVGVPAKSGVSGGIMALVPPSARREQPFQSGCGIGIYGPAIDEYGNSLTGGMLLKHMAQEWELSIF

SEQ ID NO: 87362 - protein, 508 aa, Burkholderia vietnamiensis G4
MTRVPEQLAHDGLTPLERELALASFGPEGAPGAEPAAASAPADTRHAPHNPHLEHWRTHLHTLATRSQRALPLRPCGRLTRAAGLVLEAIGLRLSVGAECTIELPPGSTLPYAQAEVVGFSGERLFLMPTTDVAGVLPGARVWPLEAAPVADPLAGAKRLPVGWEMLGRVVDASGRPLDGLGPLAAKVDAPLSAPSINPLDREPIHHVLDVGVRAINGLLTVGRGQRMGLFAGSGVGKSVLLGTMARYTSAEVIVIGLIGERGREVKEFIEQILGEDGLARSVVVAAPADVSPLLRMQGAAYATSLAEYFRDQGKHVLLLMDSLTRYAMAQREIALAIGEPPATKGYPPSVFAKLPALVERTGNGPEGGGSITAFYTVLTEGDDQQDPIADSARAILDGHIVLSRSLAEAGHYPAIDIEASISRAMTALIDEGHLDRVRQFKQMLSRYQRNRDLIAVGAYAPGRDAQLDRAIALYPRIEAFLQQGFRECAPFASSLAALDALFDEYGG

SEQ ID NO: 87363 - protein, 732 aa, Oryza sativa Indica Group
MVGGGGGVVVVRAVLLLLAAVAAAEALSLDVHHRYSAAVRRWAAAAAPPHGTAEYYAALAGHDGLRRRSLGVGGGGGGAEFAFADGNDTYRLNDFGFLHYAVVALGTPNVTFLVALDTGSDLFWVPCDCLKCAPLQSPNYGSLKFDVYSPAQSTTSRKVPCSSNLCDLQNACRSKSNSCPYSIQYLSDNTSSSGVLVEDVLYLTSDSAQSKIVTAPIMFGCGQVQTGSFLGSAAPNGLLGLGMDSKSVPSLLASKGLAANSFSMCFGDDGHGRINFGDTGSSDQKETPLNVYKQNPYYNITITGITVGSKSISTEFSAIVDSGTSFTALSDPMYTQITSSFDAQIRSSRNMLDSSMPFEFCYSVSANGIVHPNVSLTAKGGSIFPVNDPIITITDNAFNPVGYCLAIMKSEGVNLIGENFMSGLKVVFDRERMVLGWKNFNCYNFDESSRLPVNPSPSAVPPKPGLGPSSYTPEAAKGALPNGTQLRRGGMDRYQRVEKPREEAPIKENEIRITTQGRMRNYITYATTLLQDKGSDEVVFKAMGRAINKTVMIAELIKRRIVGLHQNTTTGSTDITDMWEPLEEGLLPLETTRHVSMITITLSKKELDTSSIGYQSPLPADKVKPLVEYENEEDAPSPAGRGRGRGGRGRGRGRGRGTRGNGYMDYADGGWEDDHAPPAYAGNGYTRGRGRGFRGRGRRGGGYGAQPDYQQDGGYYDEAPVHAPPRGGYMIC

SEQ ID NO: 87364 - protein, 171 aa, Thermobifida fusca YX
MEFDVTIEIPKGERNKYEMDHETGRIRLDRMLFTSTSYPADYGFIEGTLGDDGDPLDALVLLKQPTFPGCMIRCRAIGMFRMRDEAGGDDKVLCVPATDPRMEHLRDIHHVNEFERLEIQHFFTVYKDLEPGKSVEGAIWVGRHEAEQEIKNSIKRAAESGQQHGAYFKLD

SEQ ID NO: 87365 - protein, 488 aa, Bacillus subtilis subsp. subtilis str. 168
MSVITEQNTYLNFINGEWVKSQSGDMVKVENPADVNDIVGYVQNSTAEDVERAVTAANEAKTAWRKLTGAERGQYLYKTADIMEQRLEEIAACATREMGKTLPEAKGETARGIAILRYYAGEGMRKTGDVIPSTDKDALMFTTRVPLGVVGVISPWNFPVAIPIWKMAPALVYGNTVVIKPATETAVTCAKIIACFEEAGLPAGVINLVTGPGSVVGQGLAEHDGVNAVTFTGSNQVGKIIGQAALARGAKYQLEMGGKNPVIVADDADLEAAAEAVITGAFRSTGQKCTATSRVIVQSGIYERFKEKLLQRTKDITIGDSLKEDVWMGPIASKNQLDNCLSYIEKGKQEGASLLIGGEKLENGKYQNGYYVQPAIFDNVTSEMTIAQEEIFGPVIALIKVDSIEEALNIANDVKFGLSASIFTENIGRMLSFIDEIDAGLVRINAESAGVELQAPFGGMKQSSSHSREQGEAAKDFFTAIKTVFVKP

SEQ ID NO: 87366 - protein, 545 aa, Zea mays
MGSTAAASVLPVSAGSGENLVLILDYGSQYTHLITRRVRQLGVLSLCVSGTAPLASLEGLRPRAVILSGGPHSVHAPGAPAFPEGFLGFAAAAGAHVLGVCYGMQLLVQSLGGAVVSGERQEYGKMDVEVTAASSALYGQAETGKRQTVWMSHGDEVVRLPEGFEVVARSVQGAVAAIENRENRFYGLQYHPEVTHSAQGMETLRRFLFDVCGIKADWKMQDVLDEEIKTIQSTVGPDEHVICALSGGVDSTVAATLVHKAIGDRLHCVFVDNGLLRYKEGERVMTTFESDLHLPVTCVDASEQFLSKLKGVEDPEKKRKIIGREFIAVFDDFAHKLEQKIGKRPEYLVQGTLYPDVIESCPPPGSGRTHSHTIKSHHNVGGLPKDMKLKLIEPLKLLFKDEVRKLGGILNVPDSFLKRHPFPGPGLAVRVLGDVTQGNALEVLRQVDEIFVQSIKDAGLYDKIWQAFAVFLPVQTVGVQGDQRTHSNAVVLRAITSEDGMTADWYYFEHAFLVDVVNKICNNVRGINRVCQDITFKPPATVEWE

SEQ ID NO: 87367 - protein, 420 aa, Oryza sativa Japonica Group
MMKFHEVIKLPSIAHYGLRYVLPAAAVAACVLVLATVSLPGRVPLPLLLAPEVMTKTADGVGGDTSGCDIFKGEWVPDMAGEPPPYTSESCPVIHGHYDCMRYGRPDLGYVRWRWRPDGGCELLRFDAARFLAAMRGRSVAFVGDSLARNQMHSLVCLLSHAERPAPWTNGSYAYRFERHGLTVTAFWSPFLVRAVETDPDGPTGSGSGLWSLHLDEPDAGWAAHVGAFDYVVVSAGSWFYRPSMFYDRRGRLVGCNTCLSPNVTDLTLRYSLRMAFRSALRAAATGSHRHATRRTVIVRTISPSHYENGTWNGDGDCLRTRPARRGEWELNAMEKDMHRIQVEEFAAAAEETAGKRGKEAARMLLMDATEAMAQRPDGHPSKYRLWQPDKFKVSRDCVHWCLPGAMDACNDMLFHMLIG

SEQ ID NO: 87368 - protein, 154 aa, Thermobifida fusca YX
MVGVGTDVHPFQTGRPLFLAGLEWPDEVGLSGHSDGDVAAHAACDALFSACALGDLGSQFGTSDPRWRGASGVALLTEAAQRVRAAGYEIGNIAIQIIGNRPKFAPRRHEAEKVLSAAVGAPVSCAATTTDGLGFTGRGEGIAAVATALCVRVR

SEQ ID NO: 87369 - protein, 445 aa, Oryza sativa Japonica Group
MAATIQSVKARQIFDSRGNPTVEVDICCSDGTFARAAVPSGASTGVYEALELRDGGSDYLGKGVLKAVDNVNSIIGPALIGKDPTEQTVIDNFMVQQLDGTKNEWGWCKQKLGANAILAVSLALCKAGAIIKKIPLYQHIANLAGNKQLVLPVPAFNVINGGSHAGNKLAMQEFMILPTGASSFKEAMKMGVEVYHNLKSVIKKKYGQDATNVGDEGGFAPNIQENKEGLELLKTAIEKAGYTGKVVIGMDVAASEFYTEDQTYDLNFKEENNDGSQKISGDSLKNVYKSFVSEYPIVSIEDPFDQDDWVHYAKMTEEIGDQVQIVGDDLLVTNPTRVAKAIKDKACNALLLKVNQIGSVTESIEAVKMSKRAGWGVMTSHRSGETEDTFIADLAVGLSTGQIKTGAPCRSERLAKYNQLLRIEEELGAAAVYAGAKFRAPVEPY

SEQ ID NO: 87370 - protein, 423 aa, Oryza sativa Japonica Group
MTPLNNLCNFRVKKQYYNPRCLIPAVSLLLFVVILTVSNTYFPFPTTKSRTLSYSSFSSSPGGQKAADEACNIFRGEWVPDPDAPYYTNNTCSVIHEHYDCMKYGKPDLGFVQWRWRPDSCDLPRLDPARFLSSMRGKTLAFIGDSLARNHMNSLICLLTRVAEPTTSWPSSEHTVYHYGGGYNFTVLSFWAPFLVQNELVDADGPAHTGLWNLYLDEPDAVWAPHVPAFDYAVVSASSWFYRPSMLYEAGRLVGCHHCLLPNVTDLTLRYALRMATRAALRAVVGGGGGGGVTAVLRTVSPSQYEGGEWNKDGNCVRTRPYRRGEKTLQGVELDFHTLQVEEFEAAKRAASGGGARMMLMDTTEAMILRADAHPSRYRGWTRRKGWMKEYFTISNDCVHWCVPGAVDAWNDMLSHMLLTSQS

SEQ ID NO: 87371 - protein, 480 aa, Burkholderia vietnamiensis G4
MKNDLPELAPQALPSLDALTSLLRDQRAAYLRAPYPEWDTRAQHLRALRTMLIEHADALADAISADFGHRAKQEVLLSEIWMAKEEIDDALKHGKRWMKPMAKRMNKWLRPARAKVVPQPLGVVGIVVPWNYPVLLAAGPLICALAAGNRAIVKMSELTPRTSALFEQLIAKTFSRDHVAVVNGDAELGAAFSALPFDHLLFTGSTHVGRHVMRAAADNLTPVTLELGGKSPAIIGPNARFDAAVDAIIGGKTLNAGQTCIAPDYVLLPRGMEGAFIERARARFAKLYPDLSNNGDYTTIVSPRHYARLQQLASDAQAAGAQLHPLSDAQSDPASRRFVPCALTHVPDASQVMQEEIFGPLLPLVPYERLDEAIGYVNARPRPLALYLFDEDRGTIDRVLRETISGGVTVNETLMHIACGSLPFGGVGASGMGAYHGYDGFVTFSKMKPVLTQSRLNTRGLIAPPYGKRFAAVIRMMLKF

SEQ ID NO: 87372 - protein, 330 aa, Streptococcus agalactiae
MAVLILGGAGYIGSHMVDQLITQGKEKVIVVDNLVTGHRQAVHSDAIFYEGDLSDKTFMRQVFRENPDVDAVIHFAAFSLVAESMENPLKYFDNNTAGMIKLLEVMNECDIKNIVFSSTAATYGIPEQVPILETAPQNPINPYGESKLMMETIMKWADQAYGIKFVALRYFNVAGDKPDGSIGEDHKPETHLLPIILQVAQGVRDKIMILEDDSHTPDGTNVRDYVHPFDWPDAHILAVIYLRQGNESNVFNLGSSTGFSTFRCKAARRITGKKIPAQKAARRPGDPDTLIASSEKARQILGWEPKFDNIDKIISSAWAWHSSHPNGYED

SEQ ID NO: 87373 - protein, 424 aa, Lactobacillus lindneri
KNLALNIESRGYTVAIYNRSASKTEQVMKDHADKHLLPAYNLKDFVESIEKPRTILMMVKAGKPTDAVINEILPLLDKGDTLIDGGNTNFHDTMARNEELAKSGVNFIGMGVSGGELGALQGPSLMPGGQKEAYDRVAPILEKIAAKAEDGKPCVVYIGPNGAGHYVKMVHNGIEYGDEELIDESYNILRNAAGYSVDDLAKIFKDWNKGELNSYLIEITADILTRKDDLGDDKNKPIVDAILDRGANKGTGKWSSEDALDEGAPQSVITESVYARFVSMLKDERVAASKVLHGPAKKPKFGSDDIVEDMRQALYFGKIMSYAQGFEQMRMASDNYDWNLKYGELAQIWREGCIIRAQFLDEITKAFEKNPDLKNLLMDPFFGDIANKYQDSARRIVAFATEYGIPVPSLAAAVSYFDSYRAEV

SEQ ID NO: 87374 - protein, 466 aa, Sinorhizobium fredii
MSKRFRSRSAARAARHRLRRGEQDMSNRLNTTPNDLSAFWMPFTANRQFKKEPRLFVGAKDMYYTTHDGRTVLDGTAGLWCVNAGHCRPKITEAIREQAGELDYAPAFQLGHPKAFELANRLVDIAPEGLNHVLYTNSGSESVDTALKVALAYHRAKGNGSRFRLIGRERGYHGVNFGGISVGGIVANRKMFGTLLTGVDHLPHTHLPAKNAFTRGEPEHGGDLASELERIVTLHDASTIAAVIVEPVAGSTGVLIPPKGYLQKLREICTKHGILLIFDEVITGYGRLGTPFAAQYFDVKPDIITTAKGLTNGVIPMGAVFVTSEIHDAFMTGPEHLIEFFHGYTYSGNPIASAAALGTLDTYKEEGLLTRAAELASYWEEALHSLKDCPHVIDIRNIGLIGAVELEPIAGEPTKRAFSAFLKAYEKGLLIRTTGDIIALSPPLIIEKKQIDELIDKLRDVLKNNI

SEQ ID NO: 87375 - protein, 438 aa, Oryza sativa Japonica Group
MKMLLFASRAALSLTAALAVAVVVLLTASSRSRRPSFLRRYEPTVVATSLPSAAPPAYSRSAPPSPTPLAVVARVPRDCDIFRGEWVPAADGDDDGAAPYYTNATCGEIQEHQNCMKYGRPDLGFLRWRWRPERCELPRFDAAAFMEVVRGRSMAFVGDSLARNHMQSLMCLLSKVENPKDVSTTKDPEFRTVRYESHNFTVAAFRSPYLVTANQSSDPAGGMWDLYLDEPDAAWATAVAGFDYVVVSTANWFNRPTMFHEAGRLVGCHHCLVPGVADLKRTYSLRAAFRTALRALTAGAGGAGFDGTVIVRTLSPTSHFEGGEWNKGGDCRRTRPTAARMAGLDLDFHTVQVEEFRRAEAAAAAASGGAARLLLMDTTAVMVARADGHPSRYGHWAHEKVTLYNDCVHWCLPGPIDVWNEMLLQMLLLHHRSGEFSV

SEQ ID NO: 87376 - protein, 482 aa, Burkholderia xenovorans LB400
MNLTIIGSGYVGLVTGACLADIGHDVFCLDVDQRKIDVLNNGGVPIHEPGLQEIIARNRKAGRLKFSTDVEAAVAHGDIQFIAVGTPSDEDGSADLQYVLAAARNIGRHMTGFKVIVDKSTVPVGTASRVRDVIAAELAGRNAAHMFSVVSNPEFLKEGAAVEDFTRPDRIVLGCDEDVPGEKARELMKRLYAPFNRNRERTLYMDVRSAEFTKYAANAMLATRISYMNELANLADRVGADIEAVRRGIGSDPRIGYDFLYAGCGYGGSCFPKDVQALIRTAADHKANLRILEAVEAVNDTQKQVLAQKIVSRLGEDLSDRTFGVWGLAFKPNTDDMREAPSRPLIAELLRRGARVKAYDPVAIDESKRVFALDLKDVPQQHARLSFVKEEMEAAEGADALVILTEWKVFKSPDFDSLKRILRTPLIFDGRNLYEPDALLELGIEYQAIGRQHALRSAPAKVGANGLPLAHVPALNAAGAGR

SEQ ID NO: 87377 - protein, 345 aa, Oryza sativa
NVNYFDTGGSKGLAKVVRSPANSTKSGTEKTFENMDAVAYMPVVRSGGWADIGSRHTMEDVFICSDNLMKEFGVESFEDGPSAFYGVFDGHGGKHAADFVCSNLARFIVEDEDFPREIEKALSSAFLQTDAAFADACSVNSSLASGTTALAALVVGRSLLVANAGDCRAVLCCRGKAIEMSRDHKPSCNREKVRIEASGGYVYDGYLNGQLNVARAIGDWHMEGMKACDGLGPLSAEPEVMIRNLTEEDEFLIIGCDGIWDVFRSQNAVDFARRKLQEHNDPVTCCKELVDEAIKRKSGDNLSVVVICFNSRPPPVLTTPRPRVQRSISAEGLRELQSFLDSLAD

SEQ ID NO: 87378 - protein, 203 aa, Streptococcus agalactiae
MSENLGQLAINQARENGGKLEVISKVKVEDKRDLSIAYTPGVASVSSAIAEDVELAYELTTKKNTVAVVSDGSAVLGLGDIGPEAAMPVMEGKAALFKRFANVDAVPIVLKTNDTEEIISIVKAISPTFGGINLEDISAPRCFEIEQRLIEECDIPVFHDDQHGTAIVVLAALFNSLKLVKKDIEDIRVVVNGGGSAGLSITR

SEQ ID NO: 87379 - protein, 404 aa, Helicobacter hepaticus ATCC 51449
MDLQTLKKAYPKALPYHIGGKVGIQPRKRLRSIDELGLAYTPGVAVPCKQIEANPLSAYDYTSKSNLVAVISNGTAVLGLGDIGAMASKPVMEGKAILFKTFAGVDAFDIEINEKDVDKFVAVVKAISPTFGGINLEDIKAPECFEIERRLIEELDIPVMHDDQHGTAIISTAGIINALHLVNKKAKDIKVVVFGAGAAAVACAKMYKAFGVKNLVMFDSKGAISANRTDLNDLKKEFICQENYASYKDALNGADVMLGLSKGNLLSGDDIKGMNESPLIFALSNPTPEIMPDEVKKARPDAIVATGRSDFPNQINNVLGFPYIFKGALKVRASKINEEMKFAAAYAIANLAREPITEKLEKLLKKKMSFGKEYIIPSAFDERLDDVVSNAVADAAIKSGVARV

SEQ ID NO: 87380 - protein, 331 aa, Pseudomonas fluorescens PfO-1
MPPITATPAPLSRRFSVAPMMDWTDRHCRYFLRILSKNALLYTEMVTTGALLNGDHERFLRHNEAEHPLALQLGGSVPLDLAACARMAQEHGYDEVNLNVGCPSDRVQNNMIGACLMGHPQLVADCVKAMRDAVSIPVTVKHRIGINGRDSYEELCDFVGTVRDAGCTSFTVHARIAILEGLSPKENRDIPPLRYDVAARLKADFPELEFILNGGIKTMEACHEHLQTFDGVMLGREAYHNPYLLAEVDQQLFGSSAPVISRAEALAQLRPYIAEHLLAGGAMHHITRHVLGLGTGFPGARKFRQLLSVDIHKAKDPLALLDQAAELLAGR

SEQ ID NO: 87381 - protein, 435 aa, Caulobacter crescentus CB15
MRVAMIGTGYVGLVSGACFADFGHVVTCIDKDPSKIERLERGEIPIFEPGLDDLVARNVREGRLFFTLEGAQAIKDADAVFIAVGTPTRRGDGHADLSYVYAAAEEIAGLIDGFTVVVTKSTVPVGTGDEVEAIIRKVRPDAQFAVVSNPEFLREGAAIEDFKRPDRVVVGTDDERAQAVMRDLYRPLSLNETPIVFTGRRTSELIKYAANAFLAMKITFINEMADLCEKVGADVQSVAKGIGLDKRIGAKFLNAGPGYGGSCFPKDTIALVKTAQQYGAPTRLIETTVEVNTARKKAMAEKVAEAMGTRELTGKTIGVLGVTFKPNTDDMRDAPSLDILPALQTMGAKVQAFDPEGAKEAAHMLAGVEFKAGAYDAAEGADALVILTEWDQFRALDLDRLKSLLKAPVVVDLRNVYKPAEMVRHGFTYASIGRS

SEQ ID NO: 87382 - protein, 327 aa, Caulobacter crescentus CB15
MQTVLVAGGAGYVGSHCCLALAAAGFRPVVYDDLSNGHREHVQWGPLEVGDIRDGARLDAVFAAHAPVAVLHFAARIEVGESVKNPGAFFDNNVGGTITLIEAARRAGVNAMVFSSTCATFGDPVHLPMAEDHPQAPLNPYGRSKLMVEQALADYDRYVGFKSAVMRYFNAAGADPEGRIGEWHEPETHAIPLAIQVALGQRSHFTIFGDDYDTRDGTAVRDYIHVLDLADAHVSALRRLLAGGSSDSYNLGTGTGTTVRELVDGVGRVTGKPLPVQMAPRRAGDAPVLVGDNTRAREHLGWKPSRDLDATLSSAWRWHQAQALVGR

SEQ ID NO: 87383 - protein, 369 aa, Escherichia coli O157:H7 EDL933
MATLTRLFIHPVKSMRGIGLTHALADVSGLAFDRIFMITEPDGTFITARQFPQMVRFTPSPVHDGLHLTAPDSSSAYVRFADFATQDAPTEVWGTHFTARIAPEAINKWLSGFFSREVQLRWVGPQMTRRVKRHNTVPLSFADGYPYLLANEASLRDLQQRCPASVKMEQFRPNLVVSGASAWEEDSWKVIRIGDVVFDVVKPCSRCIFTTVSPEKGQKHPAGEPLKTLQSFRTAQDNGDVDFGQNLIARNSGVIRVGDEVEILTTAPAKIYGAAAADDTANITQQPDANVDIDWQGQAFRGNNQQVLLEQLENQGIRIPYSCRAGICGSCRVQLLEGEVTPLKKSAMGDDGTILCCSCVPKTALKLAR

SEQ ID NO: 87384 - protein, 337 aa, Oceanicola granulosus HTCC2516
MAVKVAINGFGRIGRNVLRGIIESGRTDIEVIAINDLGPVETNAHLLRYDSVHGRFPAEVKTTEDTIDVGQGPIKVTALRDPKELPWSDVDIVLECTGIFTSPEKAGLHLENGAKRVLVSAPLSNPTQGEKTIVYGVNHETLTADDKIVSNASCTTNCLSPVAKVLNDAIGIKKGFMTTIHSYTGDQPTLDTMHKDLYRARAAALSMIPTSTGAAKAVGLVLPELNGKLDGVAIRVPTPNVSVVDLTFEASRETSVEEINDAIRAAAGSGPLKGILTYTDEKLVSSDFNHDPSSSIFHMDQTKVMEGTMCRILTWYDNEWGFSNRMADTAVAMSKYI

SEQ ID NO: 87385 - protein, 157 aa, Photorhabdus luminescens subsp. laumondii TTO1
MRIGHGFDVHKFGGEGPIIIGGVRIPYEQGLLAHSDGDVALHAATDALLGAAALGDIGKLFPDTDPAFKGVDSRKLLREAYSRIREKGYRIGNLDITIIAQAPKMLPHIPQMRVNLAEDLQCHIDDINVKATTTEKLGFVGRKEGIACEAVALLVKE

SEQ ID NO: 87386 - protein, 473 aa, Synechococcus sp. CC9311
MAKTAQDVLRQIKDEGIELIDLKFSDLHGKWQHLTVCSDMVDEDAFKEGLAFDGSSIRGWKAINASDMSMVPDPATAWVDPFYRHKTLSLICSIQDPRTGDPYERCPRALAQKALAYLSNTGLADKAFFGPEPEFFLFDDVRYNSSEGGCFYSVDTIEAGWNSGRMEEGGNLAYKIQLKEGYFPVAPNDTAQDIRSEMLLMMAQLGIPIEKHHHEVAGAGQHELGMKFDELIQAADNVMTYKYVVRNVAKKYGKTATFMPKPVFNDNGTGMHVHQSLWKGDQPLFFGEGTYANLSQTARWYIGGILKHAPSFLAFTNPTTNSYKRLVPGFEAPVNLVYSEGNRSAAVRIPLTGPSPKAKRLEFRSGDALANPYLAFAAMMMAGIDGIKNQIDPGDGFDGDLFELPADQLKDIATVPASLNGALEALNADHHYLMEGGVFTKDFIDNWINLKYEEVQQLRQRPHPHEFTMYYDA

SEQ ID NO: 87387 - protein, 276 aa, Triticum aestivum
HYRTSLYKKAGWYRSGIPGISSTHASDRGKVAWSTRADVTANNNNNNRAVLLLLDTGNLVLRSASNASDVMWQSFDHPTDTLLPGATIGLDKVTGRSRRLVSRKNRIDQAPGAYSMELGRSGVVQMLWDASVPYWSSGEWNGDYFSSVPEMTARHLIGSTFVNDDREVSFAYHLLDETITMYSFLDVSGQKKMLVWQDATRDWVTFYVHPTTQCEVHAVCGPFTACNESAPAPCSCMKGFSVGSAEDWELDDRRTNGCKRKPHLNWASINNGTLVG

SEQ ID NO: 87388 - protein, 247 aa, Thermobifida fusca YX
MSTLVLLRHGESVWNAEGLFTGWVDVDLSPKGEEEARRGGRLLAEAGIRPDVVHTSLLKRAIRTANIALEEAGLHWIPVKRSWRLNERHYGALQGKNKAQTRAEFGDEQFMIWRRSYDTPPPPLAEDSEFSQHNDPRYATLPPELMPRTECLADVVRRMLPYWYDAIIPDLAAGRTVLVAAHGNSLRALVKHLDNIDDKSIAGLNIPTGIPLVYELNDDFTPRKTGGEYLDPEAAKEAIEAVKNQGK

SEQ ID NO: 87389 - protein, 522 aa, Candida tropicalis
MSIQDIVETYSTKWYVVVSVALIVYKVFDFFYARYLMYKLGAKPFLQSQTDGYLGFRVPFELMGKKSEGTLIDFTYQRTLELDNPDIPTFTFPIFSVSIISTLEPDNIKAILATQFNDFSLGTRHSHFAPLLGDGIFTLDGAGWKHSRSMLRPQFAREQVSHVKLLEPHMQVFFKHIRKHHGQTFDIQELFFRLTVDSATEFLFGESVESLRDESIGMLNDALDFDGKAGFADAFNYSQNYLASRALMQQMYWILNGKKFKECNAKVHKFADYYVEKALELTPDQLEKQDGYVFLYELVKQTRDRQVLRDQLLNILVAGRDTTAGLLSFVFFELARTPRVANKLREEIEDKFGLGQDARVEEISFESLKSCEYLKAVLNECLRLYPSVPQNFRVATRNTTLPRGGGKDGLSPVLVRKGQTVMYSVYAAHRNKQIYGEDALEFRPERWFEPETKKLGWAFLPFNGGPRICLGQQFALTEASYVTVRLLQEFSHLTMDPNTEYSPKKMSHLTMSLFDGANIQMY

SEQ ID NO: 87390 - protein, 312 aa, Pseudomonas fluorescens PfO-1
MYLVCGEALFDFFSEDDAGGQASKVNFKAIAGGSPFNVAVGLRRLGVDSALFGGLSTDYLGRRLQQVLQDEGVHPDYLVDFAAPTTLAMVAVGANGSPHYSFRGEGCADRQLSLAHLPALGPEVRGLHFGSFSLVVQPIADTLLALVQRESGKRLISLDPNVRLNPEPNIDLWRERIATLVPLADLIKVSDEDLSLLYPEQDPARVIEGWLQHRCQVVFLTRGGEGATVFSRVHGSWSVPASSVKIADTVGAGDTFQAALITWLTEHELDSVEGVQHLSREQIDGMLRFAVQAAALTCSKTGPDLPYRHQLT

SEQ ID NO: 87391 - protein, 341 aa, Bacteroides fragilis YCH46
MGKKVVTLGEIMLRLSPPGNTRFVQSDSFDVVYGGGEANVAVSCANYGHDAYFITKLPGHEIGQSAVNALRKYGVKTDYIARGGERVGIYYLETGAAMRPSKVIYDRAHSAIAEAVAADFDFDKIMEGADWFHWSGITPAISDKAAELTRLACEAAKRHGVTVSVDLNFRKKLWTKEKAQSIMKPLMKYVDVCIGNEEDAELCLGFKPDADVEGGHTDAEGYKGIFRQMMDEFGFSYVISTLRESFSASHNGWKAMIYNGEEFYVSRHYDIDPIIDRVGGGDSFSGGVIHGLLTKRTQGEALEFAVAASALKHTINGDFNLVSVAEVEALVGGDASGRVQR

SEQ ID NO: 87392 - protein, 252 aa, Saccharophagus degradans 2-40
MPKTILITGASSGFGEACAKIFAKQGNTLILVARRKQLLDELADNLGKQCDVYTAQVDVSQPASIATFFEQLPSKLGPIDTLINNAGLALGLESADKADINDWETMINTNCLGLVHFTRQVLPSMVANNLGHIVNIGSTAGKWPYPGGNVYGATKAFVQQFSRNLRADLLGKNIRVTNIDPGMAETEFSNIRFKGNNEKAEQVYHNAKPLTAQDIAETVQWVCNRPAHVNINSLEIMPVCQAWGGWEIDRNC

SEQ ID NO: 87393 - protein, 342 aa, Pseudomonas fluorescens PfO-1
MDRAMKILVTGGAGYIGSHTTLALLEAGYEVVVLDNLCNSSDAALHAVEAICGKSALMIRGDVCDRALLDRIFQQHAIDAVLHFAGLKAVGESVRKPLEYYETNVSGSITLCQAMAAAGVFRLVFSSSATVYGEPAQMPIREDFPTGTPTNPYGQSKLIVENVLRDLCQSEPRWSIALLRYFNPIGAHHSGQMGEDPNGIPNNLVPYISQVAVGSLKELSIFGDDYPTVDGTGVRDYIHVVDLADGHLKALQAIADRTGIHTWNLGTGDGYSVLQVLRAFEQACGQPVPYRVMPRRSGDIAESWADASKAAKELGWKATRNLQDMVTDTWRWQSNHPRGYQG

SEQ ID NO: 87394 - protein, 489 aa, Alteromonadales bacterium TW-7
MQPSTGFNLISFSGKMKILHLSWMVFFISFFVWFNHAPLLGAIAGSLGITMAQVKTLLILNVALTIPARVVVGMLTDKFGPRIVYASLLILCSIPCFMFAMATTFEQAAIARFALGFIGAGFVVGIRMVSEWFPANELGAAEGIYGGWGNFGSAAAAMLLPVLALMFGGDDGWRYAIGLTGVLSVIFGVIWYINVTDTPKGGTYFKPKKVGAMEVTSKGDFVLLLIMKLPMYGALALLTWKLSPTGANLLSENFVIGTYVFLVLLYLYEVYKTYDINGHIFKQPVPESHRYEFKQVAVLNILYFTTFGSELAVVSMLPLFFSEVFGLDMVYAGLLASAYAFMNLASRPGGGWISDRMGRRKTLIVLTTGLAVGYFVMGLVDASWPLWLAVAAAMACSFFVQAGEGAVFAAVPLIKRRLTGQIAGMTGAYGNVGAVVYLTALSLVDYQTFFMIIAASALLGLGALFFMKEPDGHITEVNEDGTVELISVT

SEQ ID NO: 87395 - protein, 571 aa, Aspergillus oryzae
MSTEKNPHIHDAVQSRELQQEVEFKNPGVKRIAAISSQLGIVARVFLFFGIFLVAYVYGLDGQLRVTYQPLATSSYAQHSLLTTINVLRNVIAAAAQPTAAKIADVFGRVELILLSVFFYTIGTIVEACADNVETFCAGAVLYQIGYTTIILLVEVLVADMTSLRSRLLFSYIPATPFIINTWVSGDIASAVLGVTSWRWGIAMFAIIFPICTIPLFATLLVGHRKAKTASVETYQHPIRLLGAGKFAKELFWYLDVVGILLLIAFLALILVPFTIARSAAEQWKTAKILAPLIIGLFCLPLFVIWERSYARYPMVPFKLLKDRAVWGALGIATMLNLAWSLQGTYLYTVLQVAFDQSVLSATRISSLYSFASVITGCILGAIIVKVKQLKPFIVAGTILFAVAFGILIQFRGGTGSSSYSGIIGGEILLGIAGGMFPYPAQASIQAATKHEHLAVITGLYLAVYNIGSAIGGTISGAVWRQRMGKELTKHLGGANETLTDLAFGKPFDFIVSYPVGTPEREAVILAYKEVQRILCITGICLTVPLIIFSLCIRNPRLTKDQSLPDAEREE

SEQ ID NO: 87396 - protein, 277 aa, Pseudomonas fluorescens PfO-1
MIRKCLFPAAGYGTRFLPATKAMPKEMLPIVNKPLIEYAVEEARDAGLQHMAIVTGRGKRALEDHFDISYELEHQIRGTEKEKFLAGTRELIDTCTFSYTRQVEMKGLGHAILSGRPLIGDEPFAVVLADDLCLNLEGDGVLTQMIELYKKFRCSIVAIQEVPRDQTHKYGVIAGEAISEGIYRVNHMVEKPAPQDAPSNLAIIGRYILTPDIFDLIADTEPGKGGEIQITDALMKQAQNGCVLAYKFKGLRFDCGDAEGYLQATNFCYENVYLKGR

SEQ ID NO: 87397 - protein, 610 aa, Sinorhizobium meliloti 1021
METTTIIYSQALMLLAGAVVAAPLFKRLGLGTILGYLAAGILIGPVAQQITEGEEILHVSELGVVFLLFIIGLELKPSRLWQMRRDIFGLGTAQVVITGAVLSFLIAFSGLLEGAGSIVAGFGLALSSTAFAMQILEENNDTNTRYGQRAFSILLLQDLAIVPLLAIIPLMAAQAPEDTTTPLEDFAIAIAAVAALFAAGRYLLNPLFQVIARTGARDVMIAAALLVVMGAATMMQLAGLSMAMGAFLAGVLLAESSYRHELEADIEPFRGILQALFFMAVGLSLELQVVAENLLSIIIAVPVLMLVKSLVLYGLCRATGSRHNDAVRIGLLLPQGGEFGFVLFTAAAAAGVFSQATSSLLVAIVTLSMALTPVAAMLSRRLMHKQDELAEEIEEDFEGAGAGADVLMIGFSRFAQIASQILLAGGRDVTIIDHSAARVRQAATFGFRIYFGDGTRLDVLRAAGIEKAKIVAVCTQKKEVTDKIIDLVHAEYPNARIFARSYDRLHTLELRARGVDYELRETFESGLLFGRKTLEALGVNGDEAIGIMDDIRRRDEARLVLQEAEGITAGRDMLHSRPVRPEPLVKPKREVTQPDDALADLADETLEKAE

SEQ ID NO: 87398 - protein, 233 aa, Zea mays
MLGFRQMSWSSAEAQAPSEQLCEGVAAVVAARQGMETPLTAVAEAFEELVRGMDADGGELRVAPFSDTCALVSVLFSSLGMAFRFAEMEYVTKVNDLIGAGKSYRTLSDILDKDIQNDCVKKQGSHSRNLRRVRLGLGLIKALFEQFLATEGSLYDAATTAYGQVCAPFHSWAIRKAVGAGMYTLPTREQLVVRLNETDLSVQKQMRRYIDASSPIIEYIDNLFLSRNISLDW

SEQ ID NO: 87399 - protein, 267 aa, Populus trichocarpa
MQTEARVGVVVEGGPRALNSQPKQHKPLQQQYQQSQIGTVSQLVAGGVAGALSKTCTAPLARLTILFQVQGMHSDVATLRKASIWHEASRVIREEGVRALWKGNLVTIAHRLPYSSVNFYAYERYKQFLHMIPGLEIHRESAGVNLFVHFVGGGLAGITAASATYPLDLVRTRLAAQTNVIYYRGIWHALQTISREEGVFGLYKGLGATLLGVGPSIAISFSVYESLRSFWHSRRPHDSTVAVSLACGSLSGIASSTAKQGVLQALN

SEQ ID NO: 87400 - protein, 385 aa, Trichodesmium erythraeum IMS101
MDDKLMLMIPGPTPVPETALLAMAKHPIGHRSGDFSKIMAEVTENLKWLHQTKNDMLILASSGTGAMEAGIINFLSPGDRVLCGCNGKFGDRWAEVATAYGLQVEKITAEWGKALETEKFRQHLEADKDKQIKAVILTHSETSTGVLNDLETINGYVKAHGEALIIVDAVTSLGAVSIPVDELGLDVVASGSQKGYMIPPGLAFVAVGPKAWTAYETAKLPRYYLDLGKYRKDAAKNTTPFTPPVNLFFALQATLRIMQAEGLENIFARHDRLKSATRAAIKALGLPLLASDKVASPAVTAVAPPTEVEAEKVRAIMKKRFDIALAGGQDHLKGKIFRIGHLGFVCERDVTSAIAALEVTLRDLGYESFTPGEALAAASRVLVES

SEQ ID NO: 87401 - protein, 521 aa, Vibrio cholerae O1 biovar eltor str. N16961
MPMFEFPSFSQHSIKNDVLSGLTVALALVPEAVAFAFVAGVDPMVGLYAAFIVGLITSIFGGRPGMISGATGAMAVVMVSLVASHGVQYLFAAILLTGLLQVAAGLFKLGKFIRMVPHPVMIGFVNGLAIVIFLAQLGQFKAPDLNGVMTWLPQKELLLMLGLVALTMAIIHFLPKLTTAIPSSLAAIVTVTLLVQGLGLETRTVVDFLRAMSGNDAATLAGSLPSFSIPAVPLTWETLKIIFPYALILAAIGLIESLLTLTVLDEMTGTRGQSNRECMGQGLANITCSMFGAMGGCAMIGQSMINVNSGGRGRLSGIVAAVLLLCFILFTASLIEMIPLAALVGVMFMVVIGTFEWATFKLARRVPKQDFFVIVLVTVVTVFTDLAIAVAVGVIASALMFAWEHAKHIYAASHINPDGHKEYHIHGPIFFGSAANFLELFDAHHDPKEVIVDFARSRVADHSAIDAIETLAERYAAVGKTLHLRHLSQDCRALLQKVGSLVEINLKEDPTYKVASDVLAG

SEQ ID NO: 87402 - protein, 672 aa, Zea mays
MAAVHGRVLLLLLSTLTFLAVHAVTAAAATATSCAPRTCGNLTIAYPFWLPVPDQQASSSSLPPCGPSAFQVDCRGGRASLARSFRGAYKILRVSYADRTVVVANDNVQTDASGCPVPRIDVSASLSLAPFTASGANAQLVFLFNCSKPPPAGFVNVTCPGAQAVVRLDPRYNTTDARAVAGACDYSVVPVLVSPGGGASAGDYPRLLRGGYLLDWRASPGNCTACNASGGQCGYDSDTDAFACLCDDGSSHPARCGAKKSDRKVILIVSVSIAFGLLLALLVLILKFHRQITRSFSFLLDRSSSGDTADVEKLLQKYGSLAPKRYRYAELKRITKSFQRKLGEGGYGAVYSGVLAAGAGGTRAREVAVKVLHHARPNGEEFLNEVVSIGRTSHVNIVTLLGFCLEGSKRALVYEYMPNGSLDRYIRSETESDPAGTAALGWEALQEIAAGIARGLEYLHEGCNTRIIHFDIKPQNVLLDADFRPKIADFGMAKLCNPKESILSMADARGTIGFIAPEVFSRGFGVISTKSDVYSYGMLLLEMVGGRSNAKACAADKSSGGGELFFPLWVYDHLLLEDGVGVLRSGGGGGAGGSGEAAAGEEIARKMALIGLWCIQTVPASRPSMSRVLEMLERSVHELAIPPRPYHTSPSNSPSPSHPSSYPSSTSDFTQR

SEQ ID NO: 87403 - protein, 556 aa, Oryza sativa Japonica Group
MGSSDFSWTLPDHPKLPKGKPVAVVVLDGWGEADADQYNCIHVAETPTMDSLKKGAPEKWKLVKAHGTAVGLPSDDDMGNSEVGHNALGAGRIFAQGAKLVDTALASGKIFEGEGFKYIKESFDQGTLHLIGLLSDGGVHSRLDQLQLLLNGASANGAKKIRVHILTDGRDVLDGTSVGFVETLENDLSQLRAKGIDACIASGGGRMYVTMDRYENDWDVVKRGWDAQVLGEAPHKFQNAVEAVKTLRSETKANDQYLPPFVIVDDSDKAVGPIVDGDAVVTFNFRADRMVMIAKALEYEDFDKFDRVRVPKIRYAGMLQYDGELKLPSHYLVSPPEIERTSGEYLVKNGIRTFACRQFGHVTFFWNGNRSGYFDETKEEYVEIPSDSGITFNVKPKMKALEIAEKARDAILSGKFDQVRVNLPNGDMVGHTGDIEATVVACKAADEAVKMILDAIEQVGGIYLVTADHGNAEDMVKRNKSGQPQLDKKGEIQILTSHTLQPVPVAIGGPGLHSGVRFRNDVQTPGLANVAATVMNLHGFEAPADYEPTLIEVVDK

SEQ ID NO: 87404 - protein, 73 aa, Triticum aestivum
DKVDAYVHQLKGSSASVGAQKVKFTCMQFRQLCQDKNRDGCIMALAVVRNEFYDLRNKFQTMLQLEQQIQAQQ

SEQ ID NO: 87405 - protein, 366 aa, Caulobacter crescentus CB15
MQVTAAVTRSPSGPFSLEALDIEPPRAGEILVRVVATGVCHTDMVMRDQHLPTPQPVVLGHEGAGVVEQVGPGVAKVAVGDHVVMTFNSCGRCPSCSDHAPTYCHEFFPRNFMGAREDGSSGLSKGSEVIHANIFGQSSFATYALCHERNAVKVDKTAPLERLGPLGCGVMTGAGAVMNALKVPAGRSLVVFGAGAVGLSAVLAAKAIGAGPIIAIDINPERLALALELGADHALNGAEGGVVEKIQAITGTGAHFSIDTTANLKVMRQAVDCLGARGVCGLVGASKMGDELPLDAVSVMSGGKVVRGVVEGDADPDVFIPELIALHLAGRFPFDRLIQFYPLAEINQAVSDGETGRVIKPVVRMS

SEQ ID NO: 87406 - protein, 432 aa, Rickettsia sibirica 246
MNITFIGSGYVGLVSGIIMGYLGHNVTCLDNDEVKISKLNKQILPIYEAKLDEYLKQALESDRLKFTNIYNNELQNADAIFITVGTPSKGLGEADLKYVYDAIDKVFEHINKDCLIVIKSTVPPGSCSNIIAYLKSRGFSFNVASNPEFLREGSAVEDFLYPDRIVIGVNNKESEEILRKIYAPLQGVKFVVTDLVTSELIKYASNSFLATKIAFINEMADLCEKIGGNIKDLSKGVGLDQRIGQNFLNAGPGFGGSCFPKDILALNNLVENHHIDCRILEAVIKSNKQRPSNMVDKIATLLDGDLKGKNIAILGLTYKAGTDDVRASPAIAIVKILLNKDVYVKAFDPIGLENAKKNLEHKNLLYLDSAVDACKSVDIIVIATEWSEFKELNWQEIYDLVKSPIIIDFRNILDNEAMKKIGFRYYAVGSKI

SEQ ID NO: 87407 - protein, 487 aa, Caulobacter crescentus CB15
MSEPLLSADAWTDRLFSDGWVKPSGGVIAVQEPATETVLTQVGRADRSDVARAAASAKAAQPAWAALTADARQAILLRAADLLVEHAPDLAPWIMRESGSVAAKAAVELEHAAGFVRQAGAMATEAAGLVLPSSPGKTSIARRVPLGVVAVISPFNFPLVLSIRAVAPALATGNAVVLKPDPRTPISGGFLIARVFEAAGLPAGLLHVLPGDAEAGDALCRDPNIAMVAFTGSTGAGRKVGEVAGAHLKKVALELGGKNPLIILDDADPDVAASNAAWGAWLHQGQVCMTAGRLLVQRGIHDAVVERLAAKAGHLPVGDPMRGDVALGPLISRGQLDRVHAIVSDTVADGARLVAGGTHKGLCYAPTVLTGVAPGMRAFEEEIFGPIAAVTVFDDLDEAARLANDGPYGLSAGIISGSVGRAMTLGAKLEVGHLHINDQTVDAGPHSPFGGMKASGNGTRISGPANLDEFTTWRWETVKAAATAYPF

SEQ ID NO: 87408 - protein, 266 aa, Chlamydophila pneumoniae AR39
MSPEALKQHYASQYNILLKTPEQKAKIYNACQITARILDELCKASQKGVTTNELDELSQELHKKYDAIAAPFHYGSPPFPKTICTSLNEVICHGIPNDIPLKDGDIMNIDVSCIVDGYYGDCSRMVMIGEVPEIKKKICQAALECLNDSIAILKPGIPLCEIGEAIEARADTYGFSVVDQFVGHGVGIEFHENPYVPHYRNRSMIPLAPGMIFTIEPMINVGKKEGVVDPKNQWEARTCDNQPSAQWEHTIAITETGYEILTLLND

SEQ ID NO: 87409 - protein, 229 aa, Listeria monocytogenes str. 4b F2365
MKLVLIRHGQSEWNKLNLFTGWHDVDLSQEGVVEAMTAGKRIKEAGLEFDVAFTSVLTRAIKTLNYVLEESDQMWVPVHKSWRLNERHYGALQGLNKQETAEKYGADQVQKWRRSYDTLPPLLEENDERQAKNDRRYQLLDTHAIPAGENLKVTLERVIPYWMDTIAPEIKEGRRVVIAAHGNSLRALVKFLEGIGDDEIMDLEIPTGVPLVYELNDDLKPVNKYYLDK

SEQ ID NO: 87410 - protein, 618 aa, Mycobacterium sp. JLS
MALYRKYRPATFAEVVGQEHVTEPLSTALSAGRINHAYLFSGPRGCGKTSSARILARSLNCEQGPTPTPCGTCDSCVALAPNGPGNMDVTELDAASHGGVDDTRELRDRAFYAPAQSRYRIFIVDEAHMVTTAGFNALLKIVEEPPEHLIFVFATTEPEKVLPTIRSRTHHYPFRLLAPKTMRTLLERICADEGVTVDDAVYPLVIRAGGGSPRDTLSVLDQLLAGAAGDRVEYGRALALLGATDVALIDDALDALAAGDAAALFGAVESVIDAGHDPRRFAVDLLERFRDLIVLQAVPDAAARGVVDAPGDVLERMRDQAARLGSATLTRYAEVVHAGLGEMRGATAPRLLLEVVCARLLLPSASDTESALLQRVERIETRLEMSIPASDMPATARPVEPAKTFTRRSQVADAPAPAPAPAPVEARPEPPAPPVPPPPAPAPPPSPPPVRPPAEPVVEAPAAAPPPAAGAPNAAAVRSMWTTVREKVRQRSRTIDVMLAGAIVRTVEGDTLVLSHESAPLAKRLVEQRNSDLIREALKDALGVDWKIRCEAGGAPAPAVVAEPARPAPVADPPPPEDDEESMLAEAVREEAGPRRDPEEAALELLQNELGARRIDGS

SEQ ID NO: 87411 - protein, 127 aa, Vitis vinifera
MFVVYLCMALIVSKYMVKKSCKKHCCIYRPKNKPLITLSNHVASMDDPLVIASLLPPSALLNAQSLRWTMCATDRCFKNPMTHAFFRCVKVLPVSLGDGIYQTGIDMVVSKLNSGGWVHIFQESSHS

SEQ ID NO: 87412 - protein, 169 aa, Borrelia hermsii DAH
MSTLIQKTLCIIKPDGVRRGLIGNVISRFEKAGLKIVAAKMTLVNRAMAEIHYLYDDIAVRHGEFVWRSLIDFIISSPVFVFVIEGVEAVEVVRKFCGSTEPKVAALGTIRGDFAYHSFNYANEKKFAVYNVIHASASVDDALREIPIWFKEDEILTYKRNDELEHYYG

SEQ ID NO: 87413 - protein, 408 aa, Burkholderia vietnamiensis G4
MHTVTLKPSKDKSLQRRHPWIYANAIDRVDGQPAPGATVVVRAHDGRFLARGAYSPQSQIRVRVWSFDETEPIDHAFFKRRVQRAVAHRNAMVSGTGAVRLVFGEADGLPGLIVDYYVADTAEPGAEPDAAPRGQLVCQFMAAGVEAWKDAIVKALIGATGCPNVYERSDVSIRDKEGLAQTTGVLAGDAPPATLIVDENGVRYHVDVPHGHKTGFYVDQRDNRALVAQYAAGRDVLNCFCYTGGFSLAALKGGAQRVVSIDSSGDALALAQQNVAANGFDAARASWLDADAFKTLRRLVDEGERFDLIVLDPPKFAPNRDSVERAARAYKDINLSGFKLLRPGGLLFTYSCSGAIDAELFQKIVAGAAADAKVDARILKRLGAGVDHPLLAAFPEGEYLKGLLLQIV

SEQ ID NO: 87414 - protein, 180 aa, Borrelia hermsii DAH
MEISMKDKTEYYDKFIMRVPNFPKEGILFYDITNVLLQAEAYKSLMEDAHAFYASRKIDCIAAIESRGYLIGSPLALKMGLPLLLIRKAGKLPRQVLREEYELEYGFSSIEIHKDDVKQHSNILLVDDILATGGTLKAAAMLLKKAGGVVSDIFCFIELVKMNGRDILREYSLNSLVRYF

SEQ ID NO: 87415 - protein, 503 aa, Vitis vinifera
MALTGYDCEILLVFICLLLLLRFFKGKNIIPWNWPLIGMLPTILFQYDQVLDLGAEILERCGGTFLVKGLWLAHSDMLVTCIPADAHHVMSTNFWNFPKGPEFRMMLDAFGNGLFISDLEDWSFHRRIGRALFNHQRFQQLSVDITLDKVENGLVPVLEHASQQRLAVDFQDLFQRFGLDATCALITGCDPKSLCLELPDVPFASAMEEAGKVIFLRHVYPKCIWKLQRWLGIGSERILIAAKKTLYDFAAEHVSFMRERSNMGTNQTEGLDILSAYINEDEAFQSSASDKVLIDNILSLLLAGKDTTSAALSWFFWLVSKNPSVETKIIEELKAAVPAKEAEKWHLFDAKELSKLVYLHGALCESLRLFPPVPLQIRTPLQPDILPSGHRVDPSTKVIFHAYAMGRMACAWGKDCLEFKPERWLTGKGRTKHEPAYKFLAFSAGPRICLGKEVAFFKMKAVAAAIMHNYHFQMVKGHRVVPTVSIVLHMKHGLRVNVKNKWA

SEQ ID NO: 87416 - protein, 517 aa, Borrelia hermsii DAH
MKEFIVSNNAVIVLDFGSQYSQLIARKIREVGVYTRVIAYSISAEEIKDMHPLGIILSGGPASVYLDEAPTVDIEIFNLGVPILGICYGMQLIIKLFGGVISKCDKQEFGNTELFIDDNQSNLFLGLPNKLEIMMSHGDNIVKVPSSFKQIAYTKTCIASVFNEEQKIYGLQFHPEVTCSESGNQILKNFIFKICQAQVNWNLNNSIDDLVEKIKLQVGDKKVILGLSGGTDSLVCALLVNKAIESNLICIFIDTGLLRKNEAREILELNRQYNLNIKHVDSSSIFLNNLKNIDDPEEKRKIIGKTFIEVFEKIALEDKDVEFLAQGTIYSDVIESESRNDVFSSHIKSHHNVGGLPGKIKLKLLEPLRELFKDEVIQLGIQLGIAEDVLYRHPFPGPGLAIRIIGKITQEKINILQKADSILIEELLASNLYYKIRQAFVVLLPVKSVGVMGDSRTYEYTAVIRCVNTLDFMTANWVELPYDFLKKVSSRIINEARGINRVCYDISSKPPATIEWE

SEQ ID NO: 87417 - protein, 251 aa, Zea mays
  misc_feature (230)..(230): Xaa can be any naturally occurring amino acid
  misc_feature (237)..(237): Xaa can be any naturally occurring amino acid
MATAGKVIKCKAAVAWEAGKPLSIEEVEVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGQSRFTINGKPIFHFVGTSTFSEYTVIHVGCLAKINPEAPLDKVCVLSCGISTGLGATLNVAKPKKGSTVAIFGLGAVGLAAMEGARMAWASRIIGVDLNPXKYEQAKXFGCTDFVNPKDTVA

SEQ ID NO: 87418 - protein, 375 aa, Bacillus subtilis subsp. subtilis str. 168
MKKQRMLVLFTALLFVFTGCSHSPETKESPKEKAQTQKVSSASASEKKDLPNIRILATGGTIAGADQSKTSTTEYKAGVVGVESLIEAVPEMKDIANVSGEQIVNVGSTNIDNKILLKLAKRINHLLASDDVDGIVVTHGTDTLEETAYFLNLTVKSDKPVVIVGSMRPSTAISADGPSNLYNAVKVAGAPEAKGKGTLVVLNDRIASARYVTKTNTTTTDTFKSEEMGFVGTIADDIYFNNEITRKHTKDTDFSVSNLDELPQVDIIYGYQNDGSYLFDAAVKAGAKGIVFAGSGNGSLSDAAEKGADSAVKKGVTVVRSTRTGNGVVTPNQDYAEKDLLASNSLNPQKARMLLMLALTKTNDPQKIQAYFNEY

SEQ ID NO: 87419 - protein, 446 aa, Pseudomonas putida GB-1
MIESVDNFLARLQQRDPGQPEFHQAVEEVLRTLWPFLEANPHYLQSGILERMVEPERAVLFRVSWVDDQGKVQVNRGYRIQMSSAIGPYKGGLRFHPSVNLSVLKFLAFEQVFKNSLTSLPMGGGKGGSDFDPKGKSDAEVMRFCQAFMSELYRHIGADCDVPAGDIGVGAREIGFMFGQYKRLANQFTSVLTGKGMTYGGSLIRPEATGYGCVYFAEEMLKRQDKRIDGRRVAVSGSGNVAQYAARKVMDLGGKVISLSDSEGTLYAEAGLTDAQWDALMELKNVKRGRISELAGQFGLEFRKGQTPWSLPCDIALPCATQNELGAEDARTLLRNGCICVAEGANMPTTLEAVDIFLDAGILYAPGKASNAGGVAVSGLEMSQNAMRLLWTAGEVDSKLHNIMQSIHHACVHYGEEADGRINYVKGANIAGFVKVADAMLAQGVV

SEQ ID NO: 87420 - protein, 356 aa, Sulfurospirillum multivorans
MNAILSDQKTFQAIIRVNQAIEDIRQGKMVVMVDDEDRENEGDLVYAASFSTPQKVNFMASHAKGLICVAISKKIANRLQLEPMVKKNDSSYETAFTITVDARTAATGISAGERDMTIKILADGGSHESELVRPGHIFPLIAKEGGALVRIGHTEGSVDLCRLAGQGDSAVICEIMKEDGTMARRPDLDIFCAKHELNIVYISDIVEYRMMNESLIRVIAESTTQFLGKDARRYDFVDHNDNHHIAYAFGNIKNRSAVKFHSIMPDNELLADTKKYNSLIQAIHYLQKSGGVLIFMDNGTQDMSKIREYGIGAQIIKHLGIENIELLSDSKNKEFVGISGFGLSVIKSTNVNETVA

SEQ ID NO: 87421 - protein, 254 aa, Populus trichocarpa
MGRKFFVGGNWKCTGTTEEVKKIVSTLNDAQVPSSDVVEVVVSPPYVFLPLVKSSLRPDFHVAAQNCWVKKGGAFTGEVSAEMLVNLGIPWVILGHSERRSLLNESNEFVGDKVAYALSQGLKVIACVGETLEQREAGSTMEVVAAQTKAIAARVSNWADVVLAYEPVWAIGTGKVASPAQAQEVHFELRKWLHANTSPEVAATTRIIYGGSVNGANCKELAAKPDVDGFLVGGASLKPEFIDIIKSAEVKKSA

SEQ ID NO: 87422 - protein, 476 aa, Trichodesmium erythraeum IMS101
MTQEFDYDLIIIGAGVGGHGAALHATSCGLKTAIVEVAEMGGTCVNRGCIPSKALLAASGKVRELRNAHHLKTLGIELDNVSYDRQVMATHASNIVTKIRGDMSKSLKRLSVDIITGWAQVAGKQKVTVKTEKGEENFTAKDIILAPGSVPFVPPGIELDGKTVFTSDDALKLDWLPPWVAIIGSGYIGLEFSDIYTALGSEITMIEALDKLMPTFDPDIAKIAQRVLIQSRDIEVKVGKLAIKVVPGSPVIIELADAKTKEVEEIIEVDACLVATGRIPYTKDLGLDSVAVETDKYGFIPVNSKMAVLSSGEPVPNLWAIGDATGKMMLAHAASAQGITVVENICGRDREPDYLSIPAAAFTHPEISYVGMTEPAAKDLGQKQGFEVASVRTYFKGNSKAIAEDETDGIAKVIYRQDTGELLGVHIIGLHASDLIQEAANAIAKKQSVNELSFNVHTHPTLSEVLDEAFKRATVH

SEQ ID NO: 87423 - protein, 305 aa, Burkholderia xenovorans LB400
MLKVTKAVFPVAGLGTRFLPATKASPKEMLPIVDKPLIQYAVEEAIAAGITEMIFVTGRSKRAIEDHFDKSYEIEAELEARNKQKLLDLVRSIKPANVDCFYVRQAEALGLGHAVLCAEKLVGDSPFAVILADDLLHSSKPVMSQLVDTFNHYHSSVIGVETIAREDSRSYGVVDGREWEDNVIKLSGIVEKPAPDKAPSNLGVVGRYVLMPTIFKHIRALKPGAGGELQLTDAVQSLLTEEQVLAYRYFGTRFDCGSKLGYLKATVEFALRHPEVKAEFEAYLQAYMQTNMQEGVPAQYAAEAA

SEQ ID NO: 87424 - protein, 338 aa, Populus trichocarpa
MMPPVKTSYRDRTQEFLSVAERLKKSFSSASNAASSSTGSSTKPDAKRSAVAIQSEFSKRASMIGYGIHQTSQKLAKLAKLAKRTSVFDDPTLEIQELTAVIKQDITALNAAVVDLQLLCNSQNESGNISSDTTTHSTTVVDNLKNRLMTATKEFKEVLTTRTENLKVHENRRQLFSSTASKDSSNPFVRQRPLTSRTAASATQAPPPPWANASVSSSQLVPSKSTDVESQPLLQQQQQQMVPLQDSYMHSRAEALHNVESTIHELSNIFTQLATMVSQQGELAIRIDENMDESLSNVEGAQGQLVRYLNSISSNRWLMMKIFLVLIVFLMFFVFFVA

SEQ ID NO: 87425 - protein, 564 aa, Lachancea kluyveri
MSEITLGLYLFERLNQVDVKTIFGLPGDFNLSLLDKIYEVPGMRWAGNANELNAAYAADGYARVKGMSCVITTFGVGELSALNGIAGSYAEHVGVLHVVGVPSVSSQAKQLLLHHTFPNGDFTVFHRMSANISETTAWVTDIATAPAEIDRCIRTTYVTQRPVYLGLPATLVDLMVPASLLDTPIDMSLKPNDPEAEAEVVNSVLELIKEAKNPIILADACASRHDVKPETKQLIDITQFPAFVTPLGKGSIDEQHPRFGGVYVGTFANDDVKEAVESADLILSVGALLSDFNTGSFSYSYKTKNIVEFHSDYIKIRNATFPGVQMKFALQKLLSEIGAVVKDYKPVAVPPKPTPNPACDPSTPLKQEWVWNQVGRFLQEGDVVITETGTSAFGINQTHFPNNTYGISQVLWGSIGFTTGACLGARCAAEELDKNKRVILFIGDGSLQLTVQEISTMIRWGLRPYLFVLNNDGYTIERLIHGENAQYNEIQPWKNLDLLPTFGAKDYETHRVATTGEWDKLAQDEAFNKNSRIRMVEVMLPVMDAPSNLVKQAQLTASINAKQD

SEQ ID NO: 87426 - protein, 470 aa, Caulobacter crescentus CB15
MSSPQAVFERRDPVTGAVATTSIAMTADQARVAVDAAQAALPTWSALGPNARRALLSKAAAALEARADDFVAAMMGEIGATEGWARFNLMLAASMVREAAALTTQVSGEVIPSDKPGCLAMAVREPVGVILGIAPWNAPIILGVRAVATPLACGNTVVLKASESCPRTHELIAEAFAAAGLPEGALSIVTNAPADAAEVVGALIDHPAVRRINFTGSTAVGKIIAKRAAEHLKPVLLELGGKAPLIVLEDADLDEAVKAAAFGAFMNQGQICMSTERIIVVDAIADAFVAKFAAKASSLAVGDPREGKTPLGAVVDLKTVTHVQGLVADALADGAVQVSGGPANGVLMPATVVDKVTPAMRLFREESFGPVVAVIRARDEEHAIALANDTEYGLSASVFTRDIARGLKVARRIQSGICHVNGPTVHDEAQMPFGGVKASGYGRFGGKAGVDAFTELRWITVETQPGHFPI

SEQ ID NO: 87427 - protein, 291 aa, Burkholderia xenovorans LB400
MATISELFVYPIKSCAGIALREARLLATGLEYDRCWMVTDPAGAMLTQRAYPRMALIKVEIGADDLVIRAPGMSELRTPLNAARLDAAPAVQTKVWRDAAYGLDTGAASAAWFSAFLGVPARLLRFDPGHERIVDPDYTDSVGGATTYFTDGFPLLVIGQASLDDLNTRLNSKGAPAIPIDRFRPNVVLTGLDAYEEDYVETLSVNGDAGENVQLQLVKPCSRCPMPTIDQAKGAPDPDWPNEPTDTMSVYRANPQRNGAITFGNNALVASGAGQWLRVGQSVEAELGFGD

SEQ ID NO: 87428 - protein, 246 aa, Saccharomyces cerevisiae
PKLVLVRHGQSEWNEKNLFTGWVDVKLSAKGQQEAARAGELLKEKKVYPDVLYTSKLSRAIQTANIALEKADRLWIPVNRSWRLNERHYGDLQGKDKAETLKKFGEEKFNTYRRSFDVPPPPIDASSPFSQKGDERYKYVDPNVLPETESLALVIDRLLPYWQDVIAKDLLSGKTVMIAAHGNSLRGLVKHLEGISDADIAKLNIPTGIPLVFELDENLKPSKPSYYLDPEAAAAGAAAVANQGKK

SEQ ID NO: 87429 - protein, 532 aa, Oceanicola granulosus HTCC2516
MWDKLNAHHESVAARRFETLFDGGRAEDFSVRVGDMLFDYSKTNIDAEGRALLIELLERADVAGRREAMFSGAPINETEGRAVLHTALRNINGEPVTVDGQDVMPGVRETLERMEAFAADVREGRFTGQGGRITDVVNIGIGGSDLGPAMATLALAPYHDGPRCHFVSNVDPADIAGVLRGCDPATTLVIVASKTFTTIETMTNARTAKAWMSETVSEPAAQFAALSTAADKTADFGIAPERVFGFEDWVGGRYSMWGPIGLSLMIAIGPRAFRQFLAGGAEMDRHFRAADWSENMPALLALVGIWHNQVCGHATRAVLPYDNRLSRLPAYLQQLEMESNGKRVSMDGAELSVQSGPIVWGEPGTNGQHAFYQLIHQGTRVVPCEFLVAARGAEDDLHHQHQLLVANCLAQSEALMKGRTLDEARAKVADKFSGDELERQASHRVFPGNRPSTTLAYPELDPATLGRIIALYEHRVFVEGAVLGINSYDQWGVELGKELATGLQPVVEGRESTDGKDGSTAGLVNFLRQSGM

SEQ ID NO: 87430 - protein, 506 aa, Nectria haematococca mpVI
MLVDTGLGLISELRARLGWAALLQIVPVTVVAYNLLWFIYTSFFSSLRKIPGPFLARISRVWEIKKAATGNIHEIVMDLHRCHGPIVRIGPNRYDFDTMEALKIIYRIGNALPKADYYIPFGLPSSPNLFDVQNPARHSAMKKQVASLYTMTALLSYEAGVDGQTIILKEQLQRFCDQKQVIDLPQFLQYYAFDVIGVITVGKSMGMMETNSDTNGACGALDAMWHYSSMMAFIPHMHAWWLRLSSLLPIDVPIKGLTEYVEQRIIQYRLKAAEFGDDDALKGENNFLAKLILMERQGTVTSTETQQAVGLNIGAGSDTTANALSSILYFLYTNPRTLRRLREELDTHVKEDPIRFQQSQSMPYLQAVIKEALRLHPGVGTQLTRVVPKGGLVIEGQFFPEGAEVGVNGWALYHNKAIFGNDASVFRPERWLETKGNLNIGGSFAFGAGSRSCIGKNISILEMSKAIPQIVRNFDIEINHGDMTWKNECWWFVKPEYKAMIKPRAA

SEQ ID NO: 87431 - protein, 484 aa, Oceanicola granulosus HTCC2516
MVSRVIPVDNFDLVIFGGTGDLARRKILPGLFRRFRAGQMPEDARVIAAARSEHDDASYRSEIEAAIKEFGGAESKDRKGLKAFLERLHYVAVDARGDGGWQQLKDLMRDGVVRAFYFSVAPGLFGDLAERLHTHGIADRDSRLVVEKPFGRDLKSARALNATLADHFNEDQIYRIDHYLGKETVQNLMAVRFANVLFEPLWNSHYVDHIQITVAETVGVGGRGSYYDKSGAMRDMVQNHLMQLLCLIAMEPPNQFEADAVRDEKLKVIRALQPIDSHHIVRGQYEASEKTASYREDVENPKSTTESFIALRATIANWRWAGVPFYLRTGKRLKARSSEINVVFKDLGHSIFEGDEARHRNVLTIRLQPNEGIDLQVTIKEPGPGGMRLIDVPLDMTFAQALGDEADDVTDAYERLIMDVIRGNQTLFMRGDEVEAAWAWTDPLIEGWEARHDVPKVYDTGSSGPEDSLMLMHRDGRRWRDIKG

SEQ ID NO: 87432 - protein, 472 aa, Methanosarcina barkeri str. Fusaro
MKIVMKFGGTSVGDGKKIRHVAQLLKRYREEGNQIVVVTSALGGVTDELLENALFASTKGKVSLVKEFKTEITNKHHKAVKDAIDDPTVAKEVIQTLDLRIDELEKALVGICYLGELTSRSIDYICSYGERLAAPIVSGAIRSLGIESTEFTGGEAGIITSSDYGNARPLEKTYELVNKRLGCRLETQILVVTGFIGENEEGIITTLGRSGSDFTASILGAALKADEIWLWKEVNGIMTTDPRIVPEAKTIPQISYAEAMELSYFGANILHPRTIEPAMREHIPVRVKNTFEPKLPGTLVVAEKFQCKNVVKAVSLIKNVALINISGAEMVGAIGTVARLFAVLAKSGVNVIMISQGSSESNISFVISEAHVKTALKALHEEFNRGIVKEITSDKNVCVVAVVGAGMAGTPGVAKRVFGALGNSLINIIMISQGSSQYNISFVVRENDAFAAVKTLHDEFELYNGNGIEKQL

SEQ ID NO: 87433 - protein, 262 aa, Silicibacter sp. TM1040
MRVARLQNAMLHWREDGSPDGPAVVFANSLGTDLRLWDAVIARLPQNLRLIRYDKRGHGLSSCPEGPYSIDDLAEDALELLDYAGVSSCVFVGLSIGGMIGQTLAARAPDRISALVLSNTAAKMGERQMWLDRIQAIESGGIAALSDAVMARWFAPAFLETDAHILWRHMLERTPEAGYIASCHAIANADLHALTQTLHQPTLGIAGRYDGASPPALVEATIDLIENARFNVIEDSGHLPCVEAPDAYAGMLTDFIKELGHV

SEQ ID NO: 87434 - protein, 344 aa, Streptomyces avermitilis MA-4680
MRATLIYGAGDVRVEDVPDPKIQQPTDAVVRVLRSCICGSDLWPYKSRPATEQGERIGHEFLGVVEDVGSDVSGLKNGDLVVAPFVWSDNTCDFCAEGLHTSCRHGGWWAADGVDGGQGEAVRVPQAQGTLVKLPVAEDSALLPSLLTLSDVFCTGHHSAVTAGVDPRTTVTVVGDGAVGLSAVLAARRLGAERIILMGRHKDRTDLGRDFGATDVVPERGEEGIERVRELTGGDGTHTVLECVGTLPALQMSLGVVRAGGTVSRVGAPQYDDVPLGFQEFMNNITLTGGVAPARAYIDELLPDVLEGKVEPGRVFDRTVGLDDVPAGYRAMDDREALKVLIRP

SEQ ID NO: 87435 - protein, 87 aa, Zea mays
MVSLWTNEQILAPLPIGFAVFLVHLATIPITGTGINPARSLGAAVIYNQHHAWADHWIFWVGPFIGAALAAIYHQVIIRAIPFKSRS

SEQ ID NO: 87436 - protein, 299 aa, Burkholderia vietnamiensis G4
MSEPIDLSQIAPTLKAEILAEALPYIRRYHGKTVVIKYGGNAMTEERLKQGFARDVILLKLVGINPVIVHGGGPQIDHALKKIGKAGTFIQGMRVTDEETMEVVEWVLGGEVQQDIVMLINHFGGHAVGLTGKDGGLIHARKLLMPDRDNPGQYIDIGQVGEVEAINPAVVKALQDDAFIPVISPIGFGEDGLSYNINADLVAGKLATVLNAEKLLMMTNIPGVMDKDGNLLTDLSAREIDALFEDGTISGGMLPKISSALDAAKSGVKSVHIVDGRIEHSVLLEILTDQPFGTMIRSH

SEQ ID NO: 87437 - protein, 338 aa, Zea mays
  misc_feature (199)..(199): Xaa can be any naturally occurring amino acid
MAPIKIGINGFGRIGRLVARVALQSPDVELVAVNDPFITTDYMTYMFKYDTVHGQWKHHEVKVKDSKTLLFGEKEVAVFGCRNPEEIPWAAAGAEYVVESTGVFTDKDKAAAHIKGGAKKVIISAPSKDAPMFVCGVNEKEYKSDIDIVSNASCTTNCLAPLAKVINDRFGIVEGLMTTVHAMTATQKTVDGPSSKDWXRGGRAASFNIIPSSTGAAKAVGKVLPELNGKLTGMAFRVPTVDVSVVDLTVRLAKPATYDQIKAAIKEESEGNLKGILGYVDENLYFSDFQGDNRSSIFDAKAGIALNDNFVKLVSWYDNEWGYSTRVVDLIRHMHSTK

SEQ ID NO: 87438 - protein, 366 aa, Mangifera indica
QMGLAENPLCFDLVQEWVLSNPKASICTAEGISDFRDIAIFQDYHGLPEFKNAVANFMARVRGNRVKYDPDRIVMSGGATGAHETVAFCLADPGEAFLVPTPYYPGFDRDLRWRTGVQLFSVVCDNSYNFKNTKKKPWKQHMKKLKKTTSESRGLLLTNPSNPLGTRLDRETLRSLVSFINEKNIHLVCDEIYAATIFMGQPDFISISEIIEEDIHCNRNLIHLVYSLSKDMGLPGFRVGIIYSYNDTVVSCARKMSSFGLVSSQTQHLIASMLSDDEFVDRFITESAKRLAKRHRAFTWGLSQVGIGCLKSNAGLFFWMDLHHLLKEQTDEAEIELWKVIINEVKLNVSPGSSFHCANPGWFRVC

SEQ ID NO: 87439 - protein, 617 aa, Mucor circinelloides
  misc_feature (443)..(443): Xaa can be any naturally occurring amino acid
  misc_feature (522)..(522): Xaa can be any naturally occurring amino acid
MLSLKRIATTTKSNIFHRALLAQRSYSYINANEYSDPRHDKNVHVMHSRGVNLLHDPLLSKGTAFSIAERERLSIRGLVPPRCQEMDKQLLRIKRNLDACETPLAKFVFLAALHDRNETLYYKIIMEHLEELAGIIYTPTVGLASQMSHSIYRRSRGMYFSSQDRGQMSAMVYNWPHDKVDVIVVTDGSRVLGLGDLGANGMEIPIGKLSLYVAAGGIRPRAVLPVVLDVGTNNQDLLNDPLYLGMSHPRLEGEEYYSFIDEWVTAITSRWPDTLIQFEDFKYPHAYNLLAKYRNRITCFNDDIQSTSSITLAGILASLKSRGMSQEDLSNERIICVGAGSAGVGVCEGIIDCMVAQGRVKSREEAYSKIYMLDQYGLLGNPGVHLPSDEEHGHPYQPRTTKLDDRQYCYVKHDLRDQMGLEELVRKVKPTVLLGLTGIQGVXSEEAVREMAKHHERPVIFPLSNPDTHAECTAEEAFKWTDGRAIFASGSPFKDVELPNGKIGRTNQCNNSYSFPVSGLGXGITVSRASRVTPNMFLETARTIADMATPSQLKEGILFPGVSQLREVALNVGTRVCEVAFEEGYATAKLEEGEILSEVVRSSAYQPEYVPLVYRDH

SEQ ID NO: 87440 - protein, 586 aa, Zea mays
MGSYAYKYCMCFTRKFRSPDAQPPPDVRAAHLSFASDAHALRRFVAGVQGESPADVDRILAMLSGGHSHGIARLVTRSPAASTPTLEDFFAFLFSPDLNPPIAHQVHQDMSAPFSHYFVFTGHNSYLTGNQLNSDSSDVPIVKALQRGVRVIELDMWPNPSKDNVDILHGGTLTAPVEMIKCLKSIKEYAFCASNYPLVITLEDHLTSDLQAKVATMLTETFGDLLFVPNPDPMKEFPSPASLMKRIIISTKPPQEYKEFLKAENNRSGSGNIAELPDQGSLRRIDSNADESDGKDELDEQDEEDSDEDDPKFQQDTACEYRKLITIQAGKPKGHLRDALKVDPDKVRRLSLSETQLAKATISHGAEVIRFTQKNILRVYPKGTRVNSSNYDPMNAWTHGAQMVAFNMQGHDKALRLMQGFFRANGGCGYVKKPDFLLRTGPNGEVFDPKASLPVKKTLKVKVYMGDGWRMDFSKTHFDAFSPPDFYTRVGIAGVKADSVMKKTRVIEDQWVPMWDEEFTFLLTVPELALLRVEVQEYDMSEKHDFGGQTVLPVWELKQGIRAVPLHDRKGVRYKSVRLLMRFDFV

SEQ ID NO: 87441 - protein, 578 aa, Sinorhizobium meliloti 1021
MNDVASGGADISRIILEASGETLGAALLVFGRDDTITFASTSILQFFPVPAGMLVPGTRLRDFLGAVYDTGVRPGTLPESSRHRPNREDWIAEQMALHWRERYENVERAGRTRWLSLRQRRLSSGIGLLAVSDVSEQKKRDEQARTDLQRIALTEEILNAQPNPICVKDRNLHYIAVNKAFSAIHDLAPDAMLGRSASDLVETELAEHFERSDRHVLETGTPYSEAEHIVRADGSDLWVVTRKYRVGLPDRHFVVTCMNDVTDIAVWYGGSEKGGDTGLQIRDYSIFTPAQNFYDPFRSLDMQQLASAGSKIGMLPARGLRVLLATADREMEERFVARLRGSGLDACAVRNGEELDAFALAAEARGLEIDLLLLDAAFPEKHGVLASWRACTWVEVSSDTDATILLAEIFGVCARGARSPLLQSEWGIALDRDQVSATNAPAVEVLVAEDNQVNQFVFAQILEGLGISHRIAADGREAVDLWHELQPALVLMDVAMPVMNGFEAAIAIRQAEKRAGRRTPIVAVTAQALDIDLERCRTSGMDDHIMKPVSPDMIEMLLRKYLPAGETRVSGSGRSGSQ

SEQ ID NO: 87442 - protein, 712 aa, Alkalilimnicola ehrlichei MLHE-1
MNEHHSLFAACPRGLEPALVEELARLGVAQPRAQRAGVAWEGDLESALRACLWSRLASRILLGLSTVPVEDADGLYQAARDLPWEDHLLPGDTLAVDFHGSNAAIRHTRFGAQRVKDGVVDRMRAVGHPRPSVDTAAPDLRINAVLAGGRLRLGIDLSGESLHRRGYRQGGGRAPLKENLAAGLLWLAGWPRIAEDGGGLLDPMCGSGTLVLEGALMALDRAPGLGRERWGFSRWAGHVPVYWKRLRDEAEERAAAGGRRRLALVGYDQDPQAIRAALDNRERAGLRDRVHFERRSLEAAEPVGERPGLVVVNPPYGERLGQRQALVTLYASLGARLRGAFGGWQGAVFSGAPELLDYLGLSIARRHALYNGALETQLAVFALREQGADRRSQGATALDNRLQKNHRHLRRWLRREGVKAYRLYDGDLPEYALAVDVYETESGRHAHVQEYQAPRSVDPRSARRRLREALEVIAAHLEVGPERVHLKVRRRQKGADQYRPVDQTGERWVVQEGPARFYINLSDYLDTGLFLDHRITRLRLGEQARGRRFLNLFAYTGTATVHAALGGARETITVDLSATYLGWARDNLLLNGIEPGARHRLERADCLAWLAGQAESRPGRYDLIFMDPPTFSNSKRMCESFDVQRDHPRLIRQAMQLLAPDGLLVFSCNRRGFSLDEAVASDYACREITRETIPPDYARNPHVHYCWELRHR

SEQ ID NO: 87443 - protein, 318 aa, Geobacillus kaustophilus HTA426
MNILVTGAAGFIGSHLCEKLLENDEHHVIGVDGFLGPTPAPLKAKNIAHLQSHPRFTFLELDLLTADLPSLLQNVEAVYHLAGMPGVRTSWGTEFAAYAAHNISTTQRLLEACKDRPLKRFIYASTSSVYGERSGPLSETLEPAPLSPYGITKLTGEHLCRVYFREFAVPIVILRYFTVYGPRQRPDMSFHRFIRQLLAGQPLTVFGDGTQSRDFTYISDCVDGTIAALERDGVIGETINIGGKERASVNEVIRLLETLTGKQAIIQYTPSARGEPKQTWADLAKAERLLGYKPVVTLEGGLQKEIEYIRSLYEGEHS

SEQ ID NO: 87444 - protein, 427 aa, Geobacillus kaustophilus HTA426
MNICIIGAGYVGLTTAAVLAELGHEVHCIDHDERKIRLLNNGEVPFYEPGLEELIAKNDNYLTFSGRWDDIKRAAVVVICVGTPPRPDGGTDLRYIEAVLDRLATTIKSYKTIVTKSTVPPGTNEWMRAELIRKGVKPQLFRIVSNPEFLREGSAVYDMFHPDKIVVGLEPDDDQSLAVMQAVYAGINAPYLTTSLTGAELIKYAANAFLATKISFINEMARICDAFAVDVNDIARGIGLDPRIGPHFLRAGLGYGGSCFPKDIKALEHAARSRQVEPHLLKAVQTINATQLDVCFQKLNEQLAPLTDKKIAVLGISFKPNTDDTRFSPAEALIRRLSENGCTVAAYDPKATLSEPLTRVTQVQSVHEAIQGADGLVIATDWDEFRTLDWGQVKAAMNGTLVFDGRNCLDRHAVEQSGLRYMGVGRP

SEQ ID NO: 87445 - protein, 201 aa, Brassica napus
MELDLTPKLPKQVYGGDGGSYFAWCPEELPMLREGNIGAAKLALKQYGFAVPRYSDSPKVAYVLQGSGTAGIVLPEKEEKVIAIKKGDSIALPFGVVTWWFNSEEADLEILFLGETHKAHQAGQFTDFYLTGSNGIFTGFSTEFVGRAWDLDETTVKTLVGSQTGKGIVKLGEDFKMPEPKVEDRDGFVINCLEAPLDVDI

SEQ ID NO: 87446 - protein, 843 aa, Trichodesmium erythraeum IMS101
MRGVLMAGGSGTRLRPLTCDLPKPMVPILNRPIAEHIINLLKKHQIREIIATLHYLPDVMREYFQDGSKFGVQMTYSVEEEQPLGTAGCVKNIAELLDGTFLVISGDTITDFDLSAAIEFHQKHKSKATLVLTRVNNPIEFGVVITDEEQRIKRFLEKPSTSEVFSDTVNTGTYILEPEILDYLPSNQECDFSKELFPLLLDKNEPIYGYIAEGYWCDVGHLDSYRKAQYDALQHTVKLELPYKERSPNLWIGENTYIDPTAKIETPTLIGDNCRIGPRVHIELGSVIGDNVTIGADANVKRPIVWNGTLVGEDTNLRGCVICRGSRIHRRAQILEGAVVGSLSTVGEEAQISPHVRVWPSKTVESGAILNINLIWGTTAQRNLFGQRGVQGLANIDITPDFAVKLGAAYGSTLKNGSTVSVSRDQRNISRMVSRSLIAGLMSVGINVINLQSTAIPIARTILPTMNLVGGLHVRLSPDRSDQILIEIFDYQGINISKVKEKNIEGAYFKEDFRRVQISEIGNMIDRHEVLNAYSKGFENLLNSEAIRYSKSKVVIDYCYGVSGAVLPQLLTKFGCDAVVLNASLKETSLGIEERENLLDQLGRVVEALQANVGVQVTANGEQLILVDEVGSAIRGETLTALMVNLMLTAHPRGTVVVPINASAAVEQIAHRHDSHVIRTKANPTALMKACQINHNVVLGGSGDMGFIFPKLHPGFDAMFCIAKVIEMLTIQERSLGQITADIPPITHRCYTIRCPWKVKGALMRYLVETNPPEKLELTDGVKIINHQDNYWVLVLPDAGKPLVHIYADSNDRDWVDKTLRDYRNMIHDFVNLFMTRNQLDNL

SEQ ID NO: 87447 - protein, 553 aa, Triticum aestivum
MATRRALSSLLRSASRARAASPVAVPPRDPLHRPSPDGYLFNRAANYASAAAAAEAPAEKLPPTSDKYVGAKITDEFTGAGSIGQVCQVIGAVVDVRFDEGLPPILTALEVLDNSIRLVLEVAQHLGENVVRTIAMDGTEGLVRGQKVLNTGSPITVPVGRATLGRIINVIGEPIDHKGDIKTHDFLPIHREAPAFVEQATEQQILVTGIKVVDLLAPYQRGGKIGLFGGAGVGKTVLIMELINNVAKAHGGFSVFAGVGERTREGNDLYREMIESGVIKLDEKQAESKCALVYGQMNEPPGARARVGLTGLTVAEHFRDAEGQDVLLFIDNIFRFTQANSEVSALLGRIPSAVGYQPTLATDLGGLQERITTTKKGSITSVQAIYVPADDLTDPAPATTFAHLDATTVLSRQISELGIYPAVDPLDSTSRMLSPHVLGVDHYNTARGVQKVLQNYKNLQDIIAILGMDELSEDDKMTVARARKIQKFLSQPFHVAEVFTGAPGKYVDLKEGVQSFQGVLDGKYDDISEHAFYMVGGIDEVIAKAEKIASENA

SEQ ID NO: 87448 - protein, 341 aa, Populus trichocarpa
MANTTTPTMARSFLQVAATEEVAPPLRAVQIEGLAVLKIIKHCKEFSPSLVTGQLLGLDVGSVLEVTNCFPFPIREEDEEIEAEGANYQLEMMRCLREVNVDNNTVGWYQSMLFGCFQTVELIETFMNYQENIRRCVCIIYDPSRANQGVLALKALKLSDSFMDLYRNNNFTGEKLREKNLSWVDIFEEIPIKVSNSALISAFMTELEDDTPVTQCDYDRLQLSTSPYLERNVEFLIECMDDLSMEQQKFQYYYRNLSRQQAQQQAWLQKRRSENMSRKAAGEEPLPEEDPLNPIFKPIPEPSRLDSFLITNQIANYCNQINGVSGQSFSRLYLMKALHEN

SEQ ID NO: 87449 - protein, 370 aa, Oceanicola granulosus HTCC2516
MDVMEAAAAAEAAGRSIVHMEVGQPGTGAPAAALERLGREMSAGPLGYSVARGIPELRARIARHYGEAHDVDLDPNRVIVTAGASGAFLLAFSALFDTGARVGLGEPCYPSYRQILKALDMVPVGIPTGLETRMQPVAAHVAEYDLAGLLVASPANPTGTMLGRDDLASLSDACRAGGAALISDEIYHGLTYGTRAVSALEVTDEVYVINSFSKYFSMTGWRVGWMVVPENHVRVVERLAQNMFICPTHASQRLALAAFDCREALDANVAVYAENRRLMLERLPRAGFDRIAPPDGAFYIYADVSAHTDDSIAFAREILEEAGVAVTPGVDFDPQRGRQWLRFSYAQSTAAITEGLDRLERFLAVRSAAE

SEQ ID NO: 87450 - protein, 618 aa, Magnaporthe grisea 70-15
MDAAGPRKRRRSKGPDWDNFYKNGLPREVIVIDDDSEPEVLLQSTAPGSSRTIINGHATRANGNGHTHTNGAPANSRSQHTAKRRRRDGEPSAHYDPVHNRVVGSHTNTPTSTISSDRTTSAIATTAPTSLGSSSSNGHYEDANAGQKRKRTTRQQAGQAKRREAALYGDAAYTNYQPPAKPIKKAPEVSVRVVHDVSSPVINVMSRDKHGIIDLSKPQPNLKNLKVDDEDGHYIVVPDAELTEDYQMIKLLGQGTFGKVVQARDRRRNELVAIKIIRSVQKYRDASRIELRVLQTLKLNDQENRNRCIHLRDTFDFRGHICIVMDLLGQSVFDFLKSNQFTPFPNSQIQSFARQLFTSVAFLHDLNLIHTDLKPENILLADATYQTFTYNRKIPSSSTTVGRTATQRKVLLDTEIRLIDFGSATFQDEYHSSVVSTRHYRAPEIILGLGWSFPCDIWSIGCILVEFFTGDALFQTHDNLEHLAMMEAVVDRKIDTHLVQQVHRNTRSGPNPATKYFKRSRLDFPSVDTQRASKKYVKAMKKLPDIIPCQNTFMKQFLDLLTKIFVYDPARRITAKEALQHPWFREVAHPDDGSEAARIRAERMSKNELHTRQAERQD

SEQ ID NO: 87451 - protein, 717 aa, Picea abies
  misc_feature (144)..(144): Xaa can be any naturally occurring amino acid
  misc_feature (369)..(369): Xaa can be any naturally occurring amino acid
  misc_feature (415)..(415): Xaa can be any naturally occurring amino acid
MATTMAMASPAVIQSNANQLTSMPSALSSRSLRYQIKHTKLEFEKLGRRFGKVHAAALSDQGEYYSEKPPTPLLDTINYPIHMKNLSIRELKQLSNELRSDTIFEVARTGGHLGSSLGVVELTVALHYVFDAPEDKILWDVGHXAYPHKILTGRRDKMPTLRQTNGLSGFTKRSESEYDCFGAGHSSTSISAGLGMAVGRDLKGRNNHVISVIGDGAMTAGQAFEAMNNAGYLDSNMIVILNDNKQVSLPTANLDGPMPPVGALSSALSKLQSSKPLRELREVAKGVTKQLGAPMHELAAKVDEYARGMISGSRSTLFEELGLYYIGPVDGHNIDDLLTILQDVKATHTTGPVLIHVVTEKGRGYPYAXRAADKYHGVAKFDPATGKQFKGKAPTQTYTAYFAEALISEADIDNXVVAIHAAMGGGTGLNMFSKRFPSRCFDVGIAEQHAVTFAAGLACEGLKPFCAIYSSFLQRAYDQVIHDVDLQKLPVRFAMDRAGLVGADGPTHCGAFDVTYLACLPNMVVMAPSDEAELFHMVATAAAIDDRPSCFRFPRGNGVGARLPPGNKGVPLEVGKGRILLEGDRVALLGYGTVVQNCLAASALLEEQGLSLTVADARFCKPLDRDLIRSLAREHEVIITVEEGTIGGFGSHVAHFLALDGFLDGKLKWRPMVLPDHYIEHGAPNDQMVEAGLTASHIAASVLNILGRTREALQVMS

SEQ ID NO: 87452 - protein, 265 aa, Picea sitchensis
MALANSSSPLSLFSATPAIIRPKVRANINGRLIDAFSRYKPNGNGIEGCNAKHPIEGFAITSIVRLRAVIRSSVVRASSAATSLQQTENSAENLLGTLLSMVEGTDRGAKLSNEEHERVARIVSQLEHLCIPEPLKSPFILGEWNVEYCSNPRSPGGYYRSAIGRLLLRTKEMTQSIQAPDFVGNRVAFSAFNAIDGEVSLKGKFTPLDNKWIEITFDSPSLKFGPFDFQYGGESSVKIAIIYLDERIRLGRGSRGSIFIFKRCG

SEQ ID NO: 87453 - protein, 403 aa, Methanosarcina barkeri str. Fusaro
MTENFIGPENLQVTEPENLQAKYDSIIEKDSKYVMQTYGRQPLVLSEGKGAIVRDINGKEYIDCVAGIAVNNVGHCHPAVVRAIQAQAEKLLHVSNLYYTEIQAELAEALVSVTGMERVFFCNSGTEAVEAAMKLARMASGKSAFIAAEHSFHGRTIGALSVTHKSMYRDPFMPPVSSETTFVPYSDADAIRQAISENTAAVILEPIQGEGGVNIPNPEYLKEVREICDETGTFLIFDEVQTGFGRTGTWFCKDQFGVEPDIMSMAKAIGGGFPMGAIAARDGLSFGRGQHASTFGGGPLACAAALASIEAIREEELLKRSKENGAYFMGKLRNMEREDVVEVRGKGLMIGVEINHPCSDFVDFAREHGVLVNCTSESVLRLVPPLVITKEQIDKVVDVLEQA

SEQ ID NO: 87454 - protein, 1402 aa, Candida glabrata CBS 138
MTAGTAGLDTGRPLYYVGAQKDNTPRDESLVSYVFKGETDYIKLLASTDPLSRVIDNNKGGVVLLDQVTLLESLPHLYSIGKKDSTSNITEGSVITIIVDLNLEDYSIIPAVSDLHLPIHIGLESINLEQNGIHFINFNRINGTQTANNIFTSGAASPKNLIINLSQYYNELVKSVPEDVAIFNITEYKKNLLPEILANVPSSITRINLLQGSSTASENQEYEDGFEPFLLDFFADFEVLVQNNIQQLLLTKIGNKVDDFNSVSAKIISNLESAKPVKNLFVGEVVDISKDVTEDYSNSIKNILKLEDAYIKVLKQLLGNNLSIINEYSNSTINTLSPEFGYGRYLQEKEIQNKLVELARKSLDPQLFHSQESDEFVKKLSKWVSFKSSSLDQNLLEEANKIGSDIFEYLKTDAHSQTAIKLLEVAENDEKYFQFKSSWLIGSDAWSYDLGNSGVHQVLTSSDNINMLIIDSEPYEQRKASTQRKKDVGLYAMNFHNVYVASVAVYSSYTQLLTAFIEANKFNGPSIVLAYLPYKSEKDTPLDVLKETKSGVESGYWPLYRYDPSKEEADEQSAFQLDSSVIRKQLEAFLERENKLTLLTKRNPALARTLAQSASDVVTQKQNKRAEAALESLLNGLSGPPLHIYFASDGGNASNLAKRLHGRASARGLKSTVLSMDDLILDELPGEENVVFITSTGGQGEFPQDGKSFWDALKGSTDLDLSNLNVSVFGLGDSQYWPRKEDKKYYNKPAQDLYRRLEFLGAKILAPLGLGDDQGDDGYQTGYSEWEPKLWEALGVANVEVEDEPKPITNEDIKLNSDFLRGTIASDLKDESTGTVQYSNEQLMKFHGIYTQDDRDIREVRKSEGLEPYYYFMARARLPGGKCTPHQWLGLDKLSEDSGNGTLKLTTRATFQIHGVLKKNLKHTLRGMNAVLIDTLAAAGDVNRNVMVTALPAQAKIHKQISTMAAEISEHFLPKTTAYHEIWLDGPEEQDYEDDWNERFNNRKEGPRKKKTLVSGNALVDIEPIYGPTYMPRKFKFNLTVPPYNDVDVFSSDIGLIAIVDKEKNSIEGYNIYVGGGMGTTHGNKKTYPRVASSFGYVKNEDVLPALEALLIIQRDYGNREDRKQARVKYTVDRLGVQGYKEKAEEIWGKKFEPERSYEITSNIDYFGWVKDENGLNHFTAYIENGRVIDTPDLPQKTGLRVLAQYMEKNNTGHFRLTGNQHLVVSDITDEHLDAVKEILAKYTLDNADFSGLRLSSSACVGLPTCGLAFAESERYLPDVITQLEDTLEEYGLRHDSIIMRMTGCPNGCSRPWLAELALVGKAPHTYNLYLGGGYYGQRVNKLYRANLNDEEIVDVIKPLFKRYAAERNEGEYFGDFVIRAGIVKPTLEGRLFHEDISEDAF

SEQ ID NO: 87455 - protein, 416 aa, Triticum aestivum
MAALSVPLRTAAALSSSGAGSRAAADPSKVSCVRSTRSAHFDCSFPSIAASSSSARNIEPLRAIATQAPPAVPQYLSGEKTKVGINGFGRIGRLVLRIATSRDDIEVVAVNDPFIDAKYMAYMFKYDSTHGPFKGSINVVDDSTLEINGKKITITSKRDPAEIPWGNFGADYVVESSGVFTTIDKASVHLKGGAKKVVISAPSADAPMFVVGVNEMSYDPKMNVVSNASCTTNCLAPLAKVVHEEFGILEGLMTTVHATTATQKTVDGPSMKDWRGGRGAGQNIIPSSTGAAKAVGKVLPELNGKLTGMAFRVPTPNVSVVDLTCRLEKSASYDDVKAAIKAASEGALKGILGYTDEDVVSNDFVGDTRSSIFDANAGMGLSSSFMKLVSWYDNEWGYSNRVLDLIAHMALVTAKH

SEQ ID NO: 87456 - protein, 228 aa, Triticum aestivum
MHPTRWELSHMVDLQAAALVISVVAAEVPVIVASQLLESMIEYPIPTRAEVADVSEAVHQRADALMLSGESAMGRYPDKALIVLSSVSLRIERWWREEKHHEPLELEDVSSSFSDKISEEICISAAKMANKLEVDAVFVYTKGGHMASLLSRCRPDCPIFAFTNSTSVRRRLNLQWGLIPFRLTFSDDMESNLNRTFSLLKARGMIKSGDLVIALSDMLQSIQVMNVP

SEQ ID NO: 87457 - protein, 515 aa, Arabidopsis thaliana
  misc_feature (474)..(474): Xaa can be any naturally occurring amino acid
MKEPLQKKKVVVRHLPPSLSQSDLLSQIDPRFADRYNWVSFRPGKSSYKNQKYSRAYVSFKAPEDVYEFAAFFNGHVFVNEKGAQFKAIVEYAPSQRVPKPSDKKDPREGSISKDPDYLEFLKVIAQPVENLPSAEIQLERREAEQSGASKAAPIVTPLMEFIRQKRATVMGPQGLSDIRRGGRRTRVVSANKPSPRPSKRNSEKKKYVEKESSKNVPRKTTADVSSSKPDYRQSNSSGKELPGNETAAIIDSSPPGIALTMDSGKKKILLLRSKDRDNPDNPPPQPEQHIDTNLSRNSTDSRQNQKSDVGGRLIKGILLRNDSRPSQSSTFVQSEQRVEPSEAENYKRPSRPANTRAGKDYHTSGTISEKQERRTRNKDRPDRVMWAPRRDGSEDQPLSSAGNNGEVKDRMFSQRSGEVVNSSGGHTLENGSARHSSRRVGGRNRKEEVVIGEEANVDPKTIIRYLIYSLNIXAKYMSHSTGFCPSMGIYRSQSKWGSNIINITWVLETFGPTL

SEQ ID NO: 87458 - protein, 473 aa, Alkalilimnicola ehrlichei MLHE-1
MKQDLIIIGGGVGGLVTASVAGQLGVKTVLIDAGANLGGDCLHYGCVPSKTLIRSAEVAALTRRAGEFGLQAELGPVDLGAVMDRVRQVIDQIQVHDDPDRFRGYGVDVRFGHARFLDRDTVSVDGERLQARRFVIATGSAPAVPPVPGLAEAGFHTNETIFQLRTLPRRLAVMGGGPIGIELAQAFSRLGSQVTVVEMAAQILPRDDAEQAAELRSVLDAEGITVHTATTVERVEQSEGITRLACRNGESHWTVTADALLLAAGRKPNLDLGLEAAGVAYGPRGIRVDRRQRSSVRHIYAVGDCCGPYPFTHMAEYQAGIVIANALFRIPKKVDYRVVPWVTYTAPELATVGLTEDEARARNLKVEVLRFPFREVDRALAEGETAGQAKLIVRRGRLVGASVLGPHAGELIHEAVLAIQARLRVGTLAAAIHAYPTLAQVFRRAVNTRYTEQLYSDRTRKLVAFLQRWLPGR

SEQ ID NO: 87459 - protein, 175 aa, Streptomyces cinnamonensis
MSTKHTLSVLVENKPGVLARITALFSRRGFNIDSLAVGVTEHPDISRITIVVNVEDLPLEQVTKQLNKLVNVLKIVELEPGAAVARELVLAKVRADNETRSQIVEIVQLFRAKTVDVSPEAVTIEATGSSDKLEAMLKMLEPFGIKELVQSGTIAIGRGSRSITDRSLRALDRSA

SEQ ID NO: 87460 - protein, 398 aa, Bradyrhizobium sp. BTAi1
MTHIDTDAAWPDHKPTALLVLADGTVLEGFGLGAEGHAVGEVCFNTAMTGYEEILTDPSYAGQLITFTFPHIGNVGTNDEDIETVNMAATPGARGVILRTAISDPSNYRATRHLDQWLRARGIIGLSGIDTRALTALIRSKGMPNAVIAYSKDGQFDLDALKKEAREWPGLEGMDLVPMVTSAQRFTWDETPWVWNEGFGQQTKPEFNVVAIDYGIKRNILRLLAGVGCKVTVVPATTSAEDIMAMKPDGVFLSNGPGDPAATGKYAVPVIQQVIASGTPTFGICLGHQMLGLAVGAKTKKMHQGHHGANHPVKDETTGKVEITSMNHGFAVDQDTLPAGATQTHISLFDGSNCGIALEGKPVFSVQYHPEASPGPRDSHYLFQRFAELMRENKRSAA

SEQ ID NO: 87461 - protein, 404 aa, Lactococcus lactis subsp. lactis Il1403
MRKFEKSHKLDNVSYDIRGPVLDEAQRMRANGEKILRLNTGNPAEFGFLAPDEVISDLIQHAVDSEGYSDSKGIFSARKAIMQYCQLKGFPNLDINDIFTGNGVSELIVMAMQGLLDTGDEVLIPMPDYPLWTASVSLAGGTAVHYLCDEQAGWFPDIDDIRSKITSNTKAIVLINPNNPTGALYSKDLLLEIVQVARENNLIIFSDEIYDRLVMDGAVHVPIASLAPDLFVVTMNGLSKSHRIAGFRVGWMVLSGEKSHVKGYIEGLNMLASMRLCSNVLAQSVVQTSLGGTQSVDKLLLPGGRVYEQREFIYKAINDIPGLSAVKPQAAFYIFPKIDREMYKIDNDEQFVLDFLKQEKILLVHGRGFNWKEPDHFRIVYLPRVDELAEIQEKMERFLWQYRK

SEQ ID NO: 87462 - protein, 325 aa, Desulfovibrio vulgaris subsp. vulgaris str. Hildenborough
MSKAIVLHAHGGVDNLHWEERDPGRPGAGEALIRHEAVGVNFIDIYHRTGLYPLPALPAVLGMEGAGIVLAVGEGVTEVQPGQRVAYAGRPIGAYAEERCIPARRLVPLPDAIPTRMAAAMMLRGMTARYLLHGCYPVRQGTTLLVHAAAGGVGSMLVPWACHLGATVIGTAGSPEKREKALAAGCHHVIDYRTGGVAARIRELTDGRGVDVVYDSVGQATFMDSLDCLRPMGTMVSFGQSSGAVPPFDPGVLAARGSLFLTRPSLMHYTERREDLLAHAADLFDVVARGVVSVHIDQSWPLAQVAEAHTALESRRTTGTMVLDV

SEQ ID NO: 87463 - protein, 1129 aa, Arabidopsis thaliana
MDAIVVDSQNCFIIILLCSFSLISYFVFFKKPKVNFDLLPSPPSLPIIGHLHLLLSTLIHKSLQKLSSKYGPLLHLRIFNIPFILVSSDSLAYEIFRDHDVNVSSRGVGAIDESLAYGSSGFIQAPYGDYWKFMKKLIATKLLGPQPLVRSQDFRSEELERFYKRLFDKAMKKESVMIHKEASRFVNNSLYKMCTGRSFSVENNEVERIMELTADLGALSQKFFVSKMFRKLLEKLGISLFKTEIMVVSRRFSELVERILIEYEEKMDGHQGTQFMDALLAAYRDENTEYKITRSHIKSLLTEFFIGAADASSIAIQWAMADIINNREILEKLREEIDSVVGKTRLVQETDLPNLPYLQAVVKEGLRLHPPTPLVVREFQEGCEIGGFFVPKNTTLIVNSYAMMRDPDSWQDPDEFKPERFLASLSREEDKKEKILNFLPFGSGRRMCPGSNLGYIFVGTAIGMMVQCFDWEINGDKINMEEATGGVHDLPSVDMFVPTADPVREPPIIVVNTVLSLLAVNYPANKLACYVSDDGCSPLTYFSLKEASKFVKIWAPFCKKYNVRVRAPFRYFLNPLVATDDSVFSKDWKMMKREYVKLCRKVEDATGDSHWLDADDDFEAFSNTKPNDHSTIVKVVWENKGGVGDEKEVPHLVYISREKRPNYLHHYKTGAMNFLLRVSGLMTNAPYMLNVDCDMYANEPDVVRQAMCVFLQNSKNSNHCAFVQFPQNFYDSYTNELVVLQHYMKRGVAGIQGPIYIGSGCFHTRRVMYGLSSDDLEDDGSLSSVASREFLSEDSLVRKYGSSKELVKSVVDALQRKSNPQKSLANLVEAAQEVGHCHYEYQTSWGNLGWLYDSVAEDTNTSIGIHLRGWTSSFISPDPPAFLGSTPSVGPEAIVQHRRWATGSIEVLFNKQSPLIGFRRKIKFRQRLAYFWVLMCIRSIPELVYCLLPAYCLLNNSALFPKGPCLGIIVTLVGMHCLYTLWQFMILGFSVKSWYVSQSLWRIIATSSWLFSIQDIILKLLGISKIGFIVAKKNMPETRSGYESKSKPSQGEDDGLKLELGKFEFDSSCHFIPGTFIMLVNLAALAGFLVRLQRSSYSHGGGGGSALAETCGCISVDRDMHITQGLGGF

SEQ ID NO: 87464 - protein, 436 aa, Oryza sativa
  misc_feature (18)..(18): Xaa can be any naturally occurring amino acid
  misc_feature (167)..(167): Xaa can be any naturally occurring amino acid
MEISIWRALCILVWGKAXRICIFNYEWARQILSSKSGHFLKNDTTPTVLALLGKGLVLVEGIDWERHRRVINPAFTMDKIKMMTKTMVACAQNMVKELEDQASSNKNGETQVELDKQFQELTADIISHTAFGSSYKLGIEAFHAQKELQEIAVKSLLNVQIPGFSSXYLPTKGNWRKLTLEKKLRGTLMQIIQSRLSSKGSGYGSDLLGLMLEACIATDQGREQHQLSLSIDEIIHECKTFFFAGHETTSLLLTWTVFLLSVYPEWQARLRLEALRECGKENPNGDNLSKLKEMSMVFLETLRLYGPALFLQRKPLTDITVGETKIPKDHAIIIPSAIMHRDKEIWGDDTDEFNPLRFQNGVTRAAKVPHALLAFSIGPRSCIGQNFAMLEAKSVMAMILKKFSFTLSPNYVHAPVDLLTLQPKFGLPVVLRLLDA

SEQ ID NO: 87465 - protein, 450 aa, Shigella flexneri 2a str. 301
MTKHYDYIAIGGGSGGIASINRAAMYGQKCALIEAKELGGTCVNVGCVPKKVMWHAAQIREAIHMYGPDYGFDTTINKFNWETLIASRTAYIDRIHTSYENVLGKNNVDVIKGFARFVDAKTLEVNGETITADHILIATGGRPSHPDIPGVEYGIDSDGFFALPALPERVAVVGAGYIAVELAGVINGLGAKTHLFVRKHAPLRSFDPMISETLVEVMNAEGPQLHTNAIPKAVVKNADGSLTLELEDGRSETVDCLIWAIGREPANDNINLEAAGVKTNEKGYIVVDKYQNTNIEGIYAVGDNTGAVELTPVAVAAGRRLSERLFNNKPDEHLDYSNIPTVVFSHPPIGTVGLTEPQAREQYGDDQVKVYKSSFTAMYTAVTTHRQPCRMKLVCVGPEEKIVGIHGIGFGMDEMLQGFAVALKMGATKKDFDNTVAIHPTAAEEFVTMR

SEQ ID NO: 87466 - protein, 489 aa, Thermobifida fusca YX
MTTIEREARIVEQVPKQVCIGGHWRDAQSGATFKVEDPATGSVLCEVADAGVADGMAALEMAAATQPTWAEYPPRERGEILRRAYELLMHRQEDLAVLMTLEMGKPVAESKGEIAYAAEFFRWFSEEAVRIDGSYSVAPNGQSRLLVMRQPVGPSLLITPWNFPMAMGTRKIGPAIAAGCTMILKPAQQTPLSALALADILHEAGLPEGVLSVLPTTDAAGLTGPLLRDGRLRKLSFTGSTPVGRALIKQSADQVLRTSMELGGNAPFLVFDDADLDAAVAGALQAKMRNIGEACTAANRFYVQSGVAEEFSRRLAERMAGLRMGRGTEPDVDVGPLIDDKARTKVQSLVDDAANRGARVLLGGKRGDGAGYFYHPTVLTDVPKDSEVCRTEIFGPVAPVIPFDTEEEALAEANRTEFGLVSYVYTENLRRALRMAEKLESGMVGLNQGIVSNPAAPFGGVKHSGLGREGGRVGIDEYLETKYVGIAGV

SEQ ID NO: 87467 - protein, 336 aa, Oryza sativa Japonica Group
MMDKYARLMQKLEIVNVELFKGICQLFGIFYHYIYETFGNQDRGQSGKSLPDHQSFRLRVALSKITQDSDQWIKPQSISYSPSSPVSMDVMPTAPPSSMFTLYGLKERCAAAETISLVARVLNRSRAHLHSVLSQSNTSILEEFFGTMVDSVPDLAEHIHRTSARMLLHINGYPDKIANAKWEVKELGMEHNGYVDLLLGEFKHYKTRLDHGGISKELQDLLLEYGIDSIAEVLVEGLSRVKRCTDEGRALMSLDLQVLINGLLHIVSANVRPKLQIVDTFIKAYYLPETEYVHWARSHPEYSKSQVVGLVNLVATMKGWKRKTRLETIERIEAGP

SEQ ID NO: 87468 - protein, 464 aa, Pseudomonas fluorescens PfO-1
MAVYNYDVVVLGSGPAGEGAAMNAAKAGRKVAMVDSRRQVGGNCTHLGTIPSKALRHSVRQIMQFNTNPMFRAIGEPRWFSFPDVLKSAEKVISKQVASRTGYYARNRVDVFFGTGSFADEQTIEVVCANGVVEKLVAKHIIIATGSRPYRPADIDFHHPRIYDSDTILSLGHTPRKLIVYGAGVIGCEYASIFSGLGVLVELVDNRGQLLSFLDSEISQALSYHFSNNNITVRHNEEYDRVEGVDNGVILHLKSGKKIKADALLWCNGRTGNTDQLGLENIGVKVNSRGQIEVDENYRTCVQNIYGAGDVIGWPSLASAAHDQGRSAAGSIVDNGSWRFVNDVPTGIYTIPEISSIGKNEQELTQAKVPYEVGKAFFKSMARAQIAGEPQGMLKILFHRETLEVLGVHCFGYQASEIVHIGQAIMNQPGELNTLKYFVNTTFNYPTMAEAYRVAAYDGLNRLF

SEQ ID NO: 87469 - protein, 471 aa, Oenococcus oeni PSU-1
MNLSHASDSKISADIPLVNKKEKPLIKNTDKEEKHHLPKLRLSTIFAMTFGFFGINMAFSLQSSQLGRIFQTIGANPNNLGFFFILPPLAGMVIQPLIGKYSDRTWNRFGRRMPYLLIGAPAAAIVLILLPNAGSFGFGYASVAALCFGAVATLFMDLTSNICMQPFKMIIGDMVNEDQKDLAWSWQQSFSNLGGVLAAVIPFVLTLVGISNTAPKGEVPLTVKIAFYSAAIILLVTSLLTIIKVHEYDPKTYAQYHEIDLQAQKKSPSLVKLLKDAPRAFWETSVVEFFSWFAILYLWTYATGAISLNVWHTSNASSAGYQAAGNWYGVLTCIMSIAAVIWGIVVQARTKPTSRKFWYSFGLLAGAVGYFMIYFIHNKWLMIIPFCLIGISYLVINTQPFSLLTEALNGQHEGSYLGLFNCSICLPQICASVASFWLFPLMGQSMPAMFLVGGTSLVLGAISVRFVHSRF

SEQ ID NO: 87470 - protein, 144 aa, Oryza sativa
MSRSLGIPVKLLHEAAGHVVTVELKTGEVYRGAMVECEDNWNCQLDNITFTAKDGKVLQLEHVFIRGSRVRFMIIPDMLKNAPMFKRLEARIRGKGSALGVGRGRAVAMRAPSAAGRCVGPVARGFAPPFMKFNACTYYLVLSR

SEQ ID NO: 87471 - protein, 340 aa, Triticum aestivum
AYLGDTIEQVCTKKQAGTGPEFPGYRRPTRPAMLPTITSKDWLDIDFGIAEGVDFIAVSFVKSAEVINHLKSYIAARSRGSDIAVIAKIESIDSLTNLEEIIRASDGAMVARGDLGAQIPLEQVPSIQQKIVKLCRQLNKPVVVASQLLESMIEYPIPTRAEVADVSEAVHQRADALMLSGESAMGRYPDKALSVLSSVSLRIERWWREEKHHEPLELEDVSSSFADKISEEICISAAKMANKLEVDAVFVYTKGGHMASLLSRCRPDCPIFAFTNSTSVRRPLNLQWGLIPFRLTFSDDMESNLNRTFSLLKARGMIKSGDLVIALSDMLQSIQVMNVP

SEQ ID NO: 87472 - protein, 625 aa, Silicibacter sp. TM1040
MDSFLSQASIYLAAAVIAVPIAARLGLGSVLGYLAAGIIIGPILGLVGAEAEELQHFAEFGVVMMLFLIGLELDPRALWAMRHHLIGLGGLQITASTALLAGAAIFFGHSWQVGLAVGLALSLSSTAIVLQTLSEKGLTRTGGGRATFSVLLTQDIAVIPILALLPLLATQHALSLSEDGSIVRAEEAHGAGHHSLSLVEGLPGWAVTLTTIGAIAFVILAGVYLTRPVFRFIHASNLREMYTALALLIVVGISFLMTLVGLSPALGAFLAGVVLANSEFRHELESDLEPFKGLLLGLFFITVGAGINYRLFLAEPGDVIGLALLVIFAKGAVLYFVGRAFGLRGRNHWLFTLGLAQAGEFGFVLLAFSLQLNVVTADLSEKLLLVIALTMLITPLLFILYEILSKRMKDAQVEHTPDEIDEEGTVIIAGIGRFGQIVHRLVNASGFKTVLLDSDMKAVQLMRRFGVKSFLGDPTRPELLKAAGISKAKVLVVALDDQESATKLVTYARRNYPDIHIVARAYDRNHVFELYKAGANDIVREMFDSSLRAGRYVLENIGLSEYEAAQAEQTFYAHDRHTIRELAGHWIPGTPASENPAYIKRARELEKDLETALLSLAEDHIKHRA

SEQ ID NO: 87473 - protein, 391 aa, Phytophthora capsici
VTEIGEYRAAVPSGASTGEFEALEMRDGGKDYMGKGVLNAVKNVNEIIAPALVGKDVTKQAELDRYMVEQLDGTQNEWGWCKKKLGANAILGVSLALCRGGAAAKKQPLWQYIADLAGNPSPCLPVPSFNIINGGSHAGNKLAMQEFMILPVGATSFTESMKIGSEVYHNLKKVIKGRYGLDATAVGDEGGFAPNIQSNGEAIDLIEEAIKAAGYTNQVRLGMDVAASEFFTGASDARYNLDFKNENAPESEKISADKLQEVYEGFIAKCAGSSKIVSIEDPFDQDDWESWVKFTAKVGEDVQIVGDDLTVTNPTRVQKAIERKACNALLLKVNQIGSITESIEAVTMAKKAGWAIMASHRSGETEDTFIASLAVGLSAGQIKTGAPCRSE

SEQ ID NO: 87474 - protein, 451 aa, Mycoplasma mycoides subsp. mycoides SC str. PG1
MSRIERIFAREILDSRGTPTVEVEVWTEFGGYGCAKAPSGASTGVNEALELRDGDKARYNGKGVLKAVKNVNEIIAPKLIGVDALDQLTVDRIMLDLDGTEFKTKLGANGILAVSLAVAKSAASELDIPLYKYLGGVQAKKLPVPMLNVINGGEHADSAIDFQEFMIMPVGAKSFSEALRWSSETFQALKSLLKSKKDITAVGDEGGFAPNFEWAYEKHDLKSFKAKTPAEIALDLLVEAIKKAGYKPGKDGIMIAMDCASSELYLEDKKYHFKKIEKVTNQEWSLTTDEMISYLEKLVDNYPIISIEDGLAETDWEGFTKLTQKIGDKVQIVGDDLFTTNPKFIKQGINKKAANSTLIKLNQIGTLSETVEAITMTQKAGWTAVVSHRSGETEDTTIADLAVAFNTGQIKTGSMSRSDRIAKYNRLLQIESELDKNAVYDGLEAFYNLKK

SEQ ID NO: 87475 - protein, 388 aa, Phytophthora pseudotsugae
  misc_feature (220)..(220): Xaa can be any naturally occurring amino acid
EYRAAVPSGASTGEFEALEMRDGGKDYMGKGVLNAVRNVNEIIAPALIGKDVTKQAEIDRFMVEELDGTQNEWGWCKKKLGANAILGVSLALCRAGAAAKKQPLWQHIADLAGNPTPCLPVPSFNIINGGSHAGNKLAMQEFMILPVGATSFTEAMKIGSEVYHNLKKVIKGRYGLDATAVGDEGGFAPNIQSNGEAIDLIEEAIKAAGYTDKVRLGMDXAASEFYTGAEDARYNLDFKNENAADSEKISADKLQEVYEGFIAKCAGSSKIVSIEDPFDQDDWESWVKITGKVGKDVQIVGDDLTVTNPTRVKKAIEQKACNALLLKVNQIGSITESIEAVTMAKKAGWGIMASHRSGETEDTFIADLAVGLSAGQIKTGAPCRSERR

SEQ ID NO: 87476 - protein, 392 aa, Phytophthora erythroseptica
LVTEIGEYRAAVPSGASTGEFEALEMRDGGKDYMGKGVLNAVKNVNEIIAPALVGKDVTKQVELDRYMVETLDGTQNEWGWCKKKLGANAILGVSLALCRAGAAAKKQPLWQYIADLAGNPSPCLPVPSFNIINGGSHAGNKLAMQEFMILPVGATSFTEAMKIGSEVYHNLKKVIKGRYGLDATAVGDEGGFAPNIQANAEAIDLIEEAIKAAGYTNQVRLGMDVAASEFYTGAKDARYNLDFKNANAPESEKIPADKLQEMYESFISKCADSSKIVSIEDPFDQDDWESWVKFTGKVGKDVQIVGDDLTVTNPTRVKKAIELKACNALLLKVNQIGSITESIEAVTMAKKAGWAIMASHRSGETEDTFIASLAVGLSAGQIKTGAPCRSE

SEQ ID NO: 87477 - protein, 391 aa, Phytophthora cryptogea
  misc_feature (265)..(265): Xaa can be any naturally occurring amino acid
VTEIGEYRAAVPSGASTGEFEALEMRDGGKDYMGKGVLNAVKNVNEIIAPALVGKDVTKQVELDRYMVETLDGTQNEWGWCKKKLGANAILGVSLALCRAGAAAKKQPLWQYIADLAGNPSPCLPVPSFNIINGGSHAGNKLAMQEFMILPVGATSFTEAMKIGSEVYHNLKKVIKGRYGLDATAVGDEGGFAPNIQANAEAIDLIEEAIKAAGYTNQVRLGMDVAASEFYTGAKDARYNLDFKNANAPESEKIPADKLQEMYEXFISKCADSSKIVSIEDPFDQDDWESWVKFTGKVGKDVQIVGDDLTVTNPTRVKKAIELKACNALLLKVNQIGSITESIEAVTMAKKAGWAIMASHRSGETEDTFIADLAVGLSAGQIKTGAPCRSE

SEQ ID NO: 87478 - protein, 359 aa, Vitis vinifera
MIFLGLSNFLSLSTIDLYLFQFLFALGKAIPGDNGSPETKENSLVVCFGEMLIDFVPTSNGLSLAEAPAFKKAPGGAPANVAVGIARLGGSSAFIGKVGEDEFGYMLADILKENNVNNEGMRFDPGARTALAFVTLRKDGEREFMFYRNPSADMLLQEDELDFDLIRKAKIFHYGSISLITEPCKSAHLAAAKAAKDAGVIVSYDPNLRLPLWPSADSAREGILSIWNTADIIKMSEEEISFLTKGEDPYDDAVVRKFYHPNLKLLLVTEGPDGCRYYTKARLQWEMDAVDTTGAGDAFVAGILSQLAADLSLLQEEDRLRDALKFANACGALTVMERGAIPALPSREAVLNAMLKLVT

SEQ ID NO: 87479 - protein, 135 aa, Vitis vinifera
  misc_feature (15)..(15): Xaa can be any naturally occurring amino acid
  misc_feature (114)..(114): Xaa can be any naturally occurring amino acid
METAICGRVPLSPNXFFTSKSAPGKGSGVLERPTIERIMPGRESEFDLRKSRKMSPPYRVLLHNDNYNKREYVVQVLMKVIPGMTLDNAVNIMQEAHHNGMSVVIICAQVDAEXHCMQLRGNGLLSSIEPASGGC

SEQ ID NO: 87480 - protein, 478 aa, Mycoplasma mycoides subsp. mycoides SC str. PG1
MTKEKLQKRMKRTKVITTIGPSTHSAEAIKELFNNGMTTIRLNFSHGSYEEHGYRIKAAKKISKALNKPISIMLDTKGPEIRLGKFKDNKQEVVKGQAITIYTDNYSYLNKECVQGEMTVAYDMSVDLKPEDMILIDDGKLELTVDSVEPQIIKATAFNHHIVKTNKRVNLPGIDFSLPFLSEKDEKDILFGCEQDVDYIAASFVNTAENVRQIKEILTKANANHIQIISKIESQVGLDNIDEIIEESDGIMIARGDLGLEIPYYDVPYWEKIIIRKCREKGKIVIVATQMLETMTENPSPTRAEVTDVYYATELGADATMLSGESAAGDYPFLTVHTMSTINKRAEVEFYNKIYYQVQLDNARNSTSGPRAEIADLLATKTKDGEYKYAIVLSKTGELLKTISKFRPNVTILGVSPDKKLWTSFGVWHSIFMNKVDTLDNLDNNVEKLSEIAKSWGAKFGEKVLVVRSTAIKEIEVI

SEQ ID NO: 87481 - protein, 238 aa, Burkholderia vietnamiensis G4
MAIYRRGSAEVSNKADSSPVTEADLASHRVLAKHLAHLLPSCQVVSEEDPASLVYRQSAGRFWLIDPLDGTKEFIARNGEFTVNIALIDEGRSTLGVVYAPAVDALYWGGSGLGAFRCICDQTVTINVEPAAEGHACRVVASKSHLNEATQAMIDRLGDVSLVQAGSSLKFCRVAEGEADIYPRLAPTCEWDTAAAQAVLEGAGGAVVDLHGQPLLYGKPDVINPSFIATRDTALIPA

SEQ ID NO: 87482 - protein, 507 aa, Physcomitrella patens subsp. patens
MGLHAGVDVPRRGLFIDGEWVDPVLGKRIPIVNPTTEETVGDIPAATSEDVDAAVKAAKEAFYRNKGKDWAKAGGKHRATFLRAIAKRVAERKSELAKLESIDCGKPIDEAEWDMDDVSGCFEYYADLAEKLDERQYAPLELPMEQFKCNILREAIGVVGLITPWNYPMLMATWKVAAALAAGCTAILKPSELASVTCLELAGIAKDVGLPRGVLNVVTGYGHEAGAPLASHSGVDKIAFTGSTATGRSVMSAASQLIKPVTLELGGKSPIIVFDDADVEKAVEWAMFGAFWTNGQICSATSRLLLQEGIADEFLKKLGIWASSIKVSDPLEKDCRLGPLVSEGQYEKVQKFVKVALDEGATLVCGGKRPDHLTTGYFLAPTVLSNVKPHMQIWTDEVFGPVLAVSTFKTEEEALALANDTQYGLAGAVISKDDDRCKRVSEALEVGIVWINCSQPCFCQAPWGGNKRSGFGRELGEWGLENYLSVKQLTRYISTDDWGWYPKPSKL

SEQ ID NO: 87483 - protein, 323 aa, Nicotiana benthamiana
GEDDDTGYDECIVPCDMNLITDDDFRELVDKVPEGCRITIVSDSCHSGGLIDKAKEQIGESHKQGDDENEGHGSGFGFKKFLRRSVEDAFESRGIHIPRRHDRREEEKESFAESSVIETEDGDQVHVKNKSLPLSTLIEILKQKTGKDDIDVGKLRPTLFDVFGEDASPKGKKFMKVIFNKLQHGKGEGESGGFLGMVGNLAQEFLKQKLDENDESYAKPAMETHVEGKQEVYAGSGSRGLPDSGILVSGCQTDQTSADATPAGGDSYGALSNAIQEILAESDGPITNEEVVTKARKKLQKQGYTQRPGLYCSDHHVDAPFVC

SEQ ID NO: 87484 - protein, 557 aa, Arabidopsis thaliana
MSTLPLFSLHHHTTQNLQTNNQNTVRYFSLKPKMETASSNFSLSQILNIEEPYSSVMLGVAALLAVVCYFWIQGKSKSKNGPPLPPGPWPLPIVGNLPFLNSDVLHTQFQALTLKHGPLMKIHLGSKLAIVVSSPDMAREVLKTHDITFANHDLPEVGKINTYGGEDILWSPYGTHWRRLRKLCVMKMFTTPTLEASYSTRREETRQTIVHMSEMAREGSPVNLGEQIFLSIFNVVTRMMWGATVEGDERTSLGNELKTLISDISDIEGIQNYSDFFPLFSRFDFQGLVKQMKGHVKKLDLLFDRVMESHVKMVGKKSEEEEDFLQYLLRVKDDDEKAPLSMTHVKSLLMDMVLGGVDTSVNASEFAMAEIVSRPEVLNKIRLELDQVVGKDNIVEESHLPKLPYLQAVMKETLRLHPTLPLLVPHRNSETSVVAGYTVPKDSKIFINVWAIHRDPKNWDEPNEFKPERFLENSLDFNGGDFKYLPFGSGRRICAAINMAERLVLFNIASLLHSFDWKAPQGQKFEVEEKFGLVLKLKSPLVAIPVPRLSDPKLYTA

SEQ ID NO: 87485 - protein, 256 aa, Mycobacterium sp. JLS
MSDRFSMEGRVAVITGGGTGIGRASALVLAEHGADVVLAGRREEPLKATAADVEALGRRAIAVPTDVTKADQCQALVDATLGEFGRLDVLLNNAGGGETKSLMKWTDEEWHEVLELNLSSAWYLSRAAAKPMIAQGKGAIVNISSGASLLAMPQAPVYAAAKAGLNNLTGSMAAAWTRKGVRVNCIACGAIRTPGLEADAKRQGFDIDMIGQTNGSGRIAEADEIGYGVLFFASDASSYCSGQTLYMHGGPGPAGV

SEQ ID NO: 87486 - protein, 259 aa, Streptococcus pyogenes M49 591
MTHTKEVAFITGAASGIGKQIGETLLKEGKTVVFSDINQEKLDQVVADYTKEGYDAFSVVCDVTKEEAVNAAIDTVVEKYGRIDILVNNAGLQHVAMIEDFPTEKFEFMIKIMLTAPFIAIKRAFPTMKAQKHGRIINMASINGVIGFAGKSAYNSAKHGLIGLTKVTALEAADSGITVNAICPGYVDTPLVRGQFEDLSKTRGIPLENVLEEVLYSLVPQKRLIDVQEIADYVSFLASDKAKGVTGQACILDGGYTAQ

SEQ ID NO: 87487 - protein, 405 aa, Triticum aestivum
  misc_feature (249)..(249): Xaa can be any naturally occurring amino acid
MLTSLYKKAGWYRSGIPGISSTHASEFLSGLQQATPRKLCPSACLLGSSRPILPDPKQASASACPARALPQIGESREPQVAFSSSVVVVVAGDGEMAGGGNRKGSGAEELRIGSGNVFAALETLKKKKKKPAAAEKKQAPLVEKPEVFWAPAPLTAKSWADVEDDDDDDYFATTAPLCPVRESQGGDADAGHEDDIEQEIESEDDSLDDEVDAAAEDEHEAGDAVLSEPAVQKAVAPLVPPKDTERQLXSKKELKKKELEELDAVLAELGISHESSNATQDETNDKNGTCQAADGGKKEDASAPLESKTSKKKKAKKDKSSKEAEETLDQNNVVDGAASVEPDEDVASVDVKERIKKVASMKKKKSSKEMDAAAKIAASEAAARRAKLEAAKKKDKNHYNQQPLR

SEQ ID NO: 87488 - protein, 250 aa, Alkalilimnicola ehrlichei MLHE-1
MRKPMVAGNWKMNGSLALVNDMGRALADVDCSAVDVLVCPPFPYIGPLRRAVPDESGVALGGQDVSRYDSGAYTGEVAGAMLAEMGCRHVIVGHSERRAMHAETDEVVVDKVQAALRAGLTPIVCVGETLEARDAGETEQVVGRQLDAVLELGGFVVEKLVLAYEPVWAIGTGRTASPEQAQAVHAFIRQRAADALGDELAQRLPILYGGSVKPGNARELFGCADVDGGLIGGASLDPDGFLEIISAARP

SEQ ID NO: 87489 - protein, 1181 aa, Arabidopsis thaliana
MYYLPSSCLVLFLFFSLFYHLPCASSKQTLGWCESQFQCGNITAGFPFWGGNRPEVCGHPLLELHCLDNITSLTISDHLYHVLSINHTYNTLRVARTDFLQSICLSPFPFANATLPPEIFDILPTYKSVTLYRCYPVIPDLARYGCPAIGSVSVSDNLENPVSCEARFTVNIPTSFVPNEKRLNITSLVRDVRNGFEVRLRIDENSCQECSSSHKYCGFTGTLPLETKCRPLNLPTPTIAGVSLLPFLVLTLVVHIIRKQKTSNDKGQQDLKEHIPKPRIKALIQLKQYSYEQVKRITNSFAEVVGRGGFGIVYRGTLSDGRMVAVKVLKDLKGNNGEDFINEVASMSQTSHVNIVTLLGFCSEGYKRAIIYEFMENGSLDKFISSKKSSTMDWRELYGIALGVARGLEYLHHGCRTRIVHFDIKPQNVLLDDNLSPKVSDFGLAKLCERKESILSLMDTRGTIGYIAPEVFSRVYGSVSHKSDVYSYGMLVLDIIGARNKTSTEDTTSSTSSMYFPEWIYKDLEKGDNGRLIVNRSEEDEIAKKMTLFMRRGSVGGISKETVVVREDRYARFIWMLFVIHISCVLSADGNHILCSPSFTCGNQRGLLYPFWIAGRKECGHPDFELDCNAGVPELSISSVKFRILGADYDSGIITLARSDNIDDPCLPNSFTTSFNETVLPLASTTDLLTIYYDCNRNVSSFVSTFVKELDCPDDGTDDRRNYYLTRNLTFLPPSLKLEGNSFLLNDFGGSCSRNVSNPASRTALNTLESTPSTDNLKIALEDGFALEVNSDCRTCIDSKGACGFSQTSSRFVCYYRQEPQNPTRNKDTSLSTGAKAGIGAASFAMMGVILVVTCLNCLIRRQRKTLNDPRMRTSDDSRQQNLKALIPLKHYSYAQVTSITKSFAEVIGKGGFGTVYRGTLYDGRSVAVKVLKESQGNGEDFINEVASMSQTSHVNIVTLLGFCSEGYKRAIIYEFMENGSLDKFISSKKSSTMDWRELYGIALGVARGLEYLHHGCRTRIVHFDIKPQNVLLDDNLSPKVSDFGLAKLCERKESILSLMDTRGTIGYIAPEVFSRVYGRVSHKSDVYSYGMLVLDIIGARNKTSTEDTTSSTSSMYFPEWIYRDLEKAHNGKSIETAISNEEDEIAKKMTLQIPTATLQESSTFSEDISAYTEICSINVA

SEQ ID NO: 87490 - protein, 458 aa, Trichodesmium erythraeum IMS101
MFISSEGIIKLQKYFKQKVFFGNEPTPELIAILLVYFVQGILGLGSLAISFFLKDELAMTPAEVSAMLGIVIIPWMIKPLFGFITDGVPILGYRRGPYIIFSGILGAFSWVALATWVDTPLTATVAIAMSSLSVAMSDVIIDSLVVERVQKESVSNTGSLQSLCWSASALGGLITAYFSGYLLEHFSPQTVFLITATFPLIVSLVPLLIEEKKVSIRINFDNVKQQIKQVKKAVIKKSILLPTAFLVIWQATPNSESAFFFFSTNELGFQAEFLGRIRLVTSIAALFGVWLFQRFFKSVPFRKIFGWSTVISALLGMTTLLLVTHTNRTLGIDDHWFSLGDSLVLTVMGKIAFMPVLVLAARLCPPGVEATVFALLMSIYNLAALISHEGGALLMHWLKVTETNFDNLWLLIVITNLSTLLPLPLLNWLPTANAQTDEEENLNSQPILEPESSEIISR

SEQ ID NO: 87491 - protein, 240 aa, Prochlorococcus marinus str. MIT 9215
MTFTKYQFNNFCYWPSNPKKIVEFIGGSYLASKPDLTYRRFIESLINKNYAVHAYKYTPQFDHQQLAIKAWRDFKNCRISLSKRIGASIPSIRIGHSLGCKLHLISPDGGRNCEKFISISFNNFSANKSIPLLKQISQKLEFKSEFSPSPERTLRLIEKTYNQKNNFLIKFNSDELDQTDKLFSCLKARKEDNSKGVMLKGTHTVIASAGLRENFLGDWADDEFKRNTIKKISSLIDESD

SEQ ID NO: 87492 - protein, 557 aa, Frankia sp. CcI3
MSAARAGTIAGRRSDEVRRSSAMPVLTSRVDAAGEQGRRNAERHWHAVTDLQERLAVAAVGGSEQARSRHVARGKLLPRDRVDTLLDRGSPFLELSPLAANGFYEDPVPGAGIITGIGRISGRECMVVANDATVKGGTYYPLTVKKHLRAQEVALQNRLPCVYLVDSGGAFLPLQDQVFPDREHFGRIFFNQARMSSLGISQIAAVLGSCTAGGAYVPAMADEAVIVRNQGTIFLGGPPLVKAATGEVVSAEDLGGGLLHSRTSGVTDHLAEDDAHALRIVRSIVAGLAPRGPRPWELEPTEAPTVDPAGLYAAVPTDGRTPYDVREVIARIVDGSRFAEFKKEYGTTLVTGTARLHGHPVGIVANNGVLFGESALKGTHFIELCDQRGIPLVFLQNITGFMVGREYEAGGIAKHGAKMVNAVACARVPKFTVVIGGSFGAGNYSMCGRAFSPHFLWMWPNACVSVMGGEQAAAVLATVRRDQMEAAGVAWSEADEVAFRAPILNRYAEQGSPYYSTARLWDDGVIDPADTRMVLGLGLSVAANAPLEPVGYGVFRM

SEQ ID NO: 87493 - protein, 612 aa, Zea mays
  misc_feature (494)..(494): Xaa can be any naturally occurring amino acid
  misc_feature (513)..(513): Xaa can be any naturally occurring amino acid
MDLIAGFANMRARNYSIPEVDKLKAKFIAGRIIPAIATSTAMATGLVCLELYKVLAGGHKVEDYRNTFANLAIPLFSMAEPVPPKTMKHQDMSWTVWDRWTVTGNMTLRELLEWLKEKGLNAYSISCGTSLLYNSMFPRHKERLDKKVVDVAREVAKVEVPSYRRHLDVVVACEDDDDNDVDIPLVSIYFRDDWANAASLRHLFAGGDDHPPGSKDSQNYDNNNQRVHPQPIDENMNQNGDSMDTVIGRIFNNISSLKSAYIQLQEAHTPYDPDKIQEADKLVIEELTRLSELKHAYREKHPKPIAASPQDSRLLSEIQEQQNLLKTYEVMVKKFQSQIQTRDTEITHLQQQIDEAKLRKSKLEKKLKQRGLLNRESEESDEEENYFSIELTPSLFTSAVDNAYQSIHDFSKPLINMMKAAGWDLDGAASAIEPGVVYTRRAHKKFAFESYICQRMFSGFQEESFSIKDSNISVSNEAFFHQLVTVKAMDPLDXSLVHLKMKGAFFGNVDQNXYVMSGGHPRTPFYQAFLKLAKSIWLLHRLAHSFDPKAKVFQVKKGSEFSDIHMESVVKDIILEDVAERPKVGLMVTPGFLIGTSIIQSRVYLSGAKCAD

SEQ ID NO: 87494 - protein, 345 aa, Cryptococcus neoformans var. neoformans B-3501A
MSLKLQDIFDVKGKVVLVTGGGTGLGKAISSGFVQNGAKVYITGRRQQVLEEAAKEIGGDIIPIQGDVSTKEGCKAIADALSAKESKLDALINCAGVMRAYKTTIKDHNNPDEVEKLLWEGHDDDDFNYSNAININGKHDKTPTHLLAQRYLADPTLLLQGPYFMTCALIPLLRKSDLRSVVIIASIAGLANQRATGSVSYGVSKAAAIHLGKLLAGRLHPLKIRVNTICPGIFPSEMTGKNDAGQGLEYDIGEIPTKAAKRSTVGTSYALSPPPPILVHSSTPPLQVPCPCPGSSFMSCRPGLPEEIVGPVLLLSSKAGGYFDGAMLTVDGGRLMVFSIIDDGG

SEQ ID NO: 87495 - protein, 394 aa, Arabidopsis thaliana
MAETQGKVITCKAAVVWGPKVPLVIQEICVDPPQKMEVRVKILYSSICHTDLGCWNGTNEAERAFPRILGHEAVGIVESVGEGVKDVKEGDYVIPTFNGECGECKVCKREESNLCERYHVDPMKRVMVNDGGTRFSTTINKDGGSSQSQPIYHFLNTSTFTEYTVLDSACVVKIDPNSPLKQMSLLSCGVSTGVGAAWNIANVKEGKSTAVFGLGSVGLAVAEGARARGASRIIGVDANASKFEKGKLMGVTDFINPKDLTKPVHQMIREITGGGVDYSFECTGNVDVLREAFLSTHVGWGSTVLVGIYPTPRTLPLHPMELFDGRRITGSVFGGFKPKSQLPNFAQQCMKGVVKLEPFITNELPFEKINDAFQLLRDGKSLRCILQISKLLKR

SEQ ID NO: 87496 - protein, 453 aa, Listeria monocytogenes str. 1/2a F6854
MKVIKFGGSSLASGIQLNKVFQLVAEDPDRKIIVVSAPGKRFKEDTKVTDLLIDCAAKALLGEDTSELFESVIARYAGIALDTGMSDEIINQIRADLQATISSDKSDPDKFLDRMKASGEDNNAKLIAAYFKFKGLNANYINPKDAGLLVTDEHASAQVLPESYDRLFALREREGIIVFPGFFGYTKDGEISTFSRSGSDITGAIVANGAQAELYENFTDVDAVYAVNPAIVKNPKKVLELTYREMRELSYAGFSVFHDEALIPAFHAGIPVHIKNTNNPDSCGTRVVHERENNNGPVVGIASDDGFCSIYISKYLMNREIGFGRKVLQILEDAGLNYEHMPSGIDDLTIIIRENQFGEDTERTIMSRLKEELNADQVIMQHGISLIMVVGETMRHNVGITSRASKALSDAKVNIEMINQGSSEVSIMFGVKEEQENTAVRALYNEFFSEVFV

SEQ ID NO: 87497 - protein, 179 aa, Candida albicans SC5314
MGLTISKLFASLLGRREMRILMVGLDAAGKTTILYKLKLGEIVTTIPTIGFNVETVEYKNISFTVWDVGGQDKIRPLWRYYFQNTQGIIFVVDSNDRDRINEAREELQSMLNEDELKDAVLLVLANKQDLPNAMNAAEITEKMGLHSIRNRPWFIQATCATTGDGLYEGLEWLSNQVGK

SEQ ID NO: 87498 - protein, 114 aa, Brassica napus
MEGLSWRTVCCLSVLCAVLFLRPAEGIRFVIDREECFSHNVEYEGDTVHVSFVVIKADTPWHYSEEGVDLVVKDPNGAQVRDSRDKTSDKFEFIVQKRGVHRFCFTNKSPYHET

SEQ ID NO: 87499 - protein, 439 aa, Magnetospirillum magnetotacticum MS-1
MTLSYDELRALDARHVWHPFTQAGTAKPSILALGAKGATIYAADGREYLDMVSSWWVNLHGHANPAIAQAVADQAGRLEQVIFADFTHEPAARLAHRVCKRLPEDLNRVFYSDDGSTAVEVALKLAHQYWRNRGQHRSTYIAFEGGYHGDTAGAMSAGHSSGYFEAWKEMLFPVETVPFPATWDGDQDVEAKELAALDALDMLFSTNPDHVAAVIIEPLIQGASGMRMCRPNFLRKLEAKVREHGSLLILDEVMTGFGRTGEIFACVKSGITPDLICLSKGLTGGFLPLSMTVARDGIFEAFLGQDLSKAFLHGHSYTANPIGCAAGLASIDLLEAPSCLERIKAIEAIHRRRLDGLKGLSNVAHTRLTGTVAALDVIGGGKGYEAVVGPKMKAAFLERGLLLRPLGNVLYLLPPYCIGDGELERAWDGVEEVLRHLAK

SEQ ID NO: 87500 - protein, 392 aa, Phytophthora palmivora
LVTELGEYRAAVPSGASTGEFEALEMRDGGKAYMGKGVLNAVKNVNEIIAPALVGKDVTQQAELDRFMVETLDGTQNEWGWCKKKLGANAILGVSLALCRGGAAAKKQPLWQYIADLAGNPTPCLPVPSFNIINGGSHAGNKLAMQEFMILPVGATSFTEAMQIGSEVYHNLKKVIKGRYGLDATAVGDEGGFAPNIQSNGEAIDLIEEAIKAAGYTNQVRLGMDVAASEFYTGAADARYNLDFKNENAPDSEKIPADKLQEVYEGFIAKCAGSSKIVSIEDPFDQDDWESWIKFTGKVGKDVQIVGDDLTVTNPTRVKKAIEQKACNALLLKVNQIGSITESIEAVTMAKKAGWAIMASHRSGETEDTFIADLAVGLSAGQIKTGAPCRSE

SEQ ID NO: 87501 - protein, 416 aa, Geobacillus thermoleovorans
MKCCRVMFVLLGLWLVFGLSVPGGRAEAATSRANDAPIVLLHGFTGWGREEMFGFKYWGGVRGDIEQWLNDNGYRTYTLAVGPLSSNWDRACEAYAQLVGGTVDYGAAHAAKHGHARFGRTYPGLLPELKRGGRIHIIAHSQGGQTARMLVSLLENGSQEEREYAKAHNVSLSPLFEGGHHFVLSVTTIATPHDGTTLVNMVDFTDRFFDLQKAVLEAAAVASNAPYTSEIYDFKLDQWGLRREPGESFDHYFERLKRSPVWTSTDTARYDLSVPGAETLNRWVKASPNTYYLSFSTERTYRGALTGNYYPEFGMNAFSAIVCAPFFGSYRNAALGIDSHWLENDGIVNTISMNGPKRGSSDRIVPYDGALKKGVWNDMGTYNVDHLEIIGVDPNPSFDIRAFYLRLAEQLASLRP

SEQ ID NO: 87502 - protein, 138 aa, Zea mays
  misc_feature (57)..(57): Xaa can be any naturally occurring amino acid
  misc_feature (117)..(117): Xaa can be any naturally occurring amino acid
FVFIFRAMDGLRVTMRLRDAPLHEFLPEWNIQVMVSESRAETGANQEDALARIEKLXEVNAKLGYLESMLGISHPELSEMQDRAILEAAIAMTNQRDQVFAEIMRPMAGTPQELGHXVTIIRQVAQKVVAKVGKTIRY

SEQ ID NO: 87503 - protein, 226 aa, Morus mongolica
MACKQRLRFGRFFYVSAVVMVIIAASFASTCGGSGVGHVPSTTEEGRDFEEVKERAQQTQNKAAETAKEANEASETWTDWAKEKISEGLGFNKDADAKDAPKKASDTVSDTAKKSEEVASETGEYSADKARSATERAAETISGAKEKTYDTAKSAKEKAYETAQKAKEKVYDSTGTAKEVKDKEKADEGYDAAKHKGEETLESAKDKTQHLKDKVAGGGRGRDEEL

SEQ ID NO: 87504 - protein, 331 aa, Phytophthora melonis
VTELGEYRAAVPSGASTGEFEALEMRDGGKAYMGKGVLNAVKNVNEIIAPALIGKDVTKQAELDRFMVEELDGTQNEWGWCKKKLGANAILGVSLALCRAGAAAKKQPLWQYIADLAGNPTPCLPVPSFNIINGGSHAGNKLAMQEFMILPVGATSFTEAMKIGSEVYHNLKKVIKGRYGLDATAVGDEGGFAPNIQSNGEAIDLIEEAIKAAGYTNQVRLGMDVAASEFYTGAEDARYNLDFKNENAPESEKISADKLQEVYEGFIAKCAGSSKIVSIEDPFDQDDWASWVKFTAKVGEDVQIVGDDLTVTNPTRVKKAIEQKACNALLL

SEQ ID NO: 87505 - protein, 392 aa, Phytophthora quercina
LVTELGEYRAAVPSGASTGEFEALEMRDGGKAYMGKGVLNAVKNVNEIIAPALVGKDVTKQAELDRFMVEKLDGTQNEWGWCKKKLGANAILGVSLALCRGGAAAKKQPLWQYIADLAGNPTPCLPVPSFNIINGGSHAGNKLAMQEFMILPVGATSFTEAMQIGSEVYHNLKKVIKGRYGLDATAVGDEGGFAPNIQSNGEAIDLIEEAIKAAGYTEQVRLGMDVAASEFYTGASDARYNLDFKNENAPDSEKISAEKLQEVYEGFIAKCAGSSKIVSIEDPFDQDDWESWVKFTGKVGKDVQIVGDDLTVTNPTRVKKAIEQKACNALLLKVNQIGSITESIEAVTMAKKAGWAIMASHRSGETEDTFIADLAVGLSAGQIKTGAPCRSE

SEQ ID NO: 87506 - protein, 475 aa, Triticum aestivum
MAAGDGHGENSSYFDGWKAYDMNPFHPQDNRGGVIQMGLAENQLSLDLIEEWSKAHPEASICTAEGASQFKRIANFQDYHGLPEFRQAMAQFMGQVRGWKARFDPDRVVMSGGATGAQETLAFCLANPGEAFLVPTPYYPGFDRDCCWRSGVKLLPIECHSSNDFRITREAVVAAYEGARSSGVRVKGILITNPSNPLGTTADRATLAMLATFATEHRVHLICDEIYAGSVFAKPEYVSIAEVIEHDAPGADRDLIHIAYSLSKDFGLPGFRVGIVYSYNDAVVACARKMSSFGLVSSQTQLFLAKMLGDEEFMSRFLRESARRLAARHELFTSGLREVGIGCLGGNAGLFSWMDLRGMLREKTAEAELELWRVIIRKVKLNVSPGTSFHCGEPGWFRVCHANMDDETMGVALSRIRDFVRQHQQQKAKAQRWAARSHLHLSLQRHGPMASQYHALSSPMAALLSPQSPLVHAAS

SEQ ID NO: 87507 - protein, 428 aa, Mycoplasma mycoides subsp. mycoides SC str. PG1
MFKVKFADIGEGLTEGIVAEVLVKVGDVVKEGQSLYFVETDKVNSEIPAPVAGKIAVINIKAGQEIKVGDVVMEIDEGTGASVASEPKAEAKSEAKVEVVEENASVVGATPVSNDLIVRKQASTVAKSSTIKATPLARKVAADLNVDLSLVTPTGPNQRILVADIKNYHSSSAQPVSQPAPAPVVTPTIKVVEPSAPLSWDEVPMNGVRKATVKAMTKSHTEIAAFTGMKNTDITETHKMRTELKDHAAASGIKLTYLAFIIKAVAKSLRDMPNINVRGDFANNKIQFMHNINIGIAVDTPNGLMVPVIKGVDHLSVFEIAIKINELANKAKDGKLTRAEMTEATFTVSNFGSVELDYATPIINSPESAILGVGAMSQTPLYINGELQKRFIMPLSMTCDHRIIDGADAGRFLIKVQDYLSKPVLLFM

SEQ ID NO: 87508 - protein, 595 aa, Mycoplasma mycoides subsp. mycoides SC str. PG1
MFKVKFADIGEGLTEGTVAEVLVKVGDVVKEGQPLYFVETDKVNSEIPSPVAGKIAIINISTGQEIKVGDVVIEIDDGTSVSTSEPKVEVVEENASVVGATPVSNDVLPSRAPKPKPEAPKVDVQIEDTFDVCVVGAGIGGYVTAIKSAQLGLKTLIIEKEYYGGVCLNVGCIPTKTLLKTSHVYHDIMHKAKELGIVLQNTEKVVIDWAQVLQRKNGVVKKLTGGVKYLLDKNKVTQIKGEAVALDKNTISVNNKNYRVNNLIIASGSTPNHLPLPGFDQGRKDGIIIDSTGILSVPKIPETLVVIGGGVIGIEFSCLFASLGTKVTVLQGLPTVLEMLDKDIIDAMTKELKNRYNIEVITNASVKEFKNGSVVYEIDDKDQMIKGEYVLESVGRKTSITGFENIGLELTPRKAIVVNEYQETNLDGVYAIGDVVGKVMLAHTAVKGAIVAANRIAKKANKDHAEDIVMDYYRIPSCIYTHPEVSMIGKTEQQLKQENIEYKTFKFPFSAIGKALADNDTSGFVKIIIEPKYKTILGAHIIGNRATEMISEIAAVIECEGTITEIANTIHPHPTMSEAIGEAAEALETGKAIHF

SEQ ID NO: 87509 - protein, 335 aa, Schizosaccharomyces pombe
MQQTYKPNTSALKDGAPKATVDQKQLLPCKYRVGRVLGGGTYATVREAVHIETNKMYAAKIMNKKMMEKKQDFVKNEIAILKRVSYEHPNILHLVDFFETVNNLYLITELATGGALFDRICAKGSFYEADAAALMRTTTSAVKYLHDNGIVHRDLKPENLLYRSKDPNSDLLIADFGLSHFYEDSQYYMLMTACGTPEYMAPEVFRRTGYGKPVDMWAIGVITYFLLSGYTPFARPSQVEVIEAILANEYTFNDPCWSGISETAKDFIKKCLENDPSKRLTAADALKHPFLSENGPATSNLLPNVRENFNARKTFRTAYNAVRAFNTWKKLENKH

SEQ ID NO: 87510 - protein, 322 aa, Mycoplasma mycoides subsp. mycoides SC str. PG1
MYTLEEIKNQLVLKSEKKSIVFPEGESEIIQSVAKTLVDEKLGLPILLFKSSKEVPSEIKNNSSIKTICLDEFDTKEFSEEFVKLRKGKATIEVAHQVMQLPNYVGAMLVKLNQADCMLSGLNNTTADTIRPALQIIGTKPGYNIASSIFIMSKGDENYIFTDCALNIRPTSEQLVEITQMAVDFAKTLNVKNVEAALLSYSTKGSGKGEDVDRVHKAVEILKSSQNDYVCEGEIQFDAAFDKKTRDKKFKNCLLTKQTPDIFVFPDINAGNIGYKIAQRMGGFEAIGPFVLGLNQPINDLSRGATFIDVLNTAIMTLHLSY

SEQ ID NO: 87511 - protein, 861 aa, Physcomitrella patens subsp. patens
MGMKKLLGGKGANLAEMSSIGLSVPPGFTITTETCREYNLNGNKLPDGLWEEVLEGLRAVEEDISATLGDPSKPLLVSVRSGAAISMPGMMDTVLNLGLNDEVVDGLSARSGERFAYDSYRRFIDMFGGVVMGVSHSLFEHELESLKTARGVHNDTDLTTQDLKELVQKYKSVYRNAIGKDFPTDPVEQLRLAVIAVFESWNSSRAVKYRSINQITDLNGTAVNVQAMVFGNMGADSGTGVLFTRNPSTGEKKLYGEYLINAQGEDVVAGIRTPEDIDTMKQVLPDAYKELFENCDILEAHYKEMMDIEFTVQEGRLWMLQCRTGKRTGAGAVKIAVDMVNEGLIDKPTAVNRVEPQHLDQLLHPQFENPVLYKSKVIATGLPASPGAAVGQLVFSAEDAEAWHLQGKVVILVRNETSPEDVGGMHAAAGILTARGGMTSHAAVVARGWGKCCVSGCSEIRVDEANKNVRVNGQTLYEGDWISLNGSTGEVIMGKQPLAPPAISGNLEIFMSWVDEFRRLKVMANADTPEDALAARKNGAEGIGLCRTEHMFFASDERIKAVRQMIMASTTPQRQVALDKLLPYQRSDFEGIFRVMDGLPVTIRLLDPPLHEFLPEGNVEEIVEQLAEATGASEDDVYSRIEKLSEVNPMLGFRGCRLGISYPELSQMQARAIFQAATAMANQGIKVIPEIMVPLVGTPQELKHQVDLIHDVAMQVFAETGMTVKYKVGTMIEIPRAALVADEIAEHADFFSFGTNDLTQMTFGYSRDDVSKFLPSYIAKGILQHDPFEVLDQRGVGQLIVIAKDRGRQSRPDLKVGVCGEHGGEPLSVEFFAKIGLDYVSCSPFRVPIARLAAAQAATKL

SEQ ID NO: 87512 - protein, 171 aa, Glycine max
MPLAVLHPHDFLRKNPSNQYQTIIPHSPNMNPNKSHRTSRNRKKRPDPSPQGVVSPARLTLSPKPQVKNKPQQQLVMGQVKILKRGQLLTQTTPDPPPQTEIVDQKLTPQTETVEKKDLTSIVDGLYAGYSMLVMSPPPSSVPLPAFITKKIAVVSDATSDLRKMLRLDFP

SEQ ID NO: 87513 - protein, 386 aa, Alkalilimnicola ehrlichei MLHE-1
MRAQPGGLLSTPAILVLEDGTVFRGRSIGVDGLVTGEVVFNTAMTGYQEIATDPSYTRQIVTLTYPHIGNTGTNEVDPESSGARLAGLVVRDVPPRMSNWRATGDLSGWLSEQGVVGIAGIDTRKLTRLLREQGSKNACLMAGEVDEDKALAAAREFPGLKGMDLATDAGTEVPYEWRRGSWALGMGVSDAGDQPADRFHVVAWDYGIKHNILRMLADRGCRVTVVPPRTSADEVLGMNPDGVFLSNGPGDPEPLGYAIEAIRQVVEAGRPTFGICLGHQLLGLASGARTVKMKFGHHGANHPVQDLDTGRVMISSQNHGFAVDEDSLPDNLRATHRSLFDGSLQGVARTDRPAFSFQGHPEAGPGPRDVQPLFDRFIDLMAAEGR

SEQ ID NO: 87514 - protein, 375 aa, Oryza sativa
MESRRGGRDGGAAQRREGVAGEEEMERREDGGGAELLIDSSWRCRFERTNLGAVKEMRRVVRAVKRRRGGDAGAASPILGRCGVEWRGPWMTSAMTAAVSLSWSGGKAAARGVGGARADGGGVRPVGHLASERARDAGPEINQRMAGEGDDQLKLLGLWVSPYTHRVKLALSFKGLSYEYVEEDLSNKSELLLSTNPVHKKVPVLIHNGKPICESQVIVQYLDEEFPNSGVSLLPSDSYDRAIARFWAAYINDKLMPSWLQSSMGKTEEERAEALKQTLEAVANLETAFKECSKGKPFFGGDTVGYLDVSLGAMIGWMRAGEALHGRRTFDATRSPLLNAWMERFAALDAAKAAMPDNNKLVEFVRVRRAAAANN

SEQ ID NO: 87515 - protein, 317 aa, Populus trichocarpa
MTAGGSSGRLPTWKERENNKRRERRRRAIAAKIYTGLRTQGNFKLPKHCDNNEVLKALCAEAGWIVEEDGTTYRKGCKPPPTEIAGTPTNISACSSIQPSPQSSNFPSPVASYHASPTSSSFPSPSRFDGNPSTYLLPFLRNIASIPTNLPPLRISNSAPVTPPLSSPTSRGSKRKADWESLSNGTLNSLHHPLLAASAPSSPTRRHHLTPATIPECDESDASTVDSGRWVSFLAGAPHVAPPSPTFNLVKPVAQQSGFQDGVDRHGGLSWGAAAERGRGAEFEFENCRVKPWEGERIHEIGVDDLELTLGGGKARG

SEQ ID NO: 87516 - protein, 397 aa, Bordetella petrii
MAKVNTLSALAKAGALHGKRVFIRADLNVPFDDAGQISEDTRIRASVPGIRLALDGGAAVMVTSHLGRPTEGTLTDADSLDRVGQRLSQLLGMPVQLVKNWVDGVNVDPGQVVLLENCRVNPGEKKNDETLSRKMAALCDIYVNDAFGTAHRAEATTHGMARFAPIACAGPLLEAELQALGRALHEPKRPLVAIVGGSKVSTKLSILQSLADKVDQLVVGGGIANTFMLAAGLSIGKSLAEPDQVDQARAVIDMMKARGADVPIPTDVVCAKSFSVDAQATVKAADAVADDDLILDIGPQTAQQLAGILAKAGTIVWNGPVGVFEFEAFSHGTEVLAKAIADSPAFSIAGGGDTLAAIAKYGIADKVGYISTGGGAFLEFLEGKSLPAVAILQERAG

SEQ ID NO: 87517 - protein, 336 aa, Bordetella petrii
MTIRVAINGYGRIGRNILRAHYEAGKKHDIEIVAINDLGDPKTNAHLTRYDTAHGKFPGTVEVDGDYMVVNGDKIRVLANRNPAELPWGELKVDVVLECTGFFTSKEKASAHLKGGAKKVIISAPGGKDVDATVVYGVNHGVLKASDTVISNASCTTNCLAPLVKPLHDKLGLESGLMTTVHAYTNDQVLTDVYHEDLRRARSATMSMIPTKTGAAAAVGLVLPELNGKLDGFAIRVPTINVSIVDLSFVAKRETSVDEVNSILKAASEGELKGILNYNTEPLVSVDFNHNPASSTYDSTLTKVSGKLVKVSSWYDNEWGFSNRMLDTTVALMSAK

SEQ ID NO: 87518 - protein, 63 aa, Populus trichocarpa
MVKVAGFFAMSVGAFIFWQTMDKIHVWNALRQDEKQERFEKEMEIKRVREELLRQAKDKDALA

SEQ ID NO: 87519 - protein, 294 aa, Listeria monocytogenes str. 4b F2365
MTKTLQDRMILPGNETIPYIGLGVFQVTEQEFIAGAVEKAIEVGYRLFDTAAVYNNEAIVGQAIASSAVSREELFISSKVWNGDLGFDETLFAFERTLRNLKLDYLDLYLIHWPVAGKYRDSWRAMERLHDEKLIKSIGVANFKQHHLSDLLVAANEKPVLNQVETHPLLPQNDLRKYLAEQNIAHAAWSPLAKGILMQNPVITEIAKKHQASVDQVILQWHLNRNTIIFPKSITSSRIEENSRLSYFQLDAIDMEKIDRLETGKRVGPDPDDLEYFLSSIERERAYLSGENAE

SEQ ID NO: 87520 - protein, 158 aa, Zea mays
  misc_feature (27)..(27): Xaa can be any naturally occurring amino acid
  misc_feature (39)..(39): Xaa can be any naturally occurring amino acid
  misc_feature (47)..(48): Xaa can be any naturally occurring amino acid
  misc_feature (55)..(55): Xaa can be any naturally occurring amino acid
  misc_feature (85)..(85): Xaa can be any naturally occurring amino acid
  misc_feature (99)..(99): Xaa can be any naturally occurring amino acid
  misc_feature (122)..(122): Xaa can be any naturally occurring amino acid
  misc_feature (126)..(126): Xaa can be any naturally occurring amino acid
RRWRNGAYLMMIKPDGGQRGLIGEIIXRCEKKGLYLKAXRLRNVQRXXAEQRDAXIGGCQRFSQGLVSPIISGPVGAMASMDKSXCTTGRKIMGAPNPXLVSEPGTIRGDFVVDIGRNVINXEETXVESANKEIALWFPEGPCLIGRSSQPTWHLTRG

SEQ ID NO: 87521 - protein, 388 aa, Vibrio cholerae O1 biovar eltor str. N16961
MNLHEYQAKQLFAEFGLPVPEGYACDTPQEAFEAAGRISTAKKVVKCQVHAGGRGKAGGVELHDTKEGVKAFAQKWLGKNLVTYQTDANGQPVSKILVEEASNIANELYLGAVVDRSTRRIVFMASTEGGVEIEKVAEETPELIHKAAIDPLVGPQAYQGRELAFKLGLQGDQIKQFVKIFMGLGEMFAQYDLALLEINPLVITAEGNLLCLDGKINIDSNAMYRQPKLRQMHDASQEDAREAHAAKWELNYVALDGNVGCMVNGAGLAMGTMDIVNLHGGKPANFLDVGGGATKERVAEAFKIILSDTNVKAVLVNIFGGIVRCDMIAEGIIGAVKEVGVSVPVVVRLEGTNAELGRKVLAESGLDIIAAVSLTDAAQKVVAAAEGK

SEQ ID NO: 87522 - protein, 312 aa, Desulfovibrio vulgaris subsp. vulgaris str. Hildenborough
MQGDLKILTGTSNPELAKAICNHLGCQITPALCETFSDGEIRIEIGDNVRGDDVFVVQATCAPVNFNLMQLFLMLDALKRASAGRVTAVMPYYGYARQDRKVSPRAPISAKLVADFLTTAGTDRVVTVDLHAGQIQGFFNSPVDNLYAAPVILDYLRQVEGEIVIVSPDAGGVERARAYAKRLNAGLAIVDKRRDKPNQAQAMHVIGDVRDKVAIVVDDMIDTAGTLCAAGEVLLKNGAREVMACATHPVLSGPAIERLCNSPFKQVIVTDTVPLGDKLNACPKLHVLSVAGLLAKAIHNIHTESSVSVLFV

SEQ ID NO: 87523 - protein, 404 aa, Vibrio cholerae O1 biovar eltor str. N16961
MTIEILVPDLPESVADATVATWHKKPGDMVARDEVIVEIETDKVVLEVPAPDAGVLEAILEQEGATVLSKQLLARLKPGAVAGEPTQDTPDATEPSPDKRHKASLTEESNDALSPAVRRLLAEHNLEANQVKGSGVGGRITREDIEAHLAANKAKPAAKAEAPIAALAPVVGRSEKRVPMTRLRKRIAERLLEAKNNTAMLTTFNEVNMKPIMDMRKQYQDVFEKRHGIRLGFMSFYVKAVTEALKRYPEVNASIDGDDLVYHNYFDVSIAVSTPRGLVTPVLKNCDTLSLAQIEKGIKELAEKGRDGKLTVDELTGGNFTITNGGVFGSLMSTPIINPPQAAILGMHKIQDRAMVVDGKIEILPMMYLALSYDHRSIDGRESVGFLVTVKELLEDPARLLLDV

SEQ ID NO: 87524 - protein, 383 aa, Listeria monocytogenes str. 4b F2365
MMNNSKIAKKHQQMPVNILADIGTLAKTMPDILDLSIGDPDLITDESIINAAFEDVRAGHTKYTESGGDVELIDAIRGYFSRNYDLSFERSQIRATVGALHGMYLTLQTILDDGDEVIIHEPYFSPYKDQVLNSGGTPIIIPTYEKDDFAINVDILEAAITDKTKALILNSPNNPTGAVFSPETFEKIANLAKKYDFFILSDEVYDGFSFYEDFVPMAKFAPDHTITFGSMSKNFAMTGWRLGYMIAPTYLNEAAKIINEGITYSAPTPSQRAAIYALNHSETLIPLVTETFQKRLEYIAKRVEEIPYLSLHPLKGSIYAFINISKTNMDSVSFTEYVLKETQVLVIPGLAFGESGDNYVRLAATQDISVLEEAFNRLAKLTF

SEQ ID NO: 87525 - protein, 391 aa, Phytophthora psychrophila
VTELGEYRAAVPSGASTGELEALEMRDGGKAYMGKGVLNAVKNVNEIIAPALVGKDVTKQTELDRYMVEQLDGTQNEWGWCKKKLGANAILGVSLALCRAGAAAKKQPLWQYIADLAGNPSPCLPVPSFNIINGGSHAGNKLAMQEFMILPVGATSFTEAMQIGSEVYHNLKKVIKGRYGLDATAVGDEGGFAPNIQSNGEAIDLIEEAIKTAGYTNQVRLGMDVAASEFFTGAKDARYNLDFKNENAPESEKISAEKLQEVYEGFIAKCADSSKIVSIEDPFDQDDWESWVKFTGKVGKDVQIVGDDLTVTNPTRVKKAIELKACNALLLKVNQIGSITESIEAVTMAKKAGWAIMASHRSGETEDTFIADLAVGLSAGQIKTGAPCRSE

SEQ ID NO: 87526 - protein, 548 aa, Magnaporthe grisea 70-15
MSYGGGGYGGRNGGGYGGGRDGGYSNGHGSHGGGYGGGGGGGYGGGGGGYGGGGGGGFGGGGDRMSNLGAGLQKQDWDINALPKFEKHFYKEHPDVTNRSQAEVDKFRREHSMAVQGSDVPKPVETFDEAGFPRYVMDEVKAQGFPAPTAIQSQGWPMALSGRDVVGIAETGSGKTLTYCLPAIVHINAQPLLAPGDGPIVLILAPTRELAVQIQAEISKFGKSSRIRNTCVYGGVPKGPQIRDLSRGVEVCIATPGRLIDMLESGKTNLRRVTYLVLDEADRMLDMGFEPQIRKIIGQIRPDRQTLMWSATWPKEVRNMAADFLQDFIQVNIGSLDLSANHRITQIVEVVSESEKRDRMIRHMEKVMDGKDSKNKILIFVGTKRVADEITRFLRQDGWPALSIHGDKQQNERDWVLDQFKTGKSPIMVATDVASRGIDVRNITHVLNYDYPNNSEDYIHRIGRTGRAGAKGTAITFFTTENSKQARDLLGVLQEAKQEIDPRLAEMARYGGGGGGGRYGGYRGRGGRHHGGGGRGANDLPMGGNRRW

SEQ ID NO: 87527 - protein, 336 aa, Gibberella zeae PH-1
MKTSTFRIARGAAAGLQKRAYTKATTAPRHLMTIADLTPTEFANLVRDANTRKIAVKAMMFSKRSTRTRVSTEAAVTMLGGHPMFLGKDDIQLGVNESLYDTSKVISSMTSCMVARVGPHSDVATLAKHSSVPVINALSDDFHPLQTIADFLTLAETFPASTSKGATLGLNGLKVAWVGDANNVLFDLAIGCVKMGVDISVAAPKGYEIPDAMRQLITSAGDGLSSPGKLIETNVPEEAVKDANVLVTDTWVSMGQEADTQKRLKDFAGFQITNDLAKRGGAKADWKFMHCLPRHPEEVADEVFYSPRSLVFPEAENRLWAALSALEGFVVNKGKF

SEQ ID NO: 87528 - protein, 391 aa, Phytophthora brassicae
TTEIGEYRAAVPSGASTGEFEALEMRDGGADYMGKGVLNAVRNVNEIIAPALVGKDVTKQAELDRYMVETLDGTQNEWGWCKKKLGANAILGVSLALCRAGAAAKKQPLWQYIADLAGNPSPCLPVPSFNIINGGSHAGNKLAMQEFMILPVGATSFTEAMKIGSEVYHNLKKVIKGRYGLDATAVGDEGGFAPNIQANAEAIDLIQEAIKDAGYTNQVRLGMDVAASEFYTGVKDARYNLDFKNADGAESEKISADKLLEMYEGFISKCTDSSKIVSIEDPFDQDDWESWVKITGRIGKDVQIVGDDLTVTNPTRVKKAIEQKACNALLLKVNQIGSITESIEAVTMAKKAGWAIMASHRSGETEDTFIADLAVGLSAGQIKTGAPCRSE

SEQ ID NO: 87529 - protein, 471 aa, Magnetospirillum magnetotacticum MS-1
MPRKMLQFTHLHQRQPDKRGAAERRKDFGEISTAFETERAAEQASRCEQCGIPFCSIHCPLGNNVPDWLMLVAQDRMEEAYAVSSSTNTFPEICGRICPQDRLCEGNCVLEQSTHGNVTIGAVEKHITETAFAQGWVKPVLAGVESGRSVGIIGGGPAGLAAAESLRRKGHSVTVYDRHDRMGGLLIYGIPGFKLEKDVVERRIRLLAEAGVKFETGVEIGKTVSFAELRKRHDAVLIATGVYKAKPLGIPGSDLPGVHAALDYLIAQNRRDLGDTVESLDAKGKNVVVIGGGDTAMDCVRTAIRQGAKSVKCLYRRDRANMPGSKREVAHAEEEGVEFVWMAAPEMVNGKAKAEGVKAVRMHLGMPDASGRQSPVAIEGSGFQLPADMVIAALGFDPEDVPALFGAPELKVSKWGTVETDGDLMASLPGVFGAGDIVRGASLVVWAIKDGRDAAESIHRYVSGVAMKAAE

SEQ ID NO: 87530 - protein, 312 aa, Gibberella zeae PH-1
MASLRSLTASLRWVAPARGVAAVRYSSSSTSAIAYKALRRRSAPLPVRDNPPAWSAQSAVSNILYETPVPSTVPPKRHILNCLVQNEPGVLSRVSGILAARGFNIDSLVVCNTEVEDLSRMTIVLTGQDGVVEQARRQLEDLVPVWAVLDYTAAALVQRELLLAKINILGPEYFEELLNHHREIAAGEYDVDNAHEAIERSISDTAKDFHPSKLAVSQALRHKHEHLKSITYFAHQFGGKVLDISNSSCIVEVSAKQSRIDSFLKLVAPFGILESARTGLMALPRSPLNEASQEAVTMEADDVVDASQLPPG

SEQ ID NO: 87531 - protein, 573 aa, Mycoplasma mycoides subsp. mycoides SC str. PG1
MSKQIKGIAASEGISLARALVIKEIKLDVQKQLIDDVDQQIAKLEQAINQTITDLKKIQKITLEKLGEEKAAIFDAHQDIANDPAIKEEVVQLIKTEKVNAEYALFIVSNNYFEMFSQLEDPYFKERSADIKDISSRIISHILGLEIHDLSTIDKEVIIISDDLTPSQTAQLNKKFVKGFLTNVGGRTSHAAIMARSLEIPAILGLKNITELVKTDDLIALDGSSGIVELDLNDNDIKNYQTKVKQYLELKDQLKKFKDKPSLTKDKIKKLIEANIGSTNDIQSVLDSGAEGIGLFRTEFLYMNNDHFPTEEEQFEAYKKVVSQINHLVVFRTLDIGGDKKLSYFKFDEEMNPFLGYRAIRFTLDRKDIFKDQIRALLKASAFGKLGIMFPMIATIDEFKQAKAFVEECKIELDKEGIKYDKQVQIGMMVEIPSAAILADQFAKYADFFSIGTNDLIQYSFASDRMNQNVSYLYQPLNPSLLRLIQLTISGAHKHNKWVGMCGEMAGDSKALPILLGLDLDAFSMSATSVLKARSLMSKIESIKAKDLANKALEYQTSQQVNELVEEFLKNLD

SEQ ID NO: 87532 - protein, 392 aa, Phytophthora gonapodyides
LVTELGEYRAAVPSGASTGEFEALEMRDGGADYMGKGVLNAVKNVNDIIAPALIGKDVTKQEELDRYMVETLDGTQNEWGWCKKKLGANAILGVSLALCRAGAAAKKQPLWQYIADLAGNPTPCLPVPSFNIINGGSHAGNKLAMQEFMILPVGATSFTEAMKIGSEVYHNLKKVIKGRYGLDATAVGDEGGFAPNIQSNGEAIDLIEEAIKAAGYTNQVRLGMDVAASEFYTGAKDARYNLDFKNENAPESEKIPAEKLQSVYEGFIAKCAASSKIVSIEDPFDQDDWESWVKFTGKVGKDVQIVGDDLTVTNPTRVKKAIELKACNALLLKVNQIGSITESIEAVTMAKKAGWAIMASHRSGETEDTFIADLAVGLSAGQIKTGAPCRSE

SEQ ID NO: 87533 - protein, 390 aa, Phytophthora citrophthora
TEIGEYRAAVPSGASTGEFEALEMRDGGKDYMGKGVLNAVKNVNEIIAPALVGKDVTKQAELDRYMVEQLDGTQNEWGWCKKKLGANAILGVSLALCRGGAAAKKQPLWQYIADLAGNPSPCLPVPSFNIINGGSHAGNKLAMQEFMILPVGATSFTESMKIGSEVYHNLKKVIKGRYGLDATAVGDEGGFAPNIQSNGEAIDLIEEAIKAAGYTNQVRLGMDVAASEFYTGASDARYNLDFKNENAPDSEKIPADKLQEVYEGFIAKCADSSKIVSIEDPFDQDDWESWVKFTAKVGKDVQIVGDDLTVTNPTRVQKAIEQKACNALLLKVNQIGSITESIEAVTMAKKAGWAIMASHRSGETEDTFIADLAVGLSAGQIKTGAPCRSE

SEQ ID NO: 87534 - protein, 754 aa, Methanosarcina barkeri str. Fusaro
MIEEINLRVAEAYHKDVGRGIARIDTRLMQQMGLVSGDIIEISGRAKTYAIVWPNVEREQENRIRIDGNLRSNAKVGIDDRVTIQKVQAKNAQRVTLAPSQPVRLVGGAHYILRIIEGRPLNKGQQIRVETVNNPLTFVVASTRPAGPVVVTKDTDIVIKEKSAEEIRVPEGISYEDIGGLRREIQLVREMIELPLRHPELFQKLGIEPPKGVLLHGPPGTGKTLIAKAVASETDANFITISGPEIVSKYYGESEQKLREIFEEAEKEAPSIIFIDEIDSIAPKRGEVTGELERRVVAQLLSLMDGLNSRGEVVVIAATNRPNSIDEALRRGGRFDREIEIGIPDRNGRKQILLIHTRGMPIQDVSLSEIADVTHGFVGADLSSLCKEAAMHALRRITPEIDIEEDEIPQEILDKLVVTKDDFKEALKNIEPSAMREVYVEVPHVGWEDIGGLENAKQELIEAVEWPLKYPELFSSINIKPPRGVLLFGPPGTGKTLLAKAVASESEANFISIKGPELLSKYVGESERAVRETFRKAKQAAPTVVFFDEIDSIAPQRSSVSDTHVSERVVSQILTELDGVEELKDVIIVAATNRPDMVDPALLRPGRFDRLIYIKPPDNISREKIFEIHTQGKPLAEDVNLSELADMTEGYVGADIEGICREAAMLALREIVTPGASRKDIEKRAGEVIISKKHFERAIRRVKPTTSRESLAAYERSAELFAKYATEFEEEAPEAEEQEKELEHENVPDFFQAQ

SEQ ID NO: 87535 - protein, 377 aa, Bacillus subtilis subsp. subtilis str. 168
MSLNSSPSYRRRAGKGLVLCVCRKAFGKWAGFSNGWVYWTSEMLITGSQLTAISLFTKHWFPQVPLWVFASIYAVLGLLIIFTGLAVFEKTENVLAVIKTAAIFMFIVIAILALCGILSGGNHGIHVPNKTSEFFPYGAMGLWTGLIYAFYAFGGIEVMGLMAVHLKKPEEASKSGKLMLATLAIIYIISIGLALLLVPLHTFTEQDSPFITSLKGYNLEIILDIFNGIFIIAGFSTLIASLFAVTTLLCTMADDGDAPKCFTLKEGKKICWPALGLTFAGLVLSIILSLVLPKNIYEHMTTAAGLMLLYTWLFILFSSKKLTDPEGMGKTQIYLAMVLIAAAVSGTLFEKSSRPGFFVSIGFLVIIAIVTMIYQKK

SEQ ID NO: 87536 - protein, 392 aa, Phytophthora cambivora
  misc_feature (236)..(236): Xaa can be any naturally occurring amino acid
  misc_feature (297)..(297): Xaa can be any naturally occurring amino acid
LVTEIGEYRAAVPSGASTGEFEALEMRDGGKAYMGKGVLNAVKNVNDIIAPALIGKDVTKQAELDRYMVEELDGTQNEWGWCKKKLGANAILGVSLALCRGGAAAKKQPLWQYIADLAGNPTPCLPVPSFNIINGGSHAGNKLAMQEFMILPVGATSFTEAMKIGSEVYHNLKKVIKNRYGLDATAVGDEGGFAPNIQSNGEAINLIEEAIKAAGYTNQVRLGMDVAASEFYTGAXDARYNLDFKNENAAESEKISADKLQEVYEGFIAKCADSSKIVSIEDPFDQDDWASWVKITXKVGKDVQIVGDDLTVTNPTRVKKAIELKACNALLLKVNQIGSITESIEAVTMAKKAGWAIMASHRSGETEDTFIADLAVGLSAGQIKTGAPCRSE

SEQ ID NO: 87537 - protein, 142 aa, Lactococcus lactis subsp. lactis Il1403
MEKEKLKKKLSLLAYRVTQENGTEAPFANEFDDFFEQGLYVDVVSGEALFTSLDKYQSGCGWPAFTQPIDKGVVKEKRDKSLFMERTEVRSSNADSHLGHVFTDGPLDKGDLRYCINSAALRFVPFDQLEAEGYGEYVKYFS

SEQ ID NO: 87538 - protein, 293 aa, Oryza sativa Japonica Group
MAGGPAAVSFLTNIAKAAAGLGAAASLLSASLYTVDGGERAVIFDRFRGVLPETVGEGTHFLVPWLQKPFVFDIRTRPHNFSSNSGTKDLQMVNLTLRLLSRPDVVHLPTIFTSLGLEYDDKVLPSIGNEVLKAVVAQFNADQLLTERPHVSALVRDALIRRAREFNIILDDVAITHLSYGIEFSQAVEKKQVAQQEAERSKFLVAKAEQERRAAIVRAEGESESARLISEATAAAGTGLIELRRIEAAREIAAELARSPNVAYVPAGDNGRMLLGLNAAGGVSLVTDVALLN

SEQ ID NO: 87539 - protein, 536 aa, Glycine max
MSTHIESLWVLALASKCIQENIAWSLLIIMVTLWLTMTFFYWSHPGGPAWGKYYYFNYWKKTTSTNTNINLKMIIPGPRGYPFIGSMSLMTSLAHHRIAAAGEACNATRLMAFSMGDTRAIVTCNPDVAKEILNSSTFADRPIKESAYSLMFNRAIGFAPYGVYWRTLRRIAATHLFCPKQIKASELQRAEIAAQMTNSFRNHRCSGGFGIRSVLKRASLNNMMWSVFGQKYNLDEINTAMDELSMLVEQGYDLLGTLNWGDHIPFLKDFDLQKIRFTCSKLVPQVNRFVGSIIADHQADTTQTNRDFVHVLLSLQGPDKLSHSDMIAVLWEMIFRGTDTVAVLIEWILARMVLHPEVQRKVQEELDAVVRGGALTEEVVAATAYLAAVVKEVLRLHPPGPLLSWARLAITDTTIDGYHVPAGTTAMVNMWAIARDPEVWLDPLEFKPERFMGLENEFSVFGSDLRLAPFGSGRRTCPGKTLGLSTVTFWVAWLLHEFEWLPSDEAKVDLTEVLRLSCEMANPLIVKVRPRHGLST

SEQ ID NO: 87540 - protein, 762 aa, Bordetella petrii
MDANLRKAALEYHESGRPGKISVTPTKQLSNQRDLALAYSPGVAAACEEIVKDPGNAVRYTARGNLVGVITNGTAVLGLGNIGALASKPVMEGKAVLFKKFAGLDVFDIEINETDPDKLVEIIAGLEATFGGINLEDIKAPECFIVERKLRERMKIPVFHDDQHGTAICVSAAFINGLKVVGKSLEKIKVVTSGAGAAALACLDLIVDLGVPVENIWVTDIEGVVYEGRTVLMDPDKARFAQKTDKRTLAEVIEGADVFLGLSAGGVLKPEMVASMAARPVILALANPNPEILPEDAHAVRDDVVMATGRSDYPNQVNNVLCFPYIFRGALDVGATTITREMEMAAVHAIAKLAQEEQSEVVAAAYGTYDISFGPEYLIPKPFDPRLITRIAPAVAKAAMDGGVATRPLPDLQAYTEQLQQFVYHSGAFMKPLFTAAKTFVRDGGKARVVFTEGEDERVLRAVQVVVDEGLAKPILVGRPAVLAARIEKYGLRLRLGEDVEVTNPEYDERFHRYWTTYWEMMCRSGVTKEMARVEMRRRLTLIGAMMVHLGDADGMICGTVSSYAEHLRFIDQVIGRRPGSKVYAAMNVLLLDERMVALVDTHVNDDPTAEQIAEFTIAAAEEMTRLNLVPKVALLSRSNFGTGSSSSGAKMREALELVRQAAPELEIDGEMHGDCALDEALRLRILPSSTLKGEANLLVCPNVDSGNIAYNLLKTAAGGNVAVGPFLLGANAPVHILTSSSTVRRIVNMTALVVVDANVPK

SEQ ID NO: 87541 - protein, 283 aa, Oenococcus oeni PSU-1
MVLSRSVPNIVLNDGHSLPAIGLGTYLVRGGQGVDQILSAIEDGYRLIDTSTNYDSEGAVGEAIRRSGIPRSEFIVTSKLPGKYHHYQDALMMIQESIFRMGIDYLDLYLIHWPLPKRDHYVEAWKALVDAQKLGLIRSIGVSNFLPEHLDRIINESGVTPAVNQIEVHPYWVQEDMLAANKSRGIVSEAWSPLGRGSAALKEDIIKNLADKYGKNTGQIILRWHTQRGIIPLPKASSLIHQRSNIDIFDFSLTSSEIEQINALNRSDGRVDGQDPNTYEEFD

SEQ ID NO: 87542 - protein, 461 aa, Botryococcus braunii
MGMLRWGVESLQNPDELIPVLRMIYADKFGKIKPKDEDRGFCYEILNLVSRSFAIVIQQLPAQLRDPVCIFYLVLRALDTVEDDMKIAATTKIPLLRDFYEKISDRSFRMTAGDQKDYIRLLDQYPKVTSVFLKLTPREQEIIADITKRMGNGMADFVHKGVPDTVGDYDLYCHYVAGVVGLGLSQLFVASGLQSPSLTRSEDLSNHMGLFLQKTNIIRDYFEDINELPAPRMFWPREIWGKYANNLAEFKDPANKAAAMCCLNEMVTDALRHAVYCLQYMSMIEDPQIFNFCAIPQTMAFGTLSLCYNNYTIFTGPKAAVKLRRGTTAKLMYTSNNMFAMYRHFLNFAEKLEVRCNTETSEDPSVTTTLEHLHKIKAACKAGLARTKDDTFDELRSRLLALTGGSFYLAWTYNFLDLRGPGDLPTFLSVTQHWWSILIFLISIAVFFIPSRPSPRPTLSA

SEQ ID NO: 87543 - protein, 384 aa, Bordetella petrii
MPRLASRAQDFLTFHVVELFKEAQALQAAGRDIISLGIGEPDFTAPPQVVEALERAAQAGLSGYSAPAGLTALREAIARFYATEFGAAVDPSRVIVTAGASGALSLACAALVDSGAEVLMPDPSYPANSNFILAAGGRPRLIPSSAAQRFQLSAQNVRDHWTDATRGVLVASPSNPTGTCIARDELAALLHAVRERRGFAIVDEIYLGLSYEGQPRSALTLDDDVIVINSFSKYFHMTGWRLGWMIVPQRLAGPIEKMAASLAICAPTLAQHAALACFAPDTLKIYEHRRDAFKQRRDYLLPEFEQLGLHVPVKPDGAFYIYADIAALGMDSAALSHRLLHEAGVAAVPGLDFGPAHGHHTLRVSYATGLDRLEEAVRRMKAVL

SEQ ID NO: 87544 - protein, 237 aa, Arabidopsis thaliana
NPPQKPRNAKMGDNGESIKWPKIKLKSNLNVSYLKNHDLFTVENCLTSDESKAFVKIAESLGFTHQGSRGPAYGEAYRDNHRISVNDPVLADTLWQSGLSNLFTDIKIRRKVAVGLNPNIRFYRYSAGQHFGRHIDESADLEDGNRTYYTLLIYLSGNSTKSKSKSSSSKTNDSSSAEPLVGGETVFYGSRNSIVAEVAPVEGMALFHIHGDKCMLHEGRNVSKGVKYVFRSDVVFA

SEQ ID NO: 87545 - protein, 357 aa, Vitis vinifera
  misc_feature (275)..(275): Xaa can be any naturally occurring amino acid
MAIAAPGQLNISESPSWGSRSVDCFEKLEQIGEGTYGDCLKGLFWFRLLQKASDDLPVSSDWRFEGSLQMIPGDDRLVVFVDNFPITAIREIKILKKLHHENVIKLKEIVTSPDGNKYKGGIYMVFEYMDHDLTGLADRPGMRFSVPQIKCYMRQLLTGLHYCHVNQVLHRDIKGSNLLIDNEGNLKLADFGLARSFSNDHNGNLTNRVITLWYRPPELLLGTTRYGPAVDMWSVGCIFAELLHGKPIFPGKDEYSSNPPGHHLSLTNCMSQKRXKKPIKRPSASFSILIDGRLGFGLDPIKVLGRKILCSLSLHPRGGYHYSSKPFDDTAKEFKPFRLVDSLSAKDLRSDSGKTLA

SEQ ID NO: 87546 - protein, 180 aa, Phaseolus vulgaris
MASSMISSPAVTTVNRAGAGAGMVAPFTGLKSLGGFPSRKMNNDITSVANNGGRVQCIQVWPTVGKKKFETLSYLPPLTKQQLAKEVDYLLRKGWVPCLEFELEHGFVYREHNKSPGYYDGRYWTMWKLPMFGCTDSSQVLKELYEAQTAHPDGFIRIIGFDNVRQVQCISFIAYKPPGY

SEQ ID NO: 87547 - protein, 483 aa, Corynebacterium glutamicum ATCC 13032
MTTALEEQNAQQAATAGRVVRVIGAVVDVEFPRGELPALYNALTVEVTLESVKKTVVLEVAQHLGDNLIRTIAMAPTDGLVRGAAVTDTARPISVPVGDVVKGHVFNALGDCLDDVSLNNNPEIERWGIHREPPSFDQLEGKTEILETGIKVIDLLTPYVKGGKIGLFGGAGVGKTVLIQEMITRIAREFSGTSVFAGVGERTREGTDLFLEMEEMGVLQDTALVFGQMDEPPGVRMRVALSGLTMAEYFRDVQNQDVLLFIDNIFRFTQAGSEVSTLLGRMPSAVGYQPTLADEMGVLQERITSTKGRSITSLQAVYVPADDYTDPAPATTFAHLDATTELDRSIASKGIYPAVNPLTSTSRILEPAIVGERHYEVSQRVIGILQKNKELQDIIAILGMDELSEEDKITVARARRIERFLGQNFFVAEKFTGLPGSYVPLTDTVDAFERICNGDFDHYPEQAFNGLGGLDDVEAAYKKLTGK

SEQ ID NO: 87548 - protein, 381 aa, Caulobacter crescentus CB15
MRAEIEPFHAIAISRLAHQLKMEGRSIIHMEFGQPSTGAPSKALAKAHDILDAEAMGYWESPLLREKIAQRYQTLYGVTVEPERIILTCGASPALVLALSSLFKPGDRIALARPGYVAYRNTLKALHLEPVEIACGPEDRFQLTAKHLADLEPAPVGVIVASPANPTGTIIEPAELEAIAKVCAARGIRIISDEIYHGLSYAGRTPSMLEFAPDALIVNSFSKYFSMAGWRLGWLLTPPGEDLDRARAYVGNLFLTAPSLAQHAGLAAMDCIDELEGHIDVYRANRQLMLDALPALGLKEIAPPDGAFYIWANIAHLTDDSLGFCEDLLRDTGVATAPGVDFDPVEGKRFIRFSFAVSTPEVEEALRRITPWFEARTASAA

SEQ ID NO: 87549 - protein, 388 aa, Phytophthora syringae
  misc_feature (268)..(268): Xaa can be any naturally occurring amino acid
IGEYRAAVPSGASTGEFEALEMRDGGADYMGKGVLNAVKNVNEIIAPALIGKDVTKQAELDTYMVETLDGTQNEWGWCKKKLGANAILGVSLALCRGGAAAKKQPLWQYIADLAGNPSPCLPVPSFNIINGGSHAGNKLAMQEFMILPVGATSFTEAMKIGSEVYHNLKKVIKGRYGLDATAVGDEGGFAPNIQANAEAIDLIEEAIKAAGYTDQVRLGMDVAASEFYTGAKDARYNLDFKNDNAPESEKISADKLLEMYEGFISKCXDSSKMVSIEDPFDQDDWESWVKITSRVGKDVQIVGDDLTVTNPTRVKKAIELKACNALLLKVNQIGSITESIEAVTMAKKAGWAIMASHRSGETEDTFIADLAVGLSAGQIKTGAPCRSE

SEQ ID NO: 87550 - protein, 201 aa, Aspergillus nidulans FGSC A4
MASEMQNSNPTIINTADLPTRLRPSASPKSSTYGSEFFASALPSLTVDALSDYSPSTSESENDDDLMEEPIDEQEIYDLVSTISDPEHPISLGALAVVSLPDISIKPALPDVPDSPLRTVTVLITPTITHCSLATVIGLGVRVRLEQSLPPRFRVNVQIKEGTHSTADEVNKQLADKERVAAALENGTLMGVIAKMLETCL

SEQ ID NO: 87551 - protein, 391 aa, Phytophthora richardiae
VTKIGEYRAAVPSGASTGEFEALEMRDGGKDYMGKGVLNAVKNVNEIIAPALVGKDVTKQVELDRYMVETLDGTQNEWGWCKKKLGANAILGVSLALCRAGAAAKKQPLWQYIADLAGNPSPCLPVPSFNIINGGSHAGNKLAMQEFMILPVGATSFTEAMKIGSEVYHNLKKVIKGRYGLDATAVGDEGGFAPNIQANAEAIDLIEEAIKAAGYTNQVRLGMDVAASEFYTGAKDARYNLDFKNANAPESEKIPADKLQEMYEGFISKCADSSKIVSIEDPFDQDDWESWVKFTGKVGKDVQIVGDDLTVTNPTRVKKAIELKACNALLLKVNQIGSITESIEAVTMAKKAGWAIMASHRSGETEDTFIASLAVGLSAGQIKTGAPCRSE

SEQ ID NO: 87552 - protein, 160 aa, Brassica napus
QQISSLSSGMSSETRRMKTKNKKKEGLGWMEWIRGWACVFHEFLFQRFMSSHLPNPLPLPPLSHLTCIVTGSTSGIGRETARQLAEAGAHVVMAARDTKAAHDLIQQWQRDWSAKGLPLNIEAMELDLLSLDSVVNFSNAWNARLAPLHVLINNAGIFAM

SEQ ID NO: 87553 - protein, 189 aa, Methanosarcina barkeri str. Fusaro
MKELKILVVNNYGQFCHLIHRAVRDLDMDTKIIPNTTPIEDILAEEPDGLILSGGPEMDRAGLCFDYVREIDLPILGICLGHQAIALAYGGHVHSGKKGGYAEVEVEVLEEDDILRGLGPKATVWASHADEVAILPEGFIHLARSDICEIEAMRHPTKPIYGVQWHPEVSHTEKGEELLTNFLEICEKY

SEQ ID NO: 87554 - protein, 392 aa, Phytophthora ramorum
  misc_feature (77)..(77): Xaa can be any naturally occurring amino acid
LVTELGEYRAAVPSGASTGELEALEMRDGGSDYMGKGVLNAVKNVNEIIAPALVGKDVTQQVELDRYMVETLDGTQXEWGWCKKKLGANAILGVSLALCRGGAAAKKQPLWQYIADLAGNPSPCLPVPSFNIINGGSHAGNKLAMQEFMILPVGATSFTEAMKIGSEVYHNLKKVIKGRYGLDATAVGDEGGFAPNIQANAEAIDLIEEAIKAAGYTDKVRLGMDVAASEFYTGAKDARYNLDFKNANAPESEKISADKLQEMYEGFISKCASSSKIVSIEDPFDQDDWESWVKITGKVGKDVQIVGDDLTVTNPTRVKKAIELKACNALLLKVNQIGSITESIEAVTMAKKAGWAIMASHRSGETEDTFIASLAVGLSAGQIKTGAPCRSE

SEQ ID NO: 87555 - protein, 294 aa, Escherichia fergusonii
IVFRAAQKRSDIEIVAINDLLDADYMAYMLKYDSTHGRFDGTVEVKDGHLIVNGKKIRVTAERDPANLKWDEVGVDVVAEATGIFLTDETARKHITAGAKKVVLTGPSKDNTPMFVKGANFDKYAGQDIVSNASCTTNCLAPLAKVINDNFGMIEGLMTTVHATTATQKTVDGPSHKDWRGGRGASQNIIPSSTGAAKAVGKVLPELNGKLTGMAFRVPTPNVSVVDLTVRLEKPATYEQIKAAVKAAAEGEMKGVLGYTEDDVVSTDFNGEVCTSVFDAKAGIALNDNFVKLV

SEQ ID NO: 87556 - protein, 887 aa, Aspergillus nidulans FGSC A4
MSSHERESGMLSGIQNIIKRTDHLWHANHTKTAEARIFLCREAASLYGLRQNVRKNNNGMKETYTIGGVGILDLREMNGKSLPYSGVKQFVNTHTGAAPDHISTSFSYIAHILVLVSNYLSLRLPAEITLPHKDYPLPTIYTPSASYLPQELRAVPFSDQLPSSRPTSRTALAHASFPRPRPLCIDKSLPKLAKEDPGTYALFIEGVTLLAWNVSWLCRSQGLNLGSDSWEDVCDIGKNLWQLLVAPPGQSSALIATRKGSYQTRAHKDFPRTMIQRTKSFPMLGHYSHGTAHSFLGASEGTEFVRNWKLPSPTKVVDGLKSTLLGEMASAEWELLEENEWDDSRQPVSHESSHGSDLPHDDQSSYTSDTITLAPKLGAPDAPAIAARSKGTSGWTKLRHSSESRFCWFHELALLLVTQICTLWPESRLRLLICPKPKGPKIEHKQGHANMEYPKSQVSTPALLGIPNVVLPQEEQHRRNIYRDSSDGKSSCGSIKQGAYNTSLHVMALFLILVLSTLACSFPILARRFPRLPIPRRFLFLSRHFGTGVLIATAFVHLLPTAFVSLTDPCLPQFWSETYRAMPGFVAMISVFGVVLVEMFFAMKGAGHVHGSEYDQLISEANANGDRDSDYSRLEASESVDDIHLSAMRESSASMNMPRNSTEESSLDRSSTNFIKNGALPALGEGRNPVVRANLSSRYPAQVSSGPNMDDNTDPKMTLQNPHRQLLQCLLLEAGILFHSIFIGMAVSVATGTSFIVLLVAICFHQTFEGFALGSRIASLIPDLFPPSSMKPWLMSLAYGTTTPIGQAIGLVLHNFYDPASATGLLMVGITNAISSGLLLFAGLVELLAEDFLSEESYVILRGRRRLEACIAVAAGALLMAFVGAFA

SEQ ID NO: 87557 - protein, 196 aa, Mycoplasma mycoides subsp. mycoides SC str. PG1
MIKQASFITSSANKSNWIDDDVSEICLIGRSNVGKSSFINSLTNNNKLAKISNTPGKTRLLNFFEINKGEYRLVDAPGYGYAKVDDNLKIQFAKMMEEYFINRRNLKGVFLLLDLRHKPSNDDIMMYQFLKHYNIPVVIIGTKLDKLKKSEYVKNEKMIKETISFYQEDDFVKISNLNKTNIIKCYELIDKLLGSK

SEQ ID NO: 87558 - protein, 439 aa, Alkalilimnicola ehrlichei MLHE-1
MRKANNRMMDDTPSFPALNETRIAVIGLGYVGLPLAVALAERYPVVGFDIDTRRVIELRQGQDHTREVAPEALQAAEQLSYSDDIESLLGCNVYIVTVPTPIDAHRRPDLQPLRSASQTVGRVLGRGDVVVYESTVYPGATEEECVPVLERASGLRFNQDFYVGYSPERINPGDKAHTVRDIVKVTAGSTPEVAEYLDQLYASVITAGTHKAGSIREAEAAKVIENTQRDVNIALINELAMLFNRMGLDTEEVLRAAGTKWNFLPFRPGLVGGHCIGVDPYYLTHKAQALGHHPEMILAGRRINDGMGAYVADQLLRLMAQRHIPVPGARILVLGLTFKENCPDLRNTRVVDIVRCLEDYQAQVDVFDPWVDSGEARDEYAIEPIGEPGSAQYDAVLLAVAHREFVELGAEILRGWLRSGGVLYDLKSALPREAVDARL

SEQ ID NO: 87559 - protein, 169 aa, Zea mays
MGGGSGSFLKVLVNNMDVLAGPLVSLAYPLYASVRAIETKSAVDDQQWLTYWVLYSFITLFELTFAPVLEWLPFWSYAKLFFNCWLVLPQFNGAAHVYEHFVRPMIVNQQVVNIWYIPKKDESSRPDDFKSSNPRRSILEEVEVERRARIQLESEAREVNPFFNPEYQY

SEQ ID NO: 87560 - protein, 498 aa, Austrobaileya scandens
MRINPTTSGPGVSTLEGKNLGRIDQIIGPVLEVAFPPGKMPNIYNFLVVKGQDTVGQPINVTCEVQQLLGNNRVRAVAMSATDGLMRGMEVIDTGAPLSVPVGGATLGRIFNVLGEPVDNLGPVDTRTTSPIHRPAPAFIQLDTKLSIFETGIKVVDLLAPYRRGGKIGLFGGAGVGKTVLIMELINNIAKAHGGVSVSGGVGERTREGNDLYMEMKESGVINEQNIAESKVALVYGQMNEPPGARMRVGLTALTMAEYFRDVNEQDVLLFIDNISRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTSQRYKELQDIIAILGLDELSEEDRLTVARARKIERFLSQPFFVAEVFTGSPGKYVGLAETIRGFQLILSGELDGLPEQAFYLVGNIDEATAKAMNLEVESKLKK

SEQ ID NO: 87561 - protein, 401 aa, Glycine max
  misc_feature (166)..(166): Xaa can be any naturally occurring amino acid
MGLKIFMASFMMTSILFFLLFIPTRLTVQFSTLRPPVNYFSVPPKSSKAYPVTFAYLISASKGDVVKLKRLMKVLYHPGNYYLIHVDYGAPQAEHRAVAEFVASDPVFGQVGNVWVVGKPNLVTYRGPTMLATTLHAMAMLLRTCQWDWFINLSASDYPLVTQDGXDLIQAFSGLPRSTNFIQHSSQLGWKFNRRGKPIIIDPGLYSLNKSEIWWVIKQRSLPTSFKLYTGSAWTILSRSFAEYCIVGWENLPRTLLLYYTNFVSSPEGYFQTVICNSEDYKNTTVNHDLHYITWDNPPKQHPRSLGLKDYRRMVLTSRPFARKFKRNDPVLDKIDRDLLKRYHGKFSYGGWCSQGGKYKACSGLRTENYGVLRPGPSSRRLKNLLTKLLSDKFFHKQQCR

SEQ ID NO: 87562 - protein, 515 aa, Bradyrhizobium sp. BTAi1
MADYDLAIIGGGLNGVSLARDAVGRGLRVILVEQGDLGSAASSASSRLVHGDLASLERRRVLRVRAALAERDVWLRIAPHLVRPIRFAIPAHAEERPTWQLRTGLWLYDRLAARKRLPAATTLDVTHHPIGDALKRPIGTAFAYSDCVVDDSRLVVLTALDAAERGAAIRTGARCVRADRDRIWRLAIIDRGHRRIVTSRALANATGAWSVSTAETVLRQPPPWVVARQISQIVVPRLFDVDAVYVFQNHDGRLIFAQPYERDFTLIGTVAHEFKGDPAVVAMPAPDVAYLCRAANRYFRSDIQPVDVVRTVSGANMMLRAAGGERLETVVSLEASRTQAPLLTMCGGDVTTARRRAEQAINRLATFYPMSPRWTAGAPLPGGDFDWNRFDDLVDDVRERWRFLSEAEARRLAGAYGTRLADVLGDASSRAELGRAFGSQLTEAEVRYLMTKEWARFPDDVLWRRTKLGLTLGAAEQEALAAFMAAAARDQSTMAPHEVDGDSPARAVELQAIDG

SEQ ID NO: 87563 - protein, 378 aa, Zea mays
MPGGSSGPDGEVDAGFAKLQGEDFEYYMQTYSIMLGRNSKKSTVDVDLSSLGGGMNISRHHARIFYDFQRRRFALDVIGKNGCLVEGVLHLPGNPPVKLDSQDLLQIGDKKFYFLLPTRSIFASAAAARHAPIIPQQLPPPPYAHARAGRPRLSEFHDRSFEGDYGREVDEIGNGISETAMRGKLVKRNKKSSGDLDIYGGHRINVEAIGTLGEDSRSEIRSRGDRDIDNQQALQAEEKDVVSSVATVLSDLCGPGEWMPMAKLHNETVVSVAWSQQLQQFYRSYSKKQCSTEVLIIIIMGSRQVCPVELLEQFGNVWHPSRVRKYLTQDDWSPTETKGRPWFGLLALLRKYPEHFVINTRSKGRMTSEFVSLVSLLS

SEQ ID NO: 87564 - protein, 521 aa, Prochlorococcus marinus str. MIT 9215
MSNFSRYLSKNWLDDPKSNILSGLVVAFAMIPEAIAFSGIAGVDPKVGLFGAFCLSITIAIVGGRRGMITSATGSTALLMTGLVAYGESQAPGLGVSYLIAAGILTGIFQILWGYLRLAYQMRFVPTGVLSGFVNALALLIFQAQLPQLGIGIKESKGLVEQTLSQYPVNYQIPVVWILVILGLIIIYGLPKITKVVPSQLIAIIAITFISIFFNLDVPTVSDLGKLPDGLPSISLPFGSIENGKVPFSLETLGIILPTSLAISLVGLMETFLTQDILDDVTDTSSNKNKEARGQGIANIVASLFGGMAGCALVGQSVMNTENGGKSRLSTLSSGISLLIMIILLKAWIGAIPMAALVAIMITIAISTADLNGLKNIRKIPKSDTAVMLMTFAVTMLTKPHNLALGVIAGVALAAILFSRKVAKVITVSRAKENNLTTYNVKGQLFFVSKIYFLQGFDIHEHPENIVIDMSLAHIWDQSGVVALEQIIRKFQNGGSKVEIIGLNKESLNLFQRLGGIESAH

SEQ ID NO: 87565 - protein, 161 aa, Triticum aestivum
  misc_feature (106)..(106): Xaa can be any naturally occurring amino acid
LAGSADFFRDIVAGPFDKFTQVTLVDTLTGQEYSDKVTENCVNIWKSSEHYSVDEGHGSAATSELKAIFYPASFPTGSTIFFTHSADGVLQASTSNTHTNFNFIAXVAFSDDTKVPEQESARVDSRALSEAVLESIIGDNGVSPSARRSLAFRLCDLINHK

SEQ ID NO: 87566 - protein, 231 aa, Saussurea involucrata
MVVGLGSGVASSLTIQYLGQKLRVGLLRDVVGIPTSVGSASEAEKAGIPLHQYQDGSQIDLAFNDADIVEEGSLNAVIGHQRLQGEESIMEEKRISDVTENLILMLTEKQYKSVIEGAIPVLVKSVSWMDTAEEIDDLFVGDAEVRRRASIGHAGPTGGDFPLVTREGYNVLDVIFTSPISSLAEVAKLLDNIDGVACHGIITKTPCTAVMTTESGLYIIDNTVTSTTRSL

SEQ ID NO: 87567 - protein, 141 aa, Zea mays
  misc_feature (74)..(74): Xaa can be any naturally occurring amino acid
  misc_feature (91)..(91): Xaa can be any naturally occurring amino acid
  misc_feature (100)..(100): Xaa can be any naturally occurring amino acid
  misc_feature (102)..(103): Xaa can be any naturally occurring amino acid
  misc_feature (124)..(124): Xaa can be any naturally occurring amino acid
MASSMLSSAAVVTSPAQATMVAPFTGLKSSAAFPVTRKANNDITSIASNGGRVSCMKVWPPVGKKKFETLSLPXLTLPKLNWVKEVDYLLXHKWIPLCEXRXXSTDLCTVSTEAPRNTTMPGTXTWGKASLGPDALTLLQG

SEQ ID NO: 87568 - protein, 276 aa, Xanthomonas oryzae pv. oryzae KACC10331
MKAQSRERFAGIDRLYGVGTVERLSACRVAVVGMGGVGSWVVEALARTGVGQIRLIDADDLCVSNTNRQLPALAGQYGRNKARAMAERCVAINPDIEADAVEAFLTSGNIETLLGAGFDLVIDACDSFRVKVETIAWCRRRKLPLLTVGAAGGRTDPTLVRVRDVSRTEHDAMLALIRKKLRGEFNFPKNPQRYFGVPAVYSLENVKYPQADGSVCGIRPQLDADATLKLDCGAGLGAATHITGTFAFVAVGKALEMLLKPKAAAARPAAEAVAAS

SEQ ID NO: 87569 - protein, 422 aa, Oryza sativa
MDDRFFPNNIPGYADEGAPPPPAAAAAAAIPSTYSSSLHHLLSLPYPDLADRFLHAALHLKQKVVHETWDKRRRAAAAAGEAVGDFTLYTGALGTALLLFRAYLVTGDRADLATCAEIVAACDAASMGAEIATFICGRAGVCALGAVVAKHAGDEAGVAHYLSAFKEIKIHSKSPDELLYGRAGYLWACTFLNKHLGDNTIPPTTTDTVMRDIIRDGRTLSTIGCPLMYEWYGEKYWGAAHGLSGIMHVLLDMDLTKDDTECVKGTLRYMIQNRFPSGNYPVTEEDKHDRFVHWCHGAPGISLTLAKASQVFPEERFLEAIAEAAEVVWNRGLLKRVGICHGVSGNAYTFLALFRLTKKKEHLYRAKAFACFLLDRAKQLIADGIMHSGDEPYSLFEGQVGMAYLFLDMINPLDSRFPGYEL

SEQ ID NO: 87570 - protein, 375 aa, Sinorhizobium meliloti
MDARAAVAIQAGKPLEVMTVQLEGPRAGEVLVEVKATGICHTDDFTLSGADPEGLFPAILGHEGAGIVVDVGPGVTSVKKGDHVIPLYTPECRSCPSCLSRKTNLCTAIRATQGQGLMPDGSSRFSINGDKIHHYMGCSTFSNFTVLPEIALAKVNPDAPFDKICYIGCGVTTGIGAVINTAKVEIGATAIVFGLGGIGLNVIQGLRLAGADMIIGVDLNNDKKPWGEKFGMTHFVNPKEVGDDIGPYLVNLTKRGADHIGGADYTFDCTGNTNVMRQALEASHRGWGKSVIIGVAGAGQKIATRPFQLVTGRTWMGTALGGARGRTDVPKIVDWYMEGKIAIDPMITHTMPLDDINKGFELMHSGESIRSVVLF

SEQ ID NO: 87571 - protein, 149 aa, Populus trichocarpa
MSAGLAKCAKIRHIVRLRQMLRRWRNKARMSANRIPSDVPAGHVAVCVGTGCRRFVVRATYLNHPIFKKLLVQAEEEFGFSNQGPLTIPCDETLFEEMIRCISRSENGKSDLFVNLEDLQRYCHVGVKNAKLDFWTDSRPLLHSDNSFW

SEQ ID NO: 87572 - protein, 106 aa, Populus tomentosa
MAKLVAVFLLALIAISMLQTLVVASHGRGGHHQNKNQYGPGSLKSFQCPSQCTRRCSKTQYHKPCMFFCQKCCRKCLCVPPGYYGNKAVCPCYNNWKTKEGGPKCP

SEQ ID NO: 87573 - protein, 54 aa, Oryza sativa
PGSKQTVGSKCFAKCVTKPGSSLSGSESSCISRCVDHYIEATGIVSRALFSTTR

SEQ ID NO: 87574 - protein, 340 aa, Bifidobacterium longum DJO10A
MTTVLVTGGAGFIATHTDIELLNKGYDVISVDNYGNSSPVALERVEQITGKPVKRYDGDVRDEALMERVFAENNIDWVIHFAGLKAVGESVAKPIEYYDNNLYSTLVLLKVMKKHNVKKIIFSSSATVYGTPKELPITEETPTGGTTNPYGTSKLFQEQILRDVHVADPSWTIVLLRYFNPVGAHESGLLGEDPKGIPANLTPYVAKVAVGELKEVQVYGDDYDTPDGTGVRDYIHVVDLAKGHVAVIDHIDKEGVFVYNLGTGHGYSVLEVIKAYEKAAGHPIPYAIKPRRPGDIAACYADASKAEKELGWKAELTIDDMAASSLNWQTKNPNGFRDAE

SEQ ID NO: 87575 - protein, 187 aa, Triticum aestivum
MQNPSSNHPAPAAAAAGKSKSSGQAAATASGQGHQPSPTTPAAAKSKSSAAAGASGHGHNSSPATPAAGKSKVSAHAVAPGQASSSNQPHAVGGADAAASSLKRKRGVFQKDLQHMMYGFGDDPNVHKAQNVASKRGKLLTEDFLYLIRKDMRKLHRATELLSMNEELKQARKAFDVNEETLVVTNE

SEQ ID NO: 87576 - protein, 437 aa, Brassica napus var. napus
  misc_feature (150)..(150): Xaa can be any naturally occurring amino acid
  misc_feature (208)..(208): Xaa can be any naturally occurring amino acid
MKGVRKTYDNSYTLSSLFVFFVLIILRPIFSTTTLSSTESLTISSNRTLVSPGNIFELGFFNTTSSSRWYLGIWYKKISERSYVWVANRDNPLSNAAGTLKISGNNLVLLGHSNRSVWSTNLTRENERSPVVAELLANGNFVMRDTNTTXSSRFLWQSFDYPTDTLLPEMKLGYEPKTGLNRFLTSWRSSDNPSSGDFSYKLEARRLXELYLSSGIFRVHRSGPWNGIRFSGIPDDKKLSYLVYNFTENSEEVAYTFLMTNKSIYSRLTVSFSGYLERQTWNPTLGMWNVSWSLPFDSQCDSYRMCGPYSYCDVNTSPICNCIQGFIPSNVEQWDQRVWANGCIRRTRLSCSGDGFIRMKNMKLPETTMATVDRSIGVKECEKKCLSDCNCTAFANADIRNGWTGCVFWTGRLDDMQNYVTDHGQDLYVRLAAADLV

SEQ ID NO: 87577 - protein, 402 aa, Physcomitrella patens subsp. patens
MQIDAVRFKPLTEQEKIRHQYLPPRFSVAPMMDWTDNHYRTLARLMSKHAWLYTEMVVADTIIHQQDNLDKFLKFNEVQHPIVLQLGGSDPEKLLKASLLASVYEYDEINLNCGCPSEKVAGHGCFGASLMLESGLVAECMAAIAEGSPGTPVTVKCRIGVDDFDSYDLLHKFVTTVSSSSPTQHFVVHARKAILKGLSPAANRTIPPLKYEYVYALIRDFPNLKFTLNGGVVNTHQVNEALQEGVFGVMLGRAAYNYPWATLGNVDNSVYGDSTPRLTRRQILEKYVEYADAELHKYGPKKPSVRHLVKPLLGIFHAESGAGVWRRAVDNSLRNAETVGALLKETLCVLPDFVLDSPPPLEATHRWFTWSRSRESFRLLAPMSLPALHLLHHRLSFHQDHR

SEQ ID NO: 87578 - protein, 234 aa, Bartonella henselae str. Houston-1
MNVQQLKKMAALKALEFVEDDMRLGIGSGSTVNEFIPLLGERVANGLRVTCVATSQYSEQLCHKFGVPISTLEKIPELDLDIDGADEIGPEMTLIKGGGGALLHEKIVASASRAMFVIADETKMVKTLGAFALPIEVNPFGIHATRIAIEKAADNLGLSGEITLRMNGDDPFKTDGGHFIFDAFWGRILQPKLLSEALLAIPGVVEHGLFLGLASRAIVAMADSQIKVLEPFDF

SEQ ID NO: 87579 - protein, 436 aa, Frankia sp. EAN1pec
MHNSTSIFLELGVVLFSLGVLGHAATRFGISPIPFYLLGGLAFGHGGLLPLGASEEFIEVGAEIGVVLLLLTLGLEYTADELLSGLRRNAPAGGLDLALNAAPGVAAAFLLGWGWRAAVVLGGVTAISSSGIIAKVLGDLGRLGNRETPVVLSVLVIEDLAMAIYLPILTALLAGQTVARGSLSLALALAAMVTVLFLALKHSAKVTRLVFNPTSDRNDEIILLRALGLALLVAGVAQQLQISAAVGAFLVGIALSGPIAEGAREVLAPLRDLFAAVFFVFFGLQTDPEQIPPALLTALLLAIAGVLTKTATGWWAARRAGIGTMGRFRAGTALIARGEFSIVIAGLAVAADVEPQLGPLAASYVLLMAVIGPVAARLSEPATRAVIKRRRPTPAHSLPPQPEHRDRPTPPAPPAPTRSRPHHTQPETPQNTAATP

SEQ ID NO: 87580 - protein, 392 aa, Phytophthora nicotianae
LVTELGEYRAAVPSGASTGEFEALEMRDGGKDYMGKGVLNAVRNVNEIIAPALVGKDVTKQAEIDRFMVEELDGTQNEWGWCKKKLGANAILGVSLALCRAGAAAKKQPLWQHIADLAGNPTPCLPVPSFNIINGGSHAGNKLAMQEFMILPVGATSFTEAMKIGSEVYHNLKKVIKGRYGLDATAVGDEGGFAPNIQSNGEAIDLIEEAIKAAGYTNQVRLGMDVAASEFYTGAEDARYNLDFKNENAAESEKISADKLQEVYEGFIAKCANSSKIVSIEDPFDQDDWASWVKFTGKVGKDVQIVGDDLTVTNPTRVKKAIEQKACNALLLKVNQIGSITESIEAVTMAKKAGWGIMASHRSGETEDTFIASLAVGLSAGQIKTGAPCRSE

SEQ ID NO: 87581 - protein, 271 aa, Silicibacter sp. TM1040
MDMNEIAARGLVLLGCGKMGSAMLKGWLEGGLPREAVYVMDPNPSDWLKGTGVHINATVPEQPAIVLVAVKPQVMGAALPSAKSYGGGGTLFISVAAGTPISTFETMLGESTPIVRAMPNTPAAVGRGITALIGNAHVDEAKMAQADALLQAVGQTVRLDDEGQMDAVTGVSGSGPAYVFHLIETLAAAGVAQGLPEPLAMQLAKATVAGAGALAEAAEEDPSALRVNVTSPNGTTQAALEVLMDEETGFPPLLQRAVAAAAKRSEELSRG

SEQ ID NO: 87582 - protein, 392 aa, Phytophthora alni
LVTEIGEYRAAVPSGASTGEFEALEMRDGGKAYMGKGVLNAVKNVNDIIAPALIGKDVTKQAELDRYMVEELDGTQNEWGWCKKKLGANAILGVSLALCRAGAAAKKQPLWQYIADLAGNPTPCLPVPSFNIINGGSHAGNKLAMQEFMILPVGATSFTEAMKIGSEVYHNLKKVIKNRYGLDATAVGDEGGFAPNIQSNGEAINLIEEAIKAAGYTNQVRLGMDVAASEFYTGAEDARYNLDFKNENAAESEKISADKLQEVYEGFIAKCADSSKIVSIEDPFDQDDWASWVKITSKVGKDVQIVGDDLTVTNPTRVKKAIELKACNALLLKVNQIGSITESIEAVTMAKKAGWAIMASHRSGETEDTFIAGLAVGLSAGQIKTGAPCRSE

SEQ ID NO: 87583 - protein, 209 aa, Glycine max
MANYLASIFGTEQDKVNCSFYYKIGACRHGDRCSRKHVKPSYSQTILLPNLYQNPAYDPKNKMNPQQMQMHFDAFYEDIWCELCQYGLAEELVVCDNNNDHLIGNVYVRFKYEEDAQKACDALNSRWYAGRPIYCELSPVTDFREACCRLNSGEGCVRGGFCNFIHRKEPTAELDRELDMCTRKWLKERGRDARSMSRSPTPPATKNRF

SEQ ID NO: 87584 - protein, 315 aa, Helianthus tuberosus
MSISCSDCFSDLLCCEDSGILSGDDRPECSYDFEYSGDFDDSIAEFIEQERKFVPGIDYVERFQSQVLDASAREESVAWILKVQRFYGFQPLTAYLSVNYLDRFIYCRGFPVANGWPLQLLSVACLSLAAKMEETLIPSILDLQVEGAKYIFEPKTIRRMEFLVLSVLDWRLRSVTPFSFIGFFSHKIDPSGMYTGFLISRATQIILSNIQEASLLEYWPSCIAAATILCAASDLSKFSLINADHAESWCDGLSKEKITKCYRLVQSPKILPVHVRVMTARVSTESGDSSSSSSSPSPYKKRKLNNYSWIEEDKR

SEQ ID NO: 87585 - protein, 392 aa, Phytophthora bisheria
LVTELGEYRASVPSGASTGEFEALEMRDGGKDYMGKGVLNAVKNVNEIIAPALVGKDVTKQVELDRFMVEELDGTQNEWGWCKKKLGANAILGVSLALCRGGAAAKKQPLWQYIADLAGNPTPCLPVPSFNIINGGSHAGNKLAMQEFMILPVGATSFTESMKIGSEVYHNLKKVIKGRYGLDATAVGDEGGFAPNIQSNGEAIDLIEEAIKAAGYTDKVRIGMDVAASEFYTGAKDARYNLDFKNENAPDSENIPAEKLQEVYEGFIAKCADSSKIVSIEDPFDQDDWESWVKFTAKVGKDVQIVGDDLTVTNPTRVKKAIEQKACNALLLKVNQIGSITESIEAVTMAKKAGWGIMASHRSGETEDTFIADLAVGLSAGQIKTGAPCRSE

SEQ ID NO: 87586 - protein, 557 aa, Manihot esculenta
MDGTKEMGLRNVSSTCSISEMDDFDLSRLLDKPRLNIERQRSFDERSLSELSIGLTRGGLDIYESTYSPGGRSGFDTPASSTRNSFEPHPMVADAWEALRRSIVYFRGQPVGTIAAIDHASEEVLNYDQVFVRDFVPSALAFLMNGEPEIVKNFLLKTLHLQGWEKRIDRFKLGEGAMPASFKVLHDPIRKTDTLIADFGESAIGRVAPVDSGFWWIILLRAYTKSTGDLSLAETPECQKGMRLILTLCLSEGFDTFPTLLCADGCSMIDRRMGIYGYPIEIQALFFMALRCALSMLKHDTEGKECIERIVKRLHALSYHMRGYFWLDFQQLNDIYRYKTEEYSHTAVNKFNVIPDSIPDWVFDFMPTRGGYFIGNVSPARMDFRWFALGNCVAILSSLATPEQSMAIMDLIESRWEELVGEMPMKIAYPAIESHEWRIVTGCDPKNTRWSYHNGGSWPVLLWMLTAACIKTGRPQIARRAIDLAETRLLKDGWPEYYDGKVGRFIGKQARKYQTWSIAGYLVAKMMLEDPSHLGMISLEEDKQMKPVIKRSTSWTC

SEQ ID NO: 87587 - protein, 357 aa, Helianthus tuberosus
MAILSPYSSSFLDTLFCNEQQDHEYHEYEYEDEFTQTTLTDSSDLHLPPLDQLDLSWEHEELVSLFTKEQEQQKQTPCTLSFGKTSPSVFAARKEAVDWILKVKSCYGFTPLTAILAINYLDRFLSSLHFQEDKPWMIQLVAVSCLSLAAKVEETQVPLLLDLQVEDTKYLFEAKNIQKMELLVMSTLKWRMNPVTPISFLDHIVRRLGLTDHVHWDFFKKCEAMILCLVSDSRFVCYKPSVLATATMLHVVDEIDPPNCIDYKSQLLDLLKTTKDDINECYELIVELAYDHHNKRKHDANETTTNPVSPAGVIDFTCDESSNESWELNAHHFREPSFKKTRMDSTIRVRVWFTYKL

SEQ ID NO: 87588 - protein, 393 aa, Phytophthora capsici
LVTEIGEYRAAVPSGASTGEFEALEMRDGGKDYMGKGVLNAVKNVNEIIAPALVGKDVTKQAELDRFMVEQLDGTQNEWGWCKKKLGANAILGVSLALCRGGAAAKKQPLWQYIADLAGNPSPCLPVPSFNIINGGSHAGNKLAMQEFMILPVGATSFTESMKIGSEVYHNLKKVIKGRYGLDATAVGDEGGFAPNIQSNGEAIDLIEEAIKAAGYTDQVRLGMDVAASEFYTGASDARYNLDFKNENAPESEKISADKLQEVYEGFIAKCAGSSKIVSIEDPFDQDDWASWVKFTAKVGKDVQIVGDDLTVTNPTRVQKAIEQKACNALLLKVNQIGSITESIEAVTMAKKAGWAIMASHRSGETEDTFIADLAVGLSAGQIKTGAPCRSER

SEQ ID NO: 87589 - protein, 495 aa, Escherichia coli
MNFHHLAYWQDKALSLAIENRLFINGEYTAAAENETFETVDPVTQAPLAKIARGKSVDIDRAMSAARGVFERGDWSLSSPAKRKAVLNKLADLMEAHAEELALLETLDTGKPIRHSLRDDIPGAARAIRWYAEAIDKVYGEVATTSSHELAMIVREPVGVIAAIVPWNFPLLLTCWKLGPALAAGNSVILKPSEKSPLSAIRLAGLAKEAGLPDGVLNVVTGFGHEAGQALSRHNDIDAIAFTGSTRTGKQLLKDAGDSNMKRVWLEAGGKSANIVFADCPDLQQAASATAAGIFYNQGQVCIAGTRLLLEERIADEFLALLKQQAQNWQPGHPLDPATTMGTLIDCAHADSVHSFIREGESKGQLLLDGRNAGLAAAIGPTIFVDVDPNASLSREEIFGPVLVVTRFTSEEQALQLANDSQYGLGAAVWTRDLSRAHRMSRRLKAGSVFVNNYNDGDMTVPFGGYKQSGNGRDKSLHALEKFTELKTIWISLEA

SEQ ID NO: 87590 - protein, 363 aa, Pseudomonas syringae pv. tomato str. DC3000
MALNNIEELVEDIRQGKMVILMDDEDRENEGDLIMAAECVKPEHINFMARFARGLICMPMTRERCETLKLPLMAPRNGSGFGTKFTVSIEAAEGVTTGISAADRARTVQAAAAKEAKAEDIVSPGHIFPLMAQAGGTLARAGHTEAACDLARMAGFEPTGLICEVMNDDGTMSRRAELEEFTLQHDIKIGTIADLIHYRMIHERTVQRIAEQPMDSELGSFNLVTYRDSVEGDVHLALTLGKICAEEPTLVRVHNMDPLRDLLMVKQPGRWSLRAAMRAVSEAGSGVVLLLGHPLDGDVLLAHIRETAGQQPIKTPTTYSTVGAGSQILRDLGVRKMRLMSSPMKFNAISGFDLEVVEYVPSE

SEQ ID NO: 87591 - protein, 158 aa, Pseudomonas syringae pv. tomato str. DC3000
MTLKTIEGTFIAPQGRYALVVGRFNSFVVESLVSGAVDALVRHGVSESDITIIRAPGAFEIPLVVQKVAQRSEFAAIVALGAVIRGGTPHFEYVAGECVKGLSQVSMEFGVPVAFGVLTVDSIEQAIERSGTKAGNKGAEAALSAIEMVSLLSQLEAK

SEQ ID NO: 87592 - protein, 221 aa, Pseudomonas syringae pv. tomato str. DC3000
MQILRISSLHTDQEHTVPVVFVAASKLPTPFAEFAMHGFIESATGREHVVLSLGDVADGAPVLGRVHSECLTGDALFSQRCDCGSQLEAAMRAIATEGRGVLLYLRQEGRGIGLMNKIRAYELQDGGADTVEANERLGFAADQRDYAICLPMLQHLGVQSLRLMTNNPRKVKALTDMGINVAERVPLHTGQNPHNRLYLATKAGKLGHMMGNEHQSEVGPA

SEQ ID NO: 87593 - protein, 332 aa, Thermobifida fusca YX
MGADTSNKPEFKRSPSHFVDRITADGSEGWPVEAGRYRLIVSRACPWANRAMIARRLLGLESAISLAVADPIQDERSWRFTLDPDGRDPVLGIRFLAEAYYARDPEYTGGISVPAIVDIPSGKLVTNDYLHIPANFATEWRSLHREGAPDLYPEPLRDEIDEISEVIFRDVNNGVYVCGFARTQQTYERAFTALFTRLDALSERLSRQRYLVGDSITVADIALFVTLVRFDAVYHGHFKCNRNKLTEMPVLWAYARDLFQTPGIGDTVDFDHIKRHYYVVHRDINPSGIVPLGPDLSGWLTPHGREELGGRPFGDGTPPGPPPEAERIPAQW

SEQ ID NO: 87594 - protein, 631 aa, Pseudomonas syringae pv. tomato str. DC3000
MPTTFKEIPRERPVTPLLDQADTPHGLRRLGEAELETLADELRLELLYSVGQTGGHFGAGLGVIELTIALHYVFDTPDDRLVWDVGHQAYPHKILTGRRARMSTLRQKDGVAAFPRRSESEYDTFGVGHSSTSISAALGMAIASRLQGSERKSIAVIGDGALTAGMAFEALNHAPEVAANMLVILNDNDMSISRNVGGLSNYLAKILSSRTYTSMREGSKKVLSRLPGAWEIARRTEEYAKGMLVPGTLFEELGWNYIGPIDGHDLPTLIATLRNMRDLKGPQFLHVVTKKGKGFAPAEVDPIGYHAITKLEPLNAPVSVQKKVSSPKYSGVFGQWICDMAEADSRLVGITPAMKEGSDLVDFSERFPERYFDVAIAEQHAVTLAAGMACEGSKPVVAIYSTFLQRGYDQLVHDVAVQNLDVLFAIDRAGLVGEDGPTHAGSFDLSYLRCIPGIVVMTPSDENELRKLLSTGYLHTGPAAVRYPRGTGPNAVIEANLDPVEIGKGVVRRQGQGVAILVFGVQLAEALVVAEKLDATVIDMRFVKPLDEALVRETAASHELLVTLEENAVMGGAGAAVSEFLARANILKSVLHLGLPDVYVEHAKPAQMLAECGLDAEGIEAAINERLALIG

SEQ ID NO: 87595 - protein, 160 aa, Arabidopsis thaliana
  misc_feature (12)..(12): Xaa can be any naturally occurring amino acid
  misc_feature (21)..(21): Xaa can be any naturally occurring amino acid
  misc_feature (64)..(64): Xaa can be any naturally occurring amino acid
  misc_feature (96)..(96): Xaa can be any naturally occurring amino acid
QVLVPKQTGPQXLKMTRITCXDTLPLSSAMNFSIMLDRISAGPLIFACIIGGTSIVDLAEKFRXMIFLIALEGFEGITAGYAATGENDLAPMAADXFYSIEQVKKLYELFRNTDCTMLKINPLAWTSTNQLVTADALLNFNDIAVFRLPDVLAVRVSKQG

SEQ ID NO: 87596 - protein, 295 aa, Pseudomonas syringae pv. tomato str. DC3000
MIASYQAQSQTRVNAALEGLFQAPSPELSRLYEAMRYSVMNGGKRVRPLLAYAACEALGGVAEDANGAACAVELIHAYSLVHDDLPAMDDDDLRRGQPTTHKAFDEACAILAGDGLQSLAFTALLAPHLSSRNAATRLQMVSTLAAAAGPAGMVGGQAIDLGSVGLKLDQAALEYMHRHKTGALIEASVRLGALASGQADQARLDALQVYARAVGLAFQVQDDILDVESDTATLGKRQGADIARDKPTYPALLGLDAAKGYALELRDQALAALSLFDTTAEPLRELARYIVERRH

SEQ ID NO: 87597 - protein, 202 aa, Ajellomyces capsulatus
MTEERAAPLRLGSIAPNFKAVTTKGEIDFHEFIGDHYVILFSHPDDFTPTCTTELGAFAKLEPEFTARRVKLIGLSANALKSHFEWIKDIDEVTGSNLQFPIIADADRKISYLYDMLDYQDTTNVDEKEVAMTIRSVFIIDPNKKIRLILSYPATTGRNAAEVLRVIDALQTTDKNGVNTPINWTLGEDVIIPPDCEDRGRD

SEQ ID NO: 87598 - protein, 572 aa, Zea mays
TRPAKVPTPSSSSSADAKSIGAVAALKLSDRTCTGVLASHPLSRDIHIESLSLTFHGHDLIVDSELELNYGRRYGLLGLNGCGKSTLLTAIGCRELPIPEHMDIYHLTHEIEASDMSALQAVVCCDEERVKLEKEAEILAAQDDGGGDALDRVYERLEAIDASTAEKRAAEILYGLGFNKQMQAKKTRDFSGGWRMRIALARALFMNPTILLLDEPTNHLDLEACVWLEETLKKFDRILVVISHSQDFLNGVCTNIIHMQNKKLKLYTGNYDQYIQTRSELEENQMKQFRWEQEQIASMKEYIARFGHGSAKLARQAQIKEKTLAKMERGGLTEKVVRDKILVFRFTNVGKLPPPVLQFVEVTFGYTPDNLLYKKLDFGVDLDSRIALVGPNGAGKSTLLKLMTGELVPLDGMVRRHNHLRIAQFHQHLAEKLDLDMSALQYMMKEYPGNEEERMRAAVGKFGLSGKAQVMPMRNLSDGQRSRVIFAWLAYRQPQLLLLDEPTNHLDIETIDSLAEALNEWDGGLVLVSHDFRLINQVAHEIWVCENQAVTRWEGDIMDFKEHLRSKACLSD

SEQ ID NO: 87599 - protein, 408 aa, Listeria monocytogenes str. 1/2a F6854
MIDIQKIRADFPILDQEINEKPLAYLDNAATSQKPKQVIEALTHYYEFDNANVHRGVHTLAARATDAYESARGKVAKFIHAREVAEIIFTRGTTSAINLVVDSYAEANIEAGDEIVISYLEHHSNLIPWQQLAKRKGAVLKYIELEEDGTISVEQAKKTIGEKTKIVALAHVSNVLGTITPIKEIAAIAHQFGAVILVDGAQAVPHMEVDVVDLDADFYAFSGHKMMAPTGIGALYGKRELLDAMEPTEFGGEMIDFVELYDSTWKELPWKFEAGTPIIGGAIALGAAIDYLAEVGLENIQAHEQALASYAIEEMSKIEGITIYGPKDASKRCGLVTFNLEGAHPHDIATILDEDGVAIRAGHHCAQPLMKWLDVSSTARASFYIYNTKEEIDALIDGLKLTKEYFGL

SEQ ID NO: 87600 - protein, 594 aa, Oryza sativa Japonica Group
MSVEAVKQIVPAHLVKPAVDPVHAKASKAGKDGRSDLIAKEILEEQKPAHRRQESSESILDKGPSNVGSDSGVLDVPLTPKGDSGELKEIQGLDCNGNQEKKTAQKSSTSESFASAKVSDGTNGLRKTCGSGKVSDTADSTESGKSSMCRPSTSSNVSDESSCSSLSSSTTKPHKGSDSRWEAIRMIRSKDGILGLSHFRLLKKLGCGDIGSVYLSELSGTRSYFAMKVMDKGSLASRKKLLRAQTEREILQSLDHPFLPTLYTHFETDKFSCLVMEFCPGGDLHTLRQRQPGKHFSEQAAKFYVAEVLLALEYLHMLGIIYRDLKPENVLVREDGHIMLSDFDLSLRCAVSPTVVKSANPGPDALQRNNQAYCVQPACIQPSCIQPSCVAPTTCFGPRFFSSKSKSKSKKEKKSKPEVVNQISPLPELIAEPTDARSMSFVGTHEYLAPEIIKGEGHGSAVDWWTFGIFLYELLFGKTPFKGSGNRATLFNVVGQPLRFPESPMVSFSARDLIRGLLVKDPQHRLAYKRGATEIKQHPFFEGVNWALIRCASPPEIPKPVELERPPKPAPATEKVAPAANQKGSDNYLEFEFF

SEQ ID NO: 87601 - protein, 309 aa, Streptococcus pyogenes serotype M3
MIYLAEGCFWGVEEYFSQVDGVLDAVSGYANGRGDTTNYQLIHQTGHAETVEVTYDANRISLKELLLHFFRIIDPTSLNKQGNDRGSQYRTGIYYTDKADLAIIDEVFKEKAKDYKKKIVVEKAPLKHFIKAEEYHQDYLKKNPNGYCHIDINQATYPVIDESKYPKPSATEIKAKLSADEYRVTQKNETEKAFSNRYWDSFDAGIYVDVVTGEPLFSSKDKFESGCGWPSFSRPISPDVVRYKEDKSFNMTRTEVRSRSGNSHLGHVFTDGPKDQGGLRYCINSLSITFIPKADMEAKGYGYLLSSVE

SEQ ID NO: 87602 - protein, 463 aa, Bartonella henselae str. Houston-1
MGSFDFDLFVIGSGSGGVRAARLAGALGKRVAIAEEYRIGGTCVIRGCVPKKLYFYASQYAQEFSKSIGFGWKYADPIFNWEKLVAAKNKEISRLEGLYREGLQNSNVHIYESRAVFVDEHTLELSVTGERISAEKILIATGAKIVSNSAIKGSDLCLTSNEIFDLEKLPKSIVIVGGGYIGVEFANIFHGLGVKTTLLHRGDLILRNFDYDLRQLLNDAMVAKGISIIYEATVSQVQSTENCYNVVLTNGQTICADRVMLATGRVPNTTGLGLERAGVKVNEFGAVVVDEKMTTNVSHIWAVGDVTGHIQLTPVAIHDAMCFVKNAFENTSTTPDYDLITTAVFSQPEIGTVGLSEEDALHRYKRVEIYRTVFRPMRNVLSGSPEKMFMKLVVDGESRIVVGAHVLGENAGEIAQLIGISLKGKLTKDIFDKTMAVHPTMSEELVTMYKPSYVYENGEKLDN

SEQ ID NO: 87603 - protein, 121 aa, Zea mays
  misc_feature (21)..(21): Xaa can be any naturally occurring amino acid
  misc_feature (44)..(44): Xaa can be any naturally occurring amino acid
  misc_feature (48)..(48): Xaa can be any naturally occurring amino acid
  misc_feature (50)..(51): Xaa can be any naturally occurring amino acid
  misc_feature (71)..(71): Xaa can be any naturally occurring amino acid
  misc_feature (78)..(78): Xaa can be any naturally occurring amino acid
  misc_feature (84)..(84): Xaa can be any naturally occurring amino acid
  misc_feature (93)..(93): Xaa can be any naturally occurring amino acid
TVAEAEDEREEKAGNGDDDDXDADAAADAADEDAEDGEDEEDLXTDYXVXXNCRAEDEEDASDFEPEENGXEEDIDEXEDDDEXYSGAGKSEXPPKRKRGAAEKREEEDSDDEDDASLPKR

SEQ ID NO: 87604 - protein, 210 aa, Magnetospirillum magnetotacticum MS-1
MARTPSSDRPERGRGGERGDRPNRGRGGAEQTPREREESEFVDKLVHINRVAKVVKGGRRFAFAALVVVGDAKGRVGCGSGKAREVPEAIRKATEQAKRNMIKIALREGRTLHHDAYGHFGAGRVILRAAPAGTGIIAGGPMRAVFETMGVQDVVAKCLGTSNPHNMIKATFDALINLASPRHVAAKRGKKVGEIIGRRDGAAAAAAAGV

SEQ ID NO: 87605 - protein, 294 aa, Helianthus tuberosus
MEQYEKVEKIGEGTYGVVYKARDKVTNETIALKKIRLEQEDEGVPSTAIREISLLKEMQHGNIVRLQDVVHSDKRLYLVFEYLDLDLKKHMDSCPEFSKDPRLVKTFLYQILRGIAYCHSHRVLHRDLKPQNLLIDRRTNALKLADFGLARAFGIPVRTFTHEVVTLWYRAPEILLGSRHYSTPVDVWSVGCIFAEMVNQRPLFPGDSEIDELFKIFRIMGTPNEETWPGVTSLPDFKSAFPKWSSKDLATVVPNLEKAGLDLLCKMLWLDPSKRITARTALEHEYFKDIGFVP

SEQ ID NO: 87606 - protein, 464 aa, Bartonella henselae str. Houston-1
MVTNELKRGMSKRQVIFLALGSAIGTGLFYGSAQAIKLAGPSVLIAYCIAGLAVFMVMRALGEMIIHNPLPGSFARYAANYISPLAGFLTGWTYVFEMILVGLADITAFATYMAFWYPDVAPWIWALSITLIITGINLAAVEVYGELEFWLSSIKIIAIIAIIILGIAIIFCGLGTSTISSAVSVDNLWKNGGIFPNGWFGFFACFSVVIFAFGGIEIIGMAVMEVQNPHQTISKAINSTPIRILLFYIMTLTILMALYPWNAIGLMESPFVSIFESLGISSAANILNVVVVTAAISAMNSGMYGAGRMIYGLSQESYALKKFQYLSKNGIPIFVILLIFIIFLLGVILNYFYHDRLFFLIAAMATFATVFVWVMILLSQIFMRLKMSKEMQCSLKFPIPFWPIGSIFSILFMVFIFILLWFFDDTRPILIVGASWISWLIICFYALKLFNFWKKKQYQSMNKD

SEQ ID NO: 87607 - protein, 304 aa, Helianthus tuberosus
MEDKYEKLEKVGEGTYGKVYKAKDKNTGELVALKKTRLEMDEEGIPPTALREISLLQMLSTSIYIVRLLCVQHIQHKGKPILYLVFEYLDTDLKKFIDSHRKGPNPSPLPPSQIQSFLYQLLKGVAHCHGHGVLHRDLKPQNLLVDKEKGILKIADLGLGRAFTVPLKSYTHEIVTLWYRAPEVLLGSAHYSTGVDMWSVGCIFAEMSRRQALFPGDSEFQQLLHIFRLLGTPTEEVWPGVSSLKDWHVYPRWEAQNLARSVPSLGPEGVDLLSKMLKYDPADRISAKLAMDHPYFDSLDRSQF

SEQ ID NO: 87608 - protein, 389 aa, Phytophthora richardiae
EIGEYRAAVPSGASTGEFEALEMRDGGKDYMGKGVLNAVKNVNEIIAPALVGKDVTKQVELDRYMVETLDGTQNEWGWCKKKLGANAILGVSLALCRAGAAAKKQPLWQYIADLAGNPSPCLPVPSFNIINGGSHAGNKLAMQEFMILPVGATSFTEAMKIGSEVYHNLKKVIKGRYGLDATAVGDEGGFAPNIQANAEAIDLIEEAIKAAGYTNQVRLGMDVAASEFYTGAKDARYNLDFKNANAPESEKIPADKLQEMYESFISKCADSSKIVSIEDPFDQDDWESWVKFTGKVGKDVQIVGDDLTVTNPTRVKKAIELKACNALLLKVNQIGSITESIEAVTMAKKAGWAIMASHRSGETEDTFIADLAVGLSAGQIKTGAPCRSE

SEQ ID NO: 87609 - protein, 600 aa, Zea mays
MTVRPFGSIHIRWTSAKKAGPHVMDRERGRCGKDPSRRRKRAPSPPTDQGFEGWPLGRVSTAALEHSDFKPITDQGFEGWPLGRAGPSEGFNSRPRARRVRDDSGYVRYIAEARATLLRQVHASPEGLLRQRVPPRLSRGSARAGFIVKQPWPYRLTNRPLRRRIKCRGCLTPYPDTHASVGQAEVTAVTSPLFFTIRHDRKTASLAPLRLPCQPPRQRLTTSHDQPPSSSLGRNRKLRLARPHAPASEGGFRLARPHAPALRGDLRLARPSDSASTPVSGGIASSPDPGLDLKRSLRLDRPWAQTDRANRGNIISLFLACSGYEEQDRRPIWLTPATGLRRSSGGHAITCTGPKLSPNGHVGMYTGLRHSTAGYNGTTDQVEKIVKTLNEGNVPSSDVGEVVVSPPYVFLPVVKSQLRQEFQVAAQNCWVKKGGAFTGEISAEMLVNLGVPWVILGHSERRALLGESNEGLKVIACVGETLEEREAGSTMDVVAAQTKAIAEKIKDWSNVVLAYEPVWAIGTGKVATPAQAQEVHASLRDWVKINVSPEVSESTRIIYGGSVTAANCKELAAQPDVDGFLVGGASLKPEFIDIINAAAV

SEQ ID NO: 87610 - protein, 225 aa, Mycoplasma mycoides subsp. mycoides SC str. PG1
MKKYIIAPSVLSANFMDLKNELELCKKNNINWIHYDVMDFDFVPNLTFGSKILHDIKKNIDINVDVHFMVSVKTKQFEDFFSDYIKAKPEMMTMHIESLKDNNTIIKFIDLCKKNNILASLAISPKTDVSLVYPYLDKLDNVLVMSVEPGFGGQKFISSSLEKIQILDQLRKEKKYKYIIEVDGGINEQTSVLVKQAGVDMIVAGSYLFGSGDFTKRAKGLFDEL

SEQ ID NO: 87611 - protein, 436 aa, Manihot esculenta
ASRFGRRRPFIAAGAAFVAVAVFLIGFAADIGQLSGDPVAKSPKPRAIAVFVVGFWILDVANNMLQGPCRALLADLSGANQKKTRTANALFSFFMAVGNVLGYAAGSYTHLYKIFPFTKTKACDVYCANLKSCFFISIVLLLTLTVLALTYVREKQWSAEQGNTTAGDDEDEDGKSESSPMPFFGEIFAALKNLQRPMWILLLVTCLNWIAWFPFLLFDTDWMGREVYGGDSSGTAYQLKLYDRGVRAGALGLMLNSVVLGFTSLGVEALARGVGGVKRLWGIVNFVLAFCLCMTILITKLAESHRRFATVAGGATIPLPPPGGIKAGALALFAVMGVPQAITYSIPFAMASIFCNTAGAGQGLSLGVLNLSIVIPQMVVSVASGPWDALFGGGNLPAFVVGAVAAAASGIFALTLLPFPQGDIPSAKGLMPAAFH

SEQ ID NO: 87612 - protein, 389 aa, Phytophthora fragariae
EIGEYRAAVPSGASTGELEALEMRDGGKAYMGKGVLNAVKNVNDIIAPALIGKDVTKQAELDRYMVEELDGTQNEWGWCKKKLGANAILGVSLALCRGGAAAKKQPLWQYIADLAGNPTPCLPVPSFNIINGGSHAGNKLAMQEFMILPVGATTFTEAMKIGSEVYHNLKKVIKNRYGLDATAVGDEGGFAPNIQSNGEAINLIEEAIKAAGYTDQVRLGMDVAASEFYTGAEDARYNLDFKNENAAESEKISADKLQEVYEGFIAKCADSSKIVSIEDPFDQDDWASWVKITSKVGKDVQIVGDDLTVTNPTRVKKAIELKACNALLLKVNQIGSITESIEAVTMAKKAGWAIMASHRSGETEDTFIAGLAVGLSAGQIKTGAPCRSE

SEQ ID NO: 87613 - protein, 300 aa, Zea mays
AEAMESPFRADVVKDKAALVTGGGSGICFEIAAQLARHGAQVAIMGRRREVLDKAVAALRSQGLRAVGFDGDVRNQEDAARVLAATVAHFGKLDILVNGAAGNFLASPEDLTPKGFRTVLEIDTLGTYTMCYEAFKYLKKGGPGKGPSTGGLIINISATLHYSASWYQIHVSAAKAGVDSITRSLALEWGTDYDIRVNGIAPGPIQDTPGLRKLAPEEMSKGLREMMPLFKFGEKRDIAIAALYLASDAGKYVNGTTLVVDGGLWLSHPRHIPKEEVRELSKVVEKKVRASGVGVTSSKL

SEQ ID NO: 87614 - protein, 480 aa, Oryza sativa Japonica Group
MAAPQASPSPSAQVVGNAFVQQYYQILHQSPDLVYRFYQDASRLGRPPADRYGDMVSVTTMEAINEKIMAMDMSRAEIKTVDSQESLGGGVTVLVTGHLTVRDGVCREFSQSFFLAPQEKGYFVLNDMFRYVGDGPTPAAAAAAEVQPEADAVAPPLANGTATAPLQPAAPDYDAMPHEEPDVVENVAVPPEEEEEVYNPPLEEVEGGAVEEEQSVPEVINEVPNNVVPVVAPADAPVSHEEAPKKSYASIVKVMKEAPVPAPIPATRPAPAARPAPPKPEKQSPAPPAPAPVADATPFSSNAESSNTHEPEVDAHAIYVRSLPLNATTTQLEDEFKKFGTIKPDGIQVRSHKIQGFCYGFVEFEEATAVQSAIEASPVMIGGRQCFVEEKRTPGSRGSSRGGRFAPGRGNNNFRADGMRGRGNYSGGRSYGRGDFSYRSDYGGRGGGRGGSARGPDVGYQRVDGGRGGRTSAGPGAPAK

SEQ ID NO: 87615 - protein, 325 aa, Zea mays
  misc_feature (61)..(61): Xaa can be any naturally occurring amino acid
  misc_feature (107)..(107): Xaa can be any naturally occurring amino acid
MAAGRELVVSFGEMLIDFVPTVAGVSLAEAPAFLKAPGGAPANVAIAVSRLGGGAAFVGQXSRDDEFGRMLAAILRDNGVDDGGVVFDSGARTALAFVTLRADGERXEFMFYRNPSADMLLTADELNVELIKRAAVFHYGSISLIAEPCRTAHLRAMEIAKEAGALLSYDPNLREALWPSREEARTQILSIWDQADIVKVSEVELEFLTGIDSVEDDVVMKLWRPTMKLLLVTLGDQGCKYYARDFHGAVPSFKVQQVDTTGAGDAFVGALLQRIVKDPSSLQDEKKLVESIKFANACGAITTTKKGAIPSLPTEAEVLQLIEKA

SEQ ID NO: 87616 - protein, 498 aa, Gyrocarpus americanus
MRINPTTSGPGVSTLEGKNLGRIAQIIGPVLEVAFPPGKMPNIYNALVVKGRDTVGQQINVTCEVQQLLGNNRVRAVAMSATDGLMRGMEVIDTGAPLSVPVGGATLGRIFNVLGEPVDNLGPVDTRTTSPIHRPAPAFIQLDTKLSIFETGIKVVDLLAPYRRGGKIGLFGGAGVGKTVLIMELINNIAKAHGGVSVFGGVGERTREGNDLYMEMKESGVINEENIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTSQRYKELQDIIAILGLDELSEEDRLTVARARKIERFLSQPFFVAEVFTGSPGKYVGLAETIRGFQLILSGELDGLPEQAFYLVGNIDEATAKGMNLEVESNLKK

SEQ ID NO: 87617 - protein, 406 aa, Physcomitrella patens subsp. patens
MGIIGAILKNPEDLHHLLKLKMASAAANRAIPSDPNLAFCYQMLRRVSGSFSIVILQLEPGLRNAVCVFYLVLRGLQAVEDDLTIPYDLKVELLRNLHKKIFDRDFHFPCGNNDYKLLMDKFYLVILAFLGLTTGYQEVITEITERMGEGMVKYLNTEIISREDYNEYCHFSAGLMGLGLTRIFYTAGMEQFTPDYLSNAMGLFLQKTNVIRDYLENINAQPTSRLRWPKEVWSKYADKPEAFMDETNYKQGLHCLNEMVTDALSHGLDCLHYMAALQDQPNLRFCATFQITALGTLAMCYNNVEVFRGSVRMRRGLTAKILDVKNMVDVYGAFYDFTRLIAAKIDKTDPSAVTTHKFVDDIRSICRFEIKNRRAFTIESKFGHETFLVVALFVILVIMLLIVTKQ

SEQ ID NO: 87618 - protein, 130 aa, Brassica napus
MAIVPALQTTFVASTNFLKQARPSSSWGSSSPSNVTLPRNKRSSSVIVAAVGDVSSDGTIYLIAGAAAVALVGTAFPILFKRTDTCPECDGAGFVRKGGATLRANAARKDQAQIVCANCNGLGKLNQIDK

SEQ ID NO: 87619 - protein, 726 aa, Triticum aestivum
MGNPGAFHHSITLQSFTVFSLVAVFVADHHVQGGDDGCSLFSCGHLRDISYPFRRRGDPRECGVEAYELGCTSSKATIHINTGTYYVTAINYTGSYFWVMDPNFNTSSSCPLPLWNHLPYFGSGDHSTTDSASPVFHYLATQSYNRACFANCSRAVTNKSAYKPVACLSAKNSHVYVWVSDFLCMVDDLEPYCGYLAEIPSDSGQLQNASYADITQFISKGFTVQFPVGTRYSYRPSASVKLRKNINLCRNNSISYFKEQASCASIVNWTHAFLWSEVHFLECVTQNSYDHYYTTKLVLIVATIVSAIVIPKFFFVLCRFLLAPVAVWIFVAYKYWKTRIIIDAVEKFLRIQQMIGPTRYAYTDIVAVTSHFRDKLGQGGYGSVYKGVLLPGDVHVAVKMLEGNTNCNGEDFISEVSTIGRIHHVNVVRLVGFCSEEMRRAIVYEYMPHGSLDKYIFSPEKSFSWDKLNQIALGIARGINYLHQGCDMQILHFDIKPHNILLDSNFVPKVADFGLAKLYPRGDSFVPLSAMRGTVGYIAPEMISRSFGVISSKSDVYSFGMLLLEMAGGRRNADPNMGSSSQAYYPSWVYDQLTQEEAGEEISPVAADMHELEKKLCVVGLWCIQMRSHDRPMMSEVIEILEAGVDGLQMPSRPFFCDEGHIHVEDSYHFTSELMSMPAHSSFSSLLLGNRHVTEMYLYICLQEPDPSYLSWIQSRTKLIFNSSNN

SEQ ID NO: 87620 - protein, 346 aa, Xanthomonas oryzae pv. oryzae KACC10331
MRAMHFERFEQVPEILQLPDPPPSDDGVVIKVAATGICRSDWHGWMGHDPDIALPHVPGHEFAGEVVAMGKRISGFAIGTRVTVPFVSGCGRCVQCHGGNQQVCSNQFQPGFTAWGSFAEYVAIDFAETNLVRLPESIDDATAASLGCRFATSFRAVVDQARTGPGEWVVVHGCGGVGLSAVMIAAALGAQVIAVDIFDDKLAFAVECGAVATVNASKAANTVEAIREITKGGAHVSIDALGSPTTCFNSISNLRRRGRHVQVGLMLGEHATPRIPMAQVIGHELEIYGSHGMQAWRYDAMLAMIQAGKIAPQRLIGRRVCLDEAIAVLIGMDATRDLGISVIDRF

SEQ ID NO: 87621 - protein, 336 aa, Vibrio vulnificus YJ016
MNILVTGGSGYIGSHTCIQMIEAGMTPIILDNLYNSKLLVLDRIEQVTGVRPAFYQGDIRDSEILQHVFAQHDIQGVIHFAGLKAVGESVEKPLMYYDNNVSGTLNLVREMDKAGVKSLIFSSSATVYGDPASVPIREDFPTSATNPYGRSKLMVEECLTDFHKANPDWSITLLRYFNPVGAHESGLLGEDPQGIPNNLLPFVAQVAVGRREKLGVFGDDYPTPDGTGVRDYIHVIDLADGHLAALNKVGQQAGLHIFNLGTGQGNSVLEMVAAFEKAAQRPIPYEIKPRRAGDIAECWADPAYAEQVLGWKATRSLETMVVDTWRWQSNNPNGYE

SEQ ID NO: 87622 - protein, 167 aa, Bordetella petrii
MTIKVGDRVPDGTLTEFFETESGGCSLGPNNFQVADLVKGKTIAVFAVPGAFTPTCSAKHLPGYVQQAQALKDKGVDEIWCVSVNDAFVMGAWGREQQTAGKVRMLADGSAHWTRALGLELDLDARGMGVRSQRYSALLQDGVVKQLNIEAPGKFEVSDAATLLSQI

SEQ ID NO: 87623 - protein, 134 aa, Zea mays
  misc_feature (61)..(61): Xaa can be any naturally occurring amino acid
  misc_feature (112)..(112): Xaa can be any naturally occurring amino acid
NSAEKAGGSTSASWPGSGRAGASSAPSSWTASRRPTTVNPGLASLLVDPEFAHEIMDRQAXWRRLVCLAINNGVSTPGMCASLAYFDSYRMDRLTANLLQAHRDYFWAHTYXRVDMPGSFHTEWFKIARSIFYN

SEQ ID NO: 87624 - protein, 340 aa, Trichodesmium erythraeum IMS101
MRIGINGFGRIGRLALRAAWEWPELEFVHINEIKGGTAAAAHLLKFDSVHGKWSLDVEAAGEQVIIDGKPLSFSEYSEPGEVPWEKLGVDIVLECSGKFRTKSTLEPYFQNGVKKVIVAAPVKEEALNVVMGVNDNLYDPEKHHLLTAASCTTNCLAPVVKVIHEGLGIKHGVITTIHDNTNTQIIVDAPHKDLRRARATSLSLIPTTTGSATAIGLIYPELNGKLNGLAVRVPLLNASLTDCVFEVVRPTTVVEINSLLKTASETPPLKGILGYEERPLVSIDYKDDPRSSIIDALSTMVVDETQVKILAWYDNEWGYANRMVELARKVVVSWKSGLSF

SEQ ID NO: 87625 - protein, 487 aa, Lupinus albus
MDLGSKTNQLLSKIATNDKHGENSPYFDGWKAYDNNPFHPSKNPNGVIQMGLAENQLCFDLIEEWIKNNPKASICTLEGVHKFRDIANFQDYHGLPEFRNALANFMSKVRGGNVRFDPNRIVMSGGATGANEVIMFCLADPGDAFLVPTPYYPAFLRDLCWRTGLQLIPVECDSSNNFKITREALEKAYNKAKEDNINVKGLIITNPSNPLGTTLDRETLKSLITFINENNIHLVCDEIYAATVFSSPSYVSVSELIQEMDQPCKKDLIHIIYSLSKDMGFPGFRVGIVYSFNDEVVNCGRKMSSFGLVSSQTQHMLASMLSDDSFVDKFLAESKKRLAKRHNIFSKVLEEVNITKFPSNAGLFCWMNLKSLLKEQTFEAEMMLWHMIINEVKLNVSPGSSFNCSEPGWFRVCFANMDDETVEVALTRIRTFIGKETKKPEMQVKSWQRNLQLSFSSIRRFVHETIMSPHMMSPHSPIPQSPLVKAT

SEQ ID NO: 87626 - protein, 348 aa, Triticum aestivum
GSRPDPRVQAPVAASGGDDGPPRYLRPEAAAEAVTGDADGEAQIPIIDHRRLLLELDHGGEESARLHRACQDWGFFQLVNHSVPDDVGESGKANIQQFFQLPAETKKRFAQEQGQLEGYGQLFVVSDDQKLDWADMLFLYAQPPERRKTRFWPDQPATFRSTLDRYSGALKDVSDSLLATMAKNLGLKRETIAEKCTRGMQSFRMNYYPPCAQAEKVIGLSPHSDANLLTLVLQVNHVQGLQIKRNGSWLPVKPVPGAFIVNIGDMLEVFTNGRYRSIEHRAVVDPKEERLSVAAFHFPDMDAMIGPLEELTAHEDDAYKTLDLESFMKIFFATKLEGKSFLDRMKLN

SEQ ID NO: 87627 - protein, 391 aa, Phytophthora nicotianae
VTELGEYRAAVPSGASTGEFEALEMRDGGKDYMGKGVLNAVRNVNEIIAPALVGKDVTKQAEIDRFMVEELDGTQNEWGWCKKKLGANAILGVSLALCRAGAAAKKQPLWQHIADLAGNPTPCLPVPSFNIINGGSHAGNKLAMQEFMILPVGATSFTEAMKIGSEVYHNLKKVIKGRYGLDATAVGDEGGFAPNIQSNGEAIDLIEEAIKAAGYTNQVRLGMDVAASEFYTGAEDARYNLDFKNENAAESEKISADKLQEVYEGFIAKCANSSKIVSIEDPFDQDDWASWVKFTGKVGKDVQIVGDDLTVTNPTRVKKAIEQKACNALLLKVNQIGSITESIEAVTMAKKAGWGIMASHRSGETEDTFIAGLAVGLSAGQIKTGAPCRSE

SEQ ID NO: 87628 - protein, 393 aa, Phytophthora ramorum
LVTELGEYRAAVPSGASTGEFEALEMRDGGSDYMGKGVLNAVKNVNEIIAPALVGKDVTQQVELDRYMVETLDGTQNEWGWCKKKLGANAILGVSLALCRGGAAAKKQPLWQYIADLAGNPSPCLPVPSFNIINGGSHAGNKLAMQEFMILPVGATSFTEAMKIGSEVYHNLKKVIKGRYGLDATAVGDEGGFAPNIQANAEAIDLIEEAIKAAGYTDKVRLGMDVAASEFYTGAKDARYNLDFKNANAPESEKISADKLQEMYEGFISKCASSSKIVSIEDPFDQDDWESWVKITGKVGKDVQIVGDDLTVTNPTRVKKAIELKACNALLLKVNQIGSITESIEAVTMAKKAGWAIMASHRSGETEDTFIADLAVGLSAGQIKTGAPCRSER

SEQ ID NO: 87629 - protein, 498 aa, Trachelium caeruleum
MRLNPTTSGSGVSTLEKNKPGRIGQIIGPVLDVAFPPGKMPNIYNALVVKGRDTLGQPINVTCEVQQLLGNNRVRAVAMSATDGLMRGMEVIDTGTPLSVPVGGATLGRIFNVLGEPIDNLGPVDTRTTSPIHRSAPAFIDLDTKLSIFETGIKVVDLLAPYRRGGKIGLFGGAGVGKTVLIMELINNIAKAHGGVSVFGGVGERTREGNDLYKEMKDSGVINEQKFAESKVALVYGQMNEPPGARMRVGLTALTMAEYFRDVNKQDVLLFIDNIFRFVQAGSEVSALLGRMPSAVGYQPTLSTEMGSLQERITSTKKGSITSIQAVYVPADDLTDPAPATTFAHLDATTVLSRGLAAKGIYPAVDPLDSTSTMLQPRIVSDEHYQTAQSVKQTLQRYKELQDIITILGLDELSEEDRLTVARARKIERFLSQPFFVAEVFTGSTGKYVGLVETIRGFELILSGKLDVLPEQAFYMVGNIDEATAKAMNLEMESNLNK

SEQ ID NO: 87630 - protein, 170 aa, Colwellia psychrerythraea 34H
MRIGHGFDVHKFGGKGPLVLGGVKIPFELGFIAHSDGDVAIHALCDAILGALCLADIGNHFPDTDGQYENISSRILLRHVVSLMTDKGFQLGNADITIVAQAPKMAPHLVAMRTCLSEDLKTTIEQVNVKATTTEKLGYTGRKEGISVHAVVLLIAIEHPLPLIEEIQNI

SEQ ID NO: 87631 - protein, 349 aa, Pasteurella multocida subsp. multocida str. Pm70
MEKKIYFGTNLKMYKGNCETVDYLTQLLALREKLQSDYDIELFVIPSYIALKDAVHAAASETTHKILIGAQNMNAKDKGQFTGEISPLMLKELGVQLVMIGHSERRHVLKETDQEENEKVLSALKHGFKTLLCVGETLEQKNYQISDEVLRTQLKIGLHGVSVKQLPHLFIAYEPVWAIGEGGIPATAQYADEKQKIIKQCLFEMFGEESKKIPVLYGGSVNLENANELIMQPHIDGLFVGRSAWDAQCFYTLIDGALKALAGTTHQFSPIATQLIKHLGGKENISALTHCASRIRVMTRNENHINKVAIEKINGVSGLFSIANQYQIIVGPKWVEKIYSEMKALLETE

SEQ ID NO: 87632 - protein, 390 aa, Phytophthora medicaginis
LVTEIGEYRAAVPSGASTGEFEALEMRDGGKDYMGKGVLNAVKNVNEIIAPALVGKDVTKQAELDRYMVETLDGTQNEWGWCKKKLGANAILGVSLALCRAGAAAKKQPLWQYIADLAGNPSPCLPVPSFNIINGGSHAGNKLAMQEFMILPVGATSFTEAMKIGSEVYHNLKKVIKGRYGLDATAVGDEGGFAPNIQANAEAIDLIEEAIKAAGYTNQVRLGMDVAASEFYTGAKDARYNLDFKNANAPESEKIPADKLQEMYEGFISKCADSSKIVSIEDPFDQDDWESWVKFTGKVGKDVQIVGDDLTVTNPTRVKKAIEQKACNALLLKVNQIGSITESIEAVTMAKKAGWAIMASHRSGETEDTFIADLAVGLSAGQIKTGAPCR

SEQ ID NO: 87633 - protein, 408 aa, Agrobacterium tumefaciens str. C58
MAAPYDVEAVRKDFPILSREVYGKPLTYLDNGASAQKPQVVIDAVSHAYSNEYANVHRGLHFLSNAATDAYEAAREKVRRFLNAGSVDEIVFTKSSTEAINTVAYGYGMPVIGEGDEIVISIMEHHSNIVPWHFIRERQGAKLVWVPVDDDGAFHIEAFEKSLTERTKLVAITHMSNALGTILPVKEICRIAHERGIPVLVDGSQGAVHMPVDVRDIDCDWYVMTGHKLYGPSGIGVLYGKTERLREMRPFQGGGEMILDVSEDNVTYNEPPHRFEAGTPPIVQAIGLGYALDYMDNLGRAAIAAHEADLAAYAATRLREVNSLRIIGNAPDKGGIFSFELEGIHAHDVSMVIDRRGVAVRAGTHCAMPLLKRFGVTSTCRASFGLYNTRAEVDRLVEALDYARKFFA

SEQ ID NO: 87634 - protein, 389 aa, Phytophthora heveae
EMGEYRAAVPSGASTGEFEALEMRDGGAAYMGKGVLNAVKNVNEIIAPALVGKDVTQQAELDRYMVETLDGTQNEWGWCKKKLGANAILGVSLALCRGGAAAKKQPLWQYIADLAGNPTPCLPVPSFNIINGGSHAGNKLAMQEFMILPVGASSFTEAMKIGSEVYHNLKKVIKGRYGLDATAVGDEGGFAPNIQSNGEAIDLIEEAIKAAGYTNQVRLGMDVAASEFYTGAEDARYNLDFKNENAPESEKISADKLQEVYEGFIEKCAGTSKIVSIEDPFDQDDWASWIKFTGKVGKDVQIVGDDLTVTNPTRVKKAIEQKACNALLLKVNQIGSITESIEAVTMAKKAGWAIMASHRSGETEDTFIADLAVGLSAGQIKTGAPCRSE

SEQ ID NO: 87635 - protein, 157 aa, Dehalococcoides sp. BAV1
MRIGNGYDVHRLAPGQKLVLGGVEIPFECGLIGWSDADVLTHAIMDSLLGAAALGDIGLYFPPGDPKYKGISSLKLLEQVTDLLAKKGFGIINVDSVIVAEEPKLRGHIDTMRKYLAKAMGIDPGRVGIKASTSEQLGFVGRQEGMVAWAVALVDEK

SEQ ID NO: 87636 - protein, 644 aa, Cryptococcus gattii
MAFSPSLTPSRPAPVPPRRAAGTAHHMIGVTDTAAAPQSNFSSTSYSPSFSYTNSSIQSTKIADTRRSRTIRSGAASIKEEGLRAFMWSKRWLVLGSAELRIYKNESSSSPVYTVSLEDIQDVQRVDLKPYCVEIETSDKLLYFAFRSDNEVYGWMDDINSRTPRLGVSQPTNFVHQVHVGCDPKSGGFTGLPPQWSKLLTSSAITEEEAARNPEAVLDVLQFYTQQQASDVLEGYQKFPLPSVSNQYLTTGAAATRFEGVGLGGQQQQQQQRLRSAPFAATGSLVTTVVSGPRSFDTETKTLAQKEKEIVLNPQRQPLDSVTRPSVGKNDKEKVMRSPGPTVEKRISTMNEVQIMEKLRSVVSAKDPSQLYSKIRKVGQGASGMVFVAKTLSNGKKVAIKQMDLSQQPRKELIVNEIIVMRESQHPNVVNFLDAFLVRGSELWVVMEYMEGGALTDVIENNKLEENQIAAICLETCRGLQHLHSRSIIHRDIKSDNLLMNTQGEVKITDFGFCAKLTDQKSKRATMVGTPYWMAPEVVKQKEYGAKVDIWSLGIMAIEMIENEPPYLDEEPLKALYLITTNGTPTLKSPEKLSQDLKHFLSVCLCVDVAFRATSTELLKHEFLQLACSVQDLAPLLRFKQDTL

SEQ ID NO: 87637 - protein, 300 aa, Lactobacillus sakei subsp. sakei 23K
MKVRKAVIPAAGLGTRFLPATKAMAKEMLPIVDKPTIQFIVEEAKASGIEDILIITGKGKRPIEDHFDSAPELEQNLKSKNKTKMLKMVNETTDMGVNLYFIRQSHPNGLGDAVRLAKSFVADEPFVVMLGDDLMEDKVPLSKQLINEYEETHASQLAVMKVPHNEVDKYGVINPENKVKDDLYNVKNFVEKPDVDKAPSDLAIIGRYLLTPEIFDVLENQKPGLGGEIQLTDAIDELNKTQRVFAHEFKGRRYDVGNKFGYLETSIEYGLKHPEVKDDLKKYIIKLGEELKQSEKKENK

SEQ ID NO: 87638 - protein, 478 aa, Bradyrhizobium sp. BTAi1
MRRLRRIKILATLGPASSDSAMIRKLFEAGADIFRINMSHTPHDKLRELVATIRSVEASYGRPIGILVDLQGPKLRLGTFADGPVQLNNGQSFVLDADKTPGDATRVHLPHPEILAALQPGHALLLDDGKVRLIAEETSPTRAVTRVVIGGRMSDRKGVSLPDTDLPVSAMTPKDRADLEAALNIGIDWIALSFVQRADDVLEAKKIIRGRAAVMSKIEKPQAIERLNDIIDASDALMVARGDLGVELPLERVPGLQKLMTRLARRAGKPVVVATQMLESMIQSPVPTRAEVSDVATAVYEGADAIMLSAESAAGKYPIEAVSTMNRIGEEVERDVVYRSVIAAQRPEPESTAGDAIAEAARRIAENLDLPTIICWTSSGSTAVRVARERPKPPVVAITPNLATGRRLSVVWGVHCVVAEDARDQDDMVERAGSIAFRDGFVRAGQRVLVVAGVPLGTPGTTNMVRIAYVGPSSEALL

SEQ ID NO: 87639 - protein, 242 aa, Zea mays
MATAGKVIKCRAAVAWEAGKPLSIEEVEVAPPQAMEVRIKILYTALCHTDVYFWEAKGQTPVFPRILGHEAGGIVESVGEGVTELAPGDHVLPVFTGECKECAHCKSEESNMCDLLRINVDRGVMIGDGKSRFTISGQPIFHFVGTSTFSEYTVIHVGCLAKINPEAPLDKVCILSCGISTGLGATLNVAKPAKGSTVAIFGLGAVGLAAMEGARLAGASRIIGVDINPAKYEQAKKFGCTE

SEQ ID NO: 87640 - protein, 488 aa, Corynebacterium efficiens YS-314
MTIRAAVSHPVGPSGRNPGTGQMRDAMQCGHGAGCGSRPPRCPRRPSIRGAVTHPRLTPWPPQKKYLFTGFKREQVFRFMVECVKGRPNVLAIVLAGGEGKRLFPLTEDRAKPAVPFGGTYRLIDFVLSNLVNAGYLKIAVLTQYKSHSLDRHISVSWNVSGPTGQYIASVPAQQRLGKRWFTGSADAILQSLNLISDEKPDYVIVFGADHVYRMDPSQMVDEHIKSGKSVSVAGIRVPRHEATAFGCIQSDDEGNITEFLEKPADPPGTPDDPDVTFASMGNYVFTTEALVRALKDDSENEDSEHDMGGDIIPYFVDRGDAHVYDFSRNIVPGATERDKGYWRDVGTIDAFYECHMDLISVHPIFNLYNKEWPIHTTVEGNLPPAKFVQGGIAQSSMVAPGSIISAGTVRNSVLSTDVIVEEGATVEGAVLMPGVRIGKGAVVRHAILDKNVVVRDGELIGVDHDRDSQRFKVSAGGVVTVGKNQVV

SEQ ID NO: 87641 - protein, 451 aa, Oryza sativa Japonica Group
MEAAAAMEAGRKLAARHPHGRSRTAHNMSSSSLRKKSDAALVRKVPVAPLRPLLANLQEVFLATKLAVLFPAVPLAIAAQCFRFDQVWVFALSLLGLIPLAERVSFLTEQIALYTGPTVGGLLNATCGNATELIIALFALLKGKIEVVKCSLLGSVLSNLLLVLGTSLFCGGVVNLGARQPYDRNQSDVSTALLFLAVLCHSAPLLLRYAVAAGEHSVSATSAAASLDLSRACSFVMLASYVAYLFFQLKTHRQLFEPQEVDGGDAGDDDEEPALGFASALFWLALMTAVISVLSEYVVGTIEPTSQSWGLSVSFISIILLPIVGNAAEHAGAIIFALKNKLDITLGVALGSATQISMFVVPLSVLVAWIMGVQMDLDFKLLETGSLFMAVLVTAFTLQDGTSHYLKGILLLLCYIVIGACFFVARQPAGHANSNGALLDVPTGSMSVQAA

SEQ ID NO: 87642 - protein, 392 aa, Prochlorococcus marinus str. MIT 9215
MSQINLSERALSIEPSLTLQISARANQLSAEGVDICNLSAGEPDFNAPKEVIEATSKAIFDGFTKYGPAAGNLDLRKAIANKLQIQNNLNFKFENVMITNGAKQAIYNLFQVLLNIGDEVIIPSPYWLSYPQMVRLAGGKPIFTNSSAEDGFKINIKDLKSKISSKTKFIIINSPNNPTGRIMSKEELMQIADLAREHPNINILSDEIYELILKKEFKHYSLSTLANDLKDRIFIINGFAKGWAMTGWRIGYLVGPKDVIKASSALQSQSTSNVCSFVQKGALEALKVNNEFFSMINSHYDQRRSLLYEGLKNINGIYIEEPNGAFYAFPRLPNSSITSVDFCNKVLQDFGLVVVPGKAFGADECIRISCAASEAKIKDGLDRFEKAISQYY

SEQ ID NO: 87643 - protein, 166 aa, Arabidopsis thaliana
VIFNVVIEISKGSKVKYELDKKTGLIKVDRILYSSVVYPHNYGFVPRTLCEDNDPIDVLVIMQEPVLPGCFLRARAIGLMPMIDQGEKDDKIIAVCVDDPEYKHITNINELPPHRLSEIRRFFEDYKKNENKEVAVNDFLQPGPAIEAIQYSMDLYAEYILHTLRR

SEQ ID NO: 87644 - protein, 593 aa, Pseudomonas aeruginosa
MHRTSRRTFVKGLAATGLLGGLGLWRAPAWALAGPGQQNLLAGDSFDLFIGETPVNLSGSPAAAMTINGSLPGPTLRWREGDNVTLRVRNRLAEDTSIHWHGIILPANMDGVPGLSFEGIAPGGLYEYHFKVRQNGTYWYHSHSGLQEQAGVYGALVIDAREPEPFSYDRDYVVLLSDWSDEKPQRILAKLKKQSDYYNFHKRTVGDFIDDVSANGWAATLADRKMWAEMKMSPTDLADVSGYTYTYLLNGQPPDGNWTGLFRPGEKLRLRFVNASAMSYFDVRIPGLKMTVVAADGQHVEPVSVDELRIAVAETYDVIVEPGGERAYTLFAQSMDRSGYARGTLALAEGLSAPVPTPDPRPLIGMDDMGMGGMDHGAMGHGAATRPASEMDHSKMAGMDMNGMDHSRMGMDTMPMQSHPASEDGNPLVDMQTMTPTPKLADPGLGLRDNGRRVLTYADLRSRFADPDGREPGRTIELHLTGHMEKFAWSFDGIKFSDAEPLRLTYGERLRIVLVNDTMMTHPIHLHGMWSDLEDEQGNFLVRKHTIDMPPGARRSYRVTADALGRWAYHCHLLFHMEMGMFREVRVDEGDNA

SEQ ID NO: 87645 - protein, 724 aa, Gibberella zeae PH-1
MKTAAYMAMAFGLASAFENVPRNLDEPCECDLEDPCYVAVQANKAVLCAPNVFSECDISMIPDACSGDSDKLRREAVNEACTCELPSTTTTTADASTETASTEAGTATTDAGTATTDAATTDAATTDAATTDGTAAGTATTGTEDVSLSTEIGTETTDVATDVTTDAATGATTETSAPTTTEEDCDDETTTEEGTAPATAPVDTATESAPTGTESAPVDTATGTAPVDTATESAPTGTESAPVDTATGTAPVDTATESAPTGTESAPVDTATESAPTGTAPVDTATESAPTGTESAPVDTATGTAPVDTATESAPTGTESAPVDTATESAPTGTETAPVDTKTDSVPTGTETAPVDTKTDSVPTGTETAPVDTTQTGANGVSTTGATVPYTTKTVYTTAVNTYTKCPDYVKDCPAGGNGPYTVTETVAVSTTVCPVTEEYPSKPTGYSPEKYTTKTIYSTEVYTVTKCPPSVKDCPYGSVTTKTYPVSTTVCAVTEEHPSKPTGYAPPNTSTLYTTKTTYSTKVYTVTECGPEVKDCPYGSVKTETVPCTTVYATGTKEIPSYPTVVIPGKPEHPTPEHPEKPEYPTPETPAQPEHPETPAQPEKPEYPAPEHPAKPEHPETPAQPEKPEYPAPEHPAQPEHPAQPEHPETPSKPEEPAKPHYPAPPAAETDSGYKAPAPSQPSATVPYHQPTGTAPAVEVTAGASRFGVEMAVAAAGIFAILL

SEQ ID NO: 87646 - protein, 284 aa, Physcomitrella patens subsp. patens
DLDTGHSDPQMCSAYAADIYMHLRMAEVKRRPTTDFMEAMQKDINPSMRGILIDWLVEVAEEYKLVPDTLYLTVAYIDRFLSCNTVTRQRLQLLGVSCMLIAAKYEEICAPRVEEFCYITDNTYQREEVLEMERKVLSQLKFELTTPTTKSFLRRFIRAAQASCKASTLVLEFLGNYLAELTLTEYSMLGFLPSMVAASAVYMARLTLDPSSCPWDATLQHYTGYKASALEKCVRDIHDLQRNSKNCTLPAIREKYRLHKFKCVATLTPPSVLPPEFFKDLQHC

SEQ ID NO: 87647 - protein, 131 aa, Alkalilimnicola ehrlichei MLHE-1
MVEVEKSDAEWRAQLTDEQYAVCRQGGTEQPFSGAYYHCKEPGTYHCVCCDAPLFSSRAKYDSGSGWPSFWAPISDDHLRILEDRSLGMVREEVRCARCDAHLGHVFPDGPMPTGLRYCINSVCLDLKRSG

SEQ ID NO: 87648 - protein, 224 aa, Triticum aestivum
  misc_feature (56)..(56): Xaa can be any naturally occurring amino acid
MDRMRDALERAKMLVGMEFDEESAPPPPEEQSFFDDINRHCTLNTTQESRRLLLLXRLYGFATCLAAGLTCTFLSMIVFFNPVKFGVTFTLGNAMALGSTAFLIGPKRQFDMMLDPVRIYATAIYIASIIISLFCALLVHSKLLTLLAIVLEFGALIWYSLSYIPFARSVVSKLMASCFDTEFGLDRDHRIRKPANKCMHNHAFSRGSPREQRSSCSRRFQDKR

SEQ ID NO: 87649 - protein, 240 aa, Zea mays
MMEGGSRADGRNPNQLRPFTCTGNPLHRAHGSARWAQGDTVVLAAVYGPKPGTRKGENPEKASIEVVWKPKTGQIGRQEREYEMTLKRTLQSICLLTVHPNTTTSVVLQVVGDDGSLMSCAINASCAALAFAGIPMKHLAVAISCGVMDNGVVILDTSRAEEQQARSFAHLVFPNSRKSVESKDPTQRDEESERGLITCITHGAMSEDDYFNCIERGVMASSRISDFMRKTLQKEVSRDA

SEQ ID NO: 87650 - protein, 601 aa, Vibrio vulnificus YJ016
MMALTSDFLQTSVVFLSAAVVAVPLAQRSGLGSVLGYLLAGVAIGPWGLGLISDVDAILHFAELGVVLLLFLIGLELNPKKLWQMRGPILGLGGAQVVITTLLIACIIQWFGVSWNTALVIGMGLALSSTAIALKVLEEQGLARTETGQSGFAVLLFQDIAVIPMLALLPLLAGSGMSGDWLSSLLTFSAVVGLLVGGHFLLRPLFRYVVLTGVRELFTVTALLVVLGIAMLMQQLGLSMALGTFLAGVLLAESEYRHELEIAIEPFKGLLLGLFFIAVGMAVNLGLLVVHPIEVISAVLGLVALKGAVLYLLGRVSRMRAKARSRMAAILSQGGEFAFVIFTAASKEGLLNPSEVSFLLVVVSLSMVTTPLLLNIQKWWYARTLNQESDVLAPDVVDTEPRVIIAGFGRFGQIVGRLLYANKIKVTVLESDASQIQLLRKYGYKVFYGDATQLDLLRAAGAAKAEALVICTDSPDQVMSIVELCQQHFPNLKVLARARSRVEAYQLLSHGVSTYSRETFLGALDLGRQTLVEIGMHPYQAKRAEAHFRKLDNAMLKELLPQHNQDKKLAQRAKEARKELEEIFAHEMENDHQSRNFWDER

SEQ ID NO: 87651 - protein, 140 aa, Brassica napus
GKGRILKEGERVALLGYGSAVQSCLGAAVMLQERGLNVTVADARFCKPLDRALIRSLAKSHEVLITVEEGSIGGFGSHVVQFLALDGLLDGKLKWRPMVLPDRYIDHGSPADQMAEAGLMPSHIAATALNLIGAPREALY

SEQ ID NO: 87652 - protein, 157 aa, Colwellia psychrerythraea 34H
MIELNQLMPVGELQELKNGEMTTHNTAELFAAKKVVLFAVPGAFTPTCSAAHLPGYVVSADELKAKGVDAIICLSVNDAFVMNAWGESQNAENIMMLADGDGSYTKALGLSMDTATFGGVRSQRYAMIIDNGEVISLHVEEPKSFEVSKAEVILDQL

SEQ ID NO: 87653 - protein, 389 aa, Phytophthora hibernalis
ELGEYRAAVPSGASTGEFEALEMRDGGADYMGKGVLNAVKNVNEIIAPALVGKDVTQQVELDRYMVETLDGTQNEWGWCKKKLGANAILGVSLALCRGGAAAKKQPLWQYIADLAGNPSPCLPVPSFNIINGGSHAGNKLAMQEFMILPVGATSFTEAMKIGSEVYHNLKSVIKGRYGLDATAVGDEGGFAPNIQANAEAIDLIEEAIKKAGYTDKVRLGMDVAASEFFTGAKDARYNLDFKNDNAPESEKISADKLLEVYEGFISKCAASSKIVSIEDPFDQDDWESWVKITGKVGKDVQIVGDDLTVTNPTRVKKAIELKACNALLLKVNQIGSITESIEAVTMAKKAGWAIMASHRSGETEDTFIADLAVGLSAGQIKTGAPCRSE

SEQ ID NO: 87654 - protein, 500 aa, Brassica napus
MGRKMLADGELDKAVAAEEATEAHYDFDLFVIGAGSGGVRAARFSANNGAKVGICELPFHPISSEEIGGVGGTCVIRGCVPKKILVYGATYGGELEDARNYGWEINENVDFTWKKLLQKKTDEILRLNNIYKRLLANAAVKLYEGEGRIVGPNEVEVRQIDGTKISYTAKHILIATGSRAQKPNIPGHELAITSDEALSLEEFPKRAVVLGGGYIAVEFASIWRGMGGTVDLFFRKELPLRGFDDEMRALVARNLEGRGVNLHPQTSLTQLTKTDEGIKVISSHGEEFMADVVLFATGRNPNTKRLNLEAVGVELDQAGAVKVDEYSRTNIPSIWAVGDATNRINLTPVALMEATCFANTVFGGKPTKADYSNVACAVFCIPPLAVVGLSEEEAVEKATGDILVFTSGFNPMKNTISGRQEKSLMKLIVDEQTDKVIGASMCGPDAAEIMQGIAIALKCGATKAQFDSTVGIHPSSAEEFVTMRTVTRRIAYKAKPKTSL

SEQ ID NO: 87655 - protein, 411 aa, Zea mays
CRQWLRSIKKHAFVASPYPVIITLEDHLPSQLQEKVAKMVVEVFGNILYYPPDDTHELKELPSPEQLKGRVLLSTKPPKEYLETKLSDSTKEGDADLHLGKGTGDDAVWGKEVPDFRTEIQSAEKDDENDDVDDEEEQKLQPHIAPQYKHLITIRAGKPKDSLADALKSDPEKVRRLSLSEQQLAKAAKDHATEIVRFTQRNILRIYPKGTRVTSSNYNPFVGWVHGAQMVAFNMQGYGRALWLMHGFYKANGGCGYVKKPDFLMQTEPQVFDPREPQPVKKTLKVKVYMGDGWRMDFKQTHFDQYSPPDFYTRVGIAGVPADSVMKKTNAIEDNWTPVWEKEFSFPLTVPELALLRVEVHEYDMSEKDDFGGQTVLPVSELRPGIRAVALFDRKGMKYNHVKLLMRFEFA

SEQ ID NO: 87656 - protein, 311 aa, Debaryomyces hansenii CBS767
MTLKVAFLGPEGTYTHQALIQQFGTESDVEIYSQAAISDCFQVLDSKEVDYAVVPFENSTNGQVVYTYDLLRDWYIPSSQDQNNDENQHIAPKFRIVGEQFVSIHHNFLSNAKTLDDVTTIYSHPQVWGQVTKFLSKHITKKISKLDSDSTSKAAEIVNNDKSGTSACISSKISADLYQLPILFENIENSSNNTTRFLVLGYDEINSHPLGPENDSHPKAYVTSIIFTLDHDDPGALCAVLDTFKKNNINLTSINSRPSHLKQWQYVFFVELVGSINDENVSASINSLSSNCLTLEVLGSFQRCWRYWSEQ

SEQ ID NO: 87657 - protein, 192 aa, Listeria innocua Clip11262
MNLPNKLTVIRIFMIPIFVVLCVVPFDWGSVSWLDSTIPVTSLVATIIFIVAALTDWFDGHLARKYNLITNFGKFADPMADKLLVAAAFIILVEMHIAPSWVVILIISRELAVTGLRLLLVEGGEVLAAGQLGKIKTFTQMIAIPLMLLNNFPFAWTGIRVDLIFLYVCAFFAVWSGIDYFYKNRGVFKGSM

SEQ ID NO: 87658 - protein, 410 aa, Oryza sativa Japonica Group
MGVVGALLGPEAEALVRLRAAAWRLRREVAAATDDDEHWAFAYSMLHRVSRSFAIVIQQLGPDLRNAVCVFYLVLRALDTVEDDTSIPTEIKVPILQEFHRHIYNRDWHFSCGTKDCKILMDKFHYVLTAFLELGSGYQEAIEEITRRMGAGMAKFICKEVETVDDYDEYCHYVAGLVGIGLSRLFHAAGLEDLAPESLSNSMGLFLQKVNITRDYLEDINEIPKSRMFWPREIWSKYVDKLEDLKYENNSVKAVKCLNEMVTNGLIHTEDCLRYMSALKDITILRFCAIPQVMALATYALCYNNVNVFRGVVKLRRGLTARIINETNSMADVYTAFYEFSSLLAEKIDDNDPNASLTRKRVNAIKETCKSSGLLKIRGYDLDRPKRNPAMIMMLLLLLVAIFLGALYRR

SEQ ID NO: 87659 - protein, 497 aa, Aspergillus nidulans FGSC A4
MTPSLQRQLFYDGKPQHASSGRTFQSINPADATLLAEIPVASQSDIDAAITAAERAFPSWAQTPPIARARILQKAAALLRERNDEIARVETLDSGKAYSETSTVDVVTGADVLEYYANLVGGGGLNGETTQLREEAWVYSKKAPLGVCVGIGAWNYPIQIALWKSAPCLAAGNTMVYKPSEFTSLHGQTLAEIYKEAGLPDGVFNVVYGAGDVGSYLTSHPTVAKVSFTGQVSTGMKVSGAAAGNMKYVTMELGGKSPLLILPDADLENAVDGAMMANFYSTGQVCTNGTRVFIPKSMKKDFESRLVEKMQYIRPGPLFDENTNFGPLSSAVHQEKVTAYIRHGIEQDKATLLYGGLGKPSLPKDLEAGFWVRPTIFTDCTDDMRIVKEEIFGPVMSILTYDSVEEAVKRANTTELGLAAGVFTKDLNLAHRIIDQLEAGITWVNTWGESPAEMAVGGWKKSGLGVENGRRGIEAWVRNKSTLVDMGNAVATVFAKL

SEQ ID NO: 87660 - protein, 175 aa, Pseudomonas syringae pv. tomato str. DC3000
MSYSKIPAGKDLPNDIYVAIEIPANHAPIKYEIDKDTDCLFVDRFMATPMFYPANYGFIPNTLADDGDPLDVLVVTPYPVTPGSVIRARPVGILHMTDDGGGDAKVIAVPHDKLSQLYVDVKEYTDLPALLLEQIKHFFENYKDLEKGKWVKIEGWGNADAARAEIMKSVEAFKG

SEQ ID NO: 87661 - protein, 388 aa, Bartonella henselae str. Houston-1
MTTEIRVPTLGESVTEATVGKWFKKLGEAVAVDEPLIELETDKVTVEVPSPVAGKLSEIIAKEGDTVEVKALLGLVEAGAAGISQSFSPSATPIPEVPSELKQSSSSGAMQKDTMPPSPSAAKLMAENNIAKSNISGSGKRGQILKEDVLGVLEQEVKAPSVSAASSSASLVQEKHEERVRMTKLRQTIARRLKDAQNTAAMLTTFNEVDMSAVMDLRKRYKDLFEKKHGVKLGFMGFFTKAVCHALKELPAVNAEIDGTDIVYKNYVNVGIAVGTDKGLVVPVVRHADQMSLAEIEKEIGRLGRLARDGKLAVSDMQGGTFTITNGGVYGSLMSTPILNAPQSGILGMHAIKERAMVVGGQIVIRPMMYLALSYDLEEHHKKLFVLH

SEQ ID NO: 87662 - protein, 413 aa, Leptosphaeria maculans
MLSQRSQRNTSEIIPRLLREYHQPQAGNIDILDLSQAENSVLRDETLDEIRSAIGKHLNGSNLSYPTGVGGELAARKSLAMFFNDRFNPARSVSPDHIVMTPGASEALETLIFHICDPGEGVLIAAPYWSGLDLALETRSLARIVQVNIPLHEFFEMSSIQYYERALATSPIPIKAILMCNPHNPLGQCYNADVLEGLLGFCQRNKLHYISDEVYGMSVFSDSDKGVTPAFTSILSHATAPGLTSWVHMVYSLSKDFGCSGLRLGAIVTQGNTDLLLGSALITNNKVSSLTSVIVPSLLEPRTTQKLLNQNLRSRLNLNYGKVQRFLENRGLEFVPAKAGLFVFACLGKTRTEKEQLLLIECMKRSGVKLVAGTSFHFEQFCWFRIMFSLPKNIVDVALQRIGDALDETEKLL

SEQ ID NO: 87663 - protein, 265 aa, Lactobacillus sakei subsp. sakei 23K
MITLKSEREIKGMAASGAVIAGVHRGLRDIIKPGISSWVIEEFANDYIEKQGAKASEKGFEGYKYATCVCVNDEVAHAIPRKNLILKEGDIVTVDMTVNLDGYESDSCWTYAVGEIAPELQKLMDDTRKALYLGIDQAVVGNRLGDIGHVIQQYTEVENNYGDVRELIGHGIQPTMHEQPNVPSYGEAGKGLRLKEGMTITIEPMVILGGTWHIKAKTVPGDDWEYYVSADGTACAQYEHTIAITKDGPKILTSQDPEMDAKYLL

SEQ ID NO: 87664 - protein, 208 aa, Physcomitrella patens subsp. patens
MYGLSRLVQGQRSVLSRCVLQHVRVGGGAFSFGSQTRKETGQATTKESLEEHGFESTTIADILKEKGQQADGSWLWCSVDDTVYDAVKSMTAHNVGALLVVKSGAEKKLAGIITERDYLRKIIVQGRSSKTTKVGDIMTEENKLITVKPDTKVLRAMELMTDNRIRHIPVVEESGMKGMVSIGDVVRAVVDEHREELQRLNSFIQGGY

SEQ ID NO: 87665 - protein, 492 aa, Wolinella succinogenes DSM 1740
MAQKTLLIITDGIGHKPSSPHNAFTQAKKPTYDSLFASAPHALLSTHGLSVGLPEGQMGNSEVGHMCIGAGRILYQDLVKISLALKDGSLEKNPTLLGFSSRAKRIHLAGLASDGGVHSHMEHLLGLAQIFSRLGHEVLLHLITDGRDVSPTSSKEFIAQALALESDLIKIATISGRYYAMDRDKRWDRIKRAFGVIARGDSPTSLTPQEYIQAQYQAGITDEFIEPAALGGYQGFEPSDGFVFANFRSDRAREIVSALGGASFEGFDRGAYQPPKTLAMTSYDDSFPFPILFPKEKVEPTLAQVISEAGLSQLHVAETEKYAHVTFFFNGGIETPWENESRVLIPSPSVATYDLKPEMSAPEVAEATLSGMRQGYDFIVVNFANGDMVGHTGNTEAAISAVESVDRELGRLLEEAKKSGYAVILTSDHGNCEEMRDERGSMLTNHTVGEVWCFILAQGVTEIREGGLNQVAPTVLKIMGLPTPKEMDSPLF

SEQ ID NO: 87666 - protein, 506 aa, Pseudomonas syringae pv. tomato str. DC3000
MRYAHPGTEGAIVNFKERYGNYIGGEFVAPVKGQYFTNTSPVNGKPIAEFPRSTAEDIDKALDAAHAAAAAWGSTSVQARSLVLLKIADRIEANLEVLAITETWDNGKAIRETLNADIPLAADHFRYFAGVLRAQEGSAAEIDGNTVAYHIHEPLGVVGQIIPWNFPILMAAWKLAPALAAGNCIVLKPAEQTPLGISVLIELIGDLLPAGVLNIVQGYGREAGEALASSKRIAKIAFTGSTPVGSHIMKLAADNIIPSTVELGGKSPNIFFEDIMSAEPEFIDKAAEGLVLAFFNQGEVCTCPSRALVQESIYPQFMEAVLRKVEKIKRGDPLDTDTMVGAQASEQQFDKILSYLEIAKGEGAELLTGGKVEKLEGDLSTGYYIQPTLLKGNNKMRVFQEEIFGPVVSVTTFKDEAQAVAIANDTEFGLGAGLWTRDINRAYRVGRAIKAGRVWTNCYHLYPAHAAFGGYKKSGVGRETHKIALEHYQQTKNLLVSYDTNPLGFF

SEQ ID NO: 87667 - protein, 634 aa, Xanthomonas oryzae pv. oryzae KACC10331
MTQESSAPLLFADLGLSGAVMRAVANVGYESPSPIQAATIPALLAGRDVLGQAQTGTGKTAAFALPVLSNADLNQVKPQALVLAPTRELAIQVAEAFQKYAEAIPGFRVLPVYGGQPYAQQLSALKRGVHVVVGTPGRVIDHLDRGTLDLSQLKTLVLDEADEMLRMGFIDDVEAVLKKLPEKRQVALFSATMPPAIRRIAQTYLKDPAEVIIAAKTTTSANIRQRYWWVSGLHKLDALTRILEVEPFDGMIIFARTKAGTEELAQKLQARGLAAAAINGDMQQAAREKTIAQLKDGKLDILVATDVAARGLDVERISHVLNYDIPYDTESYVHRIGRTGRAGRTGDAILFVTLREKGMLRSIERATRQPIEEMQLPSVDAVNDTRVARFMTRITETLAGGQIDMYRDLLQRYEAENNVPAIDIAAAMAKLLQGDAPFLLTPPVRGAREDAAPRERHQRADRGDRPRFEPKFERGPRADGERAPRPPRGDDAGGERPRRDPVAPRGEPELGMESYRIEVGHSHGVKPANIVGAIANEAGLESRYIGRIDIQDDYSILDLPADMPRELLTHLKKVWVSGQQLNMRKLEEGEAAASPAKPRFPRGGKPSGRSNGPVRPMDRAGAPHRKGPPKPRGE

SEQ ID NO: 87668 - protein, 112 aa, Brassica napus
MQPSGLKETQLNNNNNNQKVHPQPMEQQQSINQNPEAMEALISNLFGNISSLKSAYIQLQSAHTPYDPDKIQEADKVVISELKNLSELKHLYRENNPKPVCVSPQDSRLAAE

SEQ ID NO: 87669 - protein, 533 aa, Alkalilimnicola ehrlichei MLHE-1
MLANDTPLRAAVSAPHHLAAEAGAGVLREGGNAIEAMVAAAAAIAVVYPHMNGLGGDSFWLLREPGRAPLGIEACGPAAVGATPAWYRDRGLTVIPSRGGAAANTVAGTVAGWQVALALSRSQWSGRLPLHRLLAPAVAHAREGYPMTHSQAEATRDKHPELGPQPGFDAQYLPGGAFPVPGETFRQPELASTLERLAAVGLADFYSGELAQALGEGLAEAGSPIRAPDLAGYAARRVAPLNMRHSLGTLWNMPPPTQGLASLMILGVFDRLQRRHPVAAESAEWLHAMVEAVKQAFLVRDRVVTDPAYLPEDPAQWLKPEALDALADRVDWSRALAWPQPASPGDTVWLGAIDAEGRCVSFIQSLFHEFGSGVVVPDTGVIWQNRGCSFSLAPDALNDLKPGRRPFHTLNPALAVLDDGRTLVYGTMGGEGQPQTQAAVFTRVALYGQSPEQAVASPRWLLGRTWGAGTDTLKLEADFPPELVEALRGRGHDVEVVPPRNSAMGHAGLLVRDRAGHVRAASDPRSDGGVAGL

SEQ ID NO: 87670 - protein, 289 aa, Vibrio vulnificus YJ016
MSAKHPIIAVTGSSGAGTTTTSEAFRKMFNMMNIKPAWVEGDSFHRFTRPEMDVEIRKAKEQGRHISYFGPQANDFPALGEFFRQYGKSGTGEVRRYLHTFDEAVPYNQMPGTFTPWQKLPENTDVLFYEGLHGGVVDGEVNVAQHVDFLIGMVPIVNLEWIQKYVRDTRDRGHSREAVMDSIVRSMDDYLNYITPQFSRTHINFQRVPTVDTSNPLNAKGIPSLDESFVVIRLRGIKNVDFPYLLAMIDGSFMSRHNTLVVPGGKMSFAMELIVQPILQQLIETGKIG

SEQ ID NO: 87671 - protein, 309 aa, Vibrio vulnificus YJ016
MRFFTPRSSPSQVDGDVGCTLDSSRHRHFSIYAITDNVNLQQQGGVMTPAVLFQSLWNDYIQRLCPSAAKVHQLLEEDEPLINDHIALRTFNVAPLGIETLAKPFLKLGYVACGDYLFKSKKLIAKHFEHPDPTQPKVFISALKVDECSAELQAIVEKLVAQVDASRLEDSAFLHGGRLWDLSFADYQTLAKESEYASWLAAHGYGANHFTVSVNQLKALDSVKGVNDHLRNAGFVINEVGGEVKGSPEVLLEQSSTMADKVAVHFSEGSEIVPGGFYEFAKRYPMDNGELYPGFVEASADKIFESTNG

SEQ ID NO: 87672 - protein, 87 aa, Triticum aestivum
MNSATSLEPRAKATLVLGGESFTVSSESGTLSEQLAAMREKSMVILKEYITKHNVPNDVPDESIEGPSDEEGEALAKNPPKKSKKQK

SEQ ID NO: 87673 - protein, 120 aa, Triticum aestivum
  misc_feature (9)..(9): Xaa can be any naturally occurring amino acid
  misc_feature (13)..(13): Xaa can be any naturally occurring amino acid
  misc_feature (22)..(23): Xaa can be any naturally occurring amino acid
  misc_feature (44)..(44): Xaa can be any naturally occurring amino acid
  misc_feature (54)..(54): Xaa can be any naturally occurring amino acid
  misc_feature (56)..(56): Xaa can be any naturally occurring amino acid
  misc_feature (65)..(65): Xaa can be any naturally occurring amino acid
  misc_feature (72)..(72): Xaa can be any naturally occurring amino acid
  misc_feature (80)..(82): Xaa can be any naturally occurring amino acid
  misc_feature (91)..(91): Xaa can be any naturally occurring amino acid
  misc_feature (102)..(102): Xaa can be any naturally occurring amino acid
  misc_feature (106)..(106): Xaa can be any naturally occurring amino acid
  misc_feature (108)..(110): Xaa can be any naturally occurring amino acid
LTWARYSFXAPLXKVEGRAIHXXIAYDKGDVDDDIERRSFTFNXSNLVELTQKXHXETGIDDLIXCTRSPIXGKVTPLLXXXPPNNAAMHXVLVREVLKKWXETFXWXXXSKTQGRRVLQ

SEQ ID NO: 87674 - protein, 403 aa, Vibrio vulnificus YJ016
MTVEMKVERGLFDEVMVPCYNPMEMIPVKGQGSRIWDQNGNEYIDFAGGIAVSCLGHCHPVMVNALTEQAGKLWHLSNVMTNEPALRLAKKLTEVSFAERVFFANSGAEANEAALKLARRYAADVYGPEKSEIIAFKQGFHGRTFFTVTVGGQAAYSDGFGPKPGDVTHLPYNDIEALQAHISDRTCAVMMEPLQGEGGIIPPTAEFIQAVRELCDKHNALLVFDEVQTGNGRTGEFYAYQGLGVTPDILSTAKSLGGGFPIGAMLTTAKLAEHLKVGTHGSTYGGNPLACAVAEAVVTEVSKPETLQGVKEREQWFREGLAKLNEKYQIFAEIRGKGLLLGAALNEQWQGRARDVLVAAGKEGLLVLVAGANVVRFTPSLVITKQEIEEGFAKLDKAIASLV

SEQ ID NO: 87675 - protein, 391 aa, Phytophthora bisheria
VTELGEYRASVPSGASTGEFEALEMRDGGKDYMGKGVLNAVKNVNEIIAPALVGKDVTKQVELDRFMVEELDGTQNEWGWCKKKLGANAILGVSLALCRGGAAAKKQPLWQYIADLAGNPTPCLPVPSFNIINGGSHAGNKLAMQEFMILPVGATSFTESMKIGSEVYHNLKKVIKGRYGLDATAVGDEGGFAPNIQSNGEAIDLIEEAIKAAGYTDKVRIGMDVAASEFYTGAKDARYNLDFKNENAPDSEKIPAEKLQEVYEGFIAKCADSSKIVSIEDPFDQDDWESWVKFTAKVGKDVQIVGDDLTVTNPTRVKKAIEQKACNALLLKVNQIGSITESIEAVTMAKKAGWGIMASHRSGETEDTFIADLAVGLSAGQIKTGAPCRSE

SEQ ID NO: 87676 - protein, 527 aa, Cytophaga hutchinsonii ATCC 33406
MHTILPFLLAMIAVIVLLNMWATKLQIAYPILLVIAGLLISFIPGLPAVKIDPDLIFFIFLPPLLFDASWSVSFKEMKKWWRIIGSFAFLVVFFTALSVAIVTNHFIPGFTIALGFLLGGIVSPPDAVSTGAITKFVKIPKATSAILEGESLLNDASSLIIFRFALIVIGTGQFIWHEAAVSFLWMIVGGAGIGLLLGWLFVQAHKRLPTDAPSDIALTLIEPYFMYWIAEQLHSSGVLAVVSGGLFMSARRLIFLSSTSRIRAFSVWESFIFILNGIVFLIIGLELPEIVDGLRSQDIPLTTAIKYGVLVTGVLIAARIISSYAAMLATFIFRRNTARNLTSGRSWLLMPLLLGWTGMRGVVSLAAALAIPITLDDGTAFPHRNLILFITFVVILLTLVVQGLTLPYFIKNIPFFNGILNEETEAADRLKMKQGLKLHVYQVLKNKYDNELNGHAGMEKFLQQWEERAKATDDNWMNEKTKVIFIELLESQRQYLTELNKDPKINEEIIRQQLYQIDLEEERLRII

SEQ ID NO: 87677 - protein, 302 aa, Methanosarcina acetivorans C2A
MKRDVLSITDLSKEEIYELLESAADLKAKRKAGESTEYLKNKSLGMIFEKSSTRTRVSFEVAMTDFGGHALYLNSRDIQVGRGETIEDTARTLSGYLHGLMARVMSHDTVEKLAKYSTMPVINALSDREHPCQILGDFMTIMEFKKKFEGLKFAWVGDGNNVCNSALLGSAIMGMEFAVACPKGYEPKAEFLEQAKALGGKFTITDDPKVAAKDADIIYTDVWVSMGDEAEQEKRLREFASFQVNTELLGVAKPDVIVMHCLPARRGLEITDEVMDGPNSVIFEEAENRLHAQKALILKLMR

SEQ ID NO: 87678 - protein, 393 aa, Phytophthora phaseoli
  misc_feature (49)..(49): Xaa can be any naturally occurring amino acid
  misc_feature (111)..(111): Xaa can be any naturally occurring amino acid
  misc_feature (292)..(292): Xaa can be any naturally occurring amino acid
LVTELGEYRAAVPSGASTGEFEALEMRDGGKDYMGKGVLNAVKNVNEIXAPALIGKDVTKQAEIDRFMVEELDGTQNEWGWCKKKLGANAILGVSLALCRAGAAAKKQPLXQHIADLAGNPTPCLPVPSFNIINGGSHAGNKLAMQEFMILPVGAKNFTEAMKIGSEVYHNLKKVIKGRYGLDATAVGDEGGFAPNIQSNGEAIDLIEEAIKAAGYTNQVRLGMDVAASEFYTGAEDARYNLDFKNENAAESEKIPADKLLEVYEGFIAKCADSSKIVSIEDPFDQDDWESXVKITGKVGKDVQIVGDDLTVTNPTRVKKAIEQKACNALLLKVNQIGSITESIEAVTMAKKAGWGIMASHRSGETEDTFIADLAVGLSAGQIKTGAPCRSER

SEQ ID NO: 87679 - protein, 383 aa, Citrus sinensis x Poncirus trifoliata
MAIDCIKNIPTMLHQPKEEYKDEQKPLVFDASVLKHQTQIPKQFIWPDDEKPCVNAPELQVPLIDLGGFLSDDPVAAKEASRLVGEACRKHGFFLVVNHGVDSSLIADAHRYMDHFFELPLNEKQRARRKLGEHCGYASSFTGRFSSKLPWKETLSFRYSAEKSLSNNIVEDYLLNTMGDEFKQFGRVYQDYCESMSRLSLGIMELLAISLGVGRAHFKEFFEENDSIMRLNYYPPCQKPELTLGTGPHCDPTSLTILHQDQVGGLQVFVDNEWRSISPNFEAFVVNIGDTFMALSNGRYKSCLHRAVVNSQTTRKSLAFFLCPKNDKVVSPPSELVDTYSSPRIYPDFTWPMLLEFTQKHYRADMKTLEAFTNWLQQKKQLK

SEQ ID NO: 87680 - protein, 144 aa, Triticum aestivum
  misc_feature (53)..(53): Xaa can be any naturally occurring amino acid
DFCKKLCGVSIVRSGESMENALRACCKGIKIGKILIHRVGDNGQQLIYHKLPXDIAERHVLLMDPVLGTGNSANQAIQLLRSTGVPEDHIMFLNLISAPEGIHCVCKRFPDVKIVTSEIDAGLNQDYRVVPGLGEYGDRYFGTD

SEQ ID NO: 87681 - protein, 390 aa, Phytophthora phaseoli
  misc_feature (47)..(47): Xaa can be any naturally occurring amino acid
  misc_feature (109)..(109): Xaa can be any naturally occurring amino acid
  misc_feature (290)..(290): Xaa can be any naturally occurring amino acid
TELGEYRAAVPSGASTGEFEALEMRDGGKDYMGKGVLNAVKNVNEIXAPALIGKDVTKQAEIDRFMVEELDGTQNEWGWCKKKLGANAILGVSLALCRAGAAAKKQPLXQHIADLAGNPTPCLPVPSFNIINGGSHAGNKLAMQEFMILPVGAKNFTEAMKIGSEVYHNLKKVIKGRYGLDATAVGDEGGFAPNIQSNGEAIDLIEEAIKAAGYTNQVRLGMDVAASEFYTGAEDARYNLDFKNENAAESEKIPADKLLEVYEGFIAKCADSSKIVSIEDPFDQDDWESXVKITGKVGKDVQIVGDDLTVTNPTRVKKAIEQKACNALLLKVNQIGSITESIEAVTMAKKAGWGIMASHRSGETEDTFIADLAVGLSAGQIKTGAPCRSE

SEQ ID NO: 87682 - protein, 772 aa, Triticum aestivum
  misc_feature (165)..(165): Xaa can be any naturally occurring amino acid
  misc_feature (186)..(186): Xaa can be any naturally occurring amino acid
  misc_feature (271)..(271): Xaa can be any naturally occurring amino acid
  misc_feature (382)..(382): Xaa can be any naturally occurring amino acid
  misc_feature (667)..(667): Xaa can be any naturally occurring amino acid
  misc_feature (688)..(688): Xaa can be any naturally occurring amino acid
  misc_feature (703)..(703): Xaa can be any naturally occurring amino acid
  misc_feature (711)..(711): Xaa can be any naturally occurring amino acid
  misc_feature (723)..(723): Xaa can be any naturally occurring amino acid
  misc_feature (731)..(731): Xaa can be any naturally occurring amino acid
MAILGELGTEILIPVCGVVGIVFAVAQWFIVSKVKVTPGAASAAAGSKNGYGDYLIEEEEGLNDHNVVVKCAEIQTAISEGATSFLFTMYQYVGMFMVVFAAIIFLFLGSIEGFSTKGQPCTYSTGTCKPALYTALFSTASFLLGAITSLVSGFLGMKIATYANXARTTLEARKGVGKAFITAFRXSGAVMGFLLSSSGLVVLYITINVFKMYYGDDWEGLFESITGYGLGGSSMALFGRVGGGIYTKAADVGADLVGKVERNIPEDDPRXNPAVIADNVGDNVGDIAGMGSDLFGSYAESSCAALVVASISSFGINHDFTAMCYPLLVSSVGIIVCLLTTLFATDFFEIKAASEIEPALKKQLIISTALMTIGVAVISWLXALPAKFTIFNFGAQKDVSNWGLFFCVAVGLWAGLIIGFVTEYYTSNAYSPVQDVADSCRTGAATNVIFGLALGYKSVIIPIFAIAVSIYVSFSIAAMYGIAMAALGMLSTMATGLAIDAYGPISDNAGGIAEMAGMSHRIRERTDALDAAGNTTAAIGKGFAIGSAALVSLALFGAFVSRAGVKVVDVLSPKVFIGLIVGAMLPYWFSAMTMKSVGSAALKMVEEVRRQFNTIPGLMEGTAKPDYATCVKISTDASIKEMIPPGALVMLTPLIVGTLFGVETLSXGVLAGALVSGVQIAISASNTXGGAWDNAKKYIEAGXNSEHARSXLGPKGSDCHKAXAVIGDTIXGDPLKDTSGPSLNILIKLMAVESLVFAPFFATYGGVLFKYI

SEQ ID NO: 87683 - protein, 233 aa, Zea mays
MAAGGELQLLSSWYSPYVIRAKVALGLKGLIYEFIEEDLFSKSDLLLKLNPVHKKVPVLVHGGRPVCESLVIVQYVDETWAAGTGTPLLPADAHDRATARFWAAYVDDKFCKEWIKLYRSTTAEKAAEALGGVVPVVETLEQAFKECSKGKPFFGGDAVGLVDIALGSFVVWIRVVDEAAGVKLLDEAKFPALTAWAERFLAVDAVKEVMPDAGRLLEHYKGFLAKRSPPAGY

SEQ ID NO: 87684 - protein, 377 aa, Wolinella succinogenes DSM 1740
MKKVYLYFANGLFLEAKSFGASGTSVGEIVFNTSMSGYQEIVTDPSYAGQFVTFTMPEIGIVGTNEQDMESRGAFCKGILVKRYNDTPSNFRSQESLSEFLERHGVMGITEIDTRYLTKMVRQEGAMMMVASTEVSQKEELQKILQSSPHIQEINYIDEVSTKEPYLHDKGFFDFEEMDYTKPQTKKKILAVDFGIKRNILNGLVQAGLLVEVIPNDFDPKSVIERYKQGEIGGVFLSNGPGDPAVLEKEVASIKELMSAGVPLFAICLGHQLLALAHGYPTYKLKFGHHGGNHPVKNLLSGEVEITAQNHNYSVPDEIEEIAEVTYRNLFDGTIEGLKYKEGVIYSVQHHPEASPGPKEASSIFKIFAKIACGERI

SEQ ID NO: 87685 - protein, 451 aa, Thermoanaerobacter tengcongensis MB4
MNYDVIVVGGGPGGYTAAIRLSELGKKVALIEEDSLGGTCLNRGCIPTKVYAHAAELVTRIKEAKDFGITAEYTLDIAKLRQKKERVVKRLVGGVGYLMNLHHIDVINGKGTFIDKNTVEVNGAKYTAENFIIATGSKVFLPPIEGIDLEGVMTSDKALELEKIPEKIVIIGAGIIGLEFANIYASLGSKVIMIEMLPQLLPMLDRDVVGVMEKALKKQKIELHLNSKVEKIERGLRVIYTENGNQESVECDAVLVAVGRVPNVNGVDALNLEMNGRGIKVDSHMRTSIENIYAIGDVTGGIQLAHVASYQGIVAAHNIAGEEKEADLTAVPNCLYTNPEVAWVGLNESQAREKYGEVKIGTFPYTALGRAMTMGESDGFVKIIAEGKYGRVVGMEIIGAGATEIIHEGVLAIKEEFTLEELADSIHAHPTLSESIKEAAEDALGMPINKG

SEQ ID NO: 87686 - protein, 694 aa, Zea mays
MRSPPPPPWRAGRLHSPLPMLLLFVAALAARAGADDLASDARALLAFRDAVGRRLTWNASDVAGACSWTGVSCENGRVAVLRLPGATLSGAVPAGTLGNLTALHTLSLRLNGLSGALPADLASAAALRNVFLNGNRLSGGFPQAILALPALVRLSLGGNDLSGPIPAELGSLTHLRVLLLENNRFSGEISDVKLPPLQQFNVSFNQLNGSIPASLRSQPRSAFLGTGLCGGPLGPCPGEVSPSPAPAGQTPSLTPVPSSGGGNGSGSGSGGTIGGNGGESGHKNKKLSGGAIAGIAIGSALGAGLLLFLLVCLCRRSGGTRTRSLEMPPPEAPAAAAAAGGRKPPEMTSGAAVAPLTTIGHPNAPIGQSTSGKKLVFFGSAAAVAPFDLEDLLRASAEVLGKGAFGTTYKAVLESGATVAVKRLKDVTLSEAEFRERISEIGELQHEFIVPLRAYYYSKDEKLLVYDFMPMGSLSAVLHGNVSSGRTPLNWDLRSSIALAAARGVEYIHSTTSTASHGNIKSSNVLLGKSYQARVSENGLTTLVGPSSSSSRTTGYRAPEVIDSRRVSQKADVYSFGVLLLELVTGKAPSQAALNDEGVDLPRWVQSVNRSEWGSLVFDMELMRHQTGEEPMAQLVLLAMDCTAQVPEARPSMAHVVMRIEEIKKSSVTPNIEQVDDQSSKAESEAAPTNPFAT

SEQ ID NO: 87687 - protein, 575 aa, Picea sitchensis
MAMANPGQLNLQEAPSWGSRSVSCFEKLEQIGEGTYGQVYMAKEIETGEIVALKKIRMDNEREGFPITAIREIKLLKKLQHENVIKLKEIVTSPGPEKDEQGKSDGNKYNGSIYMVFEYMDHDLTGLAERPGMRFSVPQIKCYMKQLLIGLHYCHINQVLHRDIKGSNLLIDNNGILKLADFGLARSFCSDQNGNLTNRVITLWYRPPELLLGSTKYGPAVDMWSVGCIFAELLYGKPILPGKNEPEQLTKIFELCGSPDESNWPGVSKLPWYSNFKPQRLMKRRVRESFKNFDRHALDLVEKMLTLDPSQRICAKDALDAEYFWTDPVPCAPSSLPRYEPSHDFQTKRKRQQQRQHDEMTKRQKISQQHPQQQHVRLPPIQTAGQAHLPLRPGPNPPMHNPPPQFPVGPSHYGGGPRGAGGQNRHPQNIRPLHAAQGGGYNANRGYGGPPQQQGGGYAPHGMGNQGPRGGQFGGRGAGYSQGGPYGGPVGGRGPNVGGGNRGLQTQKVVLVMAVRNTCSSPCSLLIWVVHMLIIPLQGFKCQPCHHLIGMSIAHHVDDKGSNNVSKFMDLKLFF

SEQ ID NO: 87688 - protein, 467 aa, Thermoanaerobacter tengcongensis MB4
MEEKDLKEIEKRLGYKNVDAWTKISSEEREKVFEFAEGYKEFMAECKTERETAEKIIKIAEEHGFIDIEKATNLKPGSKVYYNNKGKSVVLAVIGKESMQKGIKAVASHIDSPRIDLKPNPLYEEGGLALFKTHYYGGIKKYQWVTIPLALHGVIVKSNGEKINIVVGEDENDPVLYITDLLPHLGKDQMEKKASEVVTGEALNAVVGSIPLSEEVSVKPSILKYLNEKYGIVEEDLLSAELELVPAYKPRDVGFDRSMIAAYGQDDRVSAYTSLKAILEIGVPERTAVAIFADKEEVGSMGNTGLQSRFFENAIAEILEKYEGSTDIKLRRLMANSEMLSADVNAAFDPTYAEVSEKQNTAYFGKGVCITKYTGVRGKAGSNDANAEFVGKVRRLFNENGVIWQMEELGKVDMGGGGTVAQYAANYGMEVLDCGVALLSMHAPYELSSKVDVYMAYKAYKVFMEKD

SEQ ID NO: 87689 - protein, 191 aa, Populus alba
RLVPDTVYLTVNYIDRYPSGNVMNRQRLQLLGVACMMIAAKYEEICAPQVEEFCYITDNTYFRDEVLEMESTVLNYLKFEMTAPTAKCFLRRFVRAAQGIIEAPSMQLECLANYIAELPLLEYSMLCYAPSLVAASAIFLAKYILLPSKRPWNSTLQHYTLYEPVDLSDCVKDPHRLCCGDHNSTLPAIRE

SEQ ID NO: 87690 - protein, 449 aa, Burkholderia pseudomallei K96243
MSADEPLRTAEFSHLADAIEREILAVSGVVRTGRVLEVIGTLIKVSGLDVALGELCELRTREGRLLQRAEVVGFTRDVALLSPFSQLEQISRTTQVIGLGRPLSIPVGDALLGRVIDGLGEPLDGGPPLASETLQPLIAAPPEPMSRRMIDAAMPTGVRVVDAMMALGEGQRMGIFAPAGVGKSTLLGMFARGAACDVNVIALIGERGREVREFIELILGQAGMARSVVVCATSDRSSMERAKAAYAATAIAEYFRDRGRRVLLMMDSLTRFARAGREIGLAAGEPPARRGFPPSVFAELPRLLERAGMGRTGSITALYTVLAEDESGSDPVAEEVRGILDGHMILSREVAAKNQYPAIDVLGSLSRVMPLVVDDGHMRAAARVRELLAKHREVEVLLQIGEYKAGANPLADEAIAKADAIRSFFSQRTDDYAAAEDTVARLYALSGAN

SEQ ID NO: 87691 - protein, 336 aa, Candida albicans SC5314
MYQLLACGSNGNYQLGINNDEDQNSLKVTLFDIDGTMSSEVPGKPMKIAGGGNHTMVILDNGEVFSCGSNEFGQCGLPRGESLGVFHKVPGNDWLDISCGWEFSILVKRSGEVYVCGRGLKGELGLGKETPESELIYSTTVDGFKEIKSCMQHTIIQTTNGLVGWGNSRKGQLGETEDKIMWTPKTLRFGVVCKDFSLGREFTAIQTDTNRVKIFGKSSIKNIPESTVARVAAMWSSVHILSETNVLQSFGNNSHDQLFPNNSSVAVEEYAIGSEHGLVTSDNIVYAWGWSEHGNCGTSNASDKVTFDYLNKLYTGSAKVVLIGAGCATSWVVVEK

SEQ ID NO: 87692 - protein, 417 aa, Picea sitchensis
MDPKENTAVAEIPSYFICPISMQIMRDPITVCTSITYDRESMEKWIYSCGKNTCPATMQVMPNYNMTPNYTLRRLIQGWCLANSSKGVQPIPTPKPPIDSNQVNKLLQDFESCSPFQLINGLKKLRSLADESEANRRCIAVCGGDSALISVIEMNTVEMESGCYQCPMACDEALGILYKLPMADETAETLSRSKTLKPISWILKKGSCNGRFYSAMLLKTVSSSGQKILQQLVVNADDDLIEGLLQLLTEEVCLQATTSSLEILMAICSPSRKNRIKAIEAGAIYILIELLPESQRMNCEKMLCLLDILCECAEGRATTIDHAMGIASISKKIFRVSQVATEKAIRILWSLCKFSPTPRLLNEMVQIGAVYKLCVLLQLECTSKTKQKAREMLRAHGKYWTISPCVPSYSLGIYGQY

SEQ ID NO: 87693 - protein, 211 aa, Populus alba
AQAAAALENKKQVCVNVEKVPAAGVDGVDAVGRKVAVKKPAQKKVTVKPKPEEVVVISPDSEEVVKQEKPVKKKKEGEGSKKNKPTLTSVLTARSKAACGIANKLKEQIIDIDAADVNNDLAGVEYVEDIYKFYKLVENESRPNNYMDMQPEINEKMRAILVDWLVDVHQKFQLSPETFYLTINIIDRFLSVKTVPRRELQLVGIGATLMA

SEQ ID NO: 87694 - protein, 79 aa, Zea mays
MLLPYDCGCVSVLCQHWMKIYLEMQVGIYERNRPKKRQKTKKNGKGKDWLLRKKEQMRRRGHDVPADTKYTGRKRKGYF

SEQ ID NO: 87695 - protein, 389 aa, Phytophthora erythroseptica
  misc_feature (263)..(263): Xaa can be any naturally occurring amino acid
EIGEYRAAVPSGASTGEFEALEMRDGGKDYMGKGVLNAVKNVNEIIAPALVGKDVTKQVELDRYMVETLDGTQNEWGWCKKKLGANAILGVSLALCRAGAAAKKQPLWQYIADLAGNPSPCLPVPSFNIINGGSHAGNKLAMQEFMILPVGATSFTEAMKIGSEVYHNLKKVIKGRYGLDATAVGDEGGFAPNIQANAEAIDLIEEAIKAAGYTNQVRLGMDVAASEFYTGAKDARYNLDFKNANAPESEKIPADKLQEMYEXFISKCADSSKIVSIEDPFDQDDWESWVKFTGKVGKDVQIVGDDLTVTNPTRVKKAIELKACNALLLKVNQIGSITESIEAVTMAKKAGWAIMASHRSGETEDTFIADLAVGLSAGQIKTGAPCRSE

SEQ ID NO: 87696 - protein, 188 aa, Triticum aestivum
MAPGALARLIIGRRAASPLLARPFAAKARAPQRAPEPEPLSEEDDDFTSGGEAAPIPTEGISKPLAGILKELGKRVPESLLKTRLEDNGFALKYIPWHLANKILNAHAPEWSGEVRNIVYSSDGKSVSVVYRVTLYGTDAEIYREATGTASVEDKGFGDPVQKAEGMAFRRACARLGLGLHLYHEDMS

SEQ ID NO: 87697 - protein, 646 aa, Oryza sativa Japonica Group
MADGGEMDEEAMRAFFPMSFGKAPTRAGAAASAHASTLRKPPQNPSAKPSTSSAAAAAAAGDDDDDDDDDDDEGPMVGPPRPPPQPAGGGEGEDDEEGGGVMIGPPRPPPRSSSRGEGEDADGGMIGPPRPPPVKDDDEEDEDDDDDDGDDSDDEMEDDGERYNRIPLSNEVVLRGHTKVVSALAVDHTGSRVLSGSYDYTVCMYDFQGMNSKLQSFRQLEPFEGHQVRSLSWSPTSDRFLCVTGSAQAKIYDRDGLTLGEFIKGDMYIRDLKNTKGHISGLTGGEWNPKSKETILTSSEDGSIRLWDVSDFKSQKQVIKPKLARPMRIPVTSCAWDHEGKRIVGGIGDGSIQLWTVKTGWGSRPDIHVEKTHTEDITGVKFSTDGQILLSRSMDSTLKIWDLRKMKTPLKVFEDLPNHYAETNVAFSPDEQLIFTGTSIEKDGENGGLLCFFDRRKLELVSRVGISPHYSVIRCLWHPRINQVFATVGDKKEGGTHILYDPSISQRGALVCVGRAPRKKSVDDFEVQPVIHNPHALPLFRDQPSRKRQREKILKDPLKSHKPEAPVNGPGFGGRVGTTKGSLLTQYLLKEGGLIKETWMDEDPREAILKYADAAEKDPKFIAPAYSQTQPKPVFAESDSEGEEKK

SEQ ID NO: 87698 - protein, 462 aa, Zea mays
MTMSASTAAIRTANTNGNHAVSSDSHSSQDARQRTAGITKRKALPSILQKIPSNDLSHTIRGESVLQKSNYSSEGRKDVVASATAERQNKNTTNVVASAAAVRQKKSPTKQENANWVTALSVLVKLCLLISATAWMGQVFWRWQSGELSFTTLDMENRLSRVEGFKKTAKMLQLQLDVLDKKLENEIDKAKGVIAKQFEDKGNKIEKKMKILEDKTDKLDKSLAELSDMGFLSKNEFEEILSQLKKKKGFGGTDDEISLDDIRLYAKDVVEMEIARHSADGLGMVDYALGSGGAKVVSHSEPFMNGKNYLPGRSNVHTTAQKMLEPSFGQPGECFAVKGSSGFVKVKLRTAIIPEAVTLEHVDKSVAYDRSSAPKDFQVRGWYQGPHDDSEKDSNVMSTLGEFSYDLDKSNAQTFQLERTAQSRVVNMVQLDISSNHGNLELTCIYRFRVHGRKPVSPSTGG

SEQ ID NO: 87699 - protein, 219 aa, Pasteurella multocida subsp. multocida str. Pm70
MDQLEMKKMAAAAALQYVKPDSIIGVGSGSTVNCFIEALGSMRDQIKGAVAASKASEALLAKQGIEVFSANEVSSLDIYVDGADEINPQKMMIKGGGAALTREKIVAALAKKFICIVDTSKQVDVLGSTFALPVEVIPMARSQVARKLVALGGSPEYREGVVTDNGNVILDVYHFAIMNPVEMEKELNNVPGVVTNGIFALRAADIIIVGTPEGAKVIE

SEQ ID NO: 87700 - protein, 57 aa, Zea mays
NLIDLGFLFMFFLLVATANAIIVSVLMSLAAAGGFLAIFFACLVAVYIGAVSVAIFV

SEQ ID NO: 87701 - protein, 393 aa, Phytophthora heveae
LVTEMGEYRAAVPSGASTGEFEALEMRDGGAAYMGKGVLNAVKNVNEIIAPALVGKDVTQQAELDRYMVETLDGTQNEWGWCKKKLGANAILGVSLALCRGGAAAKKQPLWQYIADLAGNPTPCLPVPSFNIINGGSHAGNKLAMQEFMILPVGASSFTEAMKIGSEVYHNLKKVIKGRYGLDATAVGDEGGFAPNIQSNGEAIDLIEEAIKAAGYTNQVRLGMDVAASEFYTGAEDARYNLDFKNENAPESEKISADKLQEVYEGFIEKCAGTSKIVSIEDPFDQDDWASWIKFTGKVGKDVQIVGDDLTVTNPTRVKKAIEQKACNALLLKVNQIGSITESIEAVTMAKKAGWAIMASHRSGETEDTFIADLAVGLSAGQIKTGAPCRSER

SEQ ID NO: 87702 - protein, 389 aa, Phytophthora katsurae
ELGEYRAAVPSGASTGEFEALEMRDGGAAYMGKGVLNAVKNVNEIIAPALVGKDVTQQAELDRYMVETLDGTQNEWGWCKKKLGANAILGVSLALCRGGAAAKKQPLWQYIADLAGNPTPCLPVPSFNIINGGSHAGNKLAMQEFMILPVGASSFTEAMKIGSEVYHNLKKVIKGRYGLDATAVGDEGGFAPNIQSNGEAIDLIEEAIKAAGYTNQVRLGMDVAASEFYTGAEDARYNLDFKNENAPESEKISADKLQEVYEGFIEKCAGTSKIVSIEDPFDQDDWASWIKFTGKVGKDVQIVGDDLTVTNPTRVKKAIEQKACNALLLKVNQIGSITESIEAVTMAKKAGWAIMASHRSGETEDTFIADLAVGLSAGQIKTGAPCRSE

SEQ ID NO: 87703 - protein, 246 aa, Escherichia coli W3110
MLDQVCQLARNAGDAIMQVYDGTKPMDVVSKADNSPVTAADIAAHTVIMDGLRTLTPDVPVLSEEDPPGWEVRQHWQRYWLVDPLDGTKEFIKRNGEFTVNIALIDHGKPILGVVYAPVMNVMYSAAEGKAWKEECGVRKQIQVRDARPPLVVISRSHADAELKEYLQQLGEHQTTSIGSSLKFCLVAEGQAHVYPRFGPTNIWDTAAGHAVAAAAGAHVHDWQGKPLDYTPRESFLNPGFRVSIY

SEQ ID NO: 87704 - protein, 358 aa, Zea mays
  misc_feature (200)..(200): Xaa can be any naturally occurring amino acid
MGSMAAEMTAVEEEACIYAMQLSSTAVLPLTLKNAIELGMLEVLMGAGGKMLSPSEVAARLPPTTTNPDAPAMVDRMLHLLASYKVVSCEVEEGTHARRYGPTPVCKWFTPNQDGISMAPLLLLTNDKVPMESLYHLKDAVLDGGLPFHKAHGMTMYEYTKTDARLNHVFNEAMKSYTTIVTGKLVELYTGFHDVATLVXDVGGGVGATIRAVTSKYPHIKGINFDLPHVIAEAPQSPGVEHVAGDMFKNVPSGDAIVLKWILHNWTDEHCTTLLRNCYNALPAHGKVVVVEGILPVEPEATSRGQQASLSDMIMLTHTAGGKERNQREFEQLAKAAGFTGVKTAYIYSNTWVIELTK

SEQ ID NO: 87705 - protein, 379 aa, Zea mays
MATAGKVIKCRGCRDVGGRQTAVHRGGGGSAAAGHGGAYQDPLHRALPHRRLLLGGQGANPGVPEDLRTRSGRIVESVGEGVTDVAPGDHVLPVFTGECKECAHCKSEESNMCDLLRINVDRGVMIGDGKSRFTISGQPIFHFVGTSTFSEYTVIHVGCLAKINPEAPLDKVCILSCGISTGLGATLNVAKPAKGSTVAIFGLGAVGLAAMEGARLAGASRIIGVDINPAKYEQAKKFGCTEFVNPKDHDKPVQEVLIELTNGGVDRSVECTGNVNAMISAFECVHDGWGVAVLVGVPHKDDQFKTHPMNFLSEKTLKGTFFGNYKPRTDLPNVVEMYMKKELELEKFITHSVPFSEINTAFDLMLKGESLRCIMRMED

SEQ ID NO: 87706 - protein, 211 aa, Aspergillus nidulans FGSC A4
MPATPAATPGASAPGSGIVPTLQNIVATVNLDCRLDLKTIALHARNAEYNPKRFAAVIMRIREPKTTALIFASGKMVVTGAKSEDDSKLASRKYARIIQKLGFNAKFTDFKIQNIVGSCDIKFPIRLEGLASRHHNFSSYEPELFPGLIYRMMKPKIVLLIFVSGKIVLTGAKVREEIYQAFELIYPVLSGKLPTFDIRTPANFGTDFRKV

SEQ ID NO: 87707 - protein, 216 aa, Haemophilus influenzae Rd KW20
MAKIQLVAQANLPTEYGIFKMVGFEFPDTKKEHVALVMGDISNADEPVLARIHSECLTGDALHSLKCDCGFQLATALKQIQEEGRGVLIYHREEGRGIGLINKIRAYSLQDKGMDTIEANLALGFKADERNFEVCADMFELLGVKKVRLMTNNPEKVETMKKAGINVVERVPLNVGENRYNTKYLDTKAKKMGHYIVHNNDEQHLMTCPHCQEEII

SEQ ID NO: 87708 - protein, 521 aa, Oryza sativa Japonica Group
MALPFPVPRGAHWAVTSTAHVLVGFTGEMARVEQPRAPAPYNAAFLRKKLTLATKMHTTKSSDSHLDIAGTVVTHSHGAAVAAGKQKAAATAAAGRPGARNRQALGDIGNVLNAHVVDGKIQLPEGINRPITRSFGAQLLKKAQENAVAANKIVVQNPARKEPAPKPAKKVVPRPENAAKASTGAGVNENKKPSESEGAGSSSGGSALKYSRKKVVNTLTSVLTARSKHACGITEKPKEVVEDIDKLDGDNQLAVVEYIEDIYNFYRTAQICSETDSVVLAQLERRPTDYMSSQVEVNPKMRAILADWIIDVHYKFELMPETLYLTMYVIDRYLSLQPVLRRELQLVGVAAMLIASKYEEMWAPEVQDLIHVCDNAYSRQHILAMEKNILNRLQWNITVPTPYVFLLRFIKAAGGDKELENMVFFFSEMALKEYGMASLCPSLVAASAVYAAQCTLKRSPLWTSTLKHHTGFTESQLRECAKVLVNAHAAAPESKLKTAYRKYASEQLGRVSLRPPAVCLA

SEQ ID NO: 87709 - protein, 77 aa, Shewanella hanedai
MSNIEERVKKIIIEQLGVKEEDVKSAASFVDDLGADSLDTVELVMALEEEFDTEIPDEEAEKITTVQAAVDYVSKNQ

SEQ ID NO: 87710 - protein, 461 aa, Rhodopseudomonas palustris CGA009
MLKTIDTPQVRDATPKLKLYSREEADAFVAKVKAAGYDYVRFEFPDMAGLSRGKTIPIGHVSSYMRSGLNLYGGTVALDSYSIPVRDSGYNEEMNYTDCVMVVDTDTLTPVPWLEKTGRVICDTMWYDGTPQMATPRLLLKKMLNVAASMGYTVKSGHEYEFYVVDHATRAPLFGGQPIFVTSRTHQTPAIDDLIRVLEAQGIDIITWNVEHGPGQIEINYSALDDIAAADRAFVFKGTVKEYLAKHGLLATFMTKPYKGLSGSCSHFHISLLDSKTGENAFLDKEAENGLSRLMRSFIQGILDHTRACMALWSPTPNCYRRIRPRTYAPSNISWGIQDRSASIRVKASYDQATHLEVRVPSALSNPYLVSASVIASGLLGVMQNRELSPAAAGPKEDDARFEKLPTAIEDALEAFEADVALREMLGDEFAKVYLAMKWQEAARLRDEIPAAETNEYFELY

SEQ ID NO: 87711 - protein, 138 aa, Haemophilus influenzae Rd KW20
MAFTRIEKRKVKMAYSEKVIDHYENPRNVGSLDKKDSNVGTGMVGAPACGDVMQLQIKVDDNGIIEDAKFKTYGCGSAIASSSLITEWVKGKSLEEAGAIKNSQIAEELELPPVKVHCSILAEDAIKAAIADYKAKQG

SEQ ID NO: 87712 - protein, 126 aa, Oryza sativa Japonica Group
MAESPENAAPAAAPAPAPAPTPAPPPPPSSPPTKSGIPPRYDLDAKWDACLDISIRRVAYSTLGGTFAGLLLFRSPTTRWASVALGAGVGIGAAYTECSYLFNGAPPKWSPKVSTVPSAHSEGEDK

SEQ ID NO: 87713 - protein, 685 aa, Magnetococcus sp. MC-1
MDRASTSTRSFRAPNRVVLSGGLTLLLSLLLTGLLAVQENGRYQNQLRVTVLEQLSQLRGLLENEINLSFHLTMGLLAYVAIEPNISQQNFQLMAREIIAQSRNIRNLGLAPDNVLSYIYPLSGNERALGLDYRKNAKQWPAVQLAISERRTVVAGPVKLVQGGEAFISRTPIYRTGMDGKKGAYWGLASTVIDKDKLFTTAGIYEVSKQIKLAIRGRDGLGAQGDLISGEGELFNERAVLQNVQLPDGRWQLAAEPLNGWDQDSPYVPVIWGAGIGGGMLAGGLVYLWLIGVARHQHILQQALQDAQAADRVKSEFYATMSHEIRTPMNVVLGMSDILLETVQEPEQRQQLARLQQAGSALLELINNILDISRIEEKRLTLHMAPMDLRSLVEDLLGFFQLPYHEKGIALVSEWEQGLATHILGDSGRLRQVLTNLLGNALKFTERGQVVVVVRRDPEDATYLRIEVRDSGIGLHADQLLHIFDKFTQAESGLTRRYGGSGLGLAICKQLVVLMGGRIWVESEDGVGSCFIFTLPYQEVTELERRQMQDEAAEWSVDVPRKVLLVEDSVDNQQLIVAYLKASPYQVSIAQNGAEGVAMAKQDAYDLILMDMQMPVLDGYAATRSIRQWERQQGREPVPIVALTAHALEGDLEKSIEAGCSLHLTKPIRKAQLLNQLRGFFKEAP

SEQ ID NO: 87714 - protein, 265 aa, Colwellia psychrerythraea 34H
MAAQVTALFNEIWEQYLSVTPSAKKIHQLLGNGNDVINDHVAYRTFNHPKINLAQLAKGLLALGYTECGQYDFSAKKLDAKHFEHADSTMPKVFISELRVEEFSSEVQDIITGLIAQLPEDVSDRADFLYAGRLWEISSKDYDTLLNVSEYAAWLAAWGYRANHFTVSINHLANYEDIEVVNATLKDAGYALNANGGEIKGDEAVKLEQSSTLADKAPVDFSDKTMEIPSCFYEFAKRYPLASGELYTGFVAASADKIFDSTNAK

SEQ ID NO: 87715 - protein, 309 aa, Agrobacterium tumefaciens str. C58
MYDCRDAFAETLEALAAANDKVVAVCNDSVGSSKLGGFKSKFPERLVNVGIAEQNMVGVGAGLANGGQLPFVCGASCFLTGRALEQIKADLAYSNANVKLIGISSGMAYGELGPTHHSIEDFAWTRVLPNLPVIAPCDRIETAAAVKWAADYAGPCFLRLSRVGVPDLLPEGHVFELGRANLLREGSDLTLIANGTLTHRIVKAADILLSRGIKARVLNMATVRPIDEAAIIAAAKETGAILTAEEHSIFGGLGSAIAEVVVDHSPVPMKRLGVPGVFAHTGSAEWLLDEFGMAPTAIADAAQALIKRK

SEQ ID NO: 87716 - protein, 265 aa, Picea sitchensis
MRKRERENPCAICGHYHKFEEGEVCTICGHRLQGANEKSAHAPSALPTEILVDFLYVGSYDNASRAELLKIQGITRILNTVPKCQNLYKNSFTYHCLKEEQTLPFNEAVDFIEQCRNDQVRVLVHCMSGQSRSPAIVIAYLMRCKGWRLAESYQWVKERRPTINLTPAVLKQLQDYEMEVFGMNASPTPVFTTSTGLAFGFGFPNNTQAAVSPPTFCQLSSNPHLNLGATNFPSSGGFTFSATRQDGNPLDSMTATTMDNSMDST

SEQ ID NO: 87717 - protein, 448 aa, Listeria innocua Clip11262
MKKEKTERTKQSWRKAQNAPSLSEVNNSVAIPKNAKFFRKLFAFMGPGALIAVGYVDPGNWATSIAGGSEFGYTLLSVILISNILAVLLQSLASKLGIVTGRDLAQASSDHFSKPFGFVLWILAELAIIATDIAEVIGSAIALNLLFGIPLIWGVCITALDIFLVLFLQHKGFRYIEVIVITLMVTILVCFGAEMVMSHPDMQAIAKGFIPQSEIVTNPAMLYIALGILGATVMPHNLYLHSSIVQTRQYARTKEGKREAIRFSFIDSTFSLTIALLINASILILAAAAFYTTGQHNVAGIEDAYKLLNPTLGSSIASTVFAVALLASGQNSTLTGTLAGQIVMEGFLNIRLKPVVRRLLTRVLAIVPAVIITALYGANGINELLIFSQVILSMQLSFAVIPLVMFTSDKQKMGEFVNSPWLKIVSWSVAIFIAFLNIYLLFYTLTSL

SEQ ID NO: 87718 - protein, 280 aa, Picea sitchensis
MAERGGGFGRGADRGGGFGRGFGRGRGDRGRGDRRGGRRGARRDEEEKWVPVTKLGRLVKEGKIRSLEQIYLFSLAVKEHQIVEAMLGPQLKDEVMKIMPVQKQTRAGQRTRFKAFVVVGDGNGHVGLGVKCSKEVATAIRGAIILAKLSVIPVRRGYWGNKIGKPHTVPVKVTGKCGSVTVRMVPAPRGAGIVAARVPKKVLQFAGIEDVFTSSRGSTKTLGNFVKATFECLLKTYGFLTPDLWRETRFSKSPFQEYTDLLAKPAKALVLEDVDKEVIL

SEQ ID NO: 87719 - protein, 341 aa, Staphylococcus aureus
MSTNIAINGMGRIGRMVLRIALQNKNLNVVAINASYPPETIAHLINYDTTHGKYNLKVEPIENGLQVGDHKIKLVADRNPESLPWKELDIDIAIDATGKFNHGDKAIAHIKAGAKKVLLTGPSKGGHVQMVVKGVNDNQLDIEAFDIFSNASCTTNCIGPVAKVLNNQFGIVNGLMTTVHAITNDQKNIDNPHKDLRRARSCNESIIPTSTGAAKALKEVLPELEGKLHGMALRVPTKNVSLVDLVVDLEKEVTAEEVNQAFENAGLEGIIEVEHQPLVSVDFNTNPNSAIIDAKSAMVMSGNKVKVIAWYDNEWGYSNRVVDVAEQIGALLTSKETVSAS

SEQ ID NO: 87720 - protein, 336 aa, Staphylococcus aureus
MAVKVAINGFGRIGRLAFRRIQEVEGLEVVAVNDLTDDDMLAHLLKYDTMQGRFTGEVEVVDGGFRVNGKEVKSFSEPDASKLPWKDLNIDVVLECTGFYTDKDKAQAHIEAGAKKVLISAPATGDLKTIVFNTNHQELDGSETVVSGASCTTNSLAPVAKVLNDDFGLVEGLMTTIHAYTGDQNTQDAPHRKGDKRRARAAAENIIPNSTGAAKAIGKVIPEIDGKLDGGAQRVPVATGSLTELTVVLEKPDVTVEQVNEAMKNASNESFGYTEDEIVSSDVVGMTYGSLFDATQTRVMSVGDRQLVKVAAWYDNEMSYTAQLVRTLAYLAELSK

SEQ ID NO: 87721 - protein, 200 aa, Wolinella succinogenes DSM 1740
MITVVESSFLTSASALSQTPPPKNSEVVFIGRSNVGKSTLINLIVDSKGLAKSSSTPGKTQLINYFETIWKRGEERIPLWLVDLPGFGYAKVSKEMRKDWGEKLIHFLQERRSIKLFVQLIDARHPDLAIDAEAWAMIGAIKRGDQKVIRVFTKMDKLNRNDQKKLQQRYPDACFTAMLGKEGIASVRERVLKDVLGEEA

SEQ ID NO: 87722 - protein, 533 aa, Listeria innocua Clip11262
MLTVNNVGLRYGDKKLFEDVSIKFLPGNCYGLIGANGAGKSTFLKVLSGELDSQSGNVHIGSGERLAVLRQDHFQYDDELVLNTVIMGHERLYKIMDEKNAIYMKEDFSDEDGIRAAELEGEFAELDGWEAESDAAVLLNGLGIPTDLHGKLMKDLTGGEKVKVLLAQALFGKPDILLLDEPTNHLDIRAIHWLEEFLINFDNTVIVVSHDRHFLNKVCTHIADLDFSKIKLYVGNYDFWYESSQLAQTMMGDRNKKKEEKMKELQDFIARFSANASKSKQATSRKKMLEKITLEDIQPSSRRYPFIQFKPDREVGNDLLTVTNLSKTIDGVKILDNLSFSINRNDKVALVGDDEVAKTVLFQILAGEMEPDEGSYKWGITTSQSYFPKDNSEFFEENDMSLVEWLRQFSPEDDSEAFLRGFLGRMLFSGDEVLKKVRVLSGGEKVRCMLSKMMLSGSNVLLLDEPTNHLDLESITALNNGLEAFKGAMIFASHDHQLLQTIATRIINLSKDQFYNKEISYDEYLKEVMNVAE

SEQ ID NO: 87723 - protein, 407 aa, Manihot esculenta
MGFAENNKQTDIGGAVQNGREIILQAFNWESHKHDWWRNLERKVPDIAKSGFTSAWLPPSSQSFAPEGYLPQNLYSLNSSYGSEHLLRALIQKMKQSNVRAMADIVINHRVGTTQGHGGMYNRYDGIPLSWDERAVTSCTGGLGNRSTGDNFHGVPNIDHSQHFVRKDITAWLQWLRNNVGFQDFRFDFARGYSPKYVKEYIEGAKPIFSVWEYWDSCNYSGSYLEYNQDSHRQRIINWIDGTGQLSTAFDFTTKGILQEAVKGQFWRLRDSPGKPPGVIGWWPSRAVTFIDNHDTGSTQGHWPSLQIILWRVCIHTHTSWIPTVFYDHFFDWGNSIHDQIVKLIDVRKRQDINSRSSIRILEAQPNLYSAIIGEKICMKIGDGSWCPAGKEWTLATSGHRYAVWQK

SEQ ID NO: 87724 - protein, 337 aa, Alkaliphilus metalliredigens QYMF
MKTKIGINGFGRIGKGVLKASLEKDLNVEVVAINSTSGPENHAHVFKYDSLYGILQEEVRATKDALIIGDKTIQFTAHRDPAQIPWKEMGVEIVVESTGIFLTKEAASKHFEGGAKKVILSAPAKSGEDLTIVMGVNHDQYDPKKHHILSNASCTTNCLAPVAKVLEDSFGIESGMMTTVHAYTNDQRILDLPHKDPRRARAAAESIIPTTTGAAKAVAKVIPSLEGKLNGMAMRVPIPVVSVVDLVAELKTKTTAEEVNQKLREAAVGKMEGILGYNEEPLVSIDYKKDPRSSIVDALSTMMVGDKMVKVVSWYDNEWGYSNRIVDLAGYIAEKGL

SEQ ID NO: 87725 - protein, 338 aa, Xylella fastidiosa Ann-1
MSVALSIDLSKKKTILCFGEALIDMLAQPPVKKGMPRAFLQCAGGAPANVAVAVARLGGAVQFVGMLGSDMFGDFLFDSFAEAGVVTDGIVRTNTAKTALAFVALDAHGERSFSFYRPPAADLLFRAEHFQDASFSDALIFHACSNSMTDADIAEVTFEGMRRAQAAGAIVSFDLNFRPMLWPNGENPASRLWKGLSLADVVKLSSEELDYLANTLAADANAVIQQLWQGRAQLLLVTDAAGPVHWYTRTAGGQVPTFRVQVQDSNAAGDAFVGGMLYTFAQQFDDAAALIDFCHDPESIASTLRFAAAVGALAVTRQGAFTAMPMLSEVLSLIQEQS

SEQ ID NO: 87726 - protein, 174 aa, Zea mays
MTSCTGLLRRSDVVAAAGHQKLMGSLTTNEGLRFGVVVARFNEVVTNLLLQGALETFERYSVKEENITVVSVPGSFEVPITAQKLGKSGKFDAILCIGAVIRGDTTHYDAVANSAASGVLNAGLSAGVPCVFGVLTCEDMDHALNRAGGKAGNKGAEAALTAIEMASLFRHHLS

SEQ ID NO: 87727 - protein, 201 aa, Mycobacterium sp. KMS
MSGPSPTDPVVPRARVANIANVLTGVRFLLVPVFLAALFVGDGHETYWRVVAFVVFAVAVITDRFDGALARSYGMVTEFGTLADPIADKALIGAALIGLSMLGDLPWWVTGVILARELGVTVLRFAVLRHGVIPASRGGKVKTLVQAVAIGLFVLPLAAWPGPWLAVAWVIMVAAVVLTVLTGLDYVLSAIRDSRERPAGH

SEQ ID NO: 87728 - protein, 387 aa, Streptococcus pyogenes MGAS315
MNKLYIDSFVEKKLTAGVQLLDEKDFSNIKEKNQLVQLETKSNRPIGTAYISKQNKGIGWYLGPEKIDLSISYFVSLFSVAKAKRQDFAQSDETNAYRLFNQEGDGFGGVTIDLYKDFAVFSWYNAFVYDKKEMIMEAFQQVFPEVKGAYEKCRFKGPDTETAHLYGELAQETFSILENGIAYQVFLNEGLMTGIFLDQHDVRRALVDGLAMGKSLLNLFSYTAAFSVAAAMGGAIETTSVDLAKRSRELSLAHFEHNQLNLASHHFVVMDVFEYFKYAKRKKLIFDVIVIDPPSFARNKKQTFSVSRDYHKLITEALDILSPKGTIIASTNAANMTVSQFKKQIIKGFGSRRPESMTLQQLPSDFTINKADERSNYLKVFTIKVRE

SEQ ID NO: 87729 - protein, 316 aa, Ralstonia solanacearum GMI1000
MSSEGLMVFTGNANPKLAEAVVKHLNIPLGKALVGRFSDGEVQVEIQENVRGKHVFILQSTCAPTNDNLMELMVMVDALKRASARRITAAIPYFGYARQDRRPRSARVAISAKVVANMLEVAGVERVLTMDLHADQIQGFFDIPVDNIYASPILLEDLRKKNYDNLLVVSPDVGGVVRARALAKQLGVDLAIIDKRRPKANVAEVMNIIGEVEGRNCVIMDDMIDTGGTLCKAAQVLKERGAKQVFSYCTHPVLSGGAAARIADSALDEVVVTDTIPLRDDAAQCGKIRQLSTAPLLAETFTRIVRGDSIMSLFAE

SEQ ID NO: 87730 - protein, 437 aa, Zymomonas mobilis subsp. mobilis ZM4
MRITMIGSGYVGLVSGACFSDFGHNVICVDHDQEKIALLQKGVMPIYEPGLADMVANNVKAGRLSFSNDLASSVKDADAVFIAVGTPSRRGDGHADLSYVFAAAKEIAASVSDNTVVVDKSTVPVGTGDEVERIIREIAPDKKIWVASNPEFLREGAAIGDFKRPDRIVIGTENPEAREIMQEIYRPLYLNQSPILFTSRRSAELIKYASNAFLATKITFINEMADLCEAVGGDVQDVARGIGADNRIGSKFLHAGPGYGGSCFPKDTLALLKTAENFATPLRVVESVVTANNIRKRAMARKVLQAIGKDMRGQKIGLLGLTFKPNTDDMRDAPSLALIQGLEDAGAIIHAYDPEGMVQARPLLPNVIFEDEPYKVAEKAEALVIVTEWDAFRALDLKRIAGLLKTPLLLDLRNIYTEEEAKKAGLVYHGIGRPHAG

SEQ ID NO: 87731 - protein, 257 aa, Xylella fastidiosa Ann-1
NHDRIVEMDVRSAELTKYAANAMLATKISFMNEVANIAVHVGADIEYVRKGIGSDPRIGWHFIYPGVGYGGSCFPKDVKALARTAQQYGVDPKLLNAVEDVNHAQKGHLFELMLRHYGCSGESTMLAGKTFAVWGLAFKPNTDDMREAPSCRLLVQLWKAGAQVRAYDPEAMQEARRIFGERDDLVFCETAYAALQCADALIVVTEWKQFRSPDFFVIRDALKDAVIFDGRNLYDPQEIEEAGLAYYGIGRGRSLHA

SEQ ID NO: 87732 - protein, 313 aa, Clostridium thermocellum ATCC 27405
MMAREACREAFSKRILEEAKKDRDIVVICTDSRGSASLGSYPEELPEQFVELGIAEQNAVTMAAGMASVGKKAYVVGPASFYSMRAAEQVKVDVAYSHNNVKIIGISGGISYGALGATHHSLQDIALMRAIPGLIVEVPSDANQMRALVGKFLSIDDPVYVRIGRGPVPVIYNENCDVEIGKAITWFDGTDAAIIACGQMVWRALEAAKELEKEGIHVTVVDMHTIKPLDEETILSVAEKCGCVLTLEEHSIYGGLGGAVAEVLKTQTKASLMIVGIPDEDVPNGTDEEVFSYYGMDVPGIVLKVKELIEKKK

SEQ ID NO: 87733 - protein, 549 aa, Secale cereale
MAAAATRRAASSLASRCLLSRPAASPAAVPSALRRADGARGLLPGLLQRFGTAAAAEEPISPSVQVSETQLLINGKFVDAASGKTFPTLDPRTGEVIARVSEGDAEDVDRAVIAARKAFDHGPWPKMTAYERSRILLRFADLIEKHNDDIAALETWDNGKPYEQAAQIEVPMLARLMRYYAGWTDKIHGLIVPADGPHHVQVLHEPIGVVGQIIPWNFPLLMYGWKVGPALACGNTIVLKTAEQTPLSALYVSKLLHEAGLPEGVLNIVSGFGPTAGAALASHMDVDKIAFTGSTDTGKVILELSARSNLKPVTLELGGKSPFIVMDDADIDQAVELAHFALFFNQGQCCCAGSRTFVHERVYDEFVEKSKARALKRVVGDPFRKGVEQGPQIDDEQFKKILRYIKSGVDSGATLVTGGDKLGDKGYYIQPTIFSDVQDGMKIAQEEIFGPVQSIFKFNDLNEVIKRANASQYGLAAGVFTNNLDTANTLTRALRAGTIWVNCFDIFDAAIPFGGYKMSGIGREKGIDSLKNYLQVKAVVTALKNPAWL

SEQ ID NO: 87734 - protein, 63 aa, Zea mays
YDFNVFIHQVRRSDVLSAWSGIRPLAMDPSAKNTESISRDHVVFEDYPGLITITGGKWTTYRR

SEQ ID NO: 87735 - protein, 214 aa, Bacillus methanolicus
MIKIAPSILSANFARLEEEIKDVERGGADYIHVDVMDGHFVPNITIGPLIVEAIRPVTNLPLDVHLMIENPDQYIGTFAKAGADILSVHVEACTHLHRTIQYIKSEGIKAGVVLNPHTPVSMIEHVIEDVDLVLLMTVNPGFGGQSFIHSVLPKIKQVANIVKEKNLQVEIEVDGGVNPETAKLCVEAGANVLVAGSAIYNQEDRSQAIAKIRN

SEQ ID NO: 87736 - protein, 551 aa, Sorghum bicolor
MAARRAASSVLSRFLLTRPSPSPSPASAASPAGKSALLGAGGPLHRFSTAPAAAAATAEEPIQPAVEVKHTQLLINGNFVDAASGKTFPTLDPRTGEVIARVAEGDSEDIDRAVAAARRAFDEGPWPRMTAYERCRVLLRFADLIERHAEEIAALETWDNGKTLAQAAGAEVPMVARCIRYYAGWADKIHGLVVPGDGAHHVQVLHEPVGVAGQIIPWNFPLLMFAWKVGPALACGNTVVLKTAEQTPLSALYVANLLHEAGLPEGVLNVVSGFGPTAGAALCSHMGVDKLAFTGSTGTGQIVLELAARSNLKPVTLELGGKSPFVVMDDADVDQAVELAHQAVFFNQGQCCCAGSRTFVHERVYDEFVEKSKARALKRVVGDPFRNGVEQGPQIDGDQFNKILRYVQSGVDSGATLVTGGDRVGSRGFYIQPTVFADAKDDMKIAREEIFGPVQTILKFSGMEEVIRRANATHYGLAAGVFTRSLDAANTLSRALRAGTVWVNCYDVFDATIPFGGYKMSGVGREKGVYALRNYLQTKAVVTPIKDPAWL

SEQ ID NO: 87737 - protein, 120 aa, Triticum aestivum
HTSLPSDLLPPSSAPAKMSTVTRAYLDQRLAAANRCSKEAAMAGAKAAAIATVATAVPTLASVRMLPWARAHLNPTGQALIISTVAGMAYFIVADKTILSMARKHSFEDAPEHLKNTSFH

SEQ ID NO: 87738 - protein, 257 aa, Bradyrhizobium japonicum USDA 110
MTETRDQTLAGRVALVTGAGNGIGRATALRLAGRGAIVGVNDLKPEFVDGTVDAIKAAGGKAVAVTQDVSSRDGMRQAVLGLAEQQGRFDILVNNAAWVRYQSVADIAPETVERMLNIGFKAVMWGIQAAAEVMDAERGGAIVNVASVAGLISAKNSIVYSGIKAGVMGITRAAAAELGARNIRVNAVAPSAIPTEGTMRNRNAELDARRVARTPLGRLGTVDDIAKAICFLAGDESGFISAQVLTVDGGITLTNIA

SEQ ID NO: 87739 - protein, 276 aa, Glycine max
  misc_feature (188)..(188): Xaa can be any naturally occurring amino acid
MAERGGGDRGSDRGGFGRGFGGRGRGGDRGRGRRRGPRREEEEKWVPVTKLGRLVKEGRIRSLEQIYLHSLPIKEHQIIDTLVGPTLKDEVMKITPVQKQTRAGQRTRFKAFVVVGDNNGHVGLGVKCSKEVATAIRGAIILAKLSVIPVRRGYWGNKIGKPHTVPCKVTGKCGSVTVRMVPAPRGSXGIVAARVPKKVLQFAGIDDVFTSSRGSTKTLGNFVKATFDCLMKTYGFLTPEFWKETRFSKSPFQEYTDLLAKPTGKTLILEEERVDA

SEQ ID NO: 87740 - protein, 268 aa, Pasteurella multocida subsp. multocida str. Pm70
MTDQHAFATEQVQLDPTLSPTTEETTHFGFKTVAKSEKQKMVANVFHSVAGKYDLMNDLLSFGIHRVWKRFTIDCSGVRKGHKVLDLAGGTGDFTAKFSRLVGPSGEVILADINDSMLRVGREKLRNLGVVGNVNYVQANAEALPFPDNTFDCVIISFGLRNVTDKDKALRSMFRVLKPGGRLLVLEFSKPILDPLSKIYNFYSFNILPKIGEVVVNDSESYRYLAESIRMHPAQDVLKQMMIDAGFEQVNYYNLSAGIVALHRGYKF

SEQ ID NO: 87741 - protein, 1870 aa, Gibberella zeae PH-1
MKGSDSLRRANRPAANFDLPPVALAQAQQQTQVQAQAQAQSFQSQSQPQESITNTVTSTSPEITNASLHGQAQAKAQALTTARFRSSSRPSLQDLALVDGTSTSNNHDLPPAYALSSSSSSTGPSSFSYPPAHVHPRPSTANAAATTHTHTRPRPLGPSSSDIATAEQAQFLRIHPVSSTSSLRPRSSTTSASAVASASASTSPSHTPNSLLRQHTSPPSAVDNNSAHFVPRGGLPPAPSIMYQANQRHVSGTDPSRPYQVPPPPPPPMGGPNNGHMPNMMNLPPPPPLPRYNTAPGSNGLSLPPPPGPPPASALGQQPPWHGAFGRMYDSRSGFNIPPPPPSSQHQPYNPKLHAQIAAGQTVSIPPPPPPNEAMSATYIPQGDTYGEGVGIPAFGLEDPTLTVNSQTLRPVTTPQSGTDTNATTPMDEATRERLYAANNAQPRGTSNSSNPTPPGSIPPEIAAQWPLDTVLLWLAQNQFSKDWQETFRALNLHGAQFLELGSGHGGRGNFGMMHQQVYPRLAQECTNSRTGWDQPREREEGKRMRRLIRSIVTGRPADVSKVSTSHGRKESLNGGHGNNLPSAGTDPMDSPNTPLTAPGPGFSSRRFSQTRSTTLPNSISASNINSESNHRNILKHVDTDGARRHSPNVSESSEATFRAPAVHSASPTGSPGIPPALYTSTTTPTIAQSPSAIKAGHRSRSSMDSVASVAAIYGSGVPSDAASLLNRNMNLGDIVHGRSHDARSRHSPSDGGDRSAGGETPSSAKDSNRLLSFLSRKKKQTKDDGAYPSPEDMNGSPTSPHGSFRPVGLGVRGSNGSDTNIDLSGSTLGDDRNGSTLNMRWNKISPVRTYVLATMDYWNYRMCDITEAETATEIRQVICMHLGLGDYENSHIYLTEAGKFEHVDPLDDPSLITVRRAKGDPLGTLKFFVTPPGVAPISSLSVKAEVPIILSPSYLSPGTPVEDAQQMSRQRSSSSPPTSRSNTLTNEKNEDKIAREAKQYRAEIERKQQEYLAKRKQAAMKGSPSETLGPGIVGRNVDFDQPRESPYEDKRPEPLFPQRRPPAPPSDPSATLIKANSLSRKTGASMRASSSSLEGYPSKRYPENEMAEKTKKANKQAPPAPGIGAALAGMGRNLSAIGQSAKNGRASSPSRSSTHSIPGGKDTFSTVEPSQGRGSPSTTSSSKLTTGNVTWNKKNLGFIVPDYSPSDSSFLLSPSPTVDAKFNATVPRAMSPAEMSPNSSRSRTSFPPNQQSPTHRRASHGPEPEFEDTDVHFSKPAPAPPADDDSDDSDDGLFAIPIANQNKGKAAAANADANGHSKRPSLHVNTERSRKGLSVAFKSPKSFGSGMDSNEDSGRQNPTTPHSETWEPEEKDKESKLGRRKSFIEKDVWANRPPTDALINNLDDFFPNLDLDQPVLDEPGESGMPPSPIAESSETNIDQQAQNVAPPQPSYPQHVPPAIPPTRQPSLYNENDTLGSDESTLKALDQHRPTSVAQRSIRRSGGLGRMKSIREVARGAHEANKRTTSTNQGQAATTNIMRRKSTKMFNANIVQIRPDRRGSVVMPQIPQDTVPKRQTTFRWFKGQLIGKGTYGRVYLGMNATTGEFLAVKEVEVNPKAAGGDKNKMKELVAALDQEIDTMQHLDHINIVQYLGCERKETSISIFLEYISGGSIGSCLRKHGKFEESVVSSLTRQTLSGLAYLHREGILHRDLKADNILLDLDGTCKISDFGISKKTDNIYGNDKTNSMQGSVFWMAPEVIRSQGEGYSAKVDIWSLGCVVLEMFAGKRPWAKEEAVGAIYKIANGERPPIPEDIQDTLGPLAVAFMMDCFQVNPFDRPTADVLLSQHPFCEVDPHYQFYDTALYHRIKSFK

SEQ ID NO: 87742 - protein, 446 aa, Listeria innocua Clip11262
MTEFTYDVVIIGSGASGTTVAFEAQAAGLKVAIVEERSWGGTCVLRGCDPKKVLVGAAEARNLSTRLRGKGIKEAATISWTDLMAFKETFVEDVPESRLESFQEAGIETFFGPASFQNENTLQVGNDILSAKKIVIATGATPNTLKVEGQEHIQTSDDFLSLEKLPDSVVFIGGGYISFEFASIALAAGRDVHIIHHNSEPLKKFDPDFVAALVATLKEEGIHFHFDTDITKINKNGEKLHIEGKNGFSLETDLIIGATGRTPNIAHLALDKANIDYTKKGITVNEKLQTPNHPHIYACGDVAATKGAPLTPVVSMEAALVAKNILGGNEKIDYPAIPSVVFTSPKLASIGISMEEANANPEKYQIKNHDTTNWYTYRRTNEKIALAKIIEDRETGQIKGAHFLSEEADYMINYIAILMKANLTLADLQSVIFAYPSPASDLTALN

SEQ ID NO: 87743 - protein, 267 aa, Methanosarcina acetivorans C2A
MTSDSYFLKLCREAYRAAYDATCDLVGTDSASSFVCMGADGTPTTCIDLAAEDAIIEVLKTDGRPMRILSEELGELVTGKSPEFSVVLDPLDGTYNASVGIPFYSVSIAFASHDLSDLRFGYVSNLALREEYYAEAGKGAYLNGNRIKTSVNSDLKSLCVSVYGYRQNVERTRRIYSNVRRVRLFGSVALELCYAASGRLDAFVDVRKALRVTDVAAGQLILEEAGGLVTDGYGKTLRLPDNVTARVEMVASNGRVHKKLLSLLSGG

SEQ ID NO: 87744 - protein, 189 aa, Agrobacterium tumefaciens str. C58
MAQEKRGSRDDRQNREERDSEFVDKLVAINRVAKVVKGGRRFGFAALVVVGDQKGRVGFGHGKAREVPEAIRKATESAKRDLIFVPLRDGRTLHHDVNGRHGAGKVLLRSAKAGTGIIAGGPMRAVFETLGVHDVVAKSTGSSNPYNMVRATFDALKHQVHPKDIAAQRGLKYATLQARRAASGNASEE

SEQ ID NO: 87745 - protein, 645 aa, Kluyveromyces lactis NRRL Y-1140
MSTVNKKPASLKYKIGKVKQIPTVVKDDKTGLEYIQVQSRENEKVYGVTKFLNNYREEEKLGQGTFGEVFKGIHLGTNRKVAIKRILVRAEKDLFPITAQREITILKRMNHKNIVKLIEIVYDESPTPKTDSTSPRPVGNYHGNNTANQQKLITGKHFFMILPYMVSDLTGLLHNPRVEFGMADVKNIMLQLLEGINYIHCNKFLHRDIKTANILIDHKGVVKIADFGLARNYYGSPPNLKYPGGAGSGAKYTSVVVTRWYRAPEIVLGDRHYTTAVDIWGIGCVFAEFFEKKPILQGQTDIDQGHVIFKLMGTPSMDEWGLAYHLPGSELTKTNYKSTLQERFSKALNETGLDLLSKLLALDPYKRVTAMKAKKHPFFFEEPLPNAQLTLPNEECHESDIKRYKSEMNESMSQRPPSAPTGHTSTDNSIRAVTGAAFPKEASIPKAPRPEHIKSTIPAQPSASRYNGAATQNIPKEPIPTAPLPKGPKNSIPTGPNKLPPNPRDSYASKYPAESRFGVNTRITTESYNAGKRYRNRGGWETGRDSLNYNNNYAPPADRSHHPTIQRPSAPRGGSYPNRYQNQDYNTSRNTGYNQYSQAGDRRSYRPGASENPGTIGHGSSQSTQKDSKSSHSNNVKPKDVADYY

SEQ ID NO: 87746 - protein, 315 aa, Pasteurella multocida subsp. multocida str. Pm70
MTIYSDNSYSIGNTPLVRLKHFGQGNIVVKVEGRNPSFSVKCRIGANMVWQAEKDGILTKEKEIVDATSGNTGIALAYVAAARGYKITLTMPETMSAERKRLLRGLGVNLVLTEGALGMKGAIAKAEEIVASDPQRYVMLKQFENPANPAIHQQTTGPEIWRDTDGQIDVLVAGVGTGGTITGISRYIKQDKGKAILSVAVEPAESPVISQTLAGEEIKPAPHKIQGIGAGFIPKNLDLALVDRVETVSSEEAMQTARRLMAEEGILGGISSGAAVAAADRLAKLPEFAEKLIVVILPSASERYLSTALFEGIEA

SEQ ID NO: 87747 - protein, 159 aa, Brassica napus
MAIADFGQLNMEEPPPFWGSRGVDCFEKLEQVGEGTYGQVYMAREIKTGEIVALKKIRMDNEREGFPITAIREIKILKKLDHPNVIHLKEIVTSPGRDRDDQGKPDNNKYKGGIYMVFEYMDHDLTGLSDRSTQGFTVPQIKCYMKQLLTGLHYCHIKK

SEQ ID NO: 87748 - protein, 403 aa, Listeria innocua Clip11262
MKIIVQKFGGTSVQNEKIRLMAFNHIKNALKDGYKVVVVVSAIGRYGDPYATDTLLELIGAKDTKLTAREQDTLLSVGETISASVFTNMLREADIKAEAFSGGQAGIITSNNHLNAKITEVDTKRLKKALETLDVAVVAGFQGITENGDITTLGRGGSDTSAAALGVSLQADYIDIFTDVDGMMTADPRIVEHARSLPRVSYNEVSNMAYQGAKVIHPRAVEIAMTAKVPMRIRSTYLESTGTLVTSLADDSGHFDVKERMVTGVAHVTNLTQIFVKTDTVKAQQQTFKILADAGISLDFINISTDSVIFTVPEEKRRVVKQLLEEANLQTTVREDCAKVSIVGAGITGVPGVTAKIVGALSEKNIPILQSADSHTTIWVLVREEDLISAVNALHDVFCLEIK

SEQ ID NO: 87749 - protein, 479 aa, Medicago truncatula
MNESKKEGTISTTPLSIEERYSQWKSLVPVLYDWLANHNLVWPSQSCRWGSLLDHATYKNRHRLYLSEQTDGTAPNTLVIATCEIVKPRVAAAEHIAMFNEEARSPFVKKVKTILHPGEVNRIRELPSNTNIVATHTDSPNVMIWNVESQPNRNNAALDAPTSIPDLVLTGHKDNAEFALAMCSTEPFVLSGGRDKLVVLWSIHDHIATLATEEEPDVNEGSNVGGNSEKAAQSPSVGARGVYRGHKDTVEDVQFCPSSAQEFCSVGDDSCLILWDARVGSFPAVKVEKAHDGDVHCVDWNTHDINFILTGSADNTVRMFDRRKLNNRGGIGSPVYKFEGHDEPVLCVQWNPAKSSVFGSGAEDGIINIWDHEKVGKTSGSADTTVPETSPGLFFRHAGHRDKVVDFHWNASDPWTIVSVSDDCASTGGGGTLQIWRMMDLIYRPEDEVMAELDKFKSHILGCDTVTDSATDPATPSHT

SEQ ID NO: 87750 - protein, 479 aa, Saccharomyces cerevisiae
YVEFMSTNTKHYDYLVIGGGSGGVASARRAASYGAKTLLVEAKALGGTCVNVGCVPKKVMWYASDLATRVSHANEYGLYQNLPLDKEHLTFNWPEFKQKRDAYVHRLNGIYQKNLEKEKVDVVFGWARFNKDGNVEVQKRDNTTEVYSANHILVATGGKAIFPENIPGFELGTDSDGFFRLEEQPKKVVVVGAGYIGIELAGVFHGLGSETHLVIRGETVLRKFDECIQNTITDHYVKEGINVHKLSKIVKVEKNVETDKLKIHMNDSKSIDDVDELIWTIGRKSHLGMGSENVGIKLNSHDQIIADEYQNTNVPNIYSLGDVVGKVELTPVAIAAGRKLSNRLFGPEKFRNDKLDYENVPSVIFSHPEAGSIGISEKEAIEKYGKENIKVYNSKFTAMYYAMLSEKSPTRYKIVCAGPNEKVVGLHIVGDSSAEILQGFGVAIKMGATKADFDNCVAIHPTSAEELVTMRGSHHHHHH

SEQ ID NO: 87751 - protein, 139 aa, Agaricus bisporus
MSGKGKAGKSGGKAGSETKSMSRSSKAGLQFPVGRVHRLLKKGNYAQRVGAGAPVYMAAVLEYLAAEILELAGNAARDNKKQRIVPRHLQLAIRNDEELHKLLGNVVISQGGVVPHIAPELLPSKSSKGKKDEGVSQEL

SEQ ID NO: 87752 - protein, 365 aa, Pseudomonas syringae pv. tomato str. DC3000
MGALLKQEKFLLLAIIAMFVAYPLEHVLLGNGQVVALVSGLALVGFIVCASMRVAHHAEMLAEKVGDPYGTMILTLSAVLVEVVILAIMMSNEPSPTLVRDTIYSAVMLDINGILGLAALMGGIKHGEQSYNDDSARTYSVMILTAMGVSMVVPEFIPKGDWKIYSAFTIGAMILLYTLFLRMQVGPHSYFFSYSYPEKKKRQGSDQTEEHAEPVNLTRSIATLITGVVVIGALAEVMSKTVDLGLEGTGAPPVMTAILVAAISAAPEILTALRAALANRMQSVVNIALGASLSTVILTVPVMEAMALYSGQPFQMAMTPVQTVMIFITLLVSAINLNDGETNAIEGMTHFVLFATFIMLSCLGL

SEQ ID NO: 87753 - protein, 380 aa, Zygosaccharomyces rouxii
MATHEEFIRTQVFGTVFEITNRYTDLNPVGMGAFGLVCSATDTLAGQPVAIKKIMKPFSTAVLAKRTYRELKLLKHLRHENLICLQDIFLSPLEDIYFVTELQGTDLHRLLQTRPLEKQFVQYFLYQILRGLKYVHSAGVIHRDLKPSNILINENCDLKICDFGLARIQDPQMTGYVSTRYYRAPEIMLTWQKYDVEVDIWSAGCIFSEMIEGKPLFPGKDHVHQFSIITDLLGSPPRDVINTICSENTLKFVTSLPHRDPVPFQERFKTVEPDAVDLLERMLVFDPKKRITAADALVHPYLAPYHDPTDEPTAEAQFDWDFNDADLPVDTWRVMMYSEILDFHKIGGGDGQIDTNAAFDDQVAAATAAPMAQHTNQTNQ

SEQ ID NO: 87754 - protein, 336 aa, Desulfococcus oleovorans Hxd3
MPFRIAINGYGRIGRCVLRALYESGRRADMAVVGINDLSNMDSIAHLTRFDSTHGRFAGRVVHEGATLYVNDDPIEVSFEKNPAALPWAKLGVDAVLECTGSFIDRATAEGHLKSGAKKVVFSCPAENADAIVVYGINHTSLKKDHTVISNASCTSNCIVPVIDVLDRALGIDHGMITTIHSIMNDQPVIDAYHNRDLRKSRSSGQSVIPVNTELPSGIDRLLPRLAGRFQAIALRVPTTNVSAMQLTAHVKTKTEAATVNEIFATGATGPLAGILGYTELPLVSCDFNHDPHSAVIDGSQTRVAGTTGVSVLAWFDNEWGYANRMLDTTFALLSA

SEQ ID NO: 87755 - protein, 444 aa, Gibberella zeae PH-1
MLSRRTTSSTSKARNDFWSKHPSVKIIILQWVDMCGVLRARLVPVSTFKKIVEANGYLNCAPLDTCVTTTAEFIPKLMPFFVDSGKIWPDVSSLKVANHNARGYTNAAVCFGHVEFQNTDARHILKTLVEKTKVHHGLEFLVGMELEFCLLLPGTLDPAEPGSAGVSHTSKLLRSKIWPLLNEIITALDGAGIEVEQAVKEYGASAYEVALSPLPPVEAIDAYVYTIEVIKNIAYKSDLVATFYPTPFAGETGQKSGQHIHISATSTNKDKSWDPDTAMAGLLSHIPALTALGLAQIDSYERVGIGKMCTGGLVGWGDNNRDMPVRRVTKNHWEVRINDATSNSYAMVAGIIGALLDPKPLKIQGATKFTMFYSAEEREKMGLTEPVPASLEEAVKELENDLDWAIHILGREYVEWFVALKKAEIVASSKMETKERRLFLLDTF

SEQ ID NO: 87756 - protein, 255 aa, Aspergillus nidulans FGSC A4
MPKSKPSKKDHHPSQSLSHQQPPNWPPLRPLVPSSDLYLDPLLPDQIYLIRNFLPASLCKTYVSFLASLPLTTTPGKPKKGDAVRVNDRFQIQDATFAENLWRGTALKELVTNPVSVDDGVGEYSDGGRSMKEIWGGEPLGLNANIRVYRYSPGQFFAQHYDDSNTLSFLSPSMPPKPARTTWTLLIYLSTCTGGETVFYPQRTRSDPNPEPISVAPEMGMALLHRHGDQCLLHEGKEVTHGEKWVLRSDLVVAR

SEQ ID NO: 87757 - protein, 297 aa, Desulfococcus oleovorans Hxd3
MKHKEDPVTVGRNDPCPCGSGKKYKKCCMGRETTPQSSLARAYREKYGICIKQAEDIRAIARAGRLALELLDRVEQMLRPGITTDQVNTLVHDQTVAAGAVPAPLNYRGFPKSVCVSVNDEVCHGIPGNRILQAGDIVNVDVTPILNGYYADVNKTFFVGTPGLNAVKIVDVTRRSLAEAMAMVTPGNHVGDIGWAIQRYVEARDCSVVREFVGHGVGFDFHEPPQVPHYGRRGEGVVLVPGMVFTIEPMINLGAKGIRVLPDGWTAVTADGSLSAQFEQTLVVTSDGFESLTPFDL

SEQ ID NO: 87758 - protein, 347 aa, Clostridium thermocellum ATCC 27405
MKGKMKVCVLTGKEKLEWVERDIPQPGRGELQIKLKHVGVCGSDLHFYKEGRLANWELDGPLALGHEPGGIVSAIGEGVEGFEIGDKVALEPGVPCGECEDCRKGHYNLCKHIKFMAIPHEKDGVFAEYCVHSASMCYKLPENVDTMEGGLMEPLSVALHATELSNAKIGETAIVLGSGCIGLCTVMALKARGVSEIYVTDVVDKRLEKALEVGATRVFNSQREDIVEFAKTLPGGGADQVYECAGSRVTTLQTCKLIKRAGKVTLVGVSPEPVLELDIATLNAMEGTVYSVYRYRNMYPIAIAAVSSGVIPLKKIVSHVFDFKDCIEAIEYSTNHKDEVIKSVIKF

SEQ ID NO: 87759 - protein, 450 aa, Streptococcus pyogenes MGAS315
MVIPYDYIVIGGGSAGIASANRAAMHGAKVLLAEGKEIGGTCVNLGCVPKKVMWYGAQVADILGTYAKDYGFDFKEKAFDFKQLKANRQAYIDRIHVSYERGFEQNGVNRIYDYAVFKDAHTVEIAGQLYTAPHILIATGGHPVFPDIEGAQYGISSDGFFALDEVPKRTAVVGAGYIAVELAGVLHALGSKTDLFIRHDRPLRSFDKAIVDVLVEEMAVGGPCLHPHSEVAKVVKNTDESLTLYLKDGQEVEVDQLIWAIGRKPNLEGFGLDKTGVTLNDKGYIETDAYENTSVKGIYAVGDVNGKLALTPVAVAAGRRLSERLFNGKTDEKLDYQNVATVIFSHPVIGSVGLSEEAAVKQYGQEAVKTYQSRFTSMFTAITNHRQPCLMKLVTVGDTEKIVGLHGIGYGVDEMIQGFAVAIKMGATKADFDNTVAIHPTGSEEFVTMR

SEQ ID NO: 87760 - protein, 278 aa, Lactobacillus acidophilus NCFM
MEKFVTLNNGIKMPRLGFGVYQIDDLAQAQQVVEDGLEVGYRLVDTAQIYGNEQAVGDAIKHSNVPREDIFITSKIWVDDYGYDNTLKAFDDSMKKLQLDYIDLYLIHKPYNDYYGTWRALERLYQEGRIRAIGVSSFWNERLADLITFNDVKPAVNQIETNVWNQEWKSQQYMEKEGVQPEAWAPFAEGANHIFTNPLLEEIAEKHHKTTAQVMLRWFLQRNYVVIPKSVHKKRLAENYDVFDFELDADDMKKIKTLDQGHSILEDEMDPEIAESFR

SEQ ID NO: 87761 - protein, 547 aa, Sorghum bicolor
MARRAASSLVSRCLLARASAPAAPPAVPSALRRPDGMRGLLPGVLQRFSTAAAVEEPITPSVQVNYTKLLINGNFVDAASGKTFPTLDPRTGEVIAHVAEGDAEDINRAVAAARKAFDEGPWPKMTAYERSRILLRFADLIEKHNDELAALETWDNGKPYEQAAHIEVPMVARLMRYYAGWADKIHGLVVPADGPHHVQILHEPIGVAGQIIPWNFPLLMFAWKVGPALACGNTLVLKTAEQTPLSALYISKLLHEAGLPEGVVNVVSGFGPTAGAALASHMDVDKLAFTGSTDTGKVVLELAARSNLKTVTLELGGKSPFIIMDDADIDHAVELAHFALFFNQGQCCCAGSRTFVHERVYDEFVEKAKARALKRVVGDPFRKGVEQGPQIDDEQFNKILRYIRSGVDSGANLVTGGDRLGEKGYYIQPTIFSDVQDGMKIAQEEIFGPVQSILKFKDLNEVIKRANASPYGLAAGVFTNSLDTANTLTRALRAGTVWINCFDIFDAAIPFGGYKMSGIGREKGIDSLKNYLQVKAVVTPIKNAAWL

SEQ ID NO: 87762 - protein, 204 aa, Clostridium thermocellum ATCC 27405
MKIYLIRHGETDWNKKLKIQGQVDIPLNQTGRMQAEIAAKYLDGIQFDAVFSSPLLRARETAKIIIKDRKIPFYIDDRLKEISYGIREGQSLRLIHAFPFLRLHAYFKKPESYIPPKGGETIRELKDRCRSFLDERIVPMEEIYNNVLISGHGALIRAMISVVVSLPDSYFWSGKEQGNCAVTIMECKNKEIKLIEEAIDTQSN

SEQ ID NO: 87763 - protein, 767 aa, Xanthobacter autotrophicus Py2
MNDCCASTASRDKVAASASATLPSYAVRPGVTFPDWPVVSSLVVKDALLAMVGSGHVLNRWSGYDPATDRVRVVLLQLYAEHGRAPTPGALAKCAALSETAIQPLLQDLRRRDLVVLDGDKIVGAYPFTDRDTGHRVTLDGRTLNAMCAVDALGIGAMTGHDIAIASSCRYCGAPIRIATRDRGRALAQVEPRTAFVWLSVRYEGACAANSLCAATSFFCSDDHLAAWRQERRSAEPGFRLSIEEALEAGRAIFGPSLAGVTAGERAVDLAAEARGAFPSSVDTVSKNTPTAGRRVASNGRNGGGYDLVVIGAGSAGFSAAITAADQGAQVALIGSGTIGGTCVNIGCVPSKTLIRAAETLHNARAAARFAGISAEAEVTDWRGTVRQKDALVSGLRQAKYIDLLPAYNGIAYREGPARLMDRGVEVDGTRIPAGKIIIATGARPAVPAIPGIETVPYLTSTTALDLEELPRSLLVIGGGYIGAELAQMFVRAGVKVTLVCRSRLLPETEPEISAALTAYFADEGITVTSGIAYRAIRKTEDGVSLIVARDGQDTTIEADRVLITTGRTPNIESLGLAEHEIAVSSRGAIVIDDRMRTTRAGIYAAGDVTGRDQFVYMAAYGAKLAAKNALNGDSLRYDNSAMPAVVFTDPQVASVGLTEAAARTAGYAVRASTIGLDQVPRALAARDTRGLIKLVADAGSGRLLGAHILAPEGADSIQTAALAIRHRLTIDDLADTIFPYLTTVEGLKLAALSFSKDVAKLSCCAG

SEQ ID NO: 87764 - protein, 188 aa, Picea sitchensis
MASVMMASMVSSTAALTTMPRKNGVQSLASSVSALNNLKSGSAAFSAKLEWEEKTTTNGSRVHCMQVWPPINNRKYETLSYLPPLSQESLVKEIDYMISKGWVPCLEFDAVGQIQRTNGVMVPGYYDGRYWSLWKLPMFGCTNSAQVLSELEECKKAYPNAYIRCLGFDNKRQTQCIAFIVHKPSHTQ

SEQ ID NO: 87765 - protein, 535 aa, Hyphomonas neptunium ATCC 15444
MPVLKSALDVSGAKFAANRAAMQALVEELRAKTAQAALGGPEDSRKRHTERGKLLPRERVERLIDPGSAFLEIGALAANGMYDGEAPGAGLITGVGRVEGRECLIVCNDATVKGGAYFPVTVKKHLRAQEVAMENHLPCIYLVDSGGANLPHQSEVFPDREHFGRIFYNQAQMSAKGIPQIAAVMGSCTAGGAYVPAMSDETVIVRKQGTIFLGGPPLVKAATGEEISAEDLGGADVHARRSGVADHYAAHDAHALAIVRSIVRTLAKPKPQPFEIQAPAEPLYDPREMHGLVPQDVREPYDAREVIARTVDGSEFHEFKKLYGETLVCGFAHIYGMPVAILANNGILFSESAQKAAHFIELADQRRIPLVFLQNITGFMVGSKYEAGGIAKDGAKMVTAVATASVPKFTVVTGGSFGAGNYGMCGRAYSPRFLFMWPNARISVMGGEQAASVLATVKRDGIERRGGQWSAEEEQGFKQPIRDLYETEGNPYFSTARLWDDGIIDPADTRRVLGLALSASLNAPFGERGFGLFRM

SEQ ID NO: 87766 - protein, 224 aa, Haemophilus influenzae Rd KW20
MKPYLIAPSILSADLARLGDDVQNVLNAGADVIHFDVMDNHYVPNLTFGPAVCQALRDYGITAPIDVHLMVKPVDRIIPDFAKAGANYITFHPESSEHIDRSLQLIRDCGCKSGLVFNPAMPLSYLDYVLDKVDVVLLMSVNPGFGGQSFIPATLKKLQQARKIIDESGYDIRLEVDGGVKVDNIAEIAAAGADMFVAGSAIFGKPDYKQVIDQIRTQLASVSA

SEQ ID NO: 87767 - protein, 474 aa, Salmonella enterica subsp. enterica serovar Typhi str. Ty2
MQYQLLINGVLVDGEGERQSVYNPATGEVILEIAEASPVQVDAAVLAADSAFAEWGQTTPKARAECLLKLADSIEQNALEFARLESQNCGKPLHCVINDEIPAIVDVFRFFAGAARCLSGLAAGEYLEGHTSMIRRDPIGVVASIAPWNYPLMMAAWKLAPALAAGNCVVIKPSEITPLTALKLAALAKDIFPPGVLNVLFGRGQTVGDVLTGHEKVRMVSLTGSIATGEHILRHTAPAIKRTHMELGGKAPVIVFDDADLDAVAQGVRTFGFYNAGQDCTAACRIYAQRGIYDALVEKLGNAVSSLKMGAPEDKSTELGPLSSLAHLKRVTAAVEEAKALSHIRVITGGSQTEGKGYYFAPTLLADAKQEDAIVQREVFGPVVSITVFDDEDQVLRWANDSRYGLASSVWTQDVGRAHRLSARLQYGCTWINTHFMLVSEMPHGGQKQSGYGKDMSLYGLEDYTLVRHIMVKH

SEQ ID NO: 87768 - protein, 148 aa, Chlamydomonas reinhardtii
MLARSLARPSSAFGRAVVARRLHVSCPAMRQVPVPQDVMPKQAQELLQEDYKYLDVRTTEEYAGGHAPAAVNVPVVNFGPGGMVPNPGFLQAVEAAFPDKQERLVVGCKSGRRSLMAIDLLSQAGYCELVNLAGGFDLWAGQGLPVVR

SEQ ID NO: 87769 - protein, 657 aa, Rhodopseudomonas palustris CGA009
MSTPEPTLPHPGSAALPQGGALPHPASLEQASAAAVGAPDVASIARLANAFFSALPTGAVPEPGAALGSAPLFVAEPLHNAIPGTPALSPSYKPNHNPGAASPIPTIGAARPSGPIFALDPKLGPEPTTAVSSVPQELKVPLAAPPVAPPPPSAPAVQPVFARDTDLAALPGRLDESRSFVPRTALPSAGPFGAAAAATAAPLYFLADNPALTHATPASAAQPRVETFDLTGLAPQHRPDVHVLDLSGARPFDANVFKRDFPILRETINGRPLVWLDNGATTQKPQCVIDRLVQFYTHENSNIHRAAHTLAARSTDAYEAARDKVRRFINASSVKDIVFVRGATEAINLVAQAWGRRNVGEGDEIVVSHLEHHANIVPWQQLAAEKGARLRVAPVDDHGQILLDEYEKLLGPKTKIVAFTQVSNALGTVTPVAEMTALAHRHGAKVLVDGAQGVCHMPVDVQALDVDFYAFSGHKMFAPTGIGVLYGKADVLEAMPPWQGGGNMIADVTFEKTIFQGPPDRFEAGTGNIADAVGLGAAIDYLSRIGMANIAAHEHELLAYGTEHLLTVPGLKLIGTAREKAGILSFVLDGCRSEDVGKALDREGIAVRAGHHCAQPILRRFGLESTVRPSLALYNTHDDIDVLVDALQRLQSGRGVR

SEQ ID NO: 87770 - protein, 339 aa, Picea sitchensis
MAQIGVRSFAQAAASEEVAAPLRSVQIDGLVVLKIIKHCKECSTALVTGQLLGLDIGSVLEVTNCFPFPSRGTEEEDEADADGANYQLEMMRCLREVNVDNNTVGWYQSTLMGSFQTVELIETFMNYQENIRRCVCIIYDPERSGQGVLAMKALKLQDTFMDLYKSNDFTGEKLREKNLTWVDIFEEIPVKISNSALVSSIMAELETDSPVSQGDYDRLVLSTNPFMEKNLEFLIDCMDDLSMEQQKFQYYYRNLSRQQSQQQAWLQKRRADNMARKAAGEEPLPEEDPSNPVFKPIIEPSRLESYLITNQVSNYCDQIKGFSGQSFSKLYLMEGVHKS

SEQ ID NO: 87771 - protein, 315 aa, Rhodopseudomonas palustris CGA009
MSQSAEPRVVTEPAWDLGEIVAELAGLRAISQRRRYRSRSLPELPSREAVAGIVDALVAALYPRHFGPAGLSEDSLDIYVADTIEQALRRLRREVGRELRLADLDGAAKPGEIEQQALTIAADFAHDLPRIRALLDSDIRAAFDGDPAAKSLDEVVFCYPGVAAMIRHRIAHRLYVLGVPMLARIVAEIAHAQTGIDIHPGATIGESFFIDHGTGVVIGETARIGKRVRLYQAVTLGAKRFETDEHGRIVKGGDRHPIIEDEVVIYAGATVLGRVTIGQGSSIGGGVWLTRDVPPNSVITQAKARHDAFEDGGGI

SEQ ID NO: 87772 - protein, 234 aa, Zea mays
  misc_feature (106)..(106): Xaa can be any naturally occurring amino acid
MAAAKIAPSMLSSDFANLASEAERMVRLGADWLHMDIMDGVRWHFVPNLTIGAPVIQSLRKHTKAYLDCHLMVTKPSDYVEPFGKAGASGFTFHIEVARDNWQDLXVRIQFRSGIKSKGMRPGVSLRPGTPVEEVFPLVEAENPVELVLVMTVEPGFGGQKFMPEMMDKVRTLRKKYPSLDIEVDGGLGPSTIDVAASAGANCIVAGSSIFGAADPGAIISVLRKSVEGSQNKN

SEQ ID NO: 87773 - protein, 127 aa, Azoarcus sp. BH72
MAYSDKLLDHYENPRNVGSFGKDDEGVATGMVGAPACGDVMKLQIKVGKDGVIEDAKFKTYGCGSAIASSSLVTEWVKGKTLDQALEIKNTQIAEELALPPVKIHCSILAEDAIKAAVADYKKKHEA

SEQ ID NO: 87774 - protein, 176 aa, Pyrococcus furiosus
MSQEWKEYAKRVLDEWEPKTKLGMMVKEGQITDIHEIFRRGYQIKEPEIIDVLLPEVNARENQEVLDIGSWECRCRRPHSVPFAVEGKEGSVRVRLIPGPRGLGLVIGDVGKKILRLAGVQDVWSQTFGETRTTVNFAKAVFNALYNTNRVAISPEMIERSGIVVGRAMPTTFTLE

SEQ ID NO: 87775 - protein, 1086 aa, Cryptococcus neoformans var. grubii
MASNDPKAKVILQSIATEKRNIEGARAVIRAFEASSKNETVIQQAQNEIRTATMSIKFLEDELAKLQVDGSGASSGTPGRGEPSGRAGAGVPGRQGPQGIATTSPGGRGMAGDRERPLPPPPPGAEQDNAKKPETKNYSQLDLLRYDAPLTGAKITRMLNQLQFKLQVEEQYRTGIEKMAQAYRAEGDKRLKSETDAKKSESEGKIQLLRKAKKRYESLAKFGGAVEDDEDLMSDGKRKEALRKPISGKLVISLRSARDLNHRTLPRRSSKTYSETTVIIKVEGNERAVSHPSRNDKWHEDFHIPVEKANEVEITIYDTVAPGDSAPIGMLWLRVSDLVEALRRQKVGIEGQGAGWVTAATAATMGPRSSGNAPDSVTLHSAGTLRGRPDAEGKGPDGIDGWWSVEPAGAISLRMDFVKDTVAGARRPYEALGRQGAVRMRKGDVYEMNGHKFVQRQFYQPIMCALCQEFLLTGEGYQCEDCRYACHKKCYPKVVTKCISKSNADGEGDEEKINHRIPHRFTSYTNMSANWCCHCGYMLPFGRKNAVKCSECALTCHQTCSHLVPDFCGMTMEMANLLLKNLRDIKTTQHRKPVPSTSTSSSVSTLPSYHSQEARSHPVQSAAPQQPALSPHPPAGTLPSADQRPIQPQAQNQQTGAYDNLRPAGGRAMPQLPPVAVPSSKISFEGERPQEPHAQIHPVMPSAQPQPQTLPPSAQSVQPPVKPHYVPQPPVQQQVTQRLPPQQPVMTRKRKVGLDDFNFLAVLGKGNFGKVMLAEEKTSSNLYAIKVLKKEFIIENDEVESTQSEKRVFLAAAQERHPFLLGLHSCFQTETRVYFVMEYISGGDLMLHIQKKQFTLRQAKFYACEVLLALQYFHSKGIIYRDLKLDNILLTLDGHVKVADYGLCKEEMWFGKTTSTFCGTPEFMAPEILLEQRYGRAVDWWAFGVLTYEMLLGQSPFRGEDEDEIFDAILEDEPLYPITMPRDAVSLLQRLLTRDPTRRLGAGEGDAEEIKQHLFFRDVNFDDVYHKRIPPPYFPVIGNATDTSNFDQEFTREQPTLTPVHTQLSEADQKEFAGFSWIAPWAAAQA

SEQ ID NO: 87776 - protein, 431 aa, Arabidopsis thaliana
MEMESCKLFIGGISWETSEDRLRDYFHSFGEVLEAVIMKDRATGRARGFGFVVFADPNVAERVVLLKHIIDGKIVEAKKAVPRDDHVVFNKSNSSLQGSPGPSNSKKIFVGGLASSVTEAEFKKYFAQFGMITDVVVMYDHRTQRPRGFGFISYDSEEAVDKVLQKTFHELNGKMVEVKLAVPKDMALNTMRNQMNVNSFGTSRISSLLNEYTQGFSPSPISGYGVKPEVRYSPAVGNRGGFSPFGHGYGIELNFEPNQTQNYGSGSSGGFGRPFSPGYAASLGRFGSQMESGGASVGNGSVLNAAPKNHLWGNGGLGYMSNSPISRSSFSGNSGMSSLGSIGDNWGTVARARSSYHGERGGVGLEAMRGVHVGGYSSGSSILEADSLYSDSMWLSLPAKAEEGLGMGPLDFMSRGPAGYINRQPNGGIAA

SEQ ID NO: 87777 - protein, 719 aa, Aspergillus nidulans FGSC A4
MAESPVDVLLKGSSGRSARGLLRIIILVTIAAAAVSSRLFSVIRFESIIHEFDPWFNFRATKYLVQNGFYDFWDWFDDRTWHPLGRVTGGTLYPGLMVTSGVIYHILRFLTFPVDIRNICVLLAPGFSGLTAFAMYLLTNEMSSSPSAGLLAAAFMGIAPGYISRSVAGSYDNEAIAIFLLVFTFFLWIKAVKNGSIMWGALAALFYGYMVSAWGGPRLYISYTTWYALGTLASMQIPFVGFLPIRNSDHMSALGVFGLLQLVAFAEFVRSYIPGKQFQRLLTASIILITGLAFAGLVVLSMSGIIAPWSGRFYSLWDTGYAKIHIPIIASVSEHQPTAWPSFFFDLNFLIWLFPAGVYMCFRDLRDEHVFVIIYAVLASYFAGVMVRLMLTLTPIVCVAAALVLSYILDTYLKTSPGPVTRGRSNDESSEGLRSARSPEVGITSYFSKAVTTSAAIVYLLLFVAHCTWVTSNAYSSPSVVLASRMPDGSQFIIDDYREAYYWLRQNTPANAKIMSWWDYGYQIGGMADRPTLVDNNTWNNTHIATVGKAMSSREEVSYPILRQHDVDYVLVVFGGLLGYSGDDINKFLWMVRIAEGIWPDEVKERDFFTARGEYRVDDQATPTMRNSLMYKMSYHNFNKLFPMGQATDRVRGAKLPAESPQLSTLEEAFTSENWIIRIYKVKDLDNLGRDHSNAVAFDRGNKRKKASKRKGPRVLRSE

SEQ ID NO: 87778 - protein, 257 aa, Mycobacterium smegmatis str. MC2 155
MDLTQRLAGKVAVITGGASGIGLATGRRLRAEGATVVVGDIDPTTGKAAADELEGLFVPVDVSEQEAVDNLFDTAASTFGRVDIAFNNAGISPPEDDLIENTDLPAWQRVQDINLKSVYLSCRAALRHMVPAGKGSIINTASFVAVMGSATSQISYTASKGGVLAMSRELGVQYARQGIRVNALCPGPVNTPLLQELFAKDPERAARRLVHIPLGRFAEPEELAAAVAFLASDDASFITGSTFLVDGGISSAYVTPL

SEQ ID NO: 87779 - protein, 448 aa, Xanthobacter autotrophicus Py2
MAEQYDLVVIGTGTAAMVAAMRVRAAGWSVAIIDYRPFGGTCALRGCDPKKMLVGGASALDHARRMRGNGVAGDVHIDWPELIAFKRTFTDPVPEKHEHRYDEKGIHTYRGHARFTGRNSLTVDGESLEARHVLIAAGAEPIRLGIPGEEYFATNEDFLAMERLPRRIVLVGGGYIASEFSHIAARAGVQVTILQRGKRMLGHFDPDLVGWLMDKFREIRVDVRLRTTVSAIEKDHAGFVVRASSEGGDATFDADLVVHSAGRAPALDALDLEAGGVAAEKGRLKLNEYLQSVSNAAVYAAGDAAQEGPPLTPVSSHDAKMVAANLLEGNRHRPDYRGVPSVAFTIPPIAAVGLSEEQARQQDLKFQTKSQKASDWFTARQAVEKTYGFKVMVEDDTGRIIGAHLVGPHADEVINLFALAIRHDLTADNLKTTMFAYPTGASDIGYML

SEQ ID NO: 87780 - protein, 745 aa, Gibberella zeae PH-1
MKQTIEDPFFEAEPTVIEELKQCIPTADGSLRYLKSLFPCFGWLPRYNWRWLVGDSIAGLTVGLVVIPQAMAYALLATLPPDFGLYTSFAGAATYWLFGTSKDIVIGTTAIGSLLVGEIVTHVHEARPDTYTSVEIAKTLSFMTGIILFALGLLRLGWLVEVIPYIPVSAFITAASIIIMCTQLPVLLGIPGVNTRDDPYRVLISTMRKLPDAQLDAAIGITCLVLLELAKYVFTKLEARQPARKKLWSIMSSLRLTFAMLLYTLVSYLVNRNLSEKESKFRIVGHINQGFIHAGPPALKTDLIGAILPQSPIILVILIVEHIAIAKSFGKKLGYDVVPSQEIMAQGTANILGPFLGGYSCTGSFGASAVLSKAGVRTPLAGLFNAFMLLLALYALTGVFYFIPRAALAGLIIHAVFNLIASPSTVRKYWRLSPFECLIWVVGVVMAVFTGLEPAIYTTTGLSFLLLLVRIARTRGEFLGKVEVEQTGETSENTDDPKTSATRDVYLSLDRNDASNRDILVESPHGGVLIYHFPEGLNYLNQAQHLKNLTDYVYTHTRRPDEEQKEDKGEALWCDTSGLCKQDNDLPVLRAIVIDCSTINNIDITSVQGLVDVRNALDRWASPSTIQWHFGGLHNRWARRALAAVGFGKSSTQDGYSFGSWAAVHTITASFGEATEGDHRRTSTDDENTIGTRHDNLSGEKRLSPVFALDRPLFNADLGEAVRAALEYARKSECRSHLQTDTETE

SEQ ID NO: 87781 - protein, 505 aa, Kluyveromyces lactis NRRL Y-1140
MVLPRFYAASSRAALQAARRAVPFTGVRGYAAAASSQGKVRAVIGAIVDVQFEQGQLPAILNALEIDTPEGKLVLEVAQHLGENTVRTIAMDGTEGLVRGENVSDTGAPISVPVGRETLGRIINVIGEPIDERGPINSKMRKPIHADPPLFVEQSTAAEVLETGIKVVDLLAPYARGGKIGLFGGAGVGKTVFIQELINNIAKAHGGFSVFTGVGERTREGNDLYREMKETGVINLEGDSKVALVFGQMNEPPGARARVALTGLTIAEYFRDEEGQDVLLFIDNIFRFTQAGSEVSALLGRIPSAVGYQPTLATDMGLLQERITTTKKGSVTSVQAVYVPADDLTDPAPATTFAHLDATTVLSRGISELGIYPAVDPLDSKSRLLDAAVVGQEHYDVATQVQQTLQAYKSLQDIIAILGMDELSEQDKLTVERARKIQRFLSQPFAVAEVFTGIPGRLVRLKDTISSFKAVLDGKYDHLPENAFYMVGGIEDVVAKAEKLAAEAN

SEQ ID NO: 87782 - protein, 541 aa, Lactobacillus acidophilus NCFM
MITVSDLSLKFGGRTLYEDVNLKFTPGNCYGVIGANGAGKSTFLKLLEGKLDPTTGSISIDPNERMSSLNQDHFAFDDFTVMDTVIQGHKELYQVMKEKDALYAKPDFGDEDGVKAAELESKFAELDGWNAEADASKLLQSLGIPEDEHQVLMKELPESEKVKVLLAQALFGNPDILLLDEPTNGLDVHTVEWLENFLADYPNIVIVVSHDRHFLNQVCTEMCDVDRGKIQLYVGNYDFWYESSKLANELAANQNAKKEEKIKQLQEFIARFSANASKSRQATSRKKQLDKITLDDIKPSSRKYPFVKFEMHRDLGNDLVKVENVSYSVDGEKILDNVSFIVRPGDKVAFLSRNSLAATALLDIIAGKIEPDTGSVTWGQTTAFNYMSRDLNANFNNDDLTILDWLRQYATKEQDDNTFLRGFLGRMLFSGEEIEKKIKVLSGGEKVRCQLSRMMLEPANVLIMDDPTNHLDLESITALNDALVSHPGSILFTSHDHEFIQTIANHIIEVGPRGIVSRQDTTYDEFLDKSSIQEQVEKIYN

SEQ ID NO: 87783 - protein, 659 aa, Ralstonia solanacearum GMI1000
MHSPLELTLVLLAAAVIGVVLFRMLQLPPMLAYLVVGVVIGPNATGLESDSAQTRYLAEFGVVFLMFSIGLEFSLAKLRSMRRLVLGLGASQVVLTMLLTVPASLLLSRWYPLSWQASLALGGALAMSSTAIVSKMLAERLQLETEHGRNIISVLLFQDLAVVLLLIVVPSLGKNPTDLVLTLSIAAVKIIVALVLILFLGQKLLSRWFHLVAARRSQELFMLNLLLVTLGMAALTERLGLSMALGAFLAGMLVSETPYRLQVEEDIKPFRDVLLGLFFVTVGMLLDPRVVIGHWGLVIGLVIGPVLFKFALIALLARAFGSGGGTAIRTALGLAQAGEFGFVLLNQIDGMRLIDPLLSQAILAAMLLSMLLAPFLIQYSDAIAMRLSRTDWLMQSLAMTKIAAQSLQTERHVIICGYGRSGQNLAHMLEQEDISYVALDLDPDRVRDAAAAGERVVYGDAARRESLVAAGVHRAAAVAVTYADTASALKVLHHVQALAPTLPVIVRTIDDADLDRLQQAGAAEVVPEIIEGSLMLASHALVLLGVPLRRVVRRAQEMRDARYGLLRGYFHGQDDDEDMLERDAVRLHSVPLIKGSPAIGRPLGTLGLETFKTSVTAIRRQGIRALDPEPNTLLELGDIVVLRGTPDGLQQAEERLSPR

SEQ ID NO: 87784 - protein, 544 aa, Wolinella succinogenes DSM 1740
MSQALALKYRPTRFEDLIGQDPISQTLSLALDSGRLSHAYLFSGLRGSGKTSSARIFSKALNCAQGPSSTPCDVCENCLAAKEGRHMDIIEMDAASSRKIDDIRDLIEQTKYHPAMGRFKIFIIDEVHMLTKEAFNALLKTLEEPPPYVKFILATTDPLKLPATILSRTQHFRFKKIAHRDVIAHIQKILHLENVPFEPEALEMIARSGGGSLRDTLTLLDQSIIFCKGNLTPALVAQMLGLVDPELLERLFDAIFSHDEPTLSELLKELELHETEMVLEEIAIFLKEKLSQNHPQYPLGMLDRFFRIIADSQTLLSLGSHNAFVLTLTILKMKEALKIKEIDGMIEELEQELFSKNPAKPLAPSPLAPPLPVVSNPPSGSIATPNKEALFEHLKAKIYDRNYDLGECFEKNIRFVDFSEGILSWSSRAEGECKERLKDAYSVIKHFVKEVYGIEASIKQVTLPPPEAHDEEPAPPPLPSLEDSPPEESLEPEGSGCVASMLEESSAPCEDSKEKLTEAILESPLVSAAKELLEVKKIIVRSKV

SEQ ID NO: 87785 - protein, 236 aa, Hyphomonas neptunium ATCC 15444
MPDMASDTEKQNAAAAAMDFVEEGMTIGLGTGSTAKFFVEMLADEIADGLIVRCIETSNQTRELARSLGVPLIPFEQVDRIHLTVDGADEVGPGGVLIKGGGAALLREKIIANASDHMVVIADSSKEVPHLGAFPLPVEVTPFGYTITAKKVHDALVASGVERPRIELRKAAGSTDLLVTDGGNHILDCHCGRIPDPAKTGAYLSGVPGVVEHGLFIGIARTVIIGEENGAHIIEY

SEQ ID NO: 87786 - protein, 334 aa, Thermoanaerobacter tengcongensis MB4
MLAFLPKFLYNIMGLLIKFYGGRVVKGRLILIVDDDRFTRRILRDILEKEGYSIIEARDGEEAFRLYKEMLPDMVILDVVLPGMSGFDLLKILRKEEENLMLPILVLTAKGDFEEKIKGLELGADDYLVKPVNEKELVIKVNNLFQRIEHNRMANPLTGLRGNIDIKEEIKRRIKSKELFAVLYIDLDNFKSYNDYYGFLRGDEVIKLTAKILSDAVELVGNDKDFLGHIGGDDFVIITTPEKAEEMCKYIISRFDSEIKFLYDKKDRERGYIETTSRRGEKLKFPFVSVSIAIVTNEFRDFRSDLEISEVAAELKKKLKQMKGSCYLKDRRRG

SEQ ID NO: 87787 - protein, 231 aa, Ralstonia solanacearum GMI1000
MAAAVHRACRIVVRRHPGRVVAGYRIAFSLSVSAMTDASISPSSPVPASTELGDVTRYLRERIRTVPDWPQLGVMFRDITPLLQDPKSLRVLVDVFVHRYMGQGLNLVAGIDARGFILGSIVAYELNLGFVPIRKKGKLPFTTVAEEYMLEYGSATVEIHADACKPGDRVLLIDDLIATGGTMMAGKRLLERLGATVVEGAAIVDLPELGGSRLLMDGGLPLFTVCRFDGH

SEQ ID NO: 87788 - protein, 223 aa, Vitis vinifera
MSQNGKLMPNLDQQSTKILNLTVLQRIDPFVEEILITAAHVTFYEFNIDLSQWSRKDVEGSLFVVKRNTQPRFQFIVMNRRNTDNLVENLLGDFEYEVQVPYLLYRNAAQEVNGIWFYNARECEEVANLFTRILNAYSKVPPKTKVSSTKSEFEELEAVPTMAVMDGPLEPSSSTSSNVADVPDDPSFVNFFSEAVTIGNASSVAVTGQPYHLLLLLNQHLLL

SEQ ID NO: 87789 - protein, 388 aa, Picea sitchensis
MMGATMSGYIADYLGRKGALRVCSVFCIAGWLTIGFAKDPLPLDMGRLLVGYGVGLTSYTVPVYIAEISPKSLRGVLTTTNQLFITTGTLIVYLLGMLVNWRILAITGVIFPILLLTGLFLIPESPRWLAKVGRGKDFEAALQALRGKECDVSCEATEIMECINELESLPKTRILDLFQRKYARAVIVGVGLMLLQQFCGINAVIFYASSIFKAAGFSSGHTASVIVAIVQVLMTAVGASLMDKSGRRPLLMIAAGGMGISCFIVGLLFYIQGHFDESSLPQLARILSLIGLLGYISTFSIGMGGIPWVIMSEIFPLNMKRIAGSLVSLTAWLGSWIVTLTFNSLFSWSDAACFFIFCVVCAFTVLFVVKLVPETKGRTLEEIQSSFS

SEQ ID NO: 87790 - protein, 554 aa, Oryza sativa Japonica Group
MATAATLPSSSSSAAAAVQTISRVLSFPRRGGGGFLHLRRHPLAAAAAATRGRGPLLRLGPRRPFSASASAGDNGAAAGGDGGGCDYDYDLFTIGAGSGGMRASRVAASLYGARAAVCEMPFATVASDSLGGVGGTCVLRGCVPKKLLVYASKYSHEFEESHGFGWRYGTEPKHDWSTLMTNKNLELQRLVGVQTNMLKNSGVTIIEGRGKVVDPHTVSVDGKLYTAKNILIAVGGRPSMPDIPGIEHVIDSDAALDLPSRPEKIAIVGGGYIALEFAGIFNGLKSGVHVFIRQKKVLRGFDEEVRDFVADQMSLRGITFHTEETPQAVMKSDDGLLTLTTNKGSINGFSHNLGLEEVGVKMDKHGAIVVDEFSRTSVDSIWAVGDVTNRVNLTPVALMEGGALARTIFGNEPTKPDYSAVPSAVFSQPPIGQVGLTEEKAIEKYGDVDVYTSNFRPLRATLSGLPDRVYMKVIVCANTNKVLGVHVCGEDAPEIIQGIAIAVKAGLMKQNFDATIGVHPTTAEELVTMRSPTRKVRRDAVDEAKMKDEATSQK

SEQ ID NO: 87791 - protein, 310 aa, Zygosaccharomyces rouxii
MVTLQNSTSTLKLNTGQTIPQVGLGTWRSKENEGYKAVIEALKAGYRHIDGAAVYGNEGEVGKAIQDSGVPRNEIFLTTKLWCTQQRNPQEALDQSLQRLGLDYVDLYLIHWPVPLRTENIKDGNLFQFAEKPDGSKDVDLEWNFIKTWELMQKLLESGKTKAIGVSNFSVNNLKDLLAAPTTKVTPAVNQVELHPLLPQEDLIKFGKENGIVIEAYSPLGGENAPILSDPTVQEIAKANGVEAGHVVISWAVQKGLVTLPKSVTPSRIVGNLKVLTLSDSDVAKVDGLLKAKGERRTCYQDFSPFPIFQ

SEQ ID NO: 87792 - protein, 251 aa, Azoarcus sp. BH72
MFSHLREDLASVRERDPAARSTWEVLTCYPGVHALMFHRVAHAAWTRKLFWLGRFISHVSRFLTGIEIHPGATIGRRVFIDHGMGVVIGETAEIGDDCTIYQAVTLGGTSLYRGTKRHPTLGKGVVVGAGAKVLGGFTVGDGAKIGSNAVVVKPVPAGATAVGNPARVLDSERDSVRAQKAEQMGFSAYGVTRDMDDPLSKALHGLLDHAVETDRRLQCLLDRLAAAGINLDRATEQNDDFDAGRLSRMVD

SEQ ID NO: 87793 - protein, 1086 aa, Cryptococcus neoformans var. neoformans
MASNDPKAKVILQSIATEKRNIEGARAVIRAFEASSKNETVIQQAQNEIRTATMSIKFLEDELAKLQVGGSGGASGTPGRGEPSGGTGAGVPGKQGPQGVVASSPGGRGMAGDRERPLPPPPPGAEQDSAKKPETKNYSQLDLLRYDAPLTGAKITRMLNQLQFKLQVEEQYKTGIEKMAQAYRAEGDKRLKSETDAKKSESEGKIQLLRKAKKRYESLAKFGGAVEDDEDLMSDGKRKEALRKPISGKLVISLRSARDLNHRALPRRSSKTYSETTVVIKVEGNERAVSHPSRNDKWHEDFHIPVEKANEVEITIYDTVAPGDSAPIGMLWLRVSDLVEALRRQKVGIEGQGAGWVTAATAATMGPRSSGNAPDSVTLHSAGTLRGKPDAEGKGPDGIDGWWSVEPAGAISLRMDFVKDTVAGARRPYEALGRQGAVRMRKGDVYEMNGHKFVQRQFYQPIMCALCQEFLLTGEGYQCEDCRYACHKKCYPKVVTKCISKSNADGEGDEEKINHRIPHRFTPYTNMSANWCCHCGYMLPFGRKNAVKCSECALTCHQTCSHLVPDFCGMTMEMANLLLKNLRDIKTTQHRKPVPSTSTSSSVSTLPSYHSQESRSHPVQSAALQQPAPSSRPPAGALPSTDQRPIQPQVQNQQTGAYDNLRPAGGRAMPQLPPVAVPSNKISFEGDRLQEPHGQIPPVMPAAQPQPQTLPPSAQSVQSPVKPQYVPQPAVQQQVAQRLPPQQPLMARKRKVGLDDFNFLAVLGKGNFGKVMLAEEKTSSNLYAIKVLKKEFIIENDEVESTQSEKRVFLAAAQERHPFLLGLHSCFQTETRVYFVMEYISGGDLMLHIQKKQFTLRQAKFYACEVLLALQYFHSKGIIYRDLKLDNILLTLDGHVKVADYGLCKEEMWFGKTTSTFCGTPEFMAPEILLEQRYGRAVDWWAFGVLTYEMLLGQSPFRGEDEDEIFDAILEDEPLYPITMPRDAVSLLQRLLTRDPTRRLGAGEGDAEEIKQHLFFRDVNFDDVYHKRIPPPYFPVIGNATDTSNFDQEFTREQATLTPVHSQLSEADQKEFAGFSWIAPWAAAQT

SEQ ID NO: 87794 - protein, 270 aa, Azoarcus sp. BH72
MHPILNIAVKAARRAATVINRASTQLDLLAVQSKSPNDFVTEVDHAAEQAIVEVLREAYPGHGILAEESGELAPANGGESEFTWIIDPLDGTTNFIHGFPQYAISIALAKNGVLEHGVVYDPNRNELFTASRGSGAFLNDRRIRVSRRTRLNEALLGTGFPYRQFDNVDAYLAIFRELTQKSAGIRRPGAAALDLAYVACGRLDGFWEFGLAPWDMAAGALLIQEAGGLISDLGGEANYLATGNVVAGAPKVFGQLLPVIQSYRTANLQA

SEQ ID NO: 87795 - protein, 563 aa, Bradyrhizobium japonicum USDA 110
MSAPSGLQGSWLRYFPPSSWLATYRRSWLPSDAVAGVTLAAYAIPVSLAYAALAGLPPQVGIYGYMLGGFGYALLGSSRQLAVGPTSAISLMIVGTVGPLAAGDPVRYGQIASLAAFAVAVLCLIAWLCKLSVLVRLVSDSILVGFKAGAGLTIIMSQLPSLFGVAGGGHDFFERGIELAGQLGDVNPLVLAVGLVAFLLLLTGERLLPGRPVGIAVVALAIAVATALGLPALGVPVTGRIPQGLPVPGLPTFGLLEFDDLFPLAAGCVLLAYIEGVSAARSFAAKHGDSLDVRQEFLGLGAANLATALGHGYPVAGGLSQSAVNDSAGARTPLALVICSGTLALCLLFFTGLLTNLPKAVLAAIVFAAVYRLVDIRTLARMWRVSRIDFYAAVIALVSVLLLGILQGVLLASIASIFLLLARASQPNVAFLGRLPGSGRYSDSARHEDVEPLVGIIAFRPEASLLYINAEMILEVVLNALQRSSDVRLVACDLSASPYIDLAGAHMLRNLHDELASRHVAFCIAGAHAQLRDLLRAEGLAERTDSGQWLRSLDNVLGDNQAR

SEQ ID NO: 87796 - protein, 376 aa, Desulfitobacterium hafniense DCB-2
MKAIVYEGIRDVKVKNVGDPGIQKPDDIIVKVTSTAICGSDLHLIHGMVPGMPEGFVLGHETMGIVEEVGGDVYNIKKGDRVIVPFPIACGHCWYCEHDLWSQCDNANPEAEVGAYFGYSNTFGGYDGGQAEYLRVPYANVGPKVVPEELTDEQVLFLTDILPTSYWGVEIGGVKKDDTVVVLGCGPVGLLTIKWAIFQGAKRVIAVDHISYRLDHAYRYYGVEVINFEDHDNTGEYIKEITHGGADVVIDCVGMDGKASTLEKIETLLKLQGGSKSAIEIATQAVRKGGTVALVGVYGSKYNLFPLGDFFSRNITLKMGQCPAHSYVEPIMELIKTGRFDATDIITHRLSLDKGEHAYEVFDEKKDNCIKVVLKP

SEQ ID NO: 87797 - protein, 379 aa, Streptococcus agalactiae NEM316
MKNEMLALILAGGQGTRLGKLTQSIAKPAVQFGGRYRIIDFALSNCANSGINNVGVITQYQPLELNTHIGNGSSWGLDGIDSGVTVLQPYSATEGNRWFQGTSHAIYQNIDYIDRINPEYVLILSGDHIYKMDYDDMLQTHKDNLASLTVAVLDVPLKEASRFGIMNTDSNDRIVEFEEKPEHPKSTKASMGIYIFDWKRLRTVLIDGEKNGIDMSDFGKNVIPAYLESGERVYTYNFDGYWKDVGTIESLWEANMEYIGEDNKLHSRDRSWKIYSKNLIAPPNFMTEDANVKDSLVVDGCFVAGNVEHSILSTNVQVKPNAIIKDSFVMSGATIGEGAKINRAIIGEDAVIGDGVVIDGSKEVEVIGYKEVVGVPNED

SEQ ID NO: 87798 - protein, 287 aa, Arabidopsis thaliana
MVSLVLMAIATMCCVQATIEEEAAKDESWTDWAKEKIGLKHEDNIQPTHTTTTVQDDAWRASQKAEDAKEAAKRKAEEAVGAAKEKAGSAYETAKSKVEEGLASVKDKASQSYDSAGQVKDDVSHKSKQVKDSLSGDENDESWTGWAKEKIGIKNEDINSPNLGETVSEKAKEAKEAAKRKAGDAKEKLAETVETAKEKASDMTSAAKEKAEKLKEEAERESKSAKEKIKESYETAKSKADETLESAKDKASQSYDSAARKSEEAKDTVSHKSKRVKESLTDDDAEL

SEQ ID NO: 87799 - protein, 377 aa, Streptococcus agalactiae NEM316
MKIDKYTAILGNTVSYPDMHSLTDNRPLASLPFDGKYRLIDFQLSSLANAGVRSIYGIFRGNNVRSVFDHIRSGREWGLGTLLSHYSLGFYDTDDDIRTVNGDYYDQILTYLRRSGSDQTIYMSCDMLCNIDLSQVIHLHNANGTQATVVYKKMPRSAIAEANQVLTIDESDHVVSLGKAVDNDDNQKMSAEIYVINTPWLIEKMEEEAQNNEPRKLRFLLRDLIVESNALAFEYTGYLSNISSIKSYYDANMDMLTPNKFYSLFFSNQKVYTKVKNEEATYFDKQSNVSNSQLASGSIIKGYLDHSIVSRNCLLENGTRVVNSIIFPKVKIGEGATIENTIIDKCVKVAPGVTLKGSLDKPLVIPKFSEINEDIIQ

SEQ ID NO: 87800 - protein, 285 aa, Kluyveromyces lactis NRRL Y-1140
MSRYTLAIVGCGVMGQALLSAIYNAPKASDEALQYYPSKIIACNDVPASAELVEKLVSGFETSPNGIEVEIATNDNERAVAEAKVIILGLKPHIVEPVLQQIPNEDGSKLLISLAAGVTLNQLSQYYKKVSRVMTNTPAKYGYGTAIVSHSTSVEPQDKAIVSELVSQVGKCLELPEKNMDAATALVGSGPAFVLLMLESMMEAGLKMGIPLKESRECAMKVLEGTAKMVEISGQSPGVLKHQVCTPGGTTIAGLCVMEDKGVKSGIIRGIEEAARVSKELGQKK

SEQ ID NO: 87801 - protein, 213 aa, Pseudomonas putida KT2440
MSRNSYIQQSSDIQAAGGLVPMVIEQSARGERAYDIYSRLLKERVIFLVGPVEDYMANLVVAQLLFLEAENPDKDIHLYINSPGGSVTAGMSIYDTMQFIKPDVSTICIGQACSMGAFLLAAGAKGKRHCLPNSRVMIHQPLGGFQGQATDIEIHAQEILNIKARLNELLAYHTGQDLETIKRDTERDNFMSASRAAEYGLIDSVYDKRQLAS

SEQ ID NO: 87802 - protein, 154 aa, Streptococcus thermophilus CNRZ1066
MSLRGARKIFQTARSILKRDPVAHSLLEVFLTYPGIRVLFWYRITHFMAFHRLYTIAGFLSQHAAKVTGISISPEAKIGKRVFIDHGIGVVIGATAMIEDDVTILHGVTLGARRAVEGRRHPYVKRVHSLVPTPNCLAPIRSAPLVKLAQGQLS

SEQ ID NO: 87803 - protein, 327 aa, Aspergillus nidulans FGSC A4
MAAPAEKQSSKYDDYDFPTTAPEAQPGHPGHTTPEQDAKVEQLRSELEQEGYTERLDTLTLLRFLRARKFDVAAAKAMFIASEKWRKEFGTDDLARTFEYTEKPEVFKYYPQYYHKTDKDGRPVYIEKLGNINIAELQKITTDERMLKNLVTEYEKLADPRLPACSRKAGKLLETCCSIIDLKGVGITSAPSVYGYLKMTSAVSQNYYPERLGKLYLINAPWGFSTVFSVVKSFLDPVTVNKIHVLGSGYQSELLKQVPKENLPQQYGGTCQCEGGCEYSDMGPWREPEWAREPKWANPKGNKGDVPAENPVAEKPTEAPEAPQPAA

SEQ ID NO: 87804 - protein, 421 aa, Xanthobacter autotrophicus Py2
MTASPSPVWHPFTQHALAPEPPVVVRGNGAWLETASGGRILDAISSWWVITHGHCHPRIVAAIAEQAGQLDQVIFAGHTHPAAEALARGLVAMTPEGLDHVFFSDSGSTAVEVALKMAAGYWRHTGEQRTRILALEHGYHGDTIGTMSVGARGVYNAAYEPFLFEVTRLPFPEKGREQATLDALEAACREAPAALLVEPLILGAGGMYIYGPGVLAEMAAICARHGVLFIADEVMTGFGRTGTLFACEQAGVVPDIACYAKGLTGGSLPLAVTLCRSAIFDAHYSTDRARTFFHSSSFTANPIACAAAVANLKIWAEEPVRGRITALGDAQEERLANFRDDRRFANVRRIGTIAALDLVAPDPGYLADVGPRLAAFFRDEGLLIRPLGNTLYVMPPYCTTAEDLDLVYGAIATAADRFGRA

SEQ ID NO: 87805 - protein, 590 aa, Zymomonas mobilis subsp. mobilis ZM4
MNSSLFSDSLVILGAAGLIIPAFARFRISPVIGFILAGAVLGPKALGSLVTEYPWLKHITISDPDGIEPFADFGIVLMLFSIGIELSFKRLWAMRQAVFGLGTGKLLGCGFLIGAGLYALGENWAGAIGMGLALSVSSTALVLPLVGTTGPVGKNAFAILLFEDLALVPIIFALGAMAPYGQDNRWDGLIATIWQGGATVIAILVLGRFALPTLFAQAARTKSAEVFLSISLLVVILASVATSAMGLSPIVGALTAGLLIAETDYHVEVEMVILPFQRLALGVFLLTVGMSLDLRLIMANWQALALGVAGVVLVKTLVTSTLLRLSHVRLATAVESGLLMSAPSETTLVILATARQAQLIMPSTAAFWEIVTAIGLTITPLLAKIGHKVSLKLTLREHNLTLPSNEEPIEDIENHTIVAGIGRVGKVIADVLTSEKKPYLAIDSDIDLVINAKRDGYHATFGDISNPVFIQQLGNKINAVVLAINDPVSMVNVVHRLHTIYPDLTIIARASDSRHAAQLFRAGATDIVAETLESSLRLAEATLISLGVSTGHAVAAIHDKRASMRENVLKAAEEGNMQAIRHTPSIMPEA

SEQ ID NO: 87806 - protein, 557 aa, Coprinopsis cinerea okayama7#130
MGATDVDPFEYLTRPPPNETPEERTIRERKEVEAKKVSDQIDEEIRKERAVMKKQQNAVRVLLLGQSESGKSTTLKNFRMRYAREEWQAELASWRTVIQLNLIRSVLSILDAVQSELDNDPAEPPGTPGADETEFLHTPTDGSTSPALASPAFNHPSSSKPGQRRPSVSSIHRQLQSKASSSSLRKDALGGKESSLLGGQHQLLKLRLAPLRRVETDLRRQLGASADDEVVDGAASDEYGALGQVDAGSSVRSTGLRRRTTARKEVSVRRLKDALSGGDRAGKSKGHSRTNSEGSGDDAVDEATDVIAKCKDDIKALWMDEAVRLVLKKRKIRLEDSAGFFLDDVDRIAAREYVPSDDDVVRARLRTLGVQEYRITVDQPGSVLSGLGATGSEWLLYDVGGSRTMRHAWIPYFENITAIIFLAPVSCFDERLLEDSRINRLEDSFLLWRHVCSSKLLQKTSLILFMNKCDLLKRKLKMGVKVNKYLPSYADRPNEAGHVVKYLKEKFRDIVKANAPEGGRVAYYYATSVTDTKTTYTTLKAVKDIILRDHLKNADFV

SEQ ID NO: 87807 - protein, 271 aa, Saccharomyces cerevisiae YJM789
MQEFKIAPVGAQSFAEAMRMGSEVYHHLKILAKEQYGPSAGNVGDEGGVAPDIDTAEDALDMIVEAINICGYEGRVKVGIDSAPSVFYKDGKYDLNFKEPNSDPSHWLSPAQLAEYYHSLLKKYPIISLEDPYAEDDWSSWSAFLKTVNVQIIADDLTCTNKTRIARAIEEKCANTLLLKLNQIGTLTESIEAANQAFDAGWGVMISHRSGETEDPFIADLVVGLRCGQIKSGALSRSERLAKYNELLRIEEELGDDCIYAGHRFHDGNKL

SEQ ID NO: 87808 - protein, 535 aa, Burkholderia pseudomallei K96243
MPIIESKLNPRSDEFRANAAALEALVADLREKIDRLALGGGQAARDKHLSRGKLLPRDRIAQLLDPGTPFLELSQLAAYGMYNDDAPGAGLITGIGRIAGRECVIVCNDATVKGGTYYPVTVKKHVRAQEIAAENRLPCVYLVDSGGANLPNQDDVFPDRDHFGRIFFNQANLSAAGIAQIAVVMGSCTAGGAYVPAMSDESIIVRNQGTIFLGGPPLVKAATGEEVSAEDLGGGDVHTRLSGVADHLAQNDAHALAIARAIVGNLGARGGAAPAMREPLPPRYDARSVYGVIPVDTRKPFDVREVIARIVDDSAFDEFKARYGTTLVTGFAHIWGQPVGIVANNGILFSESATKGAHFIELCCQRKIALVFLQNITGFMVGRKYENEGIARHGAKMVTAVSTAKVPKFTVIIGGSFGAGNYGMCGRAFGPRFLWMWPNARISVMGGEQAASVLATVRREGIEAKGGEWSAQDEEAFKQPIRDQYERQGHPYYASARLWDDGVIDPAQTRDVLGLALAAARNAPIEDTRFGVFRM

SEQ ID NO: 87809 - protein, 254 aa, Saccharomyces cerevisiae YJM789
FFNVLNGGAHAGGSLAMQEFKIAPVGAQSFAEAMRMGSEVYHHLKILAKEQYGPSAGNVGDEGGVAPDIDTAEDALDMIVEAINICGYEGRVKVGIDSAPSVFYKDGKYDLNFKEPNSDPSHWLSPAQLAEYYHSLLKKYPIISLEDPYAEDDWSSWSAFLKTVNVQIIADDLTCTNKTRIARAIEEKCANTLLLKLNQIGTLTESIEAANQAFDAGWGVMISHRSGETEDPFIADLVVGLRCGQIKSGALSRS

SEQ ID NO: 87810 - protein, 795 aa, Colwellia psychrerythraea 34H
MQENVLWYQSLGMNDVDRVGGKNASLGEMISNLANVGVQVPTGFATTSFAFNEFLEQSGINEKIYQLLDDLDVDDISALGKCGAIIRQWIIDTPFLPQMQTDIEAAYAQLAGDFSDDASFAVRSSATAEDMPDASFAGQQETFLNVRGFDSVMVAIKHVFASLFNDRAISYRVHQGYDHRGVALSAGIQQMVRSDISASGVMFSIDTESGFDQVVFITSSFGLGEMVVQGAVNPDEFYVHKPTLAKGKPAVVRRNIGSKAIKMVYSDSQEHSKQVEIVDIDEADSNRFSLTDAEVEELAKQAVIIENHYGHPMDIEWAKDGLDGKLYIVQARPETVRSRENANVMEQFQLKADNNLEVVCEGRSIGHKIGSGEAKVLSSLAEMDKILPGDVLVTDMTDPDWEPIMKRASAIVTNRGGRTCHAAIIAREMGIPAVVGCGNATELIKAGDNITVSCAEGDTGFIYRGKLDYDVKTSEINDMPELPLKIMMNVGNPDRAFAFARLPHAGIGLARLEFIINKMIGIHPKALLNFDTQPAELQDEINDIIVGYESPVEFYIAKLTEGISTLAAAYSPEKVIVRMSDFKSNEYANLVGGEAFEPHEENPMIGYRGAARYISKDFRDCFALECEAIKRVRNDMDLTNVEVMIPFVRTLGEAAAVIDILAEHGLKRGENGLRIIMMCELPSNALLADQFLDYFDGFSIGSNDLTQLTLGLDRDSGLIAHLFDERDPAIKILLAMAIKACKARGKYVGICGQGPSDHEDFAAWLVEQGIDSVSLNPDTVLPTWLYLAEQLAKKS

SEQ ID NO: 87811 - protein, 236 aa, Moorella thermoacetica ATCC 39073
MVNVSENITRVLERIAAAARRSGRRPEDITLVAVTKTVPVERIREAVACGLKDLGENRVQELLSKQPHVEGVNWHLIGHLQRNKVRQVWDRVCLIHSVDSLELAREINKRATAAGRRVDILLEVNIAGEESKFGLVPDAVIPLVREIAGWPGLHICGLMTVAPLVADPEEVRPVFLRLAALRREVEALRLPGVDMAYLSMGMTNDFEVAIEAGANMVRIGSAIFGSRDYQTKVEVH

SEQ ID NO: 87812 - protein, 338 aa, Pseudomonas syringae pv. phaseolicola 1448A
MNLSKFKRYPLTFGPSPITPLKRLSEHLGGKVELYAKREDCNSGLAFGGNKTRKLEYLVPEAIDGGYDTLVSIGGIQSNQTRQVAAVAAHLGMKCVLVQENWVNYSDALYDRVGNIEMSRIMGADVRLDSAGFDIGIRPSWEKAMSDVEESGGKPFPIPAGCSEHPYGGLGFVRFADEVRQQEEELGFKFDYIVVCSVTGSTHAGMLVGFAADGRAQRVIGIDASAKPEKTRAQVLRIAQNTAKLVELGREITAEDVVLDTRYAYPEYGLPNEGTLEAIRLCARLEGVLTDPVYEGKSMHGMIDMVRNGEFPEGSKVLYAHLGGVPALNAYSFLFKDG

SEQ ID NO: 87813 - protein, 152 aa, Thermus thermophilus HB27
MRIGYGEDSHRLEEGRPLYLCGLLIPSPVGALAHSDGDAALHALTDALLSAYGLGDIGLLFPDTDPRWRGERSEVFLREALRLVEARGARLLQASLVLTLDRPKLGPHRKALVDSLARLLRLPQDRIGLTFKTSEGLAPSHVQARAVVLLDG

SEQ ID NO: 87814 - protein, 685 aa, Dehalococcoides sp. BAV1
MSYTSFGGGGFLLYNGYYTKTNMLNIQNLSKSFGVRSLYTGVNLNIGARDRLALLGPNGSGKTTLFEMIAGRLEPDEGKIILRRGTTVGYLEQDIKPSSKQPLLKAVSSASDRLRSLSHKISLLQGELAEEKDGSESNRLMNELGELQHSFEALGGYNAEQEAKLILAGLGFKPADFDRPLHEFSGGWLMRAELAKLLFLSPDILILDEPTNHLDLESTRWFESYLKQYSGSVLFTSHDRAFLNSIATKILSLEEQKARLYTGNYDSYLRERELRLIQLESQSRRQQELIDKETKFIERFRYKATKASQVQSRIKKLDKLSAIVIPRQTKKMHFNFPEPERSGHDVIKLRNLTKSYGDMVIYQGLELVLNRGDKVALVGPNGAGKTTLLKILAGVMLFDSGYRNLGVNVNTAYFAQYYVESLCPSNNLIQELETILPDAPEQQLRGMLGAFLFSGDDVKKRISVLSGGEKTRLAIAKMLLKPANLVLMDEPTNHLDIPAREILADALQAYKGTLCFITHDRTLIREVATKIIEVRNGKIRIFEGDYDAYLEFAAANPFEDEILKNRTAVSSPRPAPVSASLSQKQRKTLEGQIRNQHYKETGALKQEISDTEEEITGLEKSKQELETLLADPDLYRSGQKVADASLEYKTCKERLIILGEKWLKLCQQNDTLKQKLEDTLKELDN

SEQ ID NO: 87815 - protein, 120 aa, Glycine max
  misc_feature (37)..(37): Xaa can be any naturally occurring amino acid
  misc_feature (63)..(63): Xaa can be any naturally occurring amino acid
  misc_feature (97)..(97): Xaa can be any naturally occurring amino acid
AISMIFTPAATTVNRAGAGMVAPFTGLKSMDGFPTKXTNNDITSIASNGGRVQCVHVWPSVGXKKSETLYYLPYLDDAQLAKEVEYLLTKGWIPCLXLQWEHGYLYRDHNRSPRYYRWTL

SEQ ID NO: 87816 - protein, 355 aa, Desulfococcus oleovorans Hxd3
MGKSYNIAVIPGDGTGPEVVAEGVKVLNAAAARFGFNLDYTDYSLGGEHYKATGEILNDDTIDRLKKADAIFLGAIGHPDVKPGILEKGLLLKLRFTCDQYINLRPVRLYEGVYTPLKDKTPADIDFTVVRENTEGLYAGAGGFLKYGTPDEVAIQESINTRKGVERCIRFAFEYTRNRNKRKKLTLCGKTNVLTFAFDLWERTFHDVAKEYPDIETDYAHVDAICMWMVKNPEWFDVIVTDNMFGDIITDLGAMIQGGMGVAAGGNINPEGVSMFEPIGGSAPKYTGLGVINPIAAIMAGSLMLEHLGESAAADAIEQAAMTAIKKDLKSVEARKMGMSTAEVGARVAAYVAQS

SEQ ID NO: 87817 - protein, 407 aa, Coprinopsis cinerea okayama7#130
MIMDKVVLGDSNLAVGHSRFLAEAPAHTPWRHAGLGSINGDNPDDLSQDEFDGVGNGRGKILPTSSHLFKLILPLGDLSHPKNQHTKPETPGQIEPAKSSVPPTVILLHPSQPLSHVGRLITMSLAPAAPVVSFRSTSAGGQAFQWSDSTDVGDFIRDAARSAEFTICISYNPSDSLRNTLLEQETSRRIPVNKDSTTKQSEDKGVVETVITVEVPTFTDRTRYLRRRLKAIEQRLHEMELLKKECDREAHRGARRMALTGFGALVVYWAAVARLTFWDYGWDIMEPITYLSGLSTVILGYLWFLYQGREVSYSSVLAQSISRRRDALYRSKGLDIAKWEELVSERRALKKEIGRIAEDYEDRLPRDTSQDESEEAKATEVEKESLTSEGVVEKIEKGEEPGKAGRI

SEQ ID NO: 87818 - protein, 521 aa, Arabidopsis thaliana
MIKQSNKKKKNHKNSRIIIEVEDFPGGSDGFDLVLRFCYGGGISIDVSNVSILHCSSVFLEMTEKLCSSNLLLRTEKFLEGMFYWSWNDIVLCLKSCEQVFLHADSYGLVDKLVFGVLAKIPQNSDVSHVFSSSSPSSSASASASSQSPETAMIRSYSDKRSTSRSFSCRTSNEWWFDDMSILGPKIIEKLINTLGAHDKNNDSLVLTKFLLHYLKTKVPNKSTNKLEYSGLADTAVQGVVFAAKTAFSCRKMFWVLRVLSGFSISKESRIGLERVIGEMLDQATLDDLLIPAGGKGEKGVYDVDLVIRLLKVFVRIGNTEEGDQNLRMRRIGKLIDKYLREISPDQNLKVSKFLEVAESLPDSARDWFDGLYRAINIYLESHPKLSSEDRTKLCRCLNYKKLTLDTCKQLAKNPKIPPNIAVQALKSQQLSNETRPHSREDKNKVNKIWNSRKYLEEKPILVCLKGFDMSEKFEDDLMMNLERKQWNNSEKVSKEKKSEVMSRSVRHGHTHSSSSFPRLC

SEQ ID NO: 87819 - protein, 475 aa, Desulfococcus oleovorans Hxd3
MTGQMSKKELDAFSKKTIRKPALVWDALSPAETRQSFDFAENYKRFLDDAKTERKAVTVIQKALAAAGFVDIDGRAKGKGKFYKVFRNKAVAAAVVGSAPLDQGMRIIAAHVDSPRLDLKQNPLYEEVDLAMLKVHYYGGIRKYQWLARPLALYGTVVGKDGRSFDVEIGEAETDPVITIADLLPHLAAKLQNSKKLSDVFEAEKLNLVAGSLPAGDEKQKDRFKLTVLKYLFDRYGLVEEDFASAELEAVPAGRARDVGFDRGLIGAYGQDDRVCAYTALAAIQDLKKPPRTAVALFFDKEEIGSEGNSGARSRFMEDFIADLFEKQDAPVSERVLRKAITASEALSADVNAALDPDYQEVHEKRNAARLGYGICITKFTGSGGKSGSSDASAEYVGRVRQIFNRAGIVWQTGELGRVDQGGGGTLAKFLAAYGMDIVDCGPALLSMHSPFELSSKADVYMTFKAFKAFFDDRQ

SEQ ID NO: 87820 - protein, 239 aa, Malus x domestica
DWRDFLPYLRWVPNKTIENKIQRLYHRRKAVMNALIKEQKKRIASGEELNCYIDYLLSEAKTLTPEQIVMLLWETIIETADTTLVTTEWAMYELAKDQKRQDRLFEEIQNVCGTNKINEEHLSQMPYLGAVFHETLRKHSPAPIVPLRYVHEDTQLGGYYVPAGTEIAINIYGCNMDKNQWESPEEWKPERFLEPKYDPIDLYKTMAFGAGKRVCAGSLQAMLIACTTIGRLVQEFEWK

SEQ ID NO: 87821 - protein, 302 aa, Triticum aestivum
  misc_feature (18)..(18): Xaa can be any naturally occurring amino acid
MAMARRRVLALVSQLLQXRVLPAPRFLSSAAGGALDRLNSLPFARQAAHRNPAPPSPWDRLGGQKRTMFIQTQSTPNPQSLMFHPGKPVMEVGSSDFPNARTAMTSPLAKALFAIEGVTRVFFGSDFVTVTKSDETSWDYLKPEVFAAIMDFYSSGQPFSPSSYTFIVFKQWDYLKPEVFAAIMDFYSSGQPLFLDSNTAAAMDTAIHEDDSEIVAMIKELLETRIRPAVQDDGGDIEYRGFEPETGIVKLKMQGACSGCPSSSVTLKSGIENMLMHYVPEVKGVEQEFDGDEEAELAGQME

SEQ ID NO: 87822 - protein, 288 aa, Burkholderia sp. 383
MPAIAELFVYPIKSCAGIALSRAQLLETGLAYDRHWLITDPAGQMITQRSHPRLALIRTALDSDALVLNAPGMREIRTPLDGDVSPATPTMAATVWRDTVDAIDTGAETAAWLTEFLGMPTKLARFGPDARRGCNRKWTGEIDTHTQFADGYPLLVIGQSSLDDLNARLAAKGAPAIPMNRFRPNIVVSDLDAYEEDFVEHLDTEGATPVRLRLVKLCTRCPMPTIDQVTGAPDPAWPHEPTDTMQTYRANPNFDGELTFGINAIVVEGAGTWLEVGQSLEAEIGFGD

SEQ ID NO: 87823 - protein, 298 aa, Zymomonas mobilis subsp. mobilis ZM4
MAVNLKTMMEQVAQDIDRLFAEQLPVPEDPRRRLVEAMRYAAIGGGKRLRPLLVVATCALFNVDREAALRVGMAIECIHVYSLIHDDMPCMDNDDLRRGKPTVHKAFDDASAVLSGDALQALAFEILSEEKIHTDPHVRLELIQALAIASGKDGMVGGQAIDLAAETSTVPFDLPTITRLQQLKTGALFGFCLEAGAIMGRQNKDIRDRLKAYARDIGLAFQIADDLIDAEGDEAVAGKAVGKDAAAGKATFLSLLGLEKARSQAQALVDQAIAHLSVFGSEADYLRSIARYIVARDH

SEQ ID NO: 87824 - protein, 198 aa, Coprinopsis cinerea okayama7#130
MVAPRDAAQPAPGTGFNPEKTNTPLQGHVAFFDRDGDGIIWPWDTYNGFRDIKFGVALSLLAMCIVHFGFSYMTMGSWIPDPFFRLKIKYMHRAKHGSDSEVYTGIGEYDDNRFNYMFDMYTQPPHAYMTFPEAMYMVRANMNPWDFFGWFAAIFEWTATYIMLWPADGKMGREDIKGVYNGSIFYMISGRKPMGKVV

SEQ ID NO: 87825 - protein, 297 aa, Hyphomonas neptunium ATCC 15444
MTTQSDAQFTARTLSEALPYIQRYAGQTIVVKYGGHAMGDASLALSFARDVVLLKALGLNPVIVHGGGPQIGKLLDKLGIVSEFKDGLRVTDEATMEVVEMVLSGPINKSIVRAINQAGGKAVGLSGADGNLLRAEKATRTTRDPDSHIEQIVDLGFVGEPSEVDISVLNALLQADAALIPVVAPVGVGADGARYNVNADTAAGALAAALKASRLILMTDVAGVLDKQKQLIREIPASQVELLIKDGTAVGGMIPKLETAAQSVNHGVGAAVILDGRAPHALLMELFTEHGAGTLVS

SEQ ID NO: 87826 - protein, 340 aa, Bacillus cereus ATCC 10987
MKAAVWYGERDIRIEERETKELQPNDVKVKVAWAGICGSDLHAYLHPGSVPINMNTVMGHEFSGEIAEVGSHVTKFKKGDRVCIYPMMLKDPSNAEIERFITLDAVGAQIDGGFAEYVILPQKTIFKIPDHLPLELAAMVEPAAVSFQSIKDSNVREGDTVVVYGAGPIGLFAVLGAKAAGASNIIVIDLFDSRLDKATEMGATHVFNAKEVNPVEEIRKLFPGGADVAIEAAGVESTFNQAIQSTKVRGTMMVISFHTQDIQFNVPASLIFSGAKLMGSVGYSNETYNEVIELFANGRLPAQSIITSKIDIDNIAEQGFEALIHDKSQAKILVKLSGAH

SEQ ID NO: 87827 - protein, 264 aa, Moorella thermoacetica ATCC 39073
MDVKIGFLGAGAMAEALIRGIIQARLVQPERLWAYDIRAARLKELEQRFGLVAAASREELAAAADIIILAVKPQNVEAALTGLQVKGDKLVISIIAGVTLSRLAGYLGDVPLVRVVPNTPALVGAGVSALAAGARVGQEDLEKALAIFRSVGEAMVLPEEQLNAVTGLSGSGPAYVYMIIEALADGGVRQGLARPVALELAARTLLGGAQMVLATGEHPGVLKDRVTSPAGTTIAGLAVLEDRGVRGALIRAVEAATLRAGELE

SEQ ID NO: 87828 - protein, 262 aa, Oryza sativa Japonica Group
MAPLVSLSLPLPCAVPASSLPPRAEPDASSSFHPPASSSSSPRGGRLALAAAQPGSGRRWVGRWRAGVSSFSFLAPFFAGNKEKENREKAERLKEELLATIRPLDRGVDATAEDKERVEKIVQQLEEVNQVKEPLKSDLLNGKWELLYTTSESILQPQRPKFLRPFGTIYQAINTDTLRAQNMETWPYFNQVTANLVPLNSRRVAVRFDYFKIFNLISIKAPGSGKGELEITYLDEELRASRGDKGNLFILKMVDPTYRVPL

SEQ ID NO: 87829 - protein, 269 aa, Physcomitrella patens
MASQLVQAVAAVVVLQCISASWVGAWAGSAQAEGGDEVHWDYSGGSHGPGGWGDLKAEWGVCKSGSRQSPIAITALDLVTDRSLGKLDAKYRKRVHATLYNSGHGAEVSMPAGSGRLRIGGETYRPVQFHIHMPSEHTIMNQSFPLELHLVHKSDDGKLAVIGFLFEEGGESEFLAQFAHEVPSSNSPGVKVDLGHIKMMKPERNYGTYMGSLTTPPCAEGVTWILSLFNFQTASAEQLAKLRASVPKGHNNRPTFGSAGRGFRMRTNA

SEQ ID NO: 87830 - protein, 285 aa, Arabidopsis thaliana
MAKDVEGSDGFQTRDYEDPPPTPFFDAEELTKWSLYRAVIAEFVATLLFLYVTVLTVIGYKIQSDTKAGGVDCGGVGILGIAWAFGGMIFILVYCTAGISGGHINPAVTFGLFLARKVSLIRAVLYMVAQCLGAICGVGFVKAFQSSHYVNYGGGANFLADGYNTGTGLAAEIIGTFVLVYTVFSATDPKRNARDSHVPVLAPLPIGFAVFMVHLATIPITGTGINPARSFGAAVIFNKSKPWDDHWIFWVGPFIGATIAAFYHQFVLRASGSKSLGSFRSAANV

SEQ ID NO: 87831 - protein, 316 aa, Bacillus cereus ATCC 10987
MKNRVNPVLLPGLEMYPDQDLRPECLPTMREEASKVFPPTIIDETLSVTNEVIEGPDANPLRLKIYRPKSNNESLPALLWIHGGGYILGSINDNDDLAVKIAKEANCMVVSVDYRLAPEHPYPAPIEDCYAALKWIADNAETLNIDSNRIGVAGVSAGGGLTAALTLLARDRQYPSICFQMPLYPMIDDRNNTPSANEIKKGFVWNQKSNEAGWKMYLGKLHGTDHIPAYAAAARAEDYRNLPRTYTCVGQLDPFRSETLTYVTKLAEAGVDVEFHLYPGAYHGFEMMHPDADISVHAWNDYVRAVKTGFAKKELR

SEQ ID NO: 87832 - protein, 307 aa, Clostridium tetani E88
MLKGRSLIDPMDFTIEEISEILNLGENISKDPTKYSNLCHNKILATLFYEPSTRTRFSFEAAMLRLGGQIIGFSEPNSSSVAKGESISDTIRTVGCYADIAVMRHSKEGAPKVASTYSNIPVVNAGDGGHHHPTQTLTDLMTIRAKKGKLSGLTVGFCGDLKFGRTVHSLIKALSRYENNKFILISPTELKIPEYIRREILEKNNIEFKEVENIEETIKELDILYMTRVQKERFFNEEDYVRLKDSYILTKDKLENALEDMIILHPLPRVNEIAYEVDEDSRACYFQQAKYGMYVRMALILKLLGVK

SEQ ID NO: 87833 - protein, 647 aa, Bordetella bronchiseptica RB50
MNTPDLAYTHWRLHREADGLAWLALARADAAANSLSAEVMAELAAVLDALQAQPPNGLVILSGKENGFIVGADINEFGALQTPQQARELVARGWQLFNRLAATPYPTLALIRGHCLGGGLELALACRYRIAADDADTALGLPEAMLGIFPGWGGMRRLPALIGAPAALDMMLTGRRVDARRAAALGLVDARVPPRLLQAAARATVLSGRAPRRARGLPAWLNRWPLKALAARRARQSVAAKDPQGHYPAPRAIIDIWARHGGNALHAPDLIDGILASDTARQLLRVFRLQERLKGYGKAAVDAPVRRVHVVGAGVMGGDIAAWCAYRGLTVTLQDQDMARIAPALARAGAFFARKLKDRRAARAAFDRLVPDPQGDGVAQADLVIEAISENAQAKQALYRQLEPRLKPGALLATNTSSLSLAGLAQVLDQPQRLVGIHFFNPVARMPLVEVVLAADGDPRALARACAFVGRIGKLPLPVRDAPGFLVNAVLAPYMLEAMRCVDEGMAPAAIDAAMAAFGMPMGPLELADTVGLDIAAAAGAQLTGEQAPPRCLAERLARKELGRKSGRGFYAWRDGKAVKPAARGVPPGLVDRLLQPLIDSARERVAAGVVADADLADAGAIFGTGFAPYTGGPLQYASQREAVQRP

SEQ ID NO: 87834 - protein, 439 aa, Methanosarcina acetivorans C2A
MFEVKYNSGNYMGRESELKRDLSLLEITLVGIGDILGAGIYVLMGKAAGLAGNMVWASFLFAGFTASLSALSYMELSSMYPRAGAEYVFARKAFGERIGLFVGLLVIYYVAITASAVALGFGRYFSNIFGGGILIGAISLYILLSLVMVYGIKESARLAILMTFIELSGLMIIIYVGIPYLGTVNYFETPSLSGVFEASALIIFAFLGFEDIVRLSQETKDAEKTTPKALLISIFFTIFLYICVAVASVSVLDFQVLGISEIPLAEVAAVAFGEKAFVLLSWIALFSTMNTVLVVMLGGSRIVYGMANSGSLPKILARVHQKLKTPWTAICGIAFFSSLFVFLGDIATVANIANFMIFIVFFIVNISLIKLRYTDPERKRPFRVPVSIGRFPIFPALGALSAVFLFSQIGKEVMLYGFFLAGISALLVLLKTRKRENEL

SEQ ID NO: 87835 - protein, 388 aa, Colwellia psychrerythraea 34H
MNLHEYQAKQLFAEYGLPVSEGFACDTPQEAAEAADKIGGDMWVVKTQVHAGGRGKAGGVKLVKSKEEIKEFAQHWLGKNLVTYQTDANGQPVAKILVESCTDIANELYLGAVVDRASQRVVFMASTEGGVDIEKIAEETPELIHQAEIDPLVGAQPYQARELGFKLGLNPTQMKQFVKIFMGLAKMFEDCDFALLEINPLVITDEGNLHCLDGKIGIDGNAIYRQPKMRAFHDPSQEDEREAHAAQWELNYVALDGTVGCMVNGAGLAMGTMDIVNLHGGKPANFLDVGGGANKERVSEAFKIILSDDNVKAVLVNIFGGIVRCDMIAEGIIGAVKEVGVKVPVVVRLEGTNAELGREVLKNSGLDIIAAESLTDAATKVVAAAEGK

SEQ ID NO: 87836 - protein, 602 aa, Pseudomonas syringae pv. phaseolicola 1448A
MPHEGSLLQAAVVFLLAAVLTVPLAKRLKLGAVIGYLFAGVIIGPSVLGLIGDTESVSHISELGVVLLLFIIGLELSPKRLWVMRKSVFGVGMAQVLLTGLVIGGIALFAFGQSLNTAVILGLGLALSSTAFGLQSLAERKQLNSPHGRMAFAILLFQDIAAIPLIAMVPFLAGADHAMDTGESINHGLRVLGSIAIVVIGGRYLLRPVFRIVAKTKIQEVSTATALLVVIGTAWLMELVGVSMALGAFLAGLLLADSEYRHELEAQIKPFKGLLLGLFFISVGMGANVGLLLSSPLAVLSLTLLLIGIKLPMLFLIGRTAGGLNNRSALQLGLVLAAGGEFAFVVFKIGSAQGLFEAGLYDMLVLTITLSMAITPLLFIALARWIKPRIKPVEVPDEYRDIQTDKPRVVIAGMGRMGQIVARILRAQKIPFIALDTAVESIEFSRSFGNVPVFYGDPLRPEILRAAKVDEAEYFVIATDDPDTNIKTAELIRKLYPHMKIIARARNRQHVHRLMDIGAHAVRETFYSSLEMSRQTLMGLGLTEAQADARISRFKRHDEQVLAAQHEVYDDDAKVLQTAREARADLAQLFEADRLDEEAAKS

SEQ ID NO: 87837 - protein, 212 aa, Saccharum officinarum
HEGQPLESEPNEPLRVNVLFKHVQKMLTGDSAVIAETGDSWFNCQKLKLPEGCGYEFQMQYGSIGWSVGALLGYAQGANNKRVIACIGDGSFQVTAQDVSTMLRCEQNSIIFLINNGGYTIEVEIHDGPYNVIKNWNYTGLVDAIHNGEGKCWTSKVKCEEELTAAIETALGEKKDCLCFIEVIAHKDDTSKELLEWGSRVSAANSRPPNPQ

SEQ ID NO: 87838 - protein, 636 aa, Streptococcus agalactiae NEM316
MIILQGNKIERSFSGDVLFDNINIQVDQRDRIALVGRNGAGKSTLLKILVGEETPTKGEINKKRDLSLSYLAQDSRFQSENTIFQEMLQVFDSLREVEKRLRELELQMGQVSGSDLEQLMKTYDILSEEFREKGGFTYESDIKAILNGFKFNSDMWEMPISELSGGQNTRLALAKMLLEKPELLVLDEPTNHLDIDTIAWLENYLVNYQGALIIVSHDRYFLDKVATVTYDLTTHSLDRYVGNYSKFMDLKAEKIATEEKNFEKQQKEIAKLEDFVQRNIVRASTTKRAQARRKQLEKMERLDKPNVEQKSANMTFHAGKVSGNVVLTLENAAIGYEGVSLSELIDLDVKKFDAIAIVGPNGIGKSTLIKSLVGQIPFIKGEAKLGANVETGYYDQSQSNLTKTNTVLDELWNAFSTTPEVEIRNRLGAFLFSGDDVKKLVSMLSGGERARLLLAKLSMENNNFLILDEPTNHLDIDSKEVLENALIEFDGTLLFVSHDRYFINRVATKVLEISDKGSTLYLGDYDYYLTKKAELEELARLNEEEVSASKTEIDVTSDYETQKANQKEFRKITRRIAEIEVRLEVLENNENNINGLMLETNDIGKLSDLQKELESIQEEQLLLMEEWENLNMRLDL

SEQ ID NO: 87839 - protein, 554 aa, Kluyveromyces lactis NRRL Y-1140
MGLCASKDSRESTHDGGPRVNRPGANDANRRNDVRKGAGDKKQDKKNKKAKGSIVNAASNINNSSSGKTKISTVSEDGTVSNGVGNTAEYDNANNKNNGNNNNSNNNDNNNNNNNNIGNNINGNNNNDSENIHDSNNSNIENKRYFNNINTGVLNGVNGNSTNSDKALSNQFDQSNNSETHSGTMTGISQALALNDSGVNGFDTDLAKRNGTVNASGGQSPGGSETVNALKVLLLGSGESGKSTVLQQLKILHQNGFSREELLEYKPFIFDNIIETGKDLAKARRTFNVQLEEDAEISESDLDELLSQQYQPTKLPCLPADLAKTLKILWNLQSTQDLLVSEHRSSFYLMDSASYFYENLDRISEPKYIPTITDVIRTRKKTSGIFDTMIDLDKNLKLHFFDVGGQRSERKKWIHCFDNVTLIIFCVSLSEYDQTLLEDNSQNRLEESLILFDSVVNSRWFARSSVVLFLNKIDIFAEKLRHVPLEKYFPDYTGGKDINKAAKYILWRFVQLNRANLNIYPHVTQATDTSNIKLVFAAIKETILENSLKDSGVL

SEQ ID NO: 87840 - protein, 219 aa, Desulfococcus oleovorans Hxd3
MKLIAPSILSADFARLGDEVMAVEAAGADWIHVDVMDGRYVPNITIGPLVVKAVRSVTSLPVDAHLMIMEPERYVAEFVQAGADLVAVHAEASVHLNRTIQLIKGLGARAGVALNPSTPLSVLDWVLDDLDLVVIMSVNPGFGGQQFIPNSLDKVRALKQRITERGLATQIQVDGGVNEKTIRDVSAAGTDVFVAGSAVFGSSNYKTTIATLRKLANEA

SEQ ID NO: 87841 - protein, 241 aa, Saccharum officinarum
GIRHEVGTSTFSEYTVMHVGCVAKINPEAPLDKVCVLSCGISTGLGASINVAKPPKGSTVAIFGLGAVGLAAAEGARIAGASRIIGVDLNANRFEEAKKFGCTEFVNPTDHNKPVQEVLAEMTNGGVDRSVECTGNINAMIQAFECVHDGWGVAVLVGVPHKDAEFKTHPMNLLNERTLKGTFFGNYKPRTDLPNVVELYMKKELEVEKFITHSVSFAEINKAFDLMAKGEGIRCIIRMEN

SEQ ID NO: 87842 - protein, 392 aa, Triticum aestivum
  misc_feature (371)..(372): Xaa can be any naturally occurring amino acid
MATPNPPPPQQDEPSSSADPKAKKDYSTAILERKKSPNRLVVDEATNDDNSVVALHPDTMERLQLFRGDTVLLKGKKRKDTICIVLADDTCDEPKIRMNKTVRKNLRVRLGDVVSVHQCPDVKYGKRVHILPIDDTVEGITGNLFDAFLKPYFLEAYRPLRKGDLFLVRGGMRSVEFKVIETDPAEYCIVAPDTEIFCDGEPVKREDEERLDDVGYDDVGGVRKQMAQIRELVELPLRHPQLFKSIGVKPPKGILLFGPPGSGKTLIARAVANETGAFFFLINGPEIMSKLAGESESNLRKAFEEAEKNAPSIIFIDEIDSIAPKREKTNGEVERRIVSQLLTLMDGLKSRAHVIVMGATNRPNSIDPALXXFGRFDREIDIGVPDEVGRLE

SEQ ID NO: 87843 - protein, 302 aa, Saccharomyces cerevisiae YJM789
MTYPKRIPINAWSEVHRVARPLIITFDAYNTLYATKLPVMEQYCIVGRKYGIKANPSTLTNNFPHVFKKLKEDYPQYGKYSGIKPEQWWSILIRNVFAPNEIPDEMINEILMQFEGFDSYFVYPDLIKFLKDLKSRHPDVILGIVSNTDPIFYKLLKNIGLFETFSGHIYLSYELNLAKPDRAIFQYALDDIISKQPHLLEKYTREEILQHCFHIGDELKNDLEGAEAAGWTGILLDRNDKYGFLSNSISKPMRDEYKLSIDKIDNNSINTWEASTKQTDTLQLSERKYVVSNLEVLEELFP

SEQ ID NO: 87844 - protein, 294 aa, Fusobacterium nucleatum subsp. vincentii ATCC 49256
MEKIYGVIDVTSGYANGKTKNPKYQDLHSSGHAETVHVRYDASKVNLSTLLKYYFKIIDPTSVNKQGNDRGSQYRTGIYYVNQNDKSVIQDEIKEQQKKYSQKIVVEVLPLKEYYLAEEYHQDYLKKNPNGYCHIDLSKADDIIVDEKKYPKLSEKELKMKLNSKQYEVTQNGDTERAFQNDYWDFFDKGIYVDITTGEPLFSSTDKYASQCGWPSFVKPIVPEVVTYHKDTSFNMIRTEVRSRSGKAHLGHVFDDGPRDRGGKRYCINSAAIQFIPYAEMEAKGYGYLLPLVK

SEQ ID NO: 87845 - protein, 341 aa, Triticum aestivum
  misc_feature (100)..(100): Xaa can be any naturally occurring amino acid
  misc_feature (141)..(141): Xaa can be any naturally occurring amino acid
  misc_feature (198)..(198): Xaa can be any naturally occurring amino acid
  misc_feature (317)..(317): Xaa can be any naturally occurring amino acid
  misc_feature (328)..(328): Xaa can be any naturally occurring amino acid
GFNWESWKHNGGWYNFLMGKVDDIAAAGITHVWLPPASQSVAEQGYMPGRLYDLDASKYGNKAQLKSLIGALHGKGVQAIRRNVINHPPAGNKGDGGGFXIFEGGGPRHAVPALITSGSRALQVSARGPDTGADFGAAPDXDHLNPRVQKELVEWLNWLRTDVGFDGWRFDFAKGYSADVAKIYIDRSEASFAVAEIXTSLAYGGDGKPNLNQDPHRQELVNWVNKVGGSGTGTTFDFTTKGILNVAVEGELWRLRGTDGKAPGMIGWWPAKAVTFVDNHDTGSMQHMWPFPSDSVMQGYAYILTHPGTPCIFYASXFFDWGMKDEIXSLVSIRTRQGDTQ

SEQ ID NO: 87846 - protein, 507 aa, Ralstonia solanacearum GMI1000
MAIDYLKKILTAKVYDVAQETDLQPAPSLSARIGNRVYLKREDNQPVFSFKLRGAYNKMASLTPAERKRGVITASAGNHAQGVAFSAARLGCKAVITMPVTTPQLKIDGVRSRGGEWVEIVLHGESYTDAYDHAVKLQEKHGYTFVHPFDDPEVIAGQGTIAVEILRQHPEPIHAIFAAIGGGGLVSGIAAYVKAVRPDIKVIGVQTADSDAMACSVAAGKRVTLRDVGLFSDGTAVKLVGKETFRLTRELVDEIITVDTDAICAALKDVFQDTRSVLEPAGALALAGLKQYAADRKLKSQSLVAIASGANMNFDRLRFVAERAEVGEAREAVFAVTIPEERGSFRRFCEVVGWSRSVTEFNYRIADKNEAHIFVGVQIASRAEGDKIADGFRKHGFPTLDLSNDELAKQHIRYMVGGHSPLAENELLYRFEFPERPGALIKFLSSMSPNWNISLFHYRNQGADSSNILVGIQVPKNEKRAFKAFLATLGYTFWDESENPVYGLFLR

SEQ ID NO: 87847 - protein, 485 aa, Picea sitchensis
MARAIPVGCMHPRSYSNITIDSSNGRGLQSQMGMKRSFYFQSKCLFSRQKRGVGRAMSAVSTPLNVNANPETASLGEITKPDFPILKQEVNGSRLVYLDNAATSQKPQFVIDAVREYYEAYNANVHRGIHFLSAKATDEYELARKKVADFINAGGSREIVFTRNATEAINLVAYSWGLTNLKAGDEIILSIAEHHSVIVPWQIVAQKTGAVLKFVNLNEREVPDLEQLKQLLCEKTKLVAIHHVSNTLGCILPIQEIVHWTQKYGARVLVDACQSVPHMSVDVQQLGVDFLVASSHKMCGPTGIGFLYGKSELLTSMPPFLGGGEMIADVFLDHSTYAEPPSRFEAGTPAIGEAIGLGAAIDYLSGIGMQRIHEYELELANYLYQSLSNVSNVRIYGPAPNATSGRAALCSFTVENVHPTDIATFLDQQHGVAVRSGHHCAQPLHRYLGTNASCRASLYFYNTKDEVDTFIKGLKDTISFFTSFQ

SEQ ID NO: 87848 - protein, 178 aa, Glycine max
FVSGDGILLDLTIQGSIRLNYHIRTFPNTNYFSYATKRTTKIMGVTVPSSILGIHPLLFIRVLQMCQWRFPPDVPPPYKGYRDEDWQDNDGALNTKFMTHPRLPIEHPNCLVEKESDCQPLQPGIWYYKYVEGDHILFIINRERAGVQFDLIYDSIFQRCRKHVFRKKPPTMPNEINH

SEQ ID NO: 87849 - protein, 331 aa, Bacillus cereus ATCC 10987
MNLAKFPRKKYTESYTPIEKLNNFSEALGGPTIYFKRDDLLGLTAGGNKTRKLEFLVADAQVKGADTLITAGGIQSNHCRLTLAAAVKEKMKCILVLEEGLEPEEKPDFNGNYFLYHLLGAENVIVVRNGADLMEEMHKVAKEVSEKGSTPYVIPVGGSNPTGAMGYVACAQEIMAQSFDQGIDFSSVVCVSGSGGMHAGLITGFAGTQSNIPVIGINVSRGKAEQEEKVAKLVDETSAHVGIPNFIPREAVTCFDEYVGPGYALPTPEMVEAVQLLAKTEGILLDPVYTGKAVAGLIDLIRKGTFKKEDNILFVHSGGSPALYANTSLFV

SEQ ID NO: 87850 - protein, 429 aa, Thermoanaerobacter tengcongensis MB4 [sequence omitted]

SEQ ID NO: 87851 - protein, 248 aa, Thermoanaerobacter tengcongensis MB4
MRRPIIAGNWKMHKTPSEAVKLVEELIPLVKDAKAEVVVIPPFVDLTEVARVIKGTNILLGAQNMFWEEKGAYTGEISPVMLKEIGVTYVVIGHSERRQYFKETDEMVNKKVLSALSHDLKPIVCVGESLSQREEGKTYDVVLTQTREALKGVSEEDITKVVIAYEPVWAIGTGKNATPQDANEVIKAIRNTIAELYGKDKAEMVRIQYGGSVKPDNISGFMAESDIDGALVGGASLVAEDFAKIVNY

SEQ ID NO: 87852 - protein, 594 aa, Rhizobium leguminosarum bv. viciae 3841
MTAFTTRPEILGTFGVVTSTHWIASAVGMSILEKGGNAFDAAVATGFVLQIVEPHLCGPGGDLPAVIYSKKKDKVEVICAQGPAPAGATIEHYTAEGLSLIPGDGLLATVIPGSFDGWMLMLRDYGSMSVRDVLEPAIYYAEHGHPMLPRVSATIKGLAAFFEKEWPTSYETWLPGGSAPEAHANFRNPVLAETWKRVIAEAETKSGREAQVEAARDAFYRGFVAEKIDDYFKTTEVMDASGNRHKGVLTANDMANWSATIEEPLTYDYHGWTIAKIGPWGQGPVFLQTLSILKGFDLAAVDPAGADFVHTVVEAMKLAFADREVYYGDPDFSEVPIAHLLSETYAAERRKLIGADASFELRPGIVPGFEAQHDLTMKMLGADSKTGAVYEPTMAHLSEKRGDTVHIDVIDRDGNMVSVTPSGGWLQSSPTVPGLGFCLNSRAQMFWLKSGLPTSLAPGKRPRTTLTPSLGLYEGRPTLAFGTPGGDQQEQWQLSFFLRYAHHKLNLQAAIDQPLFHTSHFPGSFYPRTREPGSLMAEANFGPDVLDALRRRGHKLTVADPWTIGRLTAARRDADGLLRAAATPRLMQAYAIGR

SEQ ID NO: 87853 - protein, 331 aa, Clostridium tetani E88
MTIKGITFIGGGSFGTALGIMLAKKGYNINIWDRKPHVIADINEKKENIKYLPNVVIPSNVKAYKGMKEALVGIKYVVISVPSHAIREICRNMKDYLKEDAIIISVAKGIEEHSGKRLSQIIKEELPKNPVVILSGPSHAEEVAQDIPTTVVVTSEDVKASLEVQNLFSTNKFRVYTNDDIIGVEIGGAVKNIIALAAGISDGIGYGDNTKAALMTRGINEIIRIGEKLGGQRETFWGLTGMGDMIVTCTSMHSRNRRAGLLIGKGLSMEEAIEEVGMVVEGIKACKAFYELKEKLKVSMPITDALYRVLFQGEDAKYCVYELMTRDKKDE

SEQ ID NO: 87854 - protein, 523 aa, Bordetella bronchiseptica RB50
MPENAQPHAVIPAADLQLSAQNPQWRVFAAAAAGASLVARPLRVIEAAGIYVDLSMQRHSSALAQAGLALLQARDVLGARAALFAPGAPDAAHGRYPVLRAGYGAHPEEQCDIEVEIEYARMLEFVRELDRGGACPAVLYLGGGAGQWALRLALQAFGGPAQRRQLRFVSGGDAAALHEALAGLDPRRTLVVAASRGFEPSETLDNARAAIDWLRRAGIDDVSAHLVAVTGNESAARALGVAAARVFRLPSWLQPRHELWSVGALPVALALGVDMLKALRSGAAAMDQHFLQAAPTVNAPMQMALAAVANTSAMHWPTHALAVYSARLAALPACVQQLEMTLAGRAPASLPAYPVVWSPAGAPGPGAFFEWLHRAPAGAPVDFIAGLDEYPASPPAHRALLANCLAQREALLRGLPAGPGQPAAGGGRPSTLVVLRQVDPRAVGALLALYEHKAFVQAALWGAALGGADQAQACQRLAQDIARQLAVPPAAGPVDWGHDSSTAFWIDRYREQGGAGAAAGRTA

SEQ ID NO: 87855 - protein, 311 aa, Magnetococcus sp. MC-1
MGRIYNDITETIGNTPLVRLNRISQGLDAEILVKLEYFNPMASLKDRIGLAMIQEAEAKGLITKDTLIIEPTSGNTGIALAFVCAARGYQLVLTMPESMSMERRKLFELLGAQVVLTSAMDGMKGAIDKAQELLAETDKGFMPNQFDNGANPAVHETTTAEEIWRDTDGQLDLFLAGVGTGGCLTGVARTLKKRIPQLRVVAVEPESSPVLSGGMPGPHKIQGIGAGFVPRVLDTQLMDEVVRVGDQEAFEVARRMAREEGIACGISSGAVVAAALQLARTPRYAGKRFVLVLASFAERYLSTELFPSQLP

SEQ ID NO: 87856 - protein, 317 aa, Bordetella bronchiseptica RB50
MSGSSHYPVANWNLDGIVSGLRGARQEWRGPRGRLREESESGVREFPSQESLRDIMRQLFGALFPMRLGPIDLREEVEDFYVGHTIGAALDALLHQVCLELQHLGRDDPQPYGQVLERAVDIVRRFGAELPAVRKALDLDVTAAYQGDPAARSVDEVLLCYPGVTAMIHHRLANVLYRLGAPMLARIVAEIAHSDTGIDIHPGATIGRSFFIDHGTGVVIGETAIIGERVRLYQMVTLGAKRFPPGENGELKKGLPRHPIIEDDVVIYAGATILGRITIGQGSTIGGNVWLTHSVPPNSTVTQAGAINDMPDCGLGG

SEQ ID NO: 87857 - protein, 462 aa, Streptococcus agalactiae NEM316
MAVEIIMPKLGVDMQEGEILEWKKQVGDVVNEGDVLLEIMSDKTNMEIEAEDSGVLLKITHGNGDVVPVTETIGYIGAEGEEVTEASSSENTSVEENATQVTSEPEKVEETSEPSVPAATSGEKVRATPAARKLAREMSIDLALVSGTGANGRVHREDVESFKGAQPRITPLARRIAEDQGVDIAEITGSGIRGKIVKNDVLAAMSPQAAEAPVETKATPTTEEKQLPEGVEVIKMSAMRKAISKGMTNSYLTAPSFTLNYDIDMTEMMALRKKLIDPIMAKTGLKVSFTDLIGMAVVKTLMKPEHRYLNASLINDAQEIELHNFVNIGIAVGLDDGLIVPVVHNADQMSLSDFVIASKDVIKKTQEGKLKSAEMSGSTFSITNLGMFGTKTFNPIINQPNSAILGVGATIPTPTVVDGEIVARPIMAMCLTIDHRIVDGMNGAKFMVDLKNLMENPFGLLI

SEQ ID NO: 87858 - protein, 350 aa, Physcomitrella patens subsp. patens
MAATPAREWTGLQQFPVATQTALHNILGTLRQQNKESLTVLVVGKGGVGKSSTVNSIVGERVTIVSAFQSETLRPLQCARSRAGFTLNIIDTPGLVEGGCINDQALDIIKRFLLSKTIDVVLYVDRLDGYRVDNLDRQVIRGLARSFGPNFWRLAVIVLTHAQFSPSDGVNYTEFVEKRSAALQAAIRQEAGLKKDEKEVPYALVENSGRCNTNDGGEKILPNGTVWLPALVERIVEVATGTTDSVFVDKKLIDGPNANEWGKWWIPVLAVAQYFLVVMPIRKAIEKDLAEEKNQRPQWEIRAEEFRRNTSLYDDDQVDEQAISQALEQDDGLSGQLSSFVDEDDDDDEF

SEQ ID NO: 87859 - protein, 536 aa, Kluyveromyces lactis NRRL Y-1140
MSITAGPKVTTTAALVNTDRKMNNHHSTQVLHGSGQHGMQPSGNNVLNGLANGATGLQSSASSTSTRDDSTIVGLHYKIGKKIGEGSFGVLFEGVNMINNVPVAIKFEPRKTDAPQLKDEYRTYKILSGSEGIPQAYYFGQEGLHNILVIDLLGPSLEDLFDWCGRRFSIKTVVHVAIQMITLIEELHDHDLIYRDIKPDNFLIGRPNQPDANMVHLIDFGMAKLYRDPKTKQHIPYREKKSLSGTARYMSINTHLGREQSRRDDMEALGHVFFYFLRGQLPWQGLKAANNKLKYEKIGEKKRSTNVYDLSQGLPVQFGRYLEIVRNLGFEETPDYEGYRKLLLSVLDELGQKLDGEYDWMKLNGGRGWDLAINKKPNLHGYGHPTPPNEKSKRHRNKFNQVPLAVNNLNGSNVPLQSHSPLPGGTDLTQGVSNAPQQPQQIMSQQQYQQHTQQRLDPMSYEAYKQQVQQRYAQQPQPTQQKAQKSPNNDTSQQQFSQNRQQQPQYQFQQNQPQNGKVQVADSNSEKGFFSKLGCC

SEQ ID NO: 87860 - protein, 372 aa, Zea mays
MENSAAAAAERPRLTRAAAKRSAVVTAVAVAAKRKRVALSQLPTLPNAVLGAHDDDDDKPVRKQRLLPAAKPKPKPKAAPAPAAPAAADDTDDDIQLCKPYASDIYSYLRSMESQAKRRLAVDYIAAVQIDVTPNMRGILIDWLVEVAEEYKLVSDTLYLTVSYIDRFLSAKVLNRQKLQLLGVSAMLIASKYEEISPPNVEDFCYITDNTYTKQEVVKMESDILNVLKFEVGSPTAKTFLRMFIRSAQEDNKKYPSLQLEFLGSYLSELSLLDYGLIRSLPSLVAASAVFVARLTLDPHTHPWSKKMQTLTGYKPSELKDCVAAIHNLQLNRTCQSMVAIREKYRQHRFKGVSALLPPVEIPASYFNTLKE

SEQ ID NO: 87861 - protein, 876 aa, Arabidopsis thaliana
MYNQYINSKFGERVEYSAYLDVFSQPEKIPRKLKLSRQYMKYMEALLEYLVYFFQRTEPLQDLDRILSKVCSDFEEQYADGIVEGLDNELIPSQHTVIDLDYYSTVEELVDVGPEKLKEALGALGLKVGGTPQQRAERLFLTKHTPLEKLDKKHFARPPHNGKQNGDAKSTHESENAKEIALTEAKVKKLCNLLDETIERTKQNIVKKQSLTYEEMEGEREGEEANTELESDDEDGLIYNPLKLPIGWDGKPIPYWLYKLHGLGQEFKCEICGNYSYWGRRAFERHFKEWRHQHGMRCLGIPNTKNFNEITSIEEAKELWKRIQERQGVNKWRPELEEEYEDREVQRPHSMTSVKLSSASAFQLRRLTYPPLDLKFNHLTATDEIPKNMTVGIEPLAPPPLHKQRSLPIFVTIAETLYEREISRLRNKKSKNHWESDHGDESKRAPLVDGLKIQNKNGAVKSRRALGDIGNLVSVPGVQGGKAQPPINRPITRSFRAQLLANAQLERKPINGDNKVPALGPKRQPLAARNPEAQRAVQKKNLVVKQQTKPVEVIETKKEVTKKEVAMSPKNKKVTYSSVLSARSKAACGIVNKPKIIDIDESDKDNHLAAVEYVDDMYSFYKEVEKESQPKMYMHIQTEMNEKMRAILIDWLLEVHIKFELNLETLYLTVNIIDRFLSVKAVPKRELQLVGISALLIASKYEEIWPPQVNDLVYVTDNAYSSRQILVMEKAILGNLEWYLTVPTQYVFLVRFIKASMSDPEMENMVHFLAELGMMHYDTLTFCPSMLAASAVYTARCSLNKSPAWTDTLQFHTGYTESEIMDCSKLLAFLHSRCGESRLRAVYKKYSKAENGGVAMVSPAKSLLSAAADWKKPVSS

SEQ ID NO: 87862 - protein, 538 aa, Zea mays
MGYQVVAAQLKLASSADHASVVIITLFVALLCACIVLGHLLEENRWLNESITALIIGLGTGVVILLISRGKNSRLLVFSEDLFFIYLLPPIIFNAGFQVKKKQFFRNFMTITLFGAVGTMISFFTISLGAIATFSRMSIGTLDVGDFLAIGAIFSATDSVCTLQVLHQDETPFLYSLVFGEGVVNDATSVVLFNAVQKIQFTHINAWTALQLIGNFLYLFSTSTLLGIGTGLITAFVLKKLYFGRHSTTRELAIMILMAYLSYMLAELFSLSGLLTVFFCGVLMSHVTWHNVTESSRTTSRHVFATLSFISETFIFLYVGMDALDFEKWKTSSLSFGGTLGVSGVLMGLVMLGRAAFVFPLSFLSNLAKKHQSEKISFRMQVVIWWAGLMRGAVSMALALNKFTRSGHTQLHGNAIMITSTITVVLFSTMVFGMITKPLIRLLLPASGHPRELSEPSSPKSFHSPLLTSQQGSDLESTTNIVRPSSLRGLLTKPTHTVHYYWRKFDDALMRPVFGGRGFVPFVPGSPTERNPPDLSKA

SEQ ID NO: 87863 - protein, 435 aa, Mannheimia haemolytica
MTILALGINHKTASVGLREKVAFVDDKRKLALEQIQTSGLAESVVILSTCNRTELYFHQPNISPREESEENIQWREQCFRWFAQIHQLDESELRECLYFKQNLEAANHLMKVASGLDSLILGEPQILGQVKQAYQYSEDFYQHQQKAMSTKLSRLFQRTFATAKRVRSETEIGSQAVSVAYAACGLARQIFDNFGKLRFLLVGAGETIELVARYLIQHGAKNIMLANRTHIRAEMLAEKLNAPMQILSLSALQLGLNQADVVISSTGSPDTLISKEMVEIAQKQRQFDPLLLIDIAVPRDIDEKAGDLEGVYAYSVDDLQNIIQRNMAQREEAAKQAAEIVKEESKAFFEWLKQQQSSDLIKRYRQDAEQTRQELLEKALQAISQGQDSQKVLSELSYKLTNQLLHAPTQALQAMAKSGNSTGLQSFSRALRLEE

SEQ ID NO: 87864 - protein, 882 aa, Desulfitobacterium hafniense DCB-2
MSKKFVYLFREGQASMRDLLGGKGANLAEMTNIGLPVPPGFTITTEACNDYYALGRNLPEGLWEQIGPALGDIEKATGKKFGDKDNPLLVSVRSGAKFSMPGMMDTILNLGLNDETVEGLAASTQNARFAYDSYRRFIQMFGDVVLEVEHHEFERILEEAKEKQNVNYDSELTAESLKGVVEGYKRLIQRRTGSPFPLEPMKQLEQAILAVFRSWNNDRAIVYRRINSIPDNIGTAVNVQSMVFGNMGNDSGTGVAFTRNPSTGERVLYGEYLMNAQGEDVVAGIRTPQPIKSLEDENQAIYAQFVKTSNSLEAHYRDMQDIEFTIERGRLYILQTRNGKRTAPAAIRVAVELCREGVISKEEAIARIEPGQLDQLLHRRMDSEAKLEVIAKGLPASPGAASGKIVFDADEAERLGHTGEKVLLVRTETTPDDIHGILAAQGILTSRGGMTSHAAVVARHMGKPAVCGCEALRIDYAHNTVTIDGVTYPEGTLFSIDGTTGRVIKGAVPMIDPELSEEFKELLGWADEIRTLKVLANADNPRDAQKARDFGAQGIGLCRTEHMFMDPARIPIVQEMILAQTLPEREVALAKLLPMQEEDFYGILKVMAGFPVTIRLLDPPLHEFLPNVEELVVDITKLKLQGDREEELNEKEVLLRKVRALSEMNPMLGHRGCRLGITFPEIYAMQARAIFQAAARLVKEGYEIYPEVMIPLVIHVKELAKLRKVTEEAAQTVMAEQGVTFAYTIGTMIEVPRAALTADEVATAADFFSFGTNDLTQTTLGFSRDDAEGKFLPAYLEQNILEHNPFAVLDRIGVGKLMKMGVQLGREANPGLKVGICGEHGGDPSSIEFCHQIGLNYVSCSPFRVPIACLAAAQAAVSSKGQ

SEQ ID NO: 87865 - protein, 380 aa, Desulfococcus oleovorans Hxd3
MTRPIYLDYNGTTPLDPEVLEAMRPFWETEFGNPSSAHWYGIRPRQAVEAARRQVAGLLGCLAEEVLFTSGGTESNNHAILGMARALRHKGRHIVTSTIEHPAVLEVCQYLEKEGFETTRVAVNELGMVDPAAAEQAIRPDTILVTIMHANNEVGTVQPIAEISERVRARGITMHTDAAQSLGKIPVNVSTLGVDLLSVAGHKIYAPKGIGALYIKKGLALEKFCHGAGQETGRRAGTENVTGIVGLGKACEIATRDLEVNRVHMKDMRDRLHSGISERVADMRLNGHPENRLPNTLSMAFKELEANRLLEEICLEVAASAGAACHSDTVTLSHVLEAMGVPVEWAKGTLRFSTGRMTTAEEIDRTVEVVAEAVARLRKS

SEQ ID NO: 87866 - protein, 487 aa, Burkholderia sp. 383
MTIKHWIGGREVESRETFTTLNPATGDVITDVASGGEAEVDAAVRAAKEAFPKWASTPAKERAKLMRKLGELIEKNVPNLAALETQDTGLPIAQTSKQLIPRASENFNFFAEVCVQMNGRTYPVDDQMLNYTLYQPVGVCALVSPWNVPFMTATWKTAPCLALGNTAVLKMSELSPLTADQLGRLALEAGIPPGVLNVVQGYGATAGDALVRHPDVRAVSFTGGTVTGKRIMERAGLKKYSMELGGKSPVLIFDDADFDRALDASLFTIFSINGERCTAGSRIFVQRTIYDRFVQEFARRANNLIVGDPSDPATNLGAMITRQHWEKVTGYIRIGEQEGARVVAGGADKPAGLPDHLRNGNFVRPTVLADVDNRMRVAQEEIFGPVACIIPFEDEDDGLRLANDTAYGLASYIWTQDVGKVHRLARGIEAGMVFVNSQNVRDLRQPFGGVKESGTGREGGEYSFEVFAEIKNVCISMGSHHIPRWGV

SEQ ID NO: 87867 - protein, 340 aa, Corynebacterium efficiens YS-314
MTTFRAALVESFDADIAVKDVERPTPGPNQALVKLIASGICHTDLHAAKGDWPVLPEPPFIPGHEGIGEIVELGPGEHDVAVGDIVGNAWLWSACANCEFCRTGRETFCPNAQYGGYTQNGSFGEYMLVDTRFAPRIPDGVDYLEAAPILCAGVTVYKALKVSNIRPGQFMVISGIGGLGHIAVQYAKAMGMRPIAVDIADSKLELAKSLGAEFTVNARDVDPAEAVREFTNGGAHGVLVTAVHEKAFGQALGMARTNGTIVFNGLPPGEFPVSVFDVVFRGLTITGSLVGTRQDMEEALDFYARGLIKPKVAECGLDDVADVFEKLESGGIDGRVAIRY

SEQ ID NO: 87868 - protein, 459 aa, Vitis vinifera
MDEEVEYEEVEVEEEVEEVEEEVEEEEVEEEEEEVEEEEEEEEANEADEQKSPSGGGGKIEDEDESKKHAELLALPPHGSEVYVGGISQDASEEDLKSFCESVGEVTEVRIMKGKDSGENKGFAFVTFRNVELASKAIEELNNTEFKGRKIKCSTSQAKHRLFIGNVPRSWGEEDIKKVVTEIGPGVTAVELVKDMKNSSNNRGFAFIDYYNHACAEYSRQKMMNPKFKLDNNAPTVSWADPKNADSSPASQVKAVYVKNLPKNITQDQLKQLFEHHGKITKVVLPPAKSGQEKSRIGFVHFAERSSAMKALKNTEKYEIDGQVLECSLAKPQADQKSVGGSNSQKSGLLSSYPPRVGYGFVGGAYGALGAGYGTAGFAQPLIYGRGPTPAGMAMMPMLLPDGRIGYVLQQPGAQPHTPPSHQRSSGRGGSGSGSKSGGSSSRGRHNNDGGHGRRYHPY

SEQ ID NO: 87869 - protein, 394 aa, Thermoanaerobacter tengcongensis MB4
MKKKTVRDIDVSGKRVLVRVDFNVPMDENKNITDDRRIREALPTIEYLINHNAKVILVSHLGRPKGKFNPDYSLKPVAKRLSELLKKPVIMAEDVIGEDAKVKAAALKEGEVLLLENVRFHAEEEKNDPEFAKELASLADIYVNDAFGTAHRAHASTAGVAKYLPAVAGFLIEKELSIMGEALENPKRPFVAILGGAKVSDKIGVITNLLEKVDSLLIGGGMAYTFIKAKGYEIGKSLLEEDKIELAKEIMEKAKQKGVNFMLPVDTVIAKELKSGVPYEVVDIDKMPEDQIGVDIGPKTIEEYSKVIKHAMTVVWNGPMGVFEIPEFAKGTKAIAKALSECKGTTIVGGGDSAAAIEQLGYADKVTHISTGGGASLEFLEGKVLPGIDILNDK

SEQ ID NO: 87870 - protein, 335 aa, Thermoanaerobacter tengcongensis MB4
MGVRVGINGFGRIGRNVFRAALKKNADLEFVAVNDLTDAKTLAHLLKYDSVLGKFEGEVSYTDDSLIVNGKEIKIFKETDPGKLPWGDLGVDIVIESTGRFTNKEDAIKHIHGGAKKVIITAPAKNEDVTIVMGVNEHMYDPANHHVISNASCTTNCLAPIAKVLNDKFRIKKGMMTTVHSYTNDQRILDLPHSDLRRARAAAVSIIPTTTGAAKAIHLVIPELKGKMNGFAMRVPTPNVSVVDLVAEVEIPTTVEEVNAAMKEASETYMKGILGYSEDPLVSVDYKGDDRSSIVDAPLTMVVEGTLVKVVSWYDNEWGYSNRVVDLALYIAERM

SEQ ID NO: 87871 - protein, 191 aa, Saccharomyces cerevisiae YJM789
MGLLSIIRKQKLRDKEIRCLILGLDNSGKSTIVNKLLPKDEQNNDGIMPTVGFQIHSLMIKDVTISLWDIGGQRTLRPFWDNYFDKTQAMIWCIDVSLSMRFDETLQELKELINRDENRIGYECAVIVVLNKIDLVEDKSELHRRCLLVESELKCLFKPDIRIELVKCSGITGEGIDDLRDRLVESCHFTQ

SEQ ID NO: 87872 - protein, 527 aa, Streptococcus thermophilus CNRZ1066
MQKERVIMTNISTLNDVQKIIVLDYGSQYNQLIARRIREFGVFSELKSHKITADEVRAINPIGIILSGGPNSVYAEDAFGIDEEIFELGIPILGICYGMQLLTHKLGGKVVPAGEAGNREYGQSTLRLRAQSELFAGTPEEQVVLMSHGDAVTEIPEGFHLVADSVDCPFAAMEDTKKNFYGIQFHPEVRHTVYGNDILKNFAFSICGAKGDWSMANFVDMQIAQIRETVGDRKVLLGLSGGVDSSVVGVLLQKAIGDQLTCIFVDHGLLRKGEGDQVMEMLGGKFGLNIIRVDASKRFLDLLAGVDDPDKKRKIIGNEFVHVFDDEASKLKGVDFLAQGTLYTDIIESGTETAQTIKSHHNVGGLPEDMQFELIEPLNTLFKDEVRALGTELGMPDEVVWRQPFPGPGLAIRIMGEITEEKLETVRESDAILREEIAKAGLDRDVWQYFTVNTGVRSVGVMGDGRTYDYTIAIRAITSIDGMTADFAKLPWEVLQKISVRIVNEVDHVNRIVYDITSKPPATVEWE

SEQ ID NO: 87873 - protein, 251 aa, Photobacterium profundum SS9
MMKTVVITGAASGMGLAASKLFLEKHWRVLMIDANEDQGQQQCLGLQKQGYTEVYFQWCDITKASEVAQVSQFAFANFGRIDSVINNAGIWRGGELHQTQEADWDLLFDVDVKSIFLMSKYFVPHMIEQGGGTIVNTASVSGLNGDHQMAAYNAAKGAVVNLVRAMALDYGKYNIRVNNVCPAACATPMFLANPPAVIDKFNKANPLGRICTPKEVAEAMYFLASEASSSCNGINLPVSGGLELHTGQPIQ

SEQ ID NO: 87874 - protein, 181 aa, Debaryomyces hansenii CBS767
MGLTISSLFSGLFKRKEMRILMVGLDAAGKTTILYKLKLGEIVTTIPTIGFNVETVEYKNISFTVWDVGGQDKIRPLWRYYFQNTQGIIFVVDSNDRDRIVEAREELQQMLNEDELRDAFLLVFANKQDLPNAMNAAEITEKLNLHSLRQRPWYIQSTCATTGDGLYEGLEWLSNSLKNAP

SEQ ID NO: 87875 - protein, 243 aa, Ralstonia solanacearum GMI1000
MSQTHFGFQQVDEREKAGKVAGVFHSVASKYDVMNDLMSGGMHRLWKMFTIAQAAVRPGYKVLDIAGGTGDLAKAFARQAGPTGEVWLTDINESMLRVGRDRLLDAGVLTPTCLCDAEHIPFPNAYFDVVTVAFGLRNMTHKDRALAEMRRVVKPGGKVMVLEFSKVWQPLEKAYDVYSFKVLPWLGSKVAGDAESYRYLAESIRMHPDQETLKQMMEQAGLDSVEYFNLTAGVVALHVGRRL

SEQ ID NO: 87876 - protein, 632 aa, Triticum aestivum
MSKLLAIALLLLPLINQGIYLATAWDDQDFFKYCPPSQCSQDGPEVRFPFCLESSNTSAAAAASCGCAGRSIRKLACSGRDTILFHPVLGPYNVSAIDYGRSSMKLIPLVDPCFVLQQKLVISRSSSSPQADVINYEMPSLYLRNSSLVRCLREFAPGAADEIAGPVSCLSNTTNFFYLVNGYEDMSILPLDCKVVPLSDGVGGGLIPMYEFDDPIVSFKERTERMLSFAETTVYWYGSYCARCEGSGRRCAFSSQRNRTFCMPGPHGSRIKVIAATSSVAAFVVLLLTVATVLYLSLKTRYNAEIHMKVEMFLKTYGTSKPTRYTFSEVKKMARRFKEKVGQGGFGSVYKGKLQNGVPVAVKMLENSTGEGEAFINEVATIGLIHHANIVRLLGFCSEGMRRALIYEFMPNESLEKYIFSDDSNIFQNLLVPDKLLDIALGIARGMEYLHQGCNQRILHFDIKPHNILLDYNFNPKISDFGLAKLCARDQSIVTLTAARGTMGYIAPELYSRNFGGVSYKSDVYSFGMLVLEMVSGRRNSDPRIGSQDDVYLPEWIYEKVINGEELALTLETTQEEKEKVRQLAMVALWCIQWNPRNRPSMTKVVNMLTGRLQSLQMPPKPFVSYENEPMP

SEQ ID NO: 87877 - protein, 489 aa, Bordetella bronchiseptica RB50
MTQLTQPLSRAELLRDACYIDGKWVGAGNGPSIPVDNPSTGKTIISVPKLGRKEAEQAIDAAEAALPAWSARTGKERAAILLKWAQLMMENQQDLAVIMTSEQGKPVAEAAGEIAYAASFLEWFAEEAKRIDGDILQSPKGGQRLMVLKQPIGVTAAITPWNFPAAMITRKVGPALAAGCTMVVKPAQQTPLTALALAVLAEQAGVPAGVFQVVTGSSREIGAALCESEVVRKLSFTGSTEVGRTLMEQCAPTIKKLSLELGGNAPFIVFDDADLDRAIDGILASKYRNAGQTCVCANRIYVQAGVYEEVAKRLVEKVNAMKVGDGFEQGVTQGPLIDTAAVAKVQEHIADATAHGAKVIAGGQPHALGGSFFQPTVVRDVTQSMRFAVEETFGPVAPLFKFESEDEVIGMANNTIFGLAAYFYTRDYARIWRVSEALEYGIVGINTGIISNEVGPFGGVKQSGLGREGSKYGIEDYLELKYLCVDLGA

SEQ ID NO: 87878 - protein, 162 aa, Triticum aestivum
  misc_feature (58)..(58): Xaa can be any naturally occurring amino acid
  misc_feature (78)..(78): Xaa can be any naturally occurring amino acid
  misc_feature (81)..(81): Xaa can be any naturally occurring amino acid
  misc_feature (94)..(94): Xaa can be any naturally occurring amino acid
  misc_feature (100)..(101): Xaa can be any naturally occurring amino acid
  misc_feature (124)..(124): Xaa can be any naturally occurring amino acid
  misc_feature (136)..(137): Xaa can be any naturally occurring amino acid
  misc_feature (141)..(141): Xaa can be any naturally occurring amino acid
MAPTVMASSATSVAPFQGLKSTAGLPISRRSSSAGLSSVSNGGRIRCMQVWPIEGIKXFETLSYLPPLSTGGLLKQVXDYXIRSKWVPCLRFSXVGFVLXXEHNTPPGYYDVHTGKCWELPMFXGCTDAHKCQQVXXVKKXYLTLFPLIFTAPSACLRLHRF

SEQ ID NO: 87879 - protein, 421 aa, Bordetella bronchiseptica RB50
MKNRDLNTRRTLATPRGVGVMCDFYAVRAENSTLWDAEGKEYIDFAGGIAVLNTGHRHPKVKAAIAAQLDNFTHTAYQIVPYEGYVSLAERINAVAPIEGLKKTAFFTTGVEAVENAVKIARAYTGRSGVVAFSGAFHGRTMMGMALTGKVAPYKLAFGPMPGDVFHVPFPNATQAISVADSLKALDLLFKVDIDPKRVAAIIIEPVQGEGGFNVTPPELMQALRKVCDEHGILLIADEVQTGFARTGKLFAMQHHSVQADLITMAKSLGGGMPISGVVGRAEVMDGPAAGGLGGTYAGNPLAVAAAHAVLDVIAEEKLCERAAELGKRLMDRLEGLRAKCPAIADVRGLGSMVALELNDPATGKPDAEAVKRIQQQAIERGLILLSCGVYGNVLRFLYPLTIPDDQFARALDILAETIAA

SEQ ID NO: 87880 - protein, 649 aa, Triticum aestivum
MSKLLVIALLLLPLINQGIYLATAWDDQDFFKYCPPSQCSQDGPEVRFPFCLESSNTSAAATASCGCAGRSTRKLACSGRDTILFHPVLGPYNVSAIDYGRSSMKLIPLVDPCFVLQQKPVISRSSSSPQADVINYEMPGLYRWNSILVRCSREFAPGAADGIAGPVSCLSNTTNFFYLVNGYEDMSILPLDCKVVPLSDGVGGGLIPMYIFDKPMSDTLPVSFKESTERLLSFAEMTVYWYGYTCRQCEVYWYGYTCRQCERSGGRCAFSSQRDRQFCMPGPHGSRIKVIAATSSVAAFVVLLLTVATVLYLSLKTRYNAEIHMKVEMFLKTYGTSKPTRYTFSEVKKMARRFKEKVGQGGFGSVYKGELPNGVPVAVKMLENSTGEGESFINEVATIGLIHHANIVRLLGFCSEGMRRALIYEFMPNESLEKYIFSDDSNIFQNLLVPEKLLDIALGIARGMEYLHQGCNQRILHFDIKPHNILLDYNFNPKISDFGLAKLCARDQSIVTLTAARGTMGYIAPELYSRNFGGVSYKSDVYSFGMLVLEMVSGRRNSDPRIGSQDDVYLPEWIYEKVINGEELALTLETTQEEKDKVSQLAMVALWCIQWNPSNRPSMTKVVNMLTGRLQSLQMPPKPFVSYENEPMP

SEQ ID NO: 87881 - protein, 825 aa, Hordeum vulgare subsp. vulgare
MAFSPRSPWSRSKKPDIYSTVVVHDDEDDAHGGGAARAEDDDDDDPSALPPLLQRLPKDFGGASFDDDDDPYSSDLDDASLSATVVIKRGAPASTSSSSRSPFLDLRRSSPRAAEADPYSTFVVHGTARSGGASSPRESVSGTFIRHSGGPPSPRESVSGTFIRHTRGSSSPRESYSGTFIHHTSGASSPRDPASGAGAGFGSSFMTPSTGQAEEDRQPSLLMQQQQSRRQASMSSVPDSVTREDPSTKYELLHELGKGSYGAVYKARDLRTQELVAVKIISLTEGEEGYEDIRGEIEMLQQCSHPNVVRYFGSYQGEEYLWIVMEYCGGGSVADLIGITEEPLDEPQIAYICRETLKGLAYLHTIFKVHRDIKGGNILLTEQGEVKLGDFGVAAQLTRTMSKRNTFIGTPHWMAPEVIQESRYDGKVDVWALGVSAIEMAEGMPPRSTVHPMRVIFMISSEPAPMLEDKEKWSLLFHDFIAKCLTKDARLRPAAIEMLKHKFIEKCNTGASKMLAKIKEAKIIRETAVQNQLPDSDDAMDATVRINEDYGETVPTNSQSTHETKNDGSGGDFGTMIVHPEDGDEAVESSIFPRAEFIPGLGSINSFTHDPKRAELISKFWAENTADSDATKGRDLDGLPDTQEPKAMPRSIGTFKHHKGVEGTVLRHDNTASPGVASTMTKLSSSPSRKAFSVQDKLWSIYAAGNTVPIPFLKAIDISPLALVSDSVAGNGPAGSSTTDALEAVRELFSGDGQAKKGRKGQNEVPLPPGVHDRLTTSPTLMNLAQALAYHKTCYEDMPLQDSQATEEQQTIQNLCDTLRTILRL

SEQ ID NO: 87882 - protein, 361 aa, Moorella thermoacetica ATCC 39073
MPVRGFLVLEDGTVYSGEAFGYPGRSHGEVVFNTSMTGYQEILTDPSYCGQIVALTYPLIGNYGINDEDLESDGPRVAGFVVHEACPRPSNWRSTGSLDHYLRENRIPALQGVDTRALTRHLRRRGTMRGILATGEVDLEEIKALAATRPALSGAKLVPAVTNAKPYTVEGGPRRVVLYNFGVKENIIRWLRREGCTVTVMPARSTAAAILALNPEGVVVSNGPGDPKDVPYGVATVRELLGRVPLMGICLGHQLLALALGGDTYKLPFGHRGGNHPVKDLSTGRVYITSQNHGYAVRADSLPTGAVVSHINLNDGTVEGLRHRELPAFSVQYHPESSPGPTDSEYLFHEFIRLVDEHRGQ

SEQ ID NO: 87883 - protein, 281 aa, Oryza sativa Japonica Group
MVSLRAAIVLVVAASSVAVAFSHAEGNEGPDFTYIEGAMDGPSNWGKLSPEYRMCGEGRSQSPIDINTKTVVPRSDLDTLDRNYNAVNATIVNNGKDITMKFHGEVGQVIIAGKPYRFQAIHWHAPSEHTINGRRFPLELHLVHKSDADGGLAVISVLYKLGAPDSFYLQFKDHLAELGADECDFSKEEAHVAAGLVQMRSLQKRTGSYFRYGGSLTTPPCGENVVWSVLGKVREISQEQLHLLMSPLPTKDARPAQPLNGRAVFYYNPPGSAVSFQEFAK

SEQ ID NO: 87884 - protein, 437 aa, Prosthecochloris aestuarii DSM 271
MPLITNVIARQILDSRGNPTVEVDVLTESSFGRAAVPSGASTGIHEAVELRDGDREVYLGKGVLKAVENVNTVINDALEGMLVTEQTEIDKLLLSLDGTPNKSKLGANALLGVSLACAKAAAEYSGLPLFRYIGGTLANTLPVPMMNVLNGGAHADNNVDFQEFMIMPIGFSSYSDALRCGAEVFHALKALLKSKGLSTAVGDEGGFAPDLASNEEAIELVIEAVGKAGYKAGSPTNAGGLGDAHVMIALDPASSEFYDTDKKKYIFKKSSGQELDSAEMASYWENWAGKYPIISIEDGMAEDDWEGWKILTDKIGSRVQLVGDDLFVTNSIRLADGIERKVGNSILIKVNQIGTLTETLQAIDLAKRNGYTSVISHRSGETEDSTIAQIAVATNAGQIKTGSLSRSDRMAKYNELLRIEEELGDEACYPGIRAFRV

SEQ ID NO: 87885 - protein, 809 aa, Physcomitrella patens subsp. patens
MPTKIHTAIRPSKIQYWRGVLQKPNFNACRLRSRLETEKFTRVLPGFTDECLHSTAWQSSEDYSGSEVEVCVLQQCWVAQLIVGGSEEVEFGFQMAPPVEGLTECLYDTLGVERTVDPDKLKIAYRKMAMKWHPDKIQQSGAGASPDDYQKATERFQMINRAYEVLSDPVERTWYDSHRERILNASSSSNSANAAPGEFDLNLWPYFSPSAFSGFGETGNGFYSVYSEVFKKVHMQEQVFGRMYGNGDVSAAPELGGKDTPYQNVYSFYRYWQGFSTVKDFAWCDKYDVLQAPNRKVRRLMDEENNKVRKRERKEFNNSVRQLASFVKKRDKRVIEKQLELQMIQKQKEQERKARQLALEKEKQEQIRLYKEQAWTVPSDQEEEEWDSDEDSDYDGTAKLEKTTEELECMICSKRFKSVKQLQNHERSKKHLENLAALKGAFRNDDEQVERLGKQLGIDISSTKRLKKGKADVGSDEVQEPAAGSDAQSGLEGKDPNMGISSYEEGPEVVSDAEPLRMPPTVNEIDGNPSLISKDNQSDDSIDDILQDSHNELKEEDVPLKEPISGEEEISDAEEDTDRMLAYMLKLQRSRWASSALPPETVSPDERLGSMEKSRAESIPDDEEVDEDDMLAAMSSLQLNKQKASSSEMDSEARQTEDTRNDVVEKAGVLSRSEESVVEDGDIDDDDEKPKKGKSRRRAKQDRKQAAISNRFATPSTDLEQPESVSQNGDATSDTGGPSIGANENVRAVSEVPQVKHSKLAHRGKKIKKEKKGAKQDSHTCQTCGEDFESRSQLFKHIAATNHAILKSK

SEQ ID NO: 87886 - protein, 178 aa, Bordetella parapertussis 12822
MSLDRVAPGKKLPDDFNVIIEIPMNADPVKYEVDKESGAIFVDRFMLTAMHYPCNYGYIPQTLSEDGDPADVLVLTPFPIQIGAVVRCRAIGVLEMDDESGGDAKLLAVPIEKLYPPYRNIKSYEDLPAEDVSRIQHFFEHYKDLEKGKWVKVKGWKGVDAAHEEIVRSAERYAKGQA

SEQ ID NO: 87887 - protein, 517 aa, Arabidopsis thaliana
MDAIVVDSQNCFIIILLCSFSLISYFVFFKKPKVNFDLLPSPPSLPIIGHLHLLLSTLIHKSLQKLSSKYGPLLHLRIFNIPFILVSSDSLAYEIFRDHDVNVSSRGVGAIDESLAYGSSGFIQAPYGDYWKFMKKLIATKLLGPQPLVRSQDFRSEELERFYKRLFDKAMKKESVMIHKEASRFVNNSLYKMCTGRSFSVENNEVERIMELTADLGALSQKFFVSKMFRKLLEKLGISLFKTEIMVVSRRFSELVERILIEYEEKMDGHQGTQFMDALLAAYRDENTEYKITRSHIKSLLTVNVHEFFIGAADASSIAIQWAMADIINNREILEKLREEIDSVVGKTRLVQETDLPNLPYLQAVVKEGLRLHPPTPLVVREFQEGCEIGGFFVPKNTTLIVNSYAMMRDPDSWQDPDEFKPERFLASLSREEDKKEKILNFLPFGSGRRMCPGSNLGYIFVGTAIGMMVQCFDWEINGDKINMEEATGGFLITMAHPLTCTPIPLPRTQNSLISHL

SEQ ID NO: 87888 - protein, 106 aa, Physcomitrella patens subsp. patens
PSILPCLQPAPPGSPTFPEIRSARPPQRQYEENWDAAIDLTLRRFVYGSLSGAASALLLFRSPSTRWAAVAFGAGAGIGSAFTDSSKLFRGSFGASSPSISSSPPA

SEQ ID NO: 87889 - protein, 493 aa, Kluyveromyces lactis NRRL Y-1140
MLRFNSTRSFSSSALLKTVTKKHDLVVIGGGPGGYVAAIKAAQLGYDVACVEKRGRLGGTCLNVGCIPSKALLNNSHLYHQMKTDAKQRGIDINGEININVAQFQKAKDTVVKQLTGGIEMLFKKNGVTYYKGLGAFETDKSVKVLPVEGLEGSVTEDHLLESDRIIVATGSEVTPFPGITIDEERIVSSTGALSLKEIPKKLAIIGGGIIGLEMGSVYSRLGSKVTVIEFQPQIGATMDGEVAQTTQKILKKQGLDFKLSTKVLSASRNGDVVDIEVEGAKNGKKESLQADVLLVAVGRRPYVAGLNAEKIGLEVDKRGRLVIDEQLSTKFPHVKVIGDVTFGPMLAHKAEEEGIAAAEYFKVGHGHVNYGNIPAVMYSHPEVAWVGKTEEQLKEAGIQYKIGKFPFIANSRAKTNMDTEGFVKILIDAESERLLGAHIIGPNAGEMIAEAGLALEYGASAEDIARVCHAHPTLSEAFKEANLAAYAKPINF

SEQ ID NO: 87890 - protein, 545 aa, Alkaliphilus metalliredigens QYMF
MKSSERKISSSESPLGMVSTASKQATEAGVKILKKGGNAIDAAVASAFCIGVTEPQASGLGGQSMVLVYLEEGKRVFALDGSSRAPFGIQPHKTPKTAIKTGLKSTTVPSTPATLGYMHEKYGKLSLATVMEPAILAAEEGFVVSQLQYELMSKHAELLRQDPLILKNYFKDHEPIEVGGIIRQPELAKCLIRMAEAGWHDFYIGSIGNKIVQDMEKRDGLISFTDLSQIPQPVEREVLTSSYRDYEIHTFPPPGAGRVLVQLLNILENFPPDMLNTADPAGATIFALAFRMALTDRQRMPMHPDYYLQTVNKMMTDKTYAQELSDRIHQIGKFSFPELFKPPITSGETTHLSVSDNEGNSVGITQSIELVFGSKTMADGLGFFYNNYMSAFDYKNMAHPFYLLPGGKPWSSVAPTLLFHQGKPKYLLGSPGSERISTTLAQVISRLVDGGMDLPSAIAAPRFHSSHAGVLQIEKSRFDPKVLETLEQTGFSIKNRGAYSFYLGCVQGISIPQGQGELFCGVADPRRDGTAKGPKYLSNNRGRLV

SEQ ID NO: 87891 - protein, 1013 aa, Clostridium thermocellum ATCC 27405
MKEKIGKVLRQNKSIISVVVITAILFVYNTGMLFTGIWEGALYNVKAEEVPLKLEFFNNVKDDNVTLISPYFRVINNSSSDEIYLQHVKIRYYFTLDSSDSEETMNYEIYYAGKSNIDGTGAVEDIKPNTIVKIAKMDIPTDMADHYLEIGFDESCGTIGPDKKVEVMVSISKEKYKKFIQTNDYSYNDSAENYVSWEKVTLYLDGELISGIEPNMYASRETGAWYMFDEAVEGSTNEFKDYKGNHGNAVLYSANGVVPGLNGNSVSLDGVDDYVALPDGIAGTFYNFTIAFWVRLDTIGEQPIFDFFDSGSNNKYMRLTAESDGKIKFAMTQSGYYGEKTITSGSALTEGVWKHVAVTLSGDTGTLYINGENVGENNTLSLRPLTFLGETSKGYIGKSHQTDSSEDPYYNSYLHGMIDDFRIFDRALSADEIKTLASVATRVNDSDPGIHYSSGWSHSQERDKGDYLNDVHELDSPDGENCFEYTFTGTGVNVIAPQCSDNGDAEIYIDGKLMKSVAMSVYSGYNSQAVVYSKLGLSLGTHTIKVVFKNGIGIIDALDIMTGEIVSPSPTPTPSPTPSPTPTPSPTPSPTPTPTPTPSSTPTSTPTPEPSPTSTPTPEPSPTSTPTPEPEPEPTSTPTPELSPSSTPVPTPTPTPTPAPNPAPEPVPISTPVPEPILIPTPTPTMTPMPTPTPTLEVKSDPYLSDLVVTGAKLKPAFVPDILNYEAVAEEDVRFVCIVAYARDDGAEITLNGVPVKSGSISHAVELKEGKNELIVKVVAEDGITSRTYRISVLLEALQLPTPTPDKSGNPFFSSLEDLLKENEVSPDGTKGGIFDDVPRGYWAEEYIQKLYEKGIISGIDEKTFMPGRPITRAEFTQIIVNSLKIPYREAGLHFNDVTEKDWYYKSVSSAAAFGIVVGRPDGSFAPNEFITRQDMAVVIAKFLEKKHDGNLEGMGKGLVFADSGNISEYARDSVAAVVSQGLMVGKPGNMFDPKGLTTRAEAVTVICKLMKY

SEQ ID NO: 87892 - protein, 128 aa, Glycine max
MAMALVSLNTIHTSPSSFSFSSPKPYSSSNYAPPLTLLPRFRRHLVRMAPDEEKMTRRSPLDFPIEWERPKPGRRPDIFPQFSPMKTPLPPPLPADPPEEDEEEEEKKEEEQEPDKEEPDKPDKPEKQ

SEQ ID NO: 87893 - protein, 842 aa, Penicillium chrysogenum
MFQKWGEANSNIGQSLAKVLGIKLAYRDPLGATGETVTRGESAFSMGTVDTYSYNEPEPTSIDWIREITPSGAQLGRYLLNLFPFLTWIGNYNLTWLWGDLVAGITVGAVVVPQGMAYANLAGLPVQYGLYSSFMGVLIYWFFATSKDITIGPVAVMSTLTGTIVTEVQDIYPDYPAHLIASALAVICGGIVLVMGLLRIGFIVDFIPLPAISAFMTGSALSICSGQVPTMLGETADFSTRGATYEVIINTLKYLPTSTLDAAMGVTACAMLYIIRSVCTYAARKQPARAKMWFFVSTLRTVFVILFYTMISAATNLHRKDNPAFKLLGSVPRGFQQAAVPTMDAKIIKAFVGELPAAVIVLLIEHIAISKSFGRVNNYTIDPSQEFVAIGVSNLLGPFLGGYPATGSFSRTAIKSKAGVRTPLAGVITAVVVLLAIYALPALFFYIPKASLAGVIIHAVGDLITPPNTVYQFWRVSPLDAIIFFIGVLVTVFSSIENGIYCTVCVAVAVLLFRVAKARGQFLGRVTIHSVVGDHLLDGDGKYGSFGTNKTPSDDEEHHHRTIFLPLNHTDGSNPDIEVEQPLPGIFIYRFAEGFNYPNANHYTDSLVANIFKNTRRTNPNTYKNRGDRPWNDAGPRRGKEGSDDDSHLPLLQAVILDFSSVNNVDVTSIQNLIDVRNQLDMYASPRTVQWHFAHINNRWTKRGLAAAGFGYPTPVASDGFHRWKPIFSVAEIEGSASAAAHAEIIANQRDQSQKPSDIESGFKSDSNTTARETDGIETASEDSEVIREDKFNREITDSKAYQRRPKVALVQGMNRPFFHIDLTSALQSAVANSSDEIPHIE

SEQ ID NO: 87894 - protein, 746 aa, Penicillium chrysogenum
MAETISSRVGRAFAKLLHIDLGVTPPVVTDETGTYSYYEHEPTVGDWLRGHMPTTPLVRRYIWGLFPFLHWIGYYNVQWLIGDLVAGITVGAVVIPQGMAYAELAKLPPEYGLYSSFMGVLIYWFFATSKDITIGPVAVMSTLIGSIIIRVQAVHPEIPPPVLASALAIICGVIVSFLGLLRLGFIVDFIPLPAITAFMTGSAINVCAGQVKTVLGEKAHFSTRGATYKIIIDTLKHLPSAQMDAAMGLTALAMLYGIRSACNYGTKKKPHKAKLFFFLSTLRTAFVVLLYTMISAAVNLHRRNNPAFKLLGNVPRGFKAAGVPKIDVPIIKAFVSELPVAVIVLLIEHIAISKSFGRVNNYTIDPSQEFIAIGISNLLGPFLGAYPATGSFSRTAIKAKCGVRTPLAGVVTAIVVLLAIYALPALFFFIPKSSLSAVIIHAVGDLVTPPRITYQFWRVSPIDALIFLMGVIVIIFSTIETGIYCTISVSLAVLLFRLARARGQFLGYIQVHSVVGDHILNASKGDSNTEFGDGTGMPRRIYLPTEHEGGTNPRIKIHQPAPGVFIYRVSEGFNYPNANHYTDHLVSHIFKETRRTNSQAWETTGDRPWNDPGPTRAERKVLMAEEAPTSPLPTLRAIILDFAAVNNVDVTSVQNLIDVRNQLDRWASPDSVQWHFAHIHNRWTKRALAAAGFGFPAISDRSGPRCQRSVFNVAESLDGGLSGSIDQCRVVGSEDWSKDLEAGLKV

SEQ ID NO: 87895 - protein, 194 aa, Burkholderia sp. 383
MNTKKNELPAPDATRISRTLSYLLRHAPQTIGLQLDPEGWADIDELIAGIARQGLHLDRATLETVCATNDKQRFALSDDGRRIRAVQGHSTPVVQRRYPAAQPPERLYHGTATRFLDSIRAQGLKPGARHHVHLSPDIRTALAVGTRYGVPVILEVDAQRMHRQGHTFFVAENGVWLTDTVPAEFLKEMDQPAR

SEQ ID NO: 87896 - protein, 148 aa, Xanthobacter autotrophicus Py2
MTAYKKTEAAIAKLSPEEYRVTQQSATERPGTGALLHNKEPGVYVDIVSGEPLFASSDKYESGCGWPSFTKPIEPANVNELRDNSHGMIRTEVRSTYGDSHLGHVFPDGPSDRGGLRYCINSASLRFVPRGEMESQGYGEYLNQVEDI

SEQ ID NO: 87897 - protein, 152 aa, Arabidopsis thaliana
MSSKMIVLMSSDGQSFEVEEAVAIQSQTIAHMVEDDCVADGIPLANVESKILVKVIEYCKKYHVDEANPISEEDLNKWDEKFMDLEQSTIFELILAANYLNIKSLFDLTCQTVADMIKGKTPEEIRSTFNIENDFTPEEEEAVRKENQWAFE

SEQ ID NO: 87898 - protein, 652 aa, Arabidopsis thaliana
MDSEGVSLPLIHKHHMLPWNDMRKGDCCRRFEAISDGYYCKTCDFFVHKSCGDRSSEYIEHPSHPSHALQLLRKPGHTRNCNLCGISIKSLFYNCEICNFNVHMYCAKYPPPQVIDISETHHHKLNLYKKPNYIDCGDKCGKLSYEFSYKCQECDLAFHVDCAWRPSESNLPLEVNHFYHSLHPLKLVRGKLPDYSDRKCRLCGRYIGDRLFYHCSSCNFTLDMRCVLNPPQQSLLNLKAHDHQLTLLPRLDSFTCNACGLKGDRSPYVCFQCGFMIHQDCLDLPRVININRHDHRVSRTSVLGVVKSVCGVCHQKVDWTCGGFSCQRCHGYVVHSKCATRKDVWNGKELEGVPEETEDIQPYVVIDENTIQHFSHKEHYLRLHVNGVLCDDNKWCSACTHPICLQSFYGCMDCDFILHQNCAGFRRMKWHVLHNERLTLVINEAEPFRCYACDRWSNGFRYHQGNITFDVRCGSIAEPFLHPSHPDHPLYHTLPDGGIKICNGCKNGFYDVLGCIEDDCRFAICFKCATFPQVVKHRVDDHPLSLCYGEKASGKYWCDICEKETNPEIWFYTCKDYQASLHIECVVGALSLLMPRSTINPWEKSYEVVLNNSASRPFCSYCELRCIFPIILKRLGSSDNYVCSYFCALFCI

SEQ ID NO: 87899 - protein, 390 aa, Moorella thermoacetica ATCC 39073
MQEARRIRELPPYLFARIEKKIAEARERGVDIISLGIGDPDMPTPSHVIDKLVAEAHNPENHRYPTSEGLLAFRQAVADWYQRLYGVDLDPRREVVTLIGSKEGIAHISLCYVDPGDINLVPDPGYPVYNIGTLLAGGESYFMPLTAANGFLPDLGAIPSDVARRAKLMFINYPNNPTGAVADLKFFQEVVEFARSYDLIVCHDAAYSEITYDGYRAPSFLQAPGAKEVGIEFNSVSKPYNMTGWRLGWACGRADVIEALARIKSNIDSGAFQAVQYAGIAALTGPQEGLAEVRRVYQERRDIIVEGFNSLGWHLEKPKATFYVWAPVPRGYTSASFAEMVLEKAGVIITPGNGYGNYGEGYFRIALTISKERMQEAIERLRRVLGKVEF

SEQ ID NO: 87900 - protein, 341 aa, Yersinia pseudotuberculosis IP 32953
MKALSKLKAEEGIWMTDVPQPELGHNDIMIKIRKTAICGTDVHIYNWDEWSQKTIPVPMVVGHEYVGEVVAIGQEVKGFNIGDRVSGEGHITCGHCRNCRGGRTHLCRNTVGVGVNRPGSFAEYLVIPAFNAFKIPDNISDELAAIFDPFGNAVHTALSFDLVGEDVLVSGAGPIGIMAAAVCKHVGARHVVITDVNEYRLDLARKMGVTRAVNVSKENLNDVMTELGMTEGFDVGLEMSGAPPAFRSLLNSMNHGGRIAMLGIPPSDMSIDWNQVIFKGLFIKGIYGREMFETWYKMAALIQSGLDLTPIITHRFPIDEFQQGFDAMRSGKSGKVVLSWD

SEQ ID NO: 87901 - protein, 92 aa, Arabidopsis thaliana
MAFFMLSSDPVDTWADQATMVAPFTGLKSSAAFPVTRKTNMDMTSIVSNWGRVSCMNVWPPIVKKNVETLYYLPDRRDGELANEVDYSFLNK

SEQ ID NO: 87902 - protein, 515 aa, Yersinia pseudotuberculosis IP 32953
MSSTKKPLVLTILDGYGHREEQQDNAILNAKTPVMDVLWQQQPHTLIAASGLDVGLPDGQMGNSEVGHVNLGAGRIVYQDLTRLDKEIKEGDFFTNPTLTAAVDNAVKTGKAVHIMGLLSAGGVHSHEDHIMAMVELAAKRGATAIYLHAFLDGRDTPPRSAESSLKRFTAKFAELGNGRIASIIGRYYAMDRDNRWDRVQLAYDLLTQAKGEFTADNAVAGLQAAYARGENDEFVKPTVIQATGEADAAMNEGDTLIFMNFRADRARQITRTFVNADFDGFKRDKVVNFGDFIMLTEYAADIKVACAYPPASLTNTFGEWLMKHDKTQLRISETEKYAHVTFFYNGGVEEPFKGEDRILINSPKVATYDLQPEMSSAELTEKLVSAIGSGKYDVIICNYPNGDMVGHTGDYDAAVKAVETLDNCIEQVVAAVKAADGQLLITADHGNAEQMRDPATGQAHTAHTSLPVPLIYVGNKAVKAVEGGKLSDIAPTMLSLMEMEIPQEMTGKPLFIVE

SEQ ID NO: 87903 - protein, 487 aa, Streptomyces coelicolor A3(2)
MADPKGFLNHGREVARTRPVDERVKDWNEVYVPGSLLPIISKQASRCMDCGIPFCHNGCPLGNLIPEWNDYAYREDWSAASERLHATNNFPEFTGRLCPAPCESACVLGINQPPVTIKNVEVSIIDKAWETGDVAPRIPERLSGKTVAVIGSGPAGLAAAQQLTRAGHTVAVYERADRVGGLLRYGIPEFKMEKRHINRRIEQMRAEGTRFRTGVEIGRDLKATDLKKRYDAVVIAAGSTTARDLPVPGRELNGIHQAMEYLPLANKVQEGDYVAPPITAEGKHVVVIGGGDTGADCVGTAHRQGAASVTQLEIMPRPGEERDAVRQPWPTFPMLYKVTSAHEEGGERVYAVSTTHFEGDEDGNVQWLHMSEVEFVDGKLTSKPGTERKIPAQLVTLAMGFTGTDKDNGLVDQFGLELDERGNIARDADFQTNVPGVFVAGDAGRGQSLIVWAIAEGRSAARGADRFLTGASDLPAPIRPTDRALAV

SEQ ID NO: 87904 - protein, 788 aa, Xanthomonas axonopodis pv. citri str. 306
MFRQEGRIQPPAPSRTTPPMSTDDFKQAALDYHRQQPAGKIKVTATKPMLTQRDLSLAYSPGVAFACEAIVEDATQASELTARGNLVAVITNGTAVLGLGNIGPLASKPVMEGKGVLFQKFAGIDVFDIEINENDPDKLVDIIASLEPTFGGINLEDIKAPECFIVERKLRERMNIPVFHDDQHGTAIIVGAAVLNALVVTGKKIEEVKLATTGMGAAGISCVNMLVSLGLKPENILALDRDGVIHTGRTDLDPDKQRYARDTDKRTLAEIVEGADIFLGLSAAGILKPEMVASMARQPVIFALANPNPEITPEAAKAVRPDCIIGTGRSDYPNQINNVLCFPYLFRGALDVGATGINEEMKIACVKAIAAMARREASDLGAAYGGETPSFGPEYLIPRPLDPRLLVELSSAVAQAAMDSGVATRPITDMEAYRDKLGQFVYRTSLMMKPVYDRARADKQRVVYAEGEEEVVLRAVQNVVDEGLAFPILIGRPDVIEARIERMGLRLTAGVDFEITNILDDPRFNDYWQYYHALTERRGVTVTAAKELMRSRPTLIAAVMVARGEADAMLSGVVGRFHKKLGYARSVIPLEPRVSSTSAMTGVINQLGVFFFLDTHVQEDPTVEQVVEATLQAAYRLKLFGIEPNIALLSHSNFGSHDSRDALKMRQVREALLKRKPELNIDGEMQGDTAWDEALRKQIMPNSTLKGRANLFVLPNLEAANIAYNLVRVFTDGVAIGPILMGISKPVHILTTSATSRRVMNMTAIAAVDAQIRRQRDAEKAAADKGND

SEQ ID NO: 87905 - protein, 138 aa, Streptococcus agalactiae NEM316
MEQTFFMIKPDGVKRGFIGEVISRIERRGFSIDRLEVRHADADILKRHYAELTDRPFFPTLVDYMTSGPVIIEVISGEEVISTWRTMMGSTNPKDALPGTIRGDFAQAPSPNQATCNIVHGSDSPESATREIAIWFNN

SEQ ID NO: 87906 - protein, 212 aa, Azoarcus sp. BH72
MNAGTPQHSSAWDPVGLGLIPMVVEQSGRGERSYDIYSRLLKERVVFLVGPVNDVTANLIVAQLLFLESENPDKDIYFYINSPGGSVTAGLAIYDTMQFIKPNVSTLCIGQAASMGAFLLAAGEKGKRFCLPNSRVMIHQPLGGFQGQASDIEIHAREILYLRERLNGMLAKHTGQTIEQIEKDTDRDNFMSATAAVEYGLVDKVLTSRADT

SEQ ID NO: 87907 - protein, 221 aa, Oryza sativa
  misc_feature (34)..(34): Xaa can be any naturally occurring amino acid
RPGLRFLSPSPSSSSLSSPLRRCRCCCVLLSSPXSSPPRARPLAGRRRKRRLRPEFWLAGSGSPRPWGLQEARTCQLRFLSPSPSSSSLSSPLLSAAAAAAACSSHPRLFPLRARRPLAGRRRKRRPSPEFVLAGSGSPQSMSEEAGRPLPKFGEWDVNDPASADGFTVIFNKARDEKKGGNGQDTDSPCKETRTERVESYAPKTNSKKWFCCVTSSPTQS

SEQ ID NO: 87908 - protein, 386 aa, Bacillus licheniformis ATCC 14580
MNIHEYQGKEVLRKYGVAVPEGKVAFTADEAVKAAEALSSSVYVVKAQIHAGGRGKAGGVKIAKSKEEVKAYAEELLGKTLVTHQTGPDGQQIKRLLIEEGCDIKKEYYVGLVLDRATSRIVLMASEEGGTEIEEVAEKTPEKIVKEVIDPAVGLQSYQARKIAFAINIPKELVGQAVKFMMGLYKAFTEKDCSIAEINPLVVTGDGKVMALDAKLNFDSNALYRQKDILEYRDLDEEDPKEIEASKYDLSYISLDGNIGCMVNGAGLAMSTMDIIKHYGGEPANFLDVGGGATAEKVTEAFKIILSDQNVKGIFVNIFGGIMKCDVIAEGVVEATKQVGLTLPLVVRLEGTNVDLGKKILDDSGLNITSAESMADGAQKIVSLVK

SEQ ID NO: 87909 - protein, 461 aa, Glycine max
MAGKSNEKKGGRRGRACVVVLGDIGRSPRMQYHALSLANQASLEVDIVAYGGSEPHTALLANPSIHIYIMKQWLTASQSLPKILRSIMLLLKPLVQFCMLLWFLCVKIPSPDIFIVQNPPSVPTLVAVKWASWLRNSSFVIDWHNFGYTLLALSLGRNSHFVSLYKWFEKHYGKMADASLCVTKAMLHELAQNWGINATVLLNEDLFQPLGVRDCVSNGTSLIASHRQNETLFTTEFGSNIYLKPNRPALVVSSMSWTPDKDFAILLEAAVMYDRRVAAIIGEDDSVDEEVMWKEISDAKQCLYPRLLFIITGKGPEKEKYEATIKGMKLKRVAFRTMWLSADDYPLLLGSADLGVCLHMSSSGLDLPMKVVDMFGCGLPVRAVSYSCIRELVRLDKNGLLFSSSSELADELLLLFKGFPDDCEALEVLKYGALETGSSARWATEWEEQAKPLITEVMSRF

SEQ ID NO: 87910 - protein, 623 aa, Arabidopsis thaliana
MEAVIQTRGLLSLPTKPIGVRSQLQPSHGLKQRLFAAKPRNLHGCLYPLTGTRNFKPLSQPCMGFRFPTKREAPSSYARRRRGCWRRSCLRRSDSAAVVASRKIFGVEVATLKKIIPLGLMFFCILFNYTILRDTKDVLVVTAKGSSAEIIPFLKTWVNLPMAIGFMLLYTKLSNVLSKKALFYTVIVPFIIYFGGFGFVMYPLSNYIHPEALADKLLTTLGPRFMGPIAILRIWSFCLFYVMAELWGSVVVSVLFWGFANQITTVDEAKKFYPLFGLGANVALIFSGRTVKYFSNLRKNLGPGVDGWAVSLKAMMSIVVGMGLAICLLYWWVNRYVPLPTRSKNKKEKPKMGTMESLKFLVSSPYIRDLATLVVAYGISINLVEVTWKSKLKAQFPSPNEYSAFMGDFSTCTGVATFTMMLLSQYVFNKYGWGVAAKITPTVLLLTGVAFFSLILFGGPFAPLVAKLGMTPLLAAVYVGALQNIFSKSAKYSLFDPCKEMAYIPLDEDTKVKGKAAIDVVCNPLGKSGGALIQQFMILSFGSLANSTPYLGMILLVIVTAWLAAAKSLEGQFNSLRSEEELEKEMERASSVKIPVVSQDESGNGSLGESPSSSPEKSAPTNL

SEQ ID NO: 87911 - protein, 168 aa, Methanothermobacter thermautotrophicus str. Delta H
MIEMEPDTHIISALVEHKPGVLQRVAGLFTRRGFNIENITVGESETPGIARMTIIARGDDRVLEQITKQLNKLIDVIKVRDLEPAATVKRELCMVKVHAPSESERSEIIQYTNIFRGRIVDVSPDALTVEVTGDSEKIDAFLELLRNFGIKELARTGPTAMSRGSRTM

SEQ ID NO: 87912 - protein, 192 aa, Zea mays
  misc_feature (168)..(168): Xaa can be any naturally occurring amino acid
MVLSHAASAGSSDDSVHSTFASRYVRASLPRFRMPENSIPKEAAYQIINDELMLDGNPRLNLASFVTTWMEPECNKLMMDSINKNYVDMDEYPVTTELQNRCVNMIAHLFNAPLGETETAVGVGTVRSSEAIMLAGLAFKRRWQNKMKAAGKPCDKPNIVTGANVQVXCWEKFARYFEVELKEVKLSEGYYV

SEQ ID NO: 87913 - protein, 247 aa, Zea mays
  misc_feature (61)..(61): Xaa can be any naturally occurring amino acid
  misc_feature (141)..(141): Xaa can be any naturally occurring amino acid
ESVSSESACGSRSSADLISIAATVVAVTILLHIVASYLTSSKPSTIVLSGLSGSGKTTIFXQLREGSSHQTHVTSMEENSDTFVLHSEQERKDKVKPVHIIDVPGHARLKPKLDEVLPKAAAVVFVVDAQDFLSSMQAAAXYLYDILTKATVVKKKVPVLIFCNKTDKVTAHSKEFIKKQLEKELNKLRESRNAVSSADISDEVQLGVPGEAFNFSQCQNKVAVAEGAGLTGDVSAVEQFIREHVKA

SEQ ID NO: 87914 - protein, 301 aa, Methanothermobacter thermautotrophicus str. Delta H
MKHLLSVCDMDNVVDLLDLADDYKEGKIREKILRGKTLAMIFEKSSTRTRVSFEVGAFQMGAQPLYLSASDLQLGRGEPIADTARTLSRYVDGIMIRAISHSDVVELAGEASVPVINGLTDLEHPCQALADMQTIREKLGGFDGRLVFVGDGNNVCHSLLLITATLGMDMDVACPPGYEPDPGIREMAGKIADETGSRIRVIHDPSEAVRGADVVYTDVWVSMGYEDEAEDRLEVFRPYQVNMELMELAAPEAIFMHCLPAVRGQETTAEVIDGPHSVVWDQAENRLHAQKAIMHWLMGDI

SEQ ID NO: 87915 - protein, 212 aa, Triticum aestivum
NKFVQKSRLVPVRNSRDIVDPRVRRVLASGSLDEDASSVRLFVKRGLEVFVAQSYSKNLGLYAERIGAINVICSAPEVADRVKSQLKRLARPMYSNPPIHGAKIVANVVGDPTMFGEWKEEMEQMAGRIKNVRQKLYDSLTEKDQSGKDWSFILSQIGMFSFTGLNRPQSDNMTDKWHIYMTKDGRISLAGLNLAKCEYLADAIIDSFHNVN

SEQ ID NO: 87916 - protein, 455 aa, Xanthomonas campestris pv. vesicatoria str. 85-10
MDPSVLKALQRLDAAHHLHPFNDNAALAHKGTRILTRGEGVYVWDADGNQFLDAFGGLWCVNVGYGREELAQAAARQMEQLAYYNSFFQCTTEPTIRLAAKLAALAPGDLNHAFFANSGSEANDTILRLVRHFWAVQGQPQKRIFIGRHDGYHGTTMAGASLGGMKGMHRQGGLPIADIHHIAPPYHFGDGGQMDPEDYGLLAARRLEDKILELGPEHVAAFIGEPIMGAIGVYIPPRSYWPEIERICRRYDVLLVADEVICGFGRTGEWFGAEYFGFQPDVMTLAKGITSGYIPLAAAMFNDRVAGVLKTQGGELAHGGTYAGHPVCAAVALENLRLLQDEGIVETARTQVAPYLAQRWAALGEHRLVGEARIAGLVGALELVPDKQRRGAYFPGRGRVGAMCRDFALRRGLILRATYDAMLLSPPLIITREQVDELFDKAWAALDDTAHALGR

SEQ ID NO: 87917 - protein, 434 aa, Mycobacterium smegmatis str. MC2 155
MTETRLETSQVRRTTLPGGLRVVTEYLPYVRSASVGVWVGVGSRDEGRSVAGAAHFLEHLLFKSTPTRTAVDIAQTVDAVGGELNAFTAREHTCYYAHVLDSDLELAVDLVADVVLRGRCAAEDVEVERDVVLEEIAMRDDDPEDTLGDVFLSAMFGDHPVGRPVIGSIESISEMTRAQLHSFHVRRYTPDRMVLAVAGNVDHDEVVALAREHFGRRLVQGRDAVPPRKGSGRVPGRPSLRVVERDGEQTHVSLGVRTPGRHWEHRWALSVLNTALGGGLSSRLFQEIRETRGLAYSVYSTVDTFSDSGALSIYAGCLPERFEEVVRVTTDVLETVARDGISENECRIAKGSLRGGLVLGLEDSASRMHRIGRAELNYGEHRSIEQTLAQIDAVTLDEVNAVARQLLTRDYGAAVLGPDTAKVALPQRLQDIAS

SEQ ID NO: 87918 - protein, 459 aa, Xanthomonas campestris pv. vesicatoria str. 85-10
MASENSIASLPAADAHTLSRIAGCESVDLLLPDTNGVLRGKRVTAEALGKVYREGVCLPMSLIATDITGNTVEETGLGYAIGDADRICRPIEGSLRPVPWAPRPMAQLLLAMHTPERALFEVAPRAVLQRVLQGFGALGLTPVIAVELEFYLFDAIADAQGRPQTPRDPITGERSNSTQVYSLQDLDDQRGFTDAVTAACRQQGIPADTAVAEYAPGQFEINLHHRADAVAACDEAILLKRTIKAIAQQQGKLASFMAKPFPGQAGSGLHLHVSLLDAAGHNVLASAADAPAQPLRHAIAGLQRHADASLLMFAPHANSYRRFVSNAFVPLDASWGFNNRTVALRIPHSDAHNTRIEHRIAGADANPYLAAAAVLAAMLDGLRQPAEPTAAITGNAYAQSVFTPRSWQGAVDAFLGSDFIAEQFGMQFQHVFGQQKQRELLDYQAQVPDLDYARYLRTV

SEQ ID NO: 87919 - protein, 420 aa, Solanum demissum
MGNCVGSSARVEATLSSTTPSAYEASRFPDRKSNSSVPSSLSIPSYGRKSSSESLPTPRSESEILFSPNVKSFSFNELKNATRNFRPDSLLGEGGFGCVFKGWIDAQTLTASKPGSGIVIAVKKLKPEGFQGHKEWLTEVNYLGQLRHPNLVKLIGYCIDGDNHLLVYEFMPKGSLENHLFRRGPQPLNWATRIKVAIGAARGLAFLHDAKEQVIYRDFKASNILLDAEFNSKLSDFGLAKAGPTGDRTHVSTQVMGTQGYAAPEYVATGRLTAKSDVYSFGVVLLELLSGRRAVDNTKVGIEQNLVDWAKPYLGDKRKLFRIMDTKLEGQYPQKGAYTAANLAWQCLSNEPKLRPKMSEVLTALEELQSPKGVSKLSHTEHRAIPSPVAVSPMRHHRSPLHMTPSASPFQAYQKSPRGR

SEQ ID NO: 87920 - protein, 284 aa, Coxiella burnetii RSA 493
MDKRSSLPPIVRHITCDQMTEPAFQGEYTDLKETGRYLCRQCGIALFRSQDKFHSGCGWPSFDATIAGTIKRLPDPDGQRIEIRCERCGAHLGHVFEGEALTPKNTRYCVNSLSLDFVTDSQIRDTEEAIFAGGCFWGVEYYFKRLPGVVKTEVGYTGGHKNNPTYKEVCSRTTGHVEAIRVLYDPQQINYEKILHYFFEIHDPTQTDGQGPDLGDQYHSVIFYYDNQQKRMAEMAIKVLTEKGYRIATRLAPVSIFWRAEDYHQDYYQKTGKQPYCHHYVKRF

SEQ ID NO: 87921 - protein, 603 aa, Xylella fastidiosa Ann-1
MTVIEIKVPDIGDYSKVPVIEVLVTVGDHVVKNQGILTLESDKATLEVPSMNNGIVKELKVNVGDLLSQGDVILLLETEDTTAPPSPSNAATSDTTSPPPPSPQPAASKATAPDQQHSDIKCRMVVLGAGPGGYTAAFRAADLGLDTVLVERYPNLGGVCLNVGCIPSKALLHAAAVIDEAAHASTFGIDFGKPKITLDTLREYKQNVVNKLTAGLAGMAKQRKVRTVTGIAHFVSPNTLDITAADGSTQRLHFQQCIIATGSHPVKLPNFPWDDPRIMDSTDALELAEVPKKLLVVGGGIIGLEMATVYNALGSHVTIVEFMDQIIPGTDKDLVKPLADRMKKQGIEIHLNTKASHVKADKKGITVSFEAPTQGTQPTLKTSTYDRVLVAVGRTPTGNNIGAEKAGVNVTERGFIPVDRQMRSNVPHIFAIGDIVGNPMLAHKATHEGKLAAEVAAAETESGKHREWVARVIPSVAYTNPEIAWIGMTETEAKAKSLNIGVAKFPWAASGRAIGIGRTEGFTKLIFDEDTHRIIGGAIVGVHAGDLLAEIGLAIEMGTEAEDISHTIHAHPTLSESIAMSAEVYDGTITDLYLPKKPATSAK

SEQ ID NO: 87922 - protein, 336 aa, Legionella pneumophila subsp. pneumophila str. Philadelphia 1
MSYEELSNTMEQMLHEGKGILAADESNSTIGKRFASINTENTEENRRDYRLLLATTPDLEQYINGVILFEETFTQTDEHGTPIPELFANKGIIPGIKVDKGLVDLANTEHEKVTQGLDGLTERLLHFKKLGAKFAKWRNVYSISEYTPSLTAIKTGAENLGRYAAACQSVGIVPIVEPEVLMDGNHSIEHCAEVCEMVLHELFHTLFIHQVELEHIILKPSMVTCGKEVAPFSDPEEVADYTISVFRNNVPASVPTINFLSGGQTPQQATANLNAINQIGHQPWLLSFSFGRALQEDCLKEWCGNKANIAKAQEALIKRARLNSMACLGEYQNDME

SEQ ID NO: 87923 - protein, 851 aa, Fusobacterium nucleatum subsp. vincentii ATCC 49256
MKQVYEFKDGGKEMVALLGGKGANLAEMAKIDLPIPKGIIISTTACNDYFKNDKKLSSVLEEEILTNIRVLEYETGKKFQSTKPLLVSVRSGAPVSMPGMMDTILNLGFNDYVAEKMLEITKDEKFVYTSYLRFVQMFSEIAKGINRKKFMHLKATDYKAQIIESKNIYREECGEMFPENYKAQILIAVKSIFDSWNNDRAILYRKLHNIDNNMGTAVVIQEMVFGNFNDKSGTGVLFTRNPSTGENKIFGEVLLNAQGEDIVAGIRTPDNIELLKTSMPNIYNELADTVKKLEKHNRDMQDVEFTIEDSKLYILQTRNGKRTAEASLKIAMDLVKEGIITKEEAILKVEPASLNKLLNGDFEEKYLKEATLLTKGLAASSGVAVGRIMFDAKRVKIREKTILVREETSPEDLQGMALAQGIVTLKGGATSHGAVVARGMGKCCVTGCSEIKIDEINKTMTVGKHTLKEGDFISVSGHTGEIYLGKIPLKENSFSDELKEFVSWASEIKRMGVRMNADTPEDVKQGKAFGAKGIGLCRTEHMFFKKDKIWTIREFILSDRGEEKEKALKKLHNLQKEDFLNIFKILNGDEANIRLLDPPVHEFLPKTLEDKKKMAEILSISLEDIEKRIYRLKDENPMLGHRGCRLGVSYPELYRIQARAIVEAAYECEKKGIKVHPEIMIPFIMESKELAYLRKEIEEEIESFFKEVGATVEYKLGTMIEIPRACLLANEIAEYADFFSFGTNDLTQMSMGLSRDDSVKFLDDYREKGIWEGEPFYSIDTKSVTKLVEIGVKNGKTTKPNLQIGVCGEHGGDPKSIEFFEGQKFDYVSCSPFRVPTAILAAAQSYLKLKR

SEQ ID NO: 87924 - protein, 283 aa, Oryza sativa
MKLHSLKRREIETSRLQPYMAMATTSSKNERWSLAGATALVTGGSKGIGRAIVEELASLGATVHTCARTEAPLNRCREELTAKGLAVTVSVCDVSLRADREALAGTVRELFGGKLSILVNCAGMSFLKPAVELTPDDCSQVMGMNFESCFHLSQLAYPLLKASQRGCIINISSIASVVAFCSLPNAVYSAAKGAMNQVTRNLAAEWANDGIRVNCVAPGFIRTPLLSEFVEGNELGRAEFSRVPMGRLGEPEDIASLVAFLSMPASSYITGQVICADGGRCLS

SEQ ID NO: 87925 - protein, 433 aa, Ralstonia solanacearum GMI1000
MSNVASPSTLQHAIPSYLPADNLGPWGIYLQQVDRVTPYLGSLARWVETLKRPKRALIVDVPIQMDDGRIAHFEGYRVQHNTSRGPGKGGVRFHQDVTLSEVMALSAWMSVKNAAVNVPYGGAKGGVRVDPRKLSSGELERLTRRYTSEIGIIIGPNKDIPAPDVNTNAQIMAWMMDTYSMNEGATATGVVTGKPIALGGSLGRREATGRGVFVVGSEAARNLGIDVKGARIVVQGFGNVGSVAAKLFQDAGAKVIAVQDHKGIVFNGAGLDVDALIQHVDHNGSVDGFKAETLSADDFWALECEFLIPAALEGQITGKNAPQIKAKIVVEGANGPTTPEADDILRDRGILVCPDVIANAGGVTVSYFEWVQDFSSFFWTEDEINQRLVRIMQDAFRAIWQVAQDNKVTLRTAAFIIACTRILQARQERGLYP

SEQ ID NO: 87926 - protein, 80 aa, Physcomitrella patens subsp. patens
QRVFSFRKGRSQGNMGMKSVLGGKGANFAEMSSIGLSVPPGLTVTTETCEEYNSNGSQPLNSLWEEVLGGLRTIEIDMGA

SEQ ID NO: 87927 - protein, 575 aa, Oryza sativa
MASSALICDTEQWKGLQIGRAHYDFVFWCGEQAHVGEIQKTHLRHLMHDVERCKAMTACLLIDSEYEGIYLDYSRQRATGETMEKLFKLAEAAKLKEKIEKMFRGDKINSTENRSVLHVALRAPRDEVINSIGSMWSRSWGVKDKIKQFSETFRSGSWVGATGKALTNVVSVGIGGSFLGPLFVHAALQTDPEAAESAKGRQLRFLANVDPVDVARSIKDLDPETTLVVVVSKTFTTAETMLNARTLKEWIVSSLGPDAVAKHMIAVSTNLELVEKFGIDPKNAFAFWDWVGGRYSVCSAVGVLPLSLQYGFPIVQKFLEGAASIDKHFRSSSFEKNIPAILPYSQALEKFAPHIQQLSMESNGKGVSIDGVQLPFESGEIDFGEPGTNGQHSFYQLIHQGRVIPCDFIGVVKSQQPVYLKGEIVSNHDELMSNFFAQPDALAYGKQFTGYFQTPEQLHSEKVPEHLIPHKTFQGNRPSLSLLLPSLSAYEIGQLLAIYEHRIAVQGFLWGINSFDQWGVELGKSLASQVRKSLHASRVEGKPVLGFNSSTTSLLTRYLAVEPSTPYNTTTLPKV

SEQ ID NO: 87928 - protein, 172 aa, Physcomitrella patens subsp. patens
MAQYGRKPDTEETNCQVPEGPVRCTNNCGFFGSAVTMGMCSKCYRDFVLSQSRTSSAKIAGASPPVYETQEPVADRAQIQNSCLSSTQPEAAGASSGASASGQDPSRSRPNRCFSCKKRLGLTGFECRCGNLFCSAHRYSDKHSCTFDYKLAGRDSISKANPVVKADKINKI

SEQ ID NO: 87929 - protein, 438 aa, Prosthecochloris aestuarii DSM 271
MIYYSTNKSSTPASLKRATLEGLAPDGGLYVPSAIPVFSPSEIELLKEAPFKDIAFAIAKKYTGSEIPPDRLYEIIEECFNFPTPLVPLDNNTFIEELFHGPTLAFKDYGARFLARMTGYFAEEDHTLITILVATSGDTGSAVAYGFQGIPNTRVVLLYPSGKVSRLQEQQLTTAGGNVTALEVKGDFDDCQRLVKQAFMDGSIKQNLTLTSANSINISRLIPQSFYYAWAALQLDRKYPGKKAVFSVPSGNYGNLTAGVLAKMMGFPIDHFIAASNANDSVTRYIEEGRYEPHPTIRTLSTAMDVGDPSNFARLRHIYANDHTKMAADITGYSISDNETLETIRSVYDRFGYIMDPHTAVGSRALELWREQMTQADSNPAVVLSTAHPAKFLESIREALDMEISIPDRLQTVLDKQKIATLIGSDYNELSAFLSALD

SEQ ID NO: 87930 - protein, 155 aa, Prosthecochloris aestuarii DSM 271
MTIKTIEGTLDARNSRFALVVSRFNDFIGQKLVEGAVDCIVRHGGSEEQIALYKCPGAFELPSVAKKVAVSGRYDAVITLGAIIRGATSHYDVIAAEATKGVAQVGLDTMIPVTFGVLTTDNLEQAIERAGTKAGNKGFDAALAAIEMVNLYQQV

SEQ ID NO: 87931 - protein, 142 aa, Physcomitrella patens subsp. patens
PVVAMAAVACTSCASPATCLVQKSLGTSSSHRAAARPVAGVPVLAMPRIVCSLEKKESNKGDVNGLPQLAAAVTSAATMAYAHPVFALVDERLSTEGTGLGLGVSNPKLTWILVGVTALVWAVYFTYSSTLPEGDDDSGLSL

SEQ ID NO: 87932 - protein, 482 aa, Azoarcus sp. BH72
MTIKSVILSGGSGTRLWPASRETYPKQLLPLTGELSLLQETAVRLKDFAGEVDPVPLVVTNEDYRFIIAEQLRQIGVASAGIVLEPVGRNTAPALTLAALAAAAGGNDPVLLVMPADHVITDVERFQLAIGEGAALASAGALVTFGIVPDHPETGYGYIRVGPAVSGAATSRVLAEFVEKPDAPTAERYVASGEYFWNSGIFMMKASVWLRAIERFNPEMAAACEAAFVERKADADFLRVGKGAFENCPSDSIDYAVMEKLQSAPEVGQGVVVPLSAGWSDVGAWDALWAVSPKDASGNSARGEVLFESSRNTLVHASTRLVAAVGCDDMVVVETADAVMVAHKSHTQSVKNVVARLKAEGRSLTRTHRKVYRPWGWYDSIDAGDRFQVKRIVVNPGAKLSLQMHYHRAEHWIVVRGTAEVTAGDKVFLLGENESTYIPLGHTHRLTNPGKVPLEIIEVQSGSYLGEDDIVRFEDTYGRTEG

SEQ ID NO: 87933 - protein, 500 aa, Streptococcus agalactiae NEM316
MNKRVKIVATLGPAVEFRGGKKFGESGYWGESLDVEASAEKIAQLIKEGANVFRFNFSHGDHAEQGARMATVRKAEEIAGQKVGFLLDTKGPEIRTELFEDGSDFHSYTTGTKLRVATKQGIKSTPEVIALNVAGGLDIFDDVEVGKQILVDDGKLGLTVFAKDKDTREFEVVVENDGLIGKQKGVNIPYTKIPFPALAERDNADIRFGLEQGLNFIAISFVRTAKDVNEVRAICEETGNGHVKLFAKIENQQGIDNIDEIIEAADGIMIARGDMGIEVPFEMVPVYQKMIITKVNAAGKAVITATNMLETMTDKPRATRSEVSDVFNAVIDGTDATMLSGESANGKYPVESVRTMATIDKNAQTLLNEYGRLDSSAFPRNNKTDVIASAVKDATHSMDIKLVVTITETGNTARAISKFRPDADILAVTFDEKVQRSLMINWGVIPVLADKPASTDDMFEVAERVALEAGLVESGDNIVIVAGVPVGTGGTNTMRVRTVK

SEQ ID NO: 87934 - protein, 142 aa, delta proteobacterium MLMS-1
MEENLMSEEQALVPVLIVEDDEADAYLVRLAFSDTEMGVKLSHVSDGIEALAYLRQGQNIRPRLILLDLNMPRMDGRDFLAEIKSDELLREIPVVILSTSDSPRDVALCRELGAADYIVKPMYMEELNNAVRGLARFWSSAV

SEQ ID NO: 87935 - protein, 493 aa, Erythrobacter sp. NAP1
METDFDLLVVGGGINGAGIARDAAGRGLKVCLVEKDDLAQHTSSASTKLVHGGLRYLEHYEFRLVRESLIERERLLKMAPHIIWPLRFVLPHDKGLRPKWMLRLGLFLYDNLGGRKLLPPTRNVDLRQSPHADVLEERLTHGFEYSDCWVEDSRLVVLNCMDAKERGASIRTRTECIGLTRGDTQWTATLRSESGEETLTAKMVVNAAGPWVDTVLGRAIPGETHANLRLVKGSHLIFPKLYDGEHCYIFQNKDDRIIFAIPYERDFTLVGTTDVLFTGDPSDIDISADEADYICKAANEYLRTDVSPDEAVASYAGVRPLYEDKAASNSTVTRDYQFELEEDGPKLLSIFGGKLTTYRKLAEHALERIGIDGGSWTADAVLPGGEIDPIYFDRFVGDQAALFPWLDEKTVLRLARAYGTRMIDLLGDAQGINDLGEHLGGDLYASELEYLVEHEFAATAEDVLKRRSKLYLHIDDAAQAKVARWFDSRKVPA

SEQ ID NO: 87936 - protein, 193 aa, Thermus thermophilus HB27
MRVLVVDNYDSFTYNLVQYLGELGAEPIVWRNDRFRLEEVEALDPDRILISPGPCTPFEAGLSIPLIQRYAPRYPILGVCLGHQAIGAAFGGKVVPAPVLMHGKVSPIHHDGTGVFRGLTSPFPATRYHSLAVVEVPEALVVNAWAEEAGGRTVMGFRHRDYPTHGVQFHPESYLTEAGKLILKNFLEDPWTR

SEQ ID NO: 87937 - protein, 437 aa, Bacillus licheniformis ATCC 14580
MLKQLLECIETADSYKRYGKVKQAVGLMIESKGPECSIGDVCKIYTKGDGPKAIKAEVVGFKDQNILLMPYLEAANIAPGSIVEATGESLRVKVGSGLIGQVVDAFGNPLDGSVLPKGLAQVSTDQAPPNPMKRPPIREKMAVGVRSIDSLLTVGKGQRVGIFAGSGVGKSTLMGMIARETAADLNVIALVGERGREVREFIEKDLGEEGLKRTIVVVATSDQPALMRLKAAYTATAIAEYFRDKGQNVMFMMDSVTRVAMAQREIGLATGEPPTTKGYTPSVFAILPKLLERTGTTESGSITAFYTVLVDGDDMNEPIADTVRGILDGHIVLDRALANKGQFPAVNILKSISRVMSNIAEKDHIRAANRFREMLSTYQNSEDLINIGAYKKGSSREIDEAIQFHPKLISFLKQEVDEAASLEESISLLKSLTGRED

SEQ ID NO: 87938 - protein, 490 aa, Glycine max
MASPRAAENTENSLEKIKRQLASASGRNLLQGPLLKRSETLRKWNERWVILDPTTGRMEYKIRRNEPSVKGTIIFDANSTITISPVNFHGLPKYDGCCFYIGTPQKKDYFLCAETPGAARAWVSTLHATQLVLKAHKEAVNSLSGNGSTKLGTVATVVAAANSTALECSKEIEAAMQISLRNALGMMNNRTTDGPMDDLTIMKETLRVKDEELQNLSRDLRARDSTIKDIADKLSETAEAAEAAASAAYTMDEHRRIACAEIERLNNDSEKQQELFTQKLKESAEKIVSLSKEREQLIRQRDAAIQEANMWRSELAKAREHDVILEAAVVRAEEKVRVAEANAETRIREAVQRESAALKEKEELLAYVNVLKAQLQRQHIDTTQVFEKTESCSDTKHVDPTEENVDKACLSVSRAIPVPAENVVHMATDQVNIQPVGDNEWSDIQATEARIADVREVAPETDGSSLDIPVVSQPGTNHHHEQGANSFHQP

SEQ ID NO: 87939 - protein, 165 aa, Triticum aestivum
MVQRTSNAEVMSMDLSPKKPAKAYASDGGAYYDWSPADLPMLGAASIGAAKLHLSAGGLALPSYSDSAKIAYVLQGAGACGLVLPEAAKEKVIPVKEGDTLALPFGAVTWWHNAADSASAEELVVLFLGDTSKGHTPGRFTNFQLTGAAGIFTGFSTEFVARAWD

SEQ ID NO: 87940 - protein, 313 aa, Arabidopsis thaliana
MGEPKDSLALFLCHESESSLNEDDDETIERSDKQEPHFTTTIDDEDYVADLVLKENLRFETLPSKTTSSSDRLIAIDWILTTRTRFGFQHQTAYIAISYFDLFLHKRFIGKDETWAMRLLSVACLSLAAKMEERIVPGLSQYPQDHDFVFKPDVIRKTELLILSTLDWKMNLITPFHYFNYFLAKISQDNHSVSKDLVLLRSSDSLLALTKEISFTEYRQFVVAAVTTLLASSSTSSDIRLTREEIANKFGSISWWTSNENRTLEIEERKHMTPPPEIAVSREPPASGSGAKRRLSFDDSDQSSPPAKRMRRL

SEQ ID NO: 87941 - protein, 600 aa, Halobacterium sp. NRC-1
MVINLTSHAAHADVTEACLAAGRHVFSEKPLAMDAARAADLVAAAERHDLGLGCAPITPGCDAQRHARALAADGRLGGVQFAAATANVGRVDEWHDRPASFLDVGPLYDGAVYPLALLVAWFGRVTEVRTADAVAAWPPAQRDGDDAPDGLPHVEATLSFSDGPVVSLRASFYVDHRSREFYGLELHGDDGTLYLRDTGALGAPRDAVTVRGGDREPTVAPQPQPRCSRAYAAGPERLADRVAGGCGSSARASARRGAHVVAVCNAIERAATDGGPVAVPEPGVSLARPEQRRPAPVAAAPSGFQPGGRALRLPPVGFGCSRYRDGTYVTPAMGAAVDAGYRLFDTAELYGNEWRLGDLVAAPGGPDRESVFLVGKPWRTNHGPGDLREACTGSLDELGVAAFDCYALHWPGAWAHRGALTRLSERPVEEQERLTMPTAADGTPARAPHGLVETWRRMEALHDDGLARSLGVCNVTLPQLAGLTDAARVRPALVQVECHPYRPRDALVSWCHRHGVRVVAHSPLSAPGLLDEPVVHAVADEHGVSPATAVLAWHCTRGVVPIPSTTTREHVVANLAAPRHSLTDDQRDRMAGLADPTFQR

SEQ ID NO: 87942 - protein, 176 aa, Glycine max
VSSMISSPAVTTVNRAGAGMVAPFTGLKSMVGFPTRKTNNDITSIASNGGRVQCMQVWPPIGKKKLETLSYLPDLDDAQLAKDVDYLPRNGWISCLQSELDHGFVYREHNRSPGYYDGRYWTMWKLPMVGCSEALQVMNELLAVKTVYPTGFILLIVSDNVRQVLCIIFIYYNSAS

SEQ ID NO: 87943 - protein, 245 aa, Silicibacter pomeroyi DSS-3
MHDGPPVAPISSCSGERSLASSVSFSGRGEIPHRRYAGLDPASPRAAPAHVRGVSRSGERPEPTVTVRMKENARPGHASACARPFVIALGDVSKHKEITMTHTRYAFIKANWHADIVDRALEGFLELIPPEQVDVYDVPGAFEMPLLARDLAQTGRYAAVACAAFVVDGGIYRHDFVAQAVVDGLMRAGLDTGVPILSVSLTPHQYQETDHHNAIFRAHFVDKGREAARAALQITATRSKLAQAA

SEQ ID NO: 87944 - protein, 499 aa, Corynebacterium efficiens YS-314
MRLWGAGGLAEAMSTENFVSNQIFINGWVDGTSERSTTTLNPFNGEEVATIRNASQEDVDKAYATAAEVQKEWAAVPPVKKARILNKAAQVIEDNRDAIVELIRRESGSTALKANIEAGLAMASLREAATFPARITGQILPSNTPGKSNYVFREPLGVVGVISPWNFPFALSMRSVAPALACGNGVVLKPASDTPIVGGTLLAHIFEAAGLPTGLFNVVVGAGSEIGDYFVEHRIPRLISFTGSTPVGKQVGATATGGKYIKKVALELGGNAPMVVLSDADINKAVAAASMGSFLHQGQICMAVNRIIVEAPVYDQFLEGFAARVSKVAYGDQLDDATMVGPIVNDSQVESVSGKIDLAREQGARAVVSGPIEGRVIAPHVFADVTPDMELFREEIFGPVVGVVKADNEEHALELANDTEFGLSSAVFTEDLQRGINFARRVEAGMTHINDITVNDEAHVMFGGEKNSGLGRFNGEWAIDEFTTDHWVSVTTGTDAYPI

SEQ ID NO: 87945 - protein, 450 aa, Xanthomonas campestris pv. vesicatoria str. 85-10
MPHHLPSDAADALQAPTQLDAFWMPFTANRQFKSRPRLLASAQGMHYRDVHGRQILDGTAGLWCCNAGHGRERIVAAIREQAGTLDFAPTFQMGSPLPFVLAQRLAAIAPPGLGHVFFTNSGSEAVDSAMKIVLAYHRLRGEGQRTRFIGREKAYHGVGFGGMSIGGLPNNRKWFGPLLSGTDHLRHTLDLQRNAYARGLPAHGAELADDLERLITLHDASTIAAVFVEPVSGSAGVILPPEGYLQRLRAICDRHGIVLVFDEVITGFGRVGNAFAAQRFGVTPDIITAAKGLTSGTVPMGAVLVADAIFDAFMHGPQNAIELFHGYTYSGHPLACAAAIATLDTYAEEELFTRAITLGLQWEDALHGLRGSPHVIDIRNIGLIGAIELAPRDGAPGARGYEVFERCFHEGGLLVRVTGDVIALSPPLIVTPEQIGQMVETLGKMLRQVD

SEQ ID NO: 87946 - protein, 603 aa, Solanum demissum
MDAVSIRVPYKNLKQEVELTNVDESRFTQLEIRSDSSSPRASNGEMNDSHLPLPPPPVRNSLLTLILSCTVAAGVQFGWALQLSLLTPYIQTLGIEHAFSSFIWLCGPITGLVVQPCVGIWSDKCHSKYGRRRPFIFIGAVMISIAVIIIGFSADIGYLLGDTKEHCSTFKGTRSRAAIVFVVGFWMLDLANNTVQGPARALLADLSGPDQRNTANAVFCSWMAVGNILGFSAGASGGWHRWFPFLTNRACCEPCGNLKAAFLVAVVFLTLCTLVTLYFANEVPLSPKQYKRLSDSAPLLDSPQNTGFDLSQSKRELQSVNSVANNESEMGRVADNSPKNEEQRPDKDQGDSFADSPGAVLVNLLTSLRHLPPAMHSVLIVMALTWLSWFPFFLFDTDWMGREVYHGDPKGEADEVNAYNQGVREGAFGLLLNSVVLGVSSFLIEPMCKWIGSRLVWAVSNFIVFVCMACTAIISVVSISAHTEGVQHVIGATRSTQIAALVVFSLLGIPLAVTYSVPFSITAELTADAGGGQGLAIGVLNLAIVVPQMVVSLGAGPWDALFGGGNIPAFVLASLAALAAGIFAMLRLPNLSSNFKSTGFHFG

SEQ ID NO: 87947 - protein, 776 aa, Desulfococcus oleovorans Hxd3
MSDRYYRISGKNEGTRLESRVLEELIQQAVEQGRRHIEVDAFGQHGIGGRLWKAGSEAVHVRIVNQPGQRVGAMGSANTRIEIMGPASDDVGWLNGGAEILVRGHAGNGLANAMAQGKIYVAGNIGARGMTMTKHNPRFAPPEVWVLGSVGDYFGEFMAGGIAVVCGIDPQTPDNVLGYHPLVGMVGGQVLFRGPNKGYSTADAKSVPIPDDLWQWFLENLKTFLDRVARPGLFERLSERNDWQLLTARTPQERGRVEKRSMASFHSDIWDRELGAGGLIGDLTAIDRSPIPLVTTGDLRRFVPVWENRVYKAPCEGACPTGIPVQQRWAMIRDGRVDEAVDMALMYTPFPATVCGYLCPNICMQGCTRNNQAMVPIDVTQLGRASINAKAPVLPEKNGKKVAVIGGGPAGISVAWQLLQNGHEAVVYDTSDTLGGKIAAVIPETRIPREVLSAELDRIRKVIPHVRLETALDRKKTEQVKAEYDAVVVATGAWKPRTLPVPGKERMIAALDFLARAKSGGIVPGKRIVIIGAGNVGCDVATEAHRLGAETITLIDVQKPASFGKEREEAEAAGALFRWPAFTQEITDRGVVLDSGELLPADTVVISIGDAPDTSFLPASVETERGFVKVNDFFQTSDPAVFAVGDIVRPGLLTDAIGAGRKAAAAITDLLSGEEHRPDMRTVIDKKRVSLEYFDPRLTGFDGMDQCGAQCASCGNCRDCGICVTACPQSAISRAEKPDSGFAYEVDETLCIGCGFCAGACPCGVWGLVPNTELSA

SEQ ID NO: 87948 - protein, 526 aa, Burkholderia sp. 383
MTRTLHPVPAPDLPRILPVILAGGSGTRLWPLSREQYPKQLIELTSNESPLSATARRLNGIANAVLGDKLLLVCGEQHRIMSAAQVVDRAAPARILLEPAARNTAPALTLAALDASELEDDPVLAVMPADHVIADVGAFQDTIARAARYAQEGAIVTLGVLPRRAETGYGYIRVGEPRTSRHGGQGGYSIGRFVEKPDAALAERYLQSGDYWWNSGIFVTRASVWLKAIRALAPEIHAACESAWRAGVADDPFFRIDAAAFDACPSDSIDYAVMERLADSSELGIEGIVVPLSAGWSDVGTWDAIWEIMPKDDHGNVARGPIVFEDTQDSLVRSEGRLIACVGMKDVVVIETPDAVLVANKHDVQRVKNIVERLKSDRRPQASEHRKVQRPWGHYDSIDLGERFQVKRIVVEPGKRLSLQMHYHRAEHWIVVRGTAKVTRGNETFLLSENESTYIAVGEVHRLENPGRIPLEIIEVQSGNYLGEDDIVRFDDQYGRPVVDPLPEQHAVPLAAPEPHVQVVEGDVVR

SEQ ID NO: 87949 - protein, 207 aa, Glycine max
  misc_feature (81)..(81): Xaa can be any naturally occurring amino acid
  misc_feature (116)..(116): Xaa can be any naturally occurring amino acid
  misc_feature (135)..(135): Xaa can be any naturally occurring amino acid
QESAYNETSFAGEPCEFYHCVLESKSFLEKMTVLEHTVPFFLPIREIENDLHSSNAMKLIDHVGDLLQAFVDRREQVDCPXRLIKELYGNQIRELYHSLPYHMVEFVLDDSDCKRXTRVKLGVLQLSVLQESTCXCKVTVSLRYADLISVLPTRISVLAWPMFNKNTMSRKEDGLSGSHSSPIRLTYAEDALRTMSLPEAYAEIVLN

SEQ ID NO: 87950 - protein, 506 aa, Saccharomyces cerevisiae YJM789
MPTLYTDIEIPQLKISLKQPLGLFINNEFCPSSDGKTIETVNPATGEPITSFQAANEKDVDKAVKAARAAFDNVWSKTSSEQRGIYLSNLLKLIEEEQDTLAALETLDSGKPFHSNAKQDLAQIIELTRYYAGAVDKFNMGETIPLTFNKFAYTLKVPFGVVAQIVPWNYPLAMACRKMQGALAAGNTVIIKPAENTSLSLLYFATLIKKAGFPPGVVNVIPGYGSVVGKALGTHMDIDKISFTGSTKVGGSVLEASGQSNLKDITLECGGKSPALVFEDADLDKAIEWVANGIFFNSGQICTANSRVYVQSSIYDKFVEKFKETAKKEWDVAGKFDPFDEKCIVGPVISSTQYDRIKSYIERGKKEEKLDMFQTSEFPVSGAKGYFIPPTIFTDVPETSKLLRDEIFGPVVVVSKFTNYDDALKLANDTCYGLASAVFTKDVKKAHMFARDIKAGTVWINQTNQEEAKVPFGGFKMSGIGRESGDTGVDNYLQIKSVHVDLSLDK

SEQ ID NO: 87951 - protein, 506 aa, Saccharomyces cerevisiae YJM789
MPTLYTDIEIPQLKISLKQPLGLFINNEFCPSSDGKTIETVNPATGEPITSFQAANEKDVDKAVKAARAAFDNVWSKTSSEQRGIYLSNLLKLIEEEQDTLAALETLDAGKPYHSNAKGDLAQILQLTRYFAGSADKFDKGATIPLTFNKFAYTLKVPFGVVAQIVPWNYPLAMACWKLQGALAAGNTVIIKPAENTSLSLLYFATLIKKAGFPPGVVNIVPGYGSLVGQALASHMDIDKISFTGSTKVGGFVLEASGQSNLKDVTLECGGKSPALVFEDADLDKAIDWIAAGIFYNSGQNCTANSRVYVQSSIYDKFVEKFKETAKKEWDVAGKFDPFDEKCIVGPVISSTQYDRIKSYIERGKKEEKLDMFQTSEFPIGGAKGYFIPPTIFTDVPQTSKLLQDEIFGPVVVVSKFTNYDDALKLANDTCYGLASAVFTRDVKKAHMFARDIKAGTVWINSSNDEDVTVPFGGFKMSGIGRELGQSGVDTYLQTKAVHINLSLDN

SEQ ID NO: 87952 - protein, 498 aa, Populus trichocarpa
MPRKMPIDGEVNQASQVEEDAHFDFDLFVIGAGSGGVRAARFSANYGAKVGICELPFHPISSEVNGGVGGTCVLRGCVPKKILVYGANFGGEIEDARNYGWEINEKVDFNWKKLLQKKSDEIVRLNGIYKRLLSNAGVKLYEGEGKVAGPNEVELTQLDGTKLKYSAKHILIATGSKAQRPNIPGQELGITSDEALSLEDLPKRAVVLGGGYIAVEFASIWRGMGATVDLFLRRELPLRGFDDEMRAVVARNLEGRGINLHPRTNLTELTKTEDGIKVRTDHGEELLADVVLFATGRAPNTKRLNLEAAGVELDKTGAVKVDEFSRTNIPSIWAAGDVTNRMNLTPVALMEGSCFAKTVFAGQPTKPDYNHIPYAVFSIPPLSVVGLSEEQALDQANGDVLVFTSTFNPMKNTISGRQEKTVMKLVVDAETDKVLGASMCGPDAPEIMQGIAVALKCGATKQQFDSTVGIHPSAAEEFVTMRSVARRVTASGKPKTNL

SEQ ID NO: 87953 - protein, 1318 aa, Arabidopsis thaliana
MNPEEQKMESASDLGKLFIGGISWDTDEERLQEYFGKYGDLVEAVIMRDRTTGRARGFGFIVFADPSVAERVIMDKHIIDGRTVEAKKAVPRDDQQVLKRHASPMHLISPSHGGNGGGARTKKIFVGGLPSSITEAEFKNYFDQFGTIADVVVMYDHNTQRPRGFGFITFDSEESVDMVLHKTFHELNGKMVEVKRAVPKELSSTTPNRSPLIGYGNNYGVVPNRSSANSYFNSFPPGYNNNNLGSAGRFSPIGSGRNAFSSFGLGLNQELNLNSNFDGNTLGYSRIPGNQYFNSASPNRYNSPIGYNRGDSAYNPSNRDLWGNRSDSSGPGWNLGVSVGNNRGNWGLSSVVSDNNGYGRSYGAGSGLSGLSFAGNTNGFDGSIGELYRGSSAQTHQPMPQKDTPETTMSEIDKHIEVLKHRKKSTKRSENCRSRRTAISVAEFEELLFRYQVEKETNFLHHKKKVQKSQRSNRNSDSSKSRSPSPSLLQNIIRSLLLSHPHSHSHSHCLKTMKSPAILSENRFLGSITSSSIRNLLPKSISGKQKPIIQNPDTKIPRSNDENAIPVDPNQKASDHHTALQFTKQSDSKDGNFGEPIKDNKMGQSTFAEDKRSLLDSPLKVESRSILSRRTNSVPSEIKEEDDDDSLGDQIRELKEELIRTKSDGYNKADASKSGHFARDSLSQLRVSINKSLLMSCPKRDESEGKEVIVDGEDVLELNKHIEKLHGSYDSVHSSFASASCYEADSMSGDDEDVCSEDLEKPMHGNHKDVDFVDNDPSQLDNVEFDTTGSGISIRSQLPSCVLEEPIFSESPKFKNVQKSVAASTKFSANPRNVSESSNIGDMKVNQISPCMSKKVSGPTDSLAASLQRGLQIIDYHQGSSLSKSSSVSFSFGHMALKPCAEGENLNASVQSFRKDKASEGGLSSILLCLSCRKKVDQEAEVTEEAGSNEKHLKNMCMEQAAKIEELTLLLRKSDDGEDGTEFIKETYETKQISEEFGKTNFEVSEKEALLKEIADLKSKLQPTKSTDNLRSSLLLRSIQMRKSIDVSRNGENSDDLAKEREMWTEMESEWISLTDDLRMDIDNHRSRAENLEFELKQEKLATEELNDALTRAVLGHSRFIEQYTELQETYNELGEKHSVMMAGITDVKKAASKAAMNGRHGKRFAKAFSDELSAIRAEKEKERELLKKENKNLRTQLRDTAEAVQAAGELLVRLRESEQALQVSEERFSVVEEEKERLKKQMEQLKSKHKTEIGTMKQYLAESKLPGSALLQPWYKDEEDEIEQVSEHETGAVSFDDYEDDQAWRAEFGATYQDHHY

SEQ ID NO: 87954 - protein, 505 aa, Mesorhizobium loti MAFF303099
MNKVEFSRPVKAPFDKRYGNFIGGKWTEPRSGRYFENHSPVNGQLLCEVARSDADDIEAALDAAHAAKDAWGRTSVAERSLILNRIADRMEENLDLLACAETWDNGKPIRETTVADLPLAIDHFRYFASAVRGQEGSLSQIDDDTVAYHFHEPLGVVGQIIPWNFPLLMACWKLAPALAAGNCVVLKPAEQTPAAILLWADLIGDLLPPGVLNIVNGFGLEAGKPLASSPRIAKIAFTGETTTGRLIMQYASQNLIPVTLELGGKSPNIFFKDVVAEDDDFFDKAIEGFVMFALNQGEVCTCPSRALIHESIYDRFMERALKRVEAIVQGDPLDPATMIGAQASSEQLEKILSYIDIGRQEGAEVLTGGARNVLPGDLAGGYYVKPTVFRGHNKMRIFQEEIFGPVVSVTTFKDDDEALSIANDTLYGLGAGVWTRDGNRAYRFGRAIQAGRVWTNCYHAYPAHAAFGGYKQSGIGRETHKMMLDHYQQTKNMLVSYSPKKLGFF

SEQ ID NO: 87955 - protein, 223 aa, Moorella thermoacetica ATCC 39073
MPIIAPSLLAADFANLQGEVEAVARGGADWLHLDIMDGHFVPNLTIGPAVVAALRPHSQLVFDVHLMLSRPEDFILPFARAGADYISVHAEACTHLHRVLQQIREAGCRPAVALNPATPLSVLDHVLGEVEMILLMTVNPGFGGQEFIPAMLPKIASLAAKLRENRLDILLEVDGGINPETAAAACQAGAGVLVAGSAVFGCPDRGAAIRELRQAGKLNRVQI

SEQ ID NO: 87956 - protein, 486 aa, Triticum aestivum
  misc_feature (161)..(161): Xaa can be any naturally occurring amino acid
MVCGESMPLERKKVCVIGAGMAGLASARELRREGHDVTVLEQNADVGGQWLYDPRGDGADDPLDAAGPVKVHGSLYASLRVISARENMGFTDFHFAPKDGRDGRRCPGHREVQLYLKDFCDAFGLMEAVRLNTRVLRVAMAVAPTRQWAVRSVHEGTEEEXEEVFDAVVVANGHYSQPRLPSIQGMEAWRGRQMHSHPYRLPEPFRGDMVVVVVGCGASDKDIAMEVRGVAKEVHLVAKSMEEVTPGLAKVLAKHSANLHLQLHVERLCEDGRVVFGGGGSGVLADTIIYCTGYNYSFPFLDTAGAVTVEDNRVGPLFEHVFPPSLAPSLSFVGIPIKVFAPWFFEAQAKWVAQVLSGRRTLPPEQEMMRSVEEYYRAREIAGVPKKYIHDVCLSETMPTYMDEFGSKYCDFPRVERWHHELVVSLFANMNDNLETFRDDYHDSDSIRKGVEEWHLSAQQTQAAPAAKKMSLGLSRTSTVVCAHPS

SEQ ID NO: 87957 - protein, 778 aa, Oryza sativa Japonica Group
MPHRRRLLNPAPSLPPPPAAAPAGFHHHLLAVDDTRLPLLADYALLQGDAAAAPASAEWSAGSGFTGISTDPATATTATTASTATAPGSASNLTAATAGGGGRETWVRRAREGYYLQLSLAIRLTSEAFLAGVPPELLIGCGGGGEAENHADVAADAAAVSYRLWVNGCLSWGDKIAHGFYNILGVDPHVWAMCNAAAEDGRRLPTLVALRAVDSGESSVLEVVLVDKCGDPALADLERRALDLYRAAGVSLDLVRHLAVLVSDHMGGALRSEDGDLFMRWKAVSKQLRKRHRCVVVPIGSLSIGFCRHRAILFKSLADFIGLPCRIAQGCKYCSAPHRSSCLVKIDNERRFVREYVVDLVVEPGRLSSPDSSINGQLLSSVPSPFKTSCTMSSANYATPAASWNRAISGDRRNSILSNPQYSVAKYCVAEEKSSVQVATKEAMLPKCGQITQNGNCNKNSMAVFEVSKQMKAMEISSESGDKDNISSATPLKRLSIEPSFCADWLEISWDEIELKERVGAGSFGTVYRADWHGSDVAVKVLTDQDVGEAQLKEFLREIAIMKRVRHPNVVLFMGAVTKCPHLSIVTEYLPRGSLFRLINKASAGEMLDLRRRLRMALDVAKGINYLHCLNPPIVHWDLKTPNMLVDKNWSVKVGDFGLSRFKANTFISSKSVAGTPEWMAPEFLRGEPSNEKCDVYSFGVILWELMTMQQPWNGLSPAQVVGAVAFQNRRLPIPQETVPELAALVESCWDDDPRQRPSFSSIVDTLKKLLKSMLGGS

SEQ ID NO: 87958 - protein, 403 aa, Moorella thermoacetica ATCC 39073
MNEGISFNTIEEAIAEIKAGRMVVVVDDEDRENEGDLVMAAARVTPEAINFMATHGRGLICVPMEGQRLDELELEPMVNQNTESMGTAFTVSVDAAEVTTGISAFERAATIKRLIDPSTRPEDLRRPGHIFPLRAKPDGVLRRAGHTEAAVDLARLAGLYPAGVICEIMNPDGTMARVPQLYKFCQEHGLKLITVADLIEFRRRREKLVRRVAEADLPTRYGHFKAVAYEEIMNGKGHLALVKGDIAKGRPVLVRVHSECLTGDVFGSERCDCGDQLQRAMKMIEDEGAGVILYMRQEGRGIGLLNKIKAYKLQEEGKDTVEANEALGFPPDLRDYGIGAQILADLGVRQIRLLTNNPKKIAGLEGYGLQVVERVPIEICPNKVNRRYLKTKKEKMGHLLHIS

SEQ ID NO: 87959 - protein, 155 aa, Moorella thermoacetica ATCC 39073
MPNIMEGQLEGRGLKFGIVVSRFNEFITSRLLDGALDALNRHGADPGAIDIAWVPGAFEIPLTAQKMAARGYDAVICLGAVIRGATPHFEYVAAEVTKGIAQVSLNSGVPVIYGLITADNIEQAIERAGTKAGNKGFDAAMTAMEMANLFKVMAR

SEQ ID NO: 87960 - protein, 492 aa, Physcomitrella patens subsp. patens
MEEDLEVGGRGAVRGAAELPRLVTEVREAYRNGRTRPAAWRVQQLNGIIRMISERESEIVQTLYTDLGKPSHESYVTEVSLVRSACKLAIKELKKWMAPLKVSGSITTFPSWGAIVAEPLGVALVISAWNFPFLLSVEPLVGAISAGCAMVLKPSEVAPATAALLSKLVPLYLDSSVIRVVEGGVDETTVLLDQQWDKIFYTGSPRVGRIVMAAASKHLTPVTLELGGKCPVYIDRTADLKVGLRRIALGKWGCNNGQACIAPDYLLIDEIIASEVVDTLIDVIETFYGKDPKTSQDLSRIVNTKHYSRLAGFLDDPKISSKIVHGGARDDNKLYISPTLVCDVPMDSTLMSEEIFGPILPIIKVKGVQEAIDIISDRPKPLVAYVFTKNKEVEKRIVASISSGGMVVNDTIVHFLNPGLPFGGVGESGMSSYHGKFSFDAFSHKKAVLYRNNLGDVPARFPPFTTMKQNFRRAIMDGHYLSAVISLTGLKK

SEQ ID NO: 87961 - protein, 267 aa, Pseudomonas putida KT2440
MSVPSFGLGTFRLTGQTVIDSVKSALAVGYRVIDTAQIYKNEAEVGQAIAESGVPRSELFITTKIWVDNYAADKLIPSLRDSLQKLRTDYVDLLLIHWPAPGNGVELPEYMKALADAKQQGLARQIGVSNFNIELTRQAIAVVGKGEIATNQIELSPYLQNSKLTAFLKEQGITVTSYMTLAYGKVLKDPVLAQIAAKHKATVAQVALAWALQLGYAVIPSSTKRENLASNLLARGLTLDTDDMARIAKLERNGREVSPDGLAPTWD

SEQ ID NO: 87962 - protein, 269 aa, Escherichia coli
MGFKCGIVGLPNVGKSTLFNALTKAGIEAANFPFCTIEPNTGVVPMPDPRLDQLAEIVKPQRTLPTTMEFVDIAGLVKGASKGEGLGNQFLTNIRETEAIGHVVRCFENDNIIHVSGKVNPADDIEVINTELALADLDTCERAIHRVQKKAKGGDKDAKAELAVLEKCLPQLENAGMLRALDLSAEEKAAIRYLSFLTLKPTMYIANVNEDGFENNPYLDQVREIAAKEGSVVVPVCAAVEADIAELDDEERDEFMQELGLEEPGLNRV

SEQ ID NO: 87963 - protein, 602 aa, Mannheimia haemolytica
MTTESLTFADLGLPQPILDAVNEMGFVNPSPIQQECIPHLLAGRDVLGMAQTGSGKTAAFSLPLLAQIDPTQRHPQMLVMAPTRELAIQVADACEQFAKNMKGIRVVTVYGGQRYDIQLRALKQGSQVVVGTPGRILDHIRRGTLDLSELKFIVLDEADEMLRMGFIDDVETVMAELPETHQTALFSATMPEPIRRITRRFMKDPQEVKIKATERSAPDIEQSYWLVNGFRKNDALLRFLEVEEFDAAIIFTRTKTGTIDITELCERNGYRTAALNGDMTQQAREQTLDKLRSGRLDILVATDVAARGIDIERISLVINYDIPLEEESYVHRIGRTGRAGRSGRALLFVEPRERRLLRNIENLIKKPINEVAIPNHEILMEKRREKFKARISKQLEHHDLEKYRELLEDLFTADQDHEELAAAMMMLLQEKQKLILPPDPVVRAARSERGRDRNERNDRRNGREHRENNGVAMDLYRIELGREDGVEVRHIVGAIANEGDISSRYIGHIKLYDKYSTIELPQGMPNHLVQHFAHKARVLSKPMQMTLLGSANSASNANPFEGRGRRGNDRNDRGGRRDGGFNKDRKGGFKEKRFSEKRGRRD

SEQ ID NO: 87964 - protein, 873 aa, Xanthomonas campestris pv. vesicatoria str. 85-10
MLTRKHYSVFVHRTLTWIVGTFPLYFPARPHPEPALSSPSPAPVTPDLVCLRASARDKDDAIAQAAQLLVAAGCVAPGYDASMRRREGLANTFLGHGLAIPHGVGEDRHLVRRDGIAVLQLTDGVEWNPGQITRLVVGIAAQSDTHITLLRRLTRLIQDPAQLETLFSTDDPGVIVAALTGDRAPETNAAPATDLAETFEWTIAYPSGLHARPATRWAETARGFSARAQVRAGDQAADAKSLVGLLQLGLRAGDSITVSAEGSDAAELLRRLRAVMDSLTAQEKADAERAAQRRAAPVAGWTPPQAQPAIVGIGASPGVAIGIVHRLRAAQTEVADQPVGLGDGGALLHDALTRTRQQLAAIQDDTQRRLGASDAAIFKAQAELLNDTDLITRTCQLMVEGHGVAWSWHQAVEQIASGLAALGNPVLAGRAADLRDVGRRVLAQLDPAAAGAGLTDLPEQPCILLAGDLSPSDTANLDTARVLGLATAQGGPTSHTAILSRTLGLPALVAAGGQLLEIEDGVTAIIDGSSGRLYIDPSEQDLDAARTHIAEQQAIREREAAQRALPAETTDGHHIDIGANVNLPDQVAMALTQGAEGVGLMRTEFLFLESGRTPSEDEQHATYLAMAQALDGRPLIVRALDIGGDKQVAHLELPHEENPFLGVRGARLLLRRPDLLEPQLRALYRAAKDGARLSIMFPMITSVPELVALRAICARLRADLDAPEVPIGIMIEVPAAAAQADVLARHADFFSIGTNDLTQYVLAIDRQNPELAAEADSLHPAVLRMIRSTIDGARKHDRWVGVCGGLAGDAFGASLLAGLGVQELSMTPNDIPAVKARLRGAALSQLQHLAEQALACETAEQVRALEAKREDKA

SEQ ID NO: 87965 - protein, 308 aa, Populus trichocarpa
MGFMEYVKSIEWEHESYPGYEDCIVLPLFALFFPFVRFFLDRFVFQKVAQDLIFGKEHQTLDVRSDERRKKIRKFKESAWKCIYFLSSEILVLCVTYDEPWLVNTKYFWVGPGSQAWPDQKMKLKLKAVYMYAAGFYTYSIFALIFWETRRSDFGVSMSHHVATVILIVLSYILRFGRVGSVVLAIHDASDVFLEVGKMSKYSGAEGVASFAFILFVLSWILLRLIYYPFWVLWSTSYEVLLILDKEKHPVDGPIYYYVFNTLLYCLLFLHVYWWVLIYQMLAKQIQARGHLSDDVRSDSEGEDEHED

SEQ ID NO: 87966 - protein, 501 aa, Pichia pastoris
MSDNNQPLPPVSNSILEHIGKTPLVKLNRIPKILNLKPQVYAKVELFNSGGSIKDRIALRMVEQAEKEGRIKPGYTLIEPTSGNTGIGLALVGAVKGYRTIITLPEKMSNEKVAVLKALGAEIIRTPTEAAWDSPESHIGVARRLEKEIPNAVILDQYGNVNNPDAHFYTTGAEIWDQTNGKVTHGVAGAGTGGTITGIAKFLKSKNPNIQIIGADPHGSILALPESLNTSNEQYKVEGIGYDFIPEVLDREIVDTWYKTDDKDFFKLARQLISEEGILVGGSSGSALSAAVKIINDAKLDESAVVVVVCPDSIRSYLTKFADDDWMKLNGFTEDEPAPLKRKSSFSKDTLSSYTIKDLALKPVVSVTIDDSIESTINILQTKGFDQLPVLKNDKLAGIVTLSQLLRLLSNKKIHLTSKVESAYFDFSKLENFEKSYNINKESTNKRREYQKITTSTTLAKLNKFFETSSAAIVENDKGQPIHIVSKVDLLSFLASKGEFN

SEQ ID NO: 87967 - protein, 234 aa, Triticum aestivum
MGETEEVKLLGVWFSPYAIRPKIALRLKSVDYDYVEEDLFGSKSELLLKSNPVHKKVPVLIHNNKPILESLNIVEYIDETWNASDPSILPSHPHDRAQARFWSAFVDDKWFPALKAAAITKSEEAKEKGMKEVEGGLLQLEEAFVSISKGNPFFGGEAIGFMDICLGSFVGILKAREKLKGEKLLDESKIPFLCKWANEFLSDDTVKNVVPEIDKVVEFLGELEVRAQSAVSKT

SEQ ID NO: 87968 - protein, 631 aa, Solanum tuberosum
MEGVLQTRGLLSLPSKPKIKAFYPLPQGGLRNRFNSLSSLKPNPLNGVSLSSNGFQKVQGFDTKPQLFGQKKRCFPICKAEAAAAAGAADGQPLFVEKEQPKFMGIELVTLKKIIPLGAMFFCILFNYTILRDTKDVLVVTAKGSSAEIIPFLKTWVNLPMAIGFMLLYTKLANVLSKEALFYTVILPFIAFFGAFGFVLYPLSNYFHPTAFADKLLNTLGPRFLGPIAILRIWSFCLFYVMAELWGSVVVSVLFWGFANQITTVDEAKRFYPLFGLGANVALIFSGRTVKYFSSLRSSLGPGVDGWAISLKGMMSIVVMMGGAICFFYWWVNRNVALPTRSKKKKVKPNMTTMESLKFLVSSKYIRDLATLVVAYGISINLVEVTWKSKLKAQFPSPNEYSSFMGDFSTATGIATFTMMLLSQWIFDKYGWGAAAKITPTVLLLTGVGFFSLLLFGAPLAPTLAKFGMTPLLAAVYVGAMQNIFSKSAKYSLFDPCKEMAYIPLDEDTKVKGKAAIDVVCNPLGKSGGALIQQFMILTFGSLASSTPYLGGVLLVIVLAWLGAAKSLDGQFTQLRQEEDLEKEMERASLKIPVVSQNENGNGPLSSESSLNPAGGDSTNASSEPSSPRSL

SEQ ID NO: 87969 - protein, 128 aa, Zea mays
  misc_feature (49)..(49): Xaa can be any naturally occurring amino acid
  misc_feature (71)..(71): Xaa can be any naturally occurring amino acid
  misc_feature (93)..(93): Xaa can be any naturally occurring amino acid
WKTGADHRRPPHASVDFKAGCLPAKLGLEPGALGVVKGAKRRKIHALKXKSRFGQLEFAQNKGQIAWQQFXPKGKAKKGGFFSGGRRGSILRXPADHRGRGVVTGGGKGLADFQRGGKLWYLKGGSGD

SEQ ID NO: 87970 - protein, 88 aa, Glycine max
  misc_feature (34)..(34): Xaa can be any naturally occurring amino acid
RAFAEKHYADLSAKPFFSGLVDYIVSGPVVAMIXEGKNVVTTGQKIIKATNPSQSRPTTIHNNFAINIKKNVIHKTNSFKSANKEIAL

SEQ ID NO: 87971 - protein, 183 aa, Physcomitrella patens subsp. patens
MCRQLQSRNQKHRRRGESVRAVSVGQSRAGPSGKGEGDGESWKPLSPSSAEETGAGGAGGGAAAAVAEGGVTGAASGACMMTMARCALVVLFLGCLVLEAQAQAPFAAVAPSPFTGFPPQEAPAFAGSGGPVLYITYGALRANRSPCPAGAGRSYYTPNCGAASGPPNPYSRGCSYITRCARV

SEQ ID NO: 87972 - protein, 188 aa, Arabidopsis thaliana
MFFGEGAGDVIIENKNYTLLQMHWHTPSEHHLHGVQYAAELHMVHQAKDGSFAVVASLFKIGTEEPFLSQMKEKLVKLKEERLKGNHTAQVEVGRIDTRHIERKTRKYYRYIGSLTTPPCSENVSWTILGKVRSMSKEQVELLRSPLDTSFKNNSRPCQPLNGRRVEMFHDHERVDKKETGNKKKKPN

SEQ ID NO: 87973 - protein, 304 aa, Rhizobium leguminosarum bv. viciae 3841
MDANRDTFETRLKNNARDIEALLDALLSPSAFSDEIARPETLRDAMHYAVLNGGKRLRPFLVVESAALLGGDAEAALRVGAALECVHCYSLVHDDLPAMDDDDLRRGKPTVHIKFDEATAILAGDSLLTYAFDIIAAPETTLADTSKASLVLALARAAGLGGMAGGQALDLAAEKQAPDEAGIIRLQAMKTGALIRFACEAGAVISGSLAEDRRRLRAFGEKIGLAFQLADDILDLTSDAATMGKATGKDAARGKGTLVALRGMEWAETQLREHVRDAEALLAPYGARASILIAAAHFIADRKS

SEQ ID NO: 87974 - protein, 173 aa, Physcomitrella patens subsp. patens
MASTNPRVFFDIVIGGTPTGRIIIELYKDTCPKTAENFRCLCTGEKGAGESGRNLHFKGSAFHRVIPEFMCQGGDFTKGNGTGGESIYGTKFPDENFVRRHGVPGTLSMANAGPNSNGSQFFITTVPAPWLDGKHVVFGVVVEGFNVVKAIEAVGSSDGKTRKAVIISNCGRL

SEQ ID NO: 87975 - protein, 435 aa, Azoarcus sp. BH72
MEHEQALWLPFTANRAFWKQPRVISGARGHYYTTADGRELLDGFSGLWSCGLGHAHPGIVAAVQQQVATLDFSMTFQATNDKAIALAREVASMAPPGLHKVFFTNSGSESVDTALKIALAYHRARGDGHRTRLIGRERGYHGVNLGGTSVGGIAVNRKAFGAVLTPGVDHIRHTLSLPDMAFSRGQPSWGAHLADDLERLAALHDPSTIAAVIVEPVAGSTGILVPPVGYLERLRAICDQHGFLLIFDEVINAFGRLGAPFAATRFGVTPDLITTAKGLTNGVVPMGAVIVRQDIYDALMQGPEHAVEFFHGYTYSGHPLAAAAGLAALRAYREEDSFARVRALEPVFEDGLHSLRDEPNVVDIRNFGLMGGVELAPRDGVLGVRGFEVFLKCFEAGVVIRNGGDILQFAPFFDSTEDELARIFETVRAALRATA

SEQ ID NO: 87976 - protein, 351 aa, Oryza sativa Japonica Group
MEERAWLVGRRSCLCFDDKSENAWKSRVGVLYVMHPITFFTNIIGVVTIVLISIVSILGLICLCHSLNFQLLIKRRRRNYYQANDEQLSYFNGPWLTRITLILVALWWGVGEVLRLTFVNGEGRFISDQTWQANVCKFYIVSNLGFAEPGLFLLLAFLLSAALQNQEVGALNRKWNQRTICAVFMLCSPSLIWEACVVFIGPHIASNDGQTSKVAKYWYSASSVHDGDVACTYPLLSSIFLGTFYTVLTLYVIFVGGQILSLVINKGLRRRIYMLIFATGILLPRAMFLGFSVLPWPGEIVHESLVFVSFLVLMIAAMLGIVILVYFPVAETFEVRNQEHIELQTSHSIAL

SEQ ID NO: 87977 - protein, 195 aa, Zea mays
HASADAWASSKKKSGARPSGEGKKSRLVELEEARGPRRAEGGEARKGNTQQQQEKAKAKRLVKWKCASGCGACCKLDKGPDFPIPDEIFADHPDDLQLYRSMIGSDGWCINYDKATRTCNIYQDRPSFCRVEPKIFDELFGVPRSRFDREACSACVDTIKMVYGDDSAELSNFKRVIREESNKLESKNQDKLLDA

SEQ ID NO: 87978 - protein, 478 aa, Lactobacillus plantarum WCFS1
MSNEKPQIGVIGMAVMGKNLALNIESRGYKVAIFNRTGAKTEKVVKDHADKQLVPSYKIEDFVASLETPRRIIMMVKAGKPTDAVIDELLPLLDKGDVLIDGGNTNFNDTMARNARLDKSGINFIGMGVSGGELGALQGPSLMPGGQKEAYDLVAPILEKISAKAPQDGAPCVTYIGPNGAGHYVKMVHNGIEYGDEELIDESYNIMRNVAGLSVDEMSDIFTDWNKGELSSYLIEITADILSRKDDLGADKTKPIVDMILDRGNNKGTGKWSSEDALNVQVPQSVITEAVYARYISMMKNERVAASKKLAGPTADVDLPAKEELVEKIRQALYFSKIMSYAQGFEQLRFASEHYGWDLKFGELAQIWRAGCIIRAQFLQNITDAFDKKPDLNNLLMDDYFADIAAKYQQSTREVLSLAIQAGVPVPSFSAALSYYDSYRAEVLPANLLQAQRDYFGAHTYERTDREGLYHYSWYEEQ

SEQ ID NO: 87979 - protein, 142 aa, Salinibacter ruber DSM 13855
MSESVPDTKPEASSSTDYTTTGTVRLVNAVFYGHHGVMEEEHRIGGRYEVDVSVGLDFEDAALHDDLDRTVNYEQVYEFVRQLVTENNFYLIEKLAYRIAHKVLDTYPDLEGVEVTVRKPDPPVGGTCDRAEATYTIDDPGT

SEQ ID NO: 87980 - protein, 404 aa, Xenorhabdus nematophila
MKLPIYLDYSATTPVDPRVAEKMMNYLTMDGIFGNPASRSHRFGWQAEEAVDIARNQIADLVGADPREIVFTSGATESDNLAIKGAAKFYQKKGKHIITSKTEHKAVLDTCRQLEREGFEITYLAPMNNGMIDLKELEAIMREDTILVSIMHVNNEIGIVQDIVTIGEMCRSRGIVFHVDATQSVGKLPIDLSKMKVDLMSFSAHKLYGPMGIGALYVRRKPRIRIEAQQHGGGHERGMRSGTLPVHQIVGMGEAYRIAKEELESEAERLHGLRLRLWHGIKDIEEVYLNGDLEVGAPHILNVSFNYVEGESLMMSLKDLAVSSGSACTSASLEPSYVLRALGMNDELAHSSIRFSLGRFTTAEEIDYAIKLIHNAIGHLRDLSPLWEMFKQGVDISTIEWSHH

SEQ ID NO: 87981 - protein, 128 aa, Xenorhabdus nematophila
MAYSDKVIDHYENPRNVGSFDSEDPSVGSGMVGAPACGDVMRLQIKVNNEGIIEDARFKTYGCGSAIASSSLVTEWMKGKSLEQAEAIKNTQIADELELPPVKIHCSILAEDAIKAAIADYKSKRQAK

SEQ ID NO: 87982 - protein, 371 aa, Legionella pneumophila subsp. pneumophila str. Philadelphia 1
MSFSTSTNLTPIEMQDDGLEKIQSQNNPCAINEVKTNTFVINLQQAIFGLETGSEAVDFVSHKDTGFPFPAGEYKPRHFLTGTELAREEIQFILSQARSLKQNPGLYNQALANKSLVMIFEKPSFRTRLSFALAIQSMGGIVVESIANSRKQETPADMARVLNGYADFVMVRTHEDSFLQEMAEYSKIPIINGLSALHHPCQILADLLSLEEQFGALKGLTLTYIGDGNNILHSLMLLAPQLGVTVHYCCPKSNQPNEAIVKEAQSKAGKQMIYYFDKPEEAVKQADAVYTDVWTSMGFDNPEAGKIFKGFQVNETLMSHAKPDSVFMHCMPMERGKEVSATLPDSASSIIFTQSENRMHVQKALMLFLDQ

SEQ ID NO: 87983 - protein, 268 aa, Erythrobacter sp. SD-21
MMADENKTENAEAQTEEKVATAETEHAVTKEEPAIADTPSEAAANQDPAQGAEGQPRERGGRGGRGGNRDGGGRGRGGRDNRRNNRREEEDDGIIEKLVHINRVSKTVKGGKRFGFAALVVVGDGSGRVGFGKGKAREVPEAIQKASAAARKKMIRVPLKEGRTLHHDGNGRFGAGKVTVRTAPPGTGIIAGGPMRAVFESLGVADVVTKSVGTSNPYNMIRATFDALTDQTSPKSVAQRRGKKVADLLGRGGASEAEAEADAAAVVE

SEQ ID NO: 87984 - protein, 308 aa, Streptococcus thermophilus CNRZ1066
MDLTFGVTVIRKWKRDIENSGHEAIGIVEEVGEQVTTVKPGDFVIAPFTHGCGQCDACRAGFDGSCDNHSGNNWSEGVQAEYIRFHFANWALVKILGQPSDYSEGMLKSLLTLADVMPTGYHAARVANVQKGDKVVVIGDGAVGQCAVIASKMRGASQIVLMSRHEDRQKMALESGATAVVAERGEKGIDKVREVLGGGADAALECVGTEAAVEQALGVLHNGGRMGFVGVPHYNNRSLGSTFAQNILVAGGVASVTTYDKQVLLKAVLDGDINPGRVFTTSYKLEDINQAYKDMDERKSIKSMIVLD

SEQ ID NO: 87985 - protein, 524 aa, Coxiella burnetii RSA 493
MLKDIHQHRILILDFGSQYAQLIARRVREIGVYCELMPCDIDEETIRDFNPHGIILSGGPETVTLSHTLRAPAFIFEIGCPVLGICYGMQTMAYQLGGKVNRTAKAEFGHAQLRVLNPAFLFDGIEDQVSPQGEPLLDVWMSHGDIVSELPPGFEATACTDNSPLAAMADFKRRFFGLQFHPEVTHTPQGHRILAHFVIHICQCIPNWTTKHIIEDSIRDIQEKVGKEQVIVGLSGGVDSAVTATLVHKAIGDQLVCVLVDTGLLRLNEVDEVLNVFQKHLGAKVICVDAKDRFMKALKGISDPEEKRKIAGEQFIRVFEEQAKKLNVKWLGQGTIYPDVIESAKTKTGKGHIIKTHHNVGGLPLNMELKLIEPLRELFKDEVRKLGLELGLPADLIYRHPFPGPGLAIRILGEVSAEYINILKQADAIFIEELKKSDYYHQVSQAFAVFMPLKSVGVKGDARHYGYIIALRAVKTVDFMTAQWADLPHEFLSKVSHRIVNEIKEVSRVVYDMTNKPPATIEWE

SEQ ID NO: 87986 - protein, 480 aa, Photobacterium profundum SS9
MTESVVRENQLIKRTLDDLPQPKGWPLLGNFLQLQSKNLHQVLEQWCLEYGDTYKVDIAGLLFVVIADPVVVKDILRRRPKSFNRTASLERVFKELGIHGVLSANGESWKRQRRLIMPAFSKKSLASFFPLLEQTTERLRLRLVKKRGQDTLAIHDDLRRFTVDITTSLVFGHDTRLLEHDGDGLQKHLEVIFPQLNSRTRMPFPYWQYIKFKKDRKLDQALIEVEKYALKIVEQTRDELQFNPQLADAPETILQAMVAASDDDNRLTNEELFANILTLLLAGEDTTSNLIAWMLYFISQRPDIQCKINEEAEQIRLKHKGQINVQGLDELTYLEAVARETLRLKSTAPMISAETADQVTLLDGTELPAGTGLFLMTRLGGLNKEHFKDAEQFRPERWQEEAVAAEACPHKATSHFPFGGGARHCPGETLAFMETKMVIAMLCQQFDISQPESPPVVEEYAITMRPKNLQICLRLKPVGR

SEQ ID NO: 87987 - protein, 739 aa, Triticum aestivum
MAELLPFPLVPWLLLTCFSPFFVHSMESSTSSCSSSNISIPYPFGVYGQSPSPAEGFEITCGSSGPMLPIGNNSISILNISLLDGYVTILASAASRSRHCGGDFASFSLEGTSFTFSDTRNKLTAVGCNMVAMLLNGTSDYSGGCASFCSTSNSIVDGACSGVACCQAPVPKGLKKLSLNFTNINASLSKYTLACAEAFIVEQNSYAFAAAYLKVLNNSNNSPPQYRPVVLEWSIDGGSCEEANRSASYACKENSYCYSSSNGIGYRCNCTEGFLGNPYLQGPGGCQDTDECSTVKPCTHTCINTKGSFNCVCPSGMNGDGRKEGSGCSGIGTLQISIVVGLALLLLLLVLGFWTHCLVKRRKLAKKRQRYFMQNGGVLLKQQMLSRRAPLRIFTPAELDKATNKFSDSNIVGRGGFGTVYKGVLSDQMVVAVKRSQRVDQSQVEQFVNELVILSQVTHKNVVQLLGCCLEAEVPLLVYEFISNGALFHHLHNTSIPMSWEDRLRTAVETASALAYLHLAAKTPIVHRDVKSSNILLDSSFTAKVSDFGASRPLPPNQTHVTTLVQGTLGYMDPEYFQTSQLTEKSDVYSFGVVLVELLTREKPISDGLVDEVRSLAMHFSTLFHQNQLLKIVDSQVAEEAGMRHVKTVAQLALRCLRSRGEERPRMIEVAVELEALRRLMKQHSVLKSEEEEPLLPLLRDLSCHGEMNFDAQLSSSHDGIAKDESMEIILLPSGDLSC

SEQ ID NO: 87988 - protein, 514 aa, Legionella pneumophila subsp. pneumophila str. Philadelphia 1
MSHNAPLVLMILDGWGYNENDRYNAIAKANTPQWDEWWQTCPHILLKASGLPVGLPDEQMGNSEVGHMHIGAGRVIQQDFTRINEAINNGKFAKNAVFHEVIDQLKKTEKSLHIMGLLSPGGVHSHEQHLFALLALCNQKKFRSVHLHLFLDGRDTPPQSALDSLKCLNEELAKHPVATINSICGRYYAMDRDKRWERVEPVYNLLTQGKSERQFPDAETAIHFYYKNKISDEFVPPTLIGKEHSIQDGDAVLFFNFRADRARQLTSTFLDPSFKGFERKTLPKLSYFVSMTQYDKNLLTTTAFPPVPLNNTLGEVLSSHGLSQLRIAETEKYAHVTFFFNGGCESVFTNEERIMVPSPQVATYDLQPEMSAHELTKTLIAAINSQDYHVIICNYANADMVGHTGNFEATVQAIECLDQCMQQVWQALKNNGGKLLITADHGNAEEMFSEATNQAHTAHTSEPVPFLYVGGGWHFTHSEGSLIDIAPSLLALLGITPPPEMTGRILLEKNHAHP

SEQ ID NO: 87989 - protein, 79 aa, Brassica napus
  misc_feature (22)..(22): Xaa can be any naturally occurring amino acid
GASFKGVNFSNAVIDRVNFGKXDLKGAVFKNTVLSGSTFDEANLEDVVFEDTIIGYIDLQKICRNETINEEGRLVLGCR

SEQ ID NO: 87990 - protein, 164 aa, Zea mays
MMSRERKKAAALQEKLKILRSITHSHALSNTSIIMDASAYIKELKQKVVRLNQEIACAQDALRHKASSYPTVTVEALGVQGSSFLVNVFSDKSCPGLLVAVLEAFDELGLSVLQATASCADSFRLEAVGGENVADNVDEHVVKQAVLQAVRSCSEGGSEHDDEE

SEQ ID NO: 87991 - protein, 315 aa, Arabidopsis thaliana
MANAITFFKLNTGAKFPSVGLGTWQASPGLVGDAVAAAVKIGYRHIDCAQIYGNEKEIGAVLKKLFEDRVVKREDLFITSKLWCTDHDPQDVPEALNRTLKDLQLEYVDLYLIHWPARIKKGSVGIKPENLLPVDIPSTWKAMEALYDSGKARAIGVSNFSTKKLADLLELARVPPAVNQVECHPSWRQTKLQEFCKSKGVHLSAYSPLGSPGTTWLKSDVLKNPILNMVAEKLGKSPAQVALRWGLQMGHSVLPKSTNEGRIKENFNVFDWSIPDYMFAKFAEIEQARLVTGSFLVHETLSPYKSIEELWDGEI

SEQ ID NO: 87992 - protein, 455 aa, Burkholderia xenovorans LB400
MKNVMSSLKSGDWRALVACFLYFDTGFTVWVLYGPLAPFISKSIAMTPAQQGLLVAVPVLSAAILRVTLGNLYQSAHGKRIALMGVLLSAVPTIVLPLMPSVPSYTVLLVLGVFLGVGGASFAVALPMAGSNYPPKVQGLVLGLAAAGNIGAVLDGFLFPQLATHYGWQMAAGGALPLLAIAAITLYFWANDSGVKSGSVLRAFGSFTVTLVGLIVLVLLVEAGMFGSGKTGVLLLPVIGALLAIAVLPKRYRAVLAERDTWAIMLVYSITFGGFVGMSSYVSLLLTNLYQLSKIDAGLFMALLAATGAMVRPLGGLIADKVSGVRALTFLLAIISLCDFVFAAAMPAMAGGIALLLVLYVAFGLGNGATFQLVPHRWAGRTGLMSGIVGAAGGIGGFYLPVVMGIAKESTGSYQMGFATFGVLAACAFLAIVALRRPWMAWSMHSGVMHAHATE

SEQ ID NO: 87993 - protein, 507 aa, Zea mays
MASNGCNGNGNGKAAPAGVVVPEIKFTKLFINGEFVDAASGKTFDTRDPRTGDVLAHVAEADKADVDLAVKSARDAFEHGKWPRMSGYERGRIMSKLADLVEQHTEELAALDGADAGKLLLLGKIIDIPAATQMLRYYAGAADKIHGDVLRVSGRYQGYTLKEPIGVVGVIIPWNFPTMMFFLKVSPALAAGCTVVVKPAEQTPLSALYYAHLAKMAGVPDGVINVVPGFGPTAGAALASHMDVDSVAFTGSTEVGRLIMESAARSNLKTVSLELGGKSPLIIFDDADVDMAVNLSRLAVFFNKGEVCVAGSRVYVQEGIYDEFVKKAVQAARSWKVGDPFDVTSNMGPQVDKDQFERVLKYIEHGKSEGATLLTGGKPAADKGYYIEPTIFVDVTEDMKIAQEEIFGPVMSLMKFKTVDEVIEKANCTRYGLAAGIVTKSLDVANRVSRSVRAGTVWVNCYFAFDPDAPFGGYKMSGFGRDQGLAAMDKYLQVKSVITALPDSPWY

SEQ ID NO: 87994 - protein, 308 aa, Oryza sativa Indica Group
MAGMSLQHPWAFAFGLLGNIISFMTYLAPLPTFYRIYKSKSTQGFQSVPYVVALFSAMLWIYYALLKSDECLLITINSAGCVIETIYIAVYLVYAPKKAKMFTAKLLLLVNVGVFGLILLLTLLLSAGDRRIVVLGWVCVGFSVSVFVAPLSIIRLVVRTKSVEFMPFSLSFSLTISAVVWFLYGLLIKDKYVALPNVLGFSFGVIQMGLYAMYRNSTPKAVLTKEVEAATATGDDDHSAAGVKEHVVNIAKLSAAVDVVKTREVHPVDVESPPAEAPPQEDDKAAAATAAAATAAAVAGAGEKKVAA

SEQ ID NO: 87995 - protein, 285 aa, Zea mays
MAKDVEGAEGFAARDYEDPPPTPFFDAEELTKWSLYRAVIAEFVATLLFLYVTVLTVIGYKISSDTKAGGDECGGVGILGISWAFGGMIFILVYCTAGISGGHINPAVTFGLFLARKVSLVRAVLYMVAQCLGAICGVGFVKAFQSSYYVRYGGGANSLADGYSTGTGLAAEIIGTFVLVYTVFSATDPKRNARDSHVPVLAPLPIGFAVFMVHLATIPITGTGINPARSFGAAVIYNESKPWDDHWIFWVGPFIGAAIAAFYHQFVLRASGSKSLGSFRSAANV

SEQ ID NO: 87996 - protein, 144 aa, Triticum aestivum
  misc_feature (108)..(108): Xaa can be any naturally occurring amino acid
  misc_feature (116)..(116): Xaa can be any naturally occurring amino acid
  misc_feature (131)..(132): Xaa can be any naturally occurring amino acid
  misc_feature (143)..(143): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQVDYLIRSKWVPCLEFNKVGFIFREQNATPGYXNGGTGTMXWKLPMFGVQPTPRKXXTKVEEVKEREXP

SEQ ID NO: 87997 - protein, 412 aa, Triticum aestivum
MAVAAARSRLWRGMRTAAATTASGEELYASLLSRLVAEPECRVKATMEEATSSVPHHDGAFWEPLAAALLRASYPAKAHLVLEWKLEKLLMEGVNSHNCEPYLTLIRFCGKTRNAALAMRVFECAEAQGIQLNTGIFNALINTFLSVGDLLAAVTLYETMEGIEDSKPDRATYDAFISAFSRLRSGDAMMSWYLAAKNAGFVPGIQAFESLIVGFVLLNKLDDAELVFEEMVSFEMKPTCTVEAKLEVLPRTEEVNRVNSFIKLVSDGNWELNKALVDRLTRLCLDGGEADVMEQLLALIQKEAHFSSVTQLHCGIIRFYASADLLSDMEHAIDRMLDDGMMFLCPEDVEAVICSYFRHKAFDRLEIFLNRIRSLYMLTRSSYDILVAGFRRFDLNQRLEATIKDMREAGFA

SEQ ID NO: 87998 - protein, 490 aa, Pseudomonas syringae pv. phaseolicola 1448A
MARFELQKLYIDGGYVDASNTETFDAINPANGEVLAQIQRAGKEDVERAVVAAEKGQKIWAAMTAVERSRILRRAVDILRERNDELAALETLDTGKAISETRYVDIVTGADVLEYYAGLVPAIEGEQIPLRDSSFVYTRREPLGVVAGIGAWNYPIQIALWKSAPALAAGNAMIFKPSEVTSLTTLKLAEIYTEAGVPNGVFNVLTGSGREVGTWITEHPRIEKVSFTGGTDTGKKVMASASSSSLKEVTMELGGKSPLIVFDDADLDRAADIAMMANFYSSGQVCTNGTRVFVPNALKAEFEAKILERVKRIRAGNPEDENINFGPLVSFEHMESVLGYIAKGKEQGARLLCGGDRLTGGVFDKGAFVAPTVFTDCTDEMTIVREEIFGPVMSILGYDTEEEVVRRANDTDFGLAAGIVTRDLNRAHRVIHLLEAGICWINAWGESAAQMPVGGYKQSGVGRENGISSLAQYTRIKSVQIELGDYASVF

SEQ ID NO: 87999 - protein, 426 aa, Halobacterium sp. NRC-1
MDVSIVGSGYVGTTIAACFAELGHTVVNVDVDADVVAAINDGDAPIHEPGLAERIDAHAGTRLRATTDYEAVRDTDVTFLALPTPAREDGSIDTSIMESGAASLGEALAGADDHMVVVKSTVVPGTTEDVVESALVSAGFDDPLLAMNPEFLRMGSAVDDFRHPDKVVFGARRDAAYDQLHAVFEPLLADAGDATVVETGLREAEMIKYANNAFLASKVSLINDLGNICKELGVDAYEVADAIAEDDRISGRFLRSGVGWGGSCFPKDVAAITAAAKDAGYEPAMLEAAVEVNDRQPERLLSLLDGHVDVAGERVAVLGLSFKPGTDDIRGTRAVPVIDGLQDREADVVAYDPVAAEKMAEQRPEVTYADSAAGALADAVGAVVVTDWDEFAALDDEFDAMAERVVVDGRRVVDPQADLTYDGLTW

SEQ ID NO: 88000 - protein, 245 aa, Zea mays
IKKKYGQDATNVGDEGGFAPNIQENKEGLELLKAAIEKAGYTGKVVIGMDVAASEFFGEKDKTYDLNFKEENNDGSKKISGDSLKDLYKSFVSEYPIESIEDPFDQDDWSTYAKLTDEIGQKVQIVGDDLLVTNPTRVAKAINEKTCNALLLKVNQIGSVTESIEAVRMSKRAGWGVMASHRSGETEDTFIADLSVGLSTGQIKTGAPCRSERLAKYNQLLRIEEELGDAAVYAGAKFRAPVEPY

SEQ ID NO: 88001 - protein, 520 aa, Arabidopsis thaliana
MASVSAIGVLKVPPASTSNSTGKATEAVPTRTLSFSSSVTSSDDKISLKSTVSRLCKSVVRRNPIIVSPKAVSDSQNSQTCLDPDASSSVLGIILGGGAGTRLYPLTKKRAKPAVPLGANYRLIDIPVSNCLNSNISKIYVLTQFNSASLNRHLSRAYASNMGGYKNEGFVEVLAAQQSPENPNWFQGTADAVTDYLWLFEEHNVLEYLILAGDHLYRMDYEKFIQAHRETDADITVAALPMDEQRATAFGLMKIDEEGRIIEFSEKPKGEHLKAMKVDTTILGLDDQRAKEMPFIASMGIYVVSRDVMLDLLRNQFPGANDFGSEVIPGATSLGLRVQAYLYDGYWEDIGTIEAFYNANLGITKKPVPDFSFYDRSAPIYTQPRYLPPSKMLDADVTDSVIGEGCVIKNCKIHHSVVGLRSCISEGAIIEDSLLMGADYYETATEKSLLAAKGSVPIGIGKNSHIKRAIIDKNSRIGDNVKIINSDNVQEAARETDGYFIKSGIVTVIKDALIPTGTVI

SEQ ID NO: 88002 - protein, 290 aa, Synechococcus sp. CC9311
MRTQLLEALQTDFCERQGCQCKTLEPVGSASTWRADLSDGRSLFLKLASPVMLNVEARGLRSLQQWADPTLLLIPDPLGIVPVGELAALILPWLDTGRGNQYDLGRGLALLHRTSADAGKERFGWDEEGFIGLGPQPAGWLTAWGDAFVTLRLTPQLQLARNWGLALDQLEPLLAATRIWLDQHQPLPCLVHGDLWGGNASVLADGRGALIDPACWWADREVDLAMTRLFGGFSARFYEGYQKEWPLDPNYCDRIDVYNLYHLLNHANLFGGGYKKKCLTAINAMRSMLL

SEQ ID NO: 88003 - protein, 369 aa, Arabidopsis thaliana
MASSVFLSSFSSSSSLQLCSSFHGEYLAPSRCFIGAPVTSSSLSLSGKKNSYSPRQFHVSAKKVSGLEEAIRIRKMRELETKSKVRRNPPLRRGRVSPRLLVPDHIPRPPYVESGVLPDISSEFQIPGPEGIAKMRAACELAARVLNYAGTLVKPSVTTNEIDKAVHDMIIEAGAYPSPLGYGGFPKSVCTSVNECMCHGIPDSRQLQSGDIINIDVTVYLDGYHGDTSRTFFCGEVDEGFKQLVKVTEECLEKGIAVCKDGASFKKIGKRISEHAEKFGYNVVERFVGHGVGPVFHSEPLIYHYRNDEPGLMVEGQTFTIEPILTIGTTECVTWPDNWTTLTADGGVAAQFEHTILITRTGSEILTKC

SEQ ID NO: 88004 - protein, 438 aa, Erythrobacter sp. SD-21
MEGVKKRNPGQDEFIQAVHEVAQDIFEFIEDKEEYHEAQILRRIAEPDRVVSFRVCWEDDNHNIRVQRGWRVQNNNAIGPYKGGIRFHPSVNESVLKFLAFEQTFKNSLTGLPMGGGKGGANFNPKGKSDSEVMRFCQSFMTELYRHIGPDTDVPAGDIGVGAREIGYMFGQYKRITNRWEGVLTGKGTEYGGSKMRPEATGYGAVYFLRNMLEKDGQDIEGKQAVISGSGNVATHAAEKLCQLGAKVLTLSDSDGFIHDPDGIDQEKIDWVKRLKNERRGRISEYADHFTNATFHEGKKPWNVECDIALPCATQNELCEDDAKALVENGCMAVSEGANMPTTLEGVKVFHEAKILYGPGKAANAGGVAVSGLEMSQNAERISWNHDKLGEMLTELMQDIHDKCVEHGEQDGYIDYVRGANIAGFKKVADAMLAFGVV

SEQ ID NO: 88005 - protein, 209 aa, Lactobacillus plantarum WCFS1
MTENKHRRPVVIGVTGGSGSGKTTVSNAIYNQLSGQSLLILQQDSYYNDQSEMTMAERHAVNYDHPLAFDTDLMIKQIKQLLAYQPIEKPVYDYEQYTRSDKTIHQEPRDVIIVEGVLILDDQRLRDLMDIKVFVDTDDDIRIIRRIQRDIKERGRTLDSVIGQYLATVKPMYHQFVEPTKRYADLIVPEGGENEVAIDLLTTKVRSIL

SEQ ID NO: 88006 - protein, 344 aa, Arabidopsis thaliana
MLQKISQSISLCNGDQFKPLIYLAGAPTNFISSPLSGKKKSSSLRIKRIQQLQSTLEDRINPPLVCGTVSPRLSVPDHILKPLYVESSKVPEISSELQIPDSIGIVKMKKACELAARVLDYAGTLVRPFVTTDEIDKAVHQMVIEFGAYPSPLGYGGFPKSVCTSVNECMFHGIPDSRPLQNGDIINIDVAVYLDGYHGDTSKTFLCGDVNGSLKQLVKVTEECLEKGISVCKDGASFKQIGKIISEHAAKYGYNMERFIGHGLGTVLHSEPLIYLHSNYDYELEYMIEGQTFTLEPILTIGTTEFVTWPDKWTIVTADGGPAAQFEHTILITTTGAEILTISS

SEQ ID NO: 88007 - protein, 358 aa, Codonopsis lanceolata
MSCYKGKYADELIANATYIGTPGKGILAADESTGTIGKRLSSINVENIESNRWALRELLFCTPGALQYLSGVILFEETLYQKTAAGKPFVDVLKENGVLPGIKVDKGTVVLAGTNGETTTQGLDGLGARCAQYYAAGARFAKWRAVLNIGPNEPSQLAINENANGLARYAIICQENGLVPIVEPEILVDGAHDIAKCADVTERVLAACYKALNDHHVLLEGTLLKPNMVTPGSDSAKVAPEVVAEYTIRALQRTMPAAVPAVVFLSGGQSEEQATVNLNAINKYKGKKPWSLTFSFGRALQQSTLKAWAGKEENVAKAQAAFLARCKANSEATLGTYEGGASLSEGAAESLHVKDYKY

SEQ ID NO: 88008 - protein, 530 aa, Glycine max
MVSACVTLKANTHLVKSRKDNTFRQDGGFLGERIKGGLNYSPWIINQLASTSSLRTQEKVNKAKPGVVSAVLTSSNIKESVAFQMPSFLRRKADPKNVVSVILGGGPGIQLFPLTKRAATPAVPVGGCYRLIDIPMSNCINSGLNKIFVLTQFNSASLNRHISRTYFGNGINFGDGCVEVLAATQTQGEAGNNWFQGTADAVRQFTWVFEDAKHANIENVLILAGDHLYRMNYMDLVQSHVDRNADITVSCAAVGESRASDYGLVKADARGRIIQFSEKPNGADLKAMQVDTSVLGLPLHEAKRSPYIASMGVYVFKTDVLLRLLKWRYPTSNDFGSEIIPAAVRENNVQAYFFIDYWEDIGTIKSFYDANLALTEENPMFKFYDPKTPIYTSPRFLPPTKIDKCRIVDAIISHGCFLRECTVQHSIVGERSRLDYGVELQDTVMMGADYYQTESEIASLLAEGKVPIGIGRNTKIRNCIIDKNAKIGKDVIIMNKDGVQEADRPEDGFYIRSGITVILEKATIEDGTVI

SEQ ID NO: 88009 - protein, 329 aa, Beta vulgaris
MTITRFVLNEQSKRPESRGDFTILMSHIVLGCKFVCSAVNKAGLAKLIGLAGETNIQGEEQKKLDVLSNEVFIKALISSGRTCILVSEEDEEATFVEPSLRGKYCVVFDPLDGCSNIDCGVSIGTIFGIYMVKDLNNATLDDVLQPGKNMVAAGYCMYGSSCTLVMSTGSGVNGFTHDPSLGEFILTHPDIKIPKKGKIYSVNEGNAKNWDGPTTKYVEKCKFPKDGSSPKSLRYIGSMVADVHRTLLYGGIFMYPGDKKSPNGKLRVLYEVFPMSFLMEQAGGQAFTGEQRALDLVPKNIHDRSPVFLGSYDDVEDIKALYAAEQKNA

SEQ ID NO: 88010 - protein, 524 aa, Oryza sativa Japonica Group
MHGDGLPWRGTDDICARGYLGRDTHCGLRLFNRHPQISPDFEAIMQGYPSLFTVRTVLQRHSMDTLNSQASPLSTSSFAMGAASTPRHHLPLPKRIFAYALYALLPLAALHYLLLSPPPPPLATTSTSTTPPVAAVAVARKAAPRCDYSEGEWVRSASAPRYNGTSCGSTIKGGQNCMAHGRPDTGYLHWRWRPRGGGGCALPPFAPGEFLELVRGRHVAFVGDSLARNQCESLVCLLASGFPAELVRGGNGGDGGDGDEARKFRRWVFPSHNATVSVFWSPFLVNGTEKSSSSAAAAGAGGLDHNRLYLDQPDERWAGELDGIDVVVLSAGHWFLHPAMYYERGEVIGCHHCPEPNRTETGFFGVFRLAVKNALREVITRAARSPSQQQKLAVVTTFSPAHFEGEWDARDACARSEPYAPGEKEVGYMDREMGRAEAEEVAAAAADARVRAPGRVEVEALEVTAMAALRGDGHPGPYMNAFPFAGGERARVPNDCVHWCLPGPIDTWNEILLQLVKRWRDSSK

SEQ ID NO: 88011 - protein, 209 aa, Coprinopsis cinerea
MGLLSIIRKNRQKEREMRILFLGLDNAGKTTILKKLNNEDISGISPTLGFNIKTFVHRAYTLNIWDVGGQTTLRPYWRNYFEQTDALVWVVDSSDRMRMHDCKRELHSLLTEDRLAGASLLVFANKQDLPGSMDDSEISNVSLLALDLPSIKSHHWTIWPCSAVTGQNLVSGLDWVVNDVANRLYYSSTTAHPTNENIGGAPQPVEPIS

SEQ ID NO: 88012 - protein, 432 aa, Glycine max
MCSSHSPNHRSKCSAPAPATIIFLFVPLLCSVSFTNVNSQILEACSAATDCGPGLFCGNCPSLGLKQPICTRGQVTLPTSIVNGLPFNKYTWIVTHNSFSIVDAPPLPGVQRITFYNQEDTVTNQLRNGVRGLMLDMYDFQNDIWLCHSFRGQCFNFTAFQPAVNTLKEVEAFLTENPTEIVTIIIEDYVHTPKGLTNVFTSAGLDKYWFPVSKMPKKGDDWPTVTEMVQANHRLVVFTSDASKEAGEGIAYQWKHMVENESGDPGVQQGSCPHRKESKALNSKSHSLFLMNYFPTYPVEADSCKEHSAPLAEMVNTCYKAAGNLMPNFIAVNFYMRSDGGGVFDIVDKMNGHTLCGCSTVTACQVGVPFGSCKNISVPSTSPVTNTAGSFTGSVQFSKSASAVHLPNFLLLVVFYFLQSLAAAVMTISTVL

SEQ ID NO: 88013 - protein, 108 aa, Triticum aestivum
  misc_feature (20)..(20): Xaa can be any naturally occurring amino acid
  misc_feature (83)..(83): Xaa can be any naturally occurring amino acid
  misc_feature (103)..(103): Xaa can be any naturally occurring amino acid
MLIIQRSHLHETCKAVVSIXGPRVTEEQVQRDLAMNKIDSNHPRHLQPVGEPVGQPVTVTSDAYEPVRDAHAVCILTEWEEFXSIDCRRMYNVMQKLAFVFAXRNIVD

SEQ ID NO: 88014 - protein, 175 aa, Triticum aestivum
MPPTLMPSSPTEVAPFQGLKSTAGLPVSRRSKGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 88015 - protein, 379 aa, Streptomyces albus G
MATDYYAVLGVRRDASQDEIKKAFRRLARELHPDVNPDPKTQERFKEINAAYEVLSDPQKKQVYDLGGDPLSQNGGGGAGGFGQGGFGNFSDIMDAFFGTASQRGPRSRTRRGQDAMIRLDIELDEAAFGTTKDIQVDTAVVCNTCNGEGAAPGTSAQTCDMCRGRGEVSQVTRSFLGQVMTSRPCPQCQGFATVVPTPCPECAGDGRVPSRRTLTVKIPAGVDNGTRIQLAGEGEVGPGGGPGGDLYVEIHELPHSVFQRRGDDLHCTVTIPMTGPRPSAPRCLETLDGMEEIDIRPGTQSGQSVPLHGRGITHLRGGGGRDLIVHVEVTTPGKLDAEQEHLLRELAKLRGEERPTGQFQPGQQGLFSRLKDAFNGRS

SEQ ID NO: 88016 - protein, 316 aa, Helicobacter hepaticus ATCC 51449
MAGGAAIDECGECLPMKSLQICKQSDSVLLGAVGGPKWDNEPSHNRPEKALLTLRKELGLFANIRPATLLPQLSKASPLKDEILNRGIDFIIVRELIGGVYFGEHKLEEINGEKVASDAMTYSASQIESIAKVAFNIARNRKKEIVCVDKANVLSSSRLWREVVDKVAQNYKDVHLSYMYVDNAAMQICRAPSQFDVILTENMFGDILSDEASIITGTIGVIPSASLSNGTLGMYEPIHGSAPDIAGQDKANPIGTILSAAMMLELSFGLTKESEVIQKAVQNALDKGYRTGDMMSEGMQLVGCEQMGDVILESVI

SEQ ID NO: 88017 - protein, 528 aa, Streptomyces coelicolor A3(2)
MDQLALLFMLLLGALLSVPIGARLGLPAPVLMTLLGIVLALLDFVPNVDIPPELILPGLLPPLLYAAVRRTSWRQFAANKRPIFLLAVALVFVTMVCVASVAHAIVPGLPIAAAFALGALVAPPDPVAATAVAGQLGLPRRLVSILEGEGLFNDVTAIVLYHVAIAAAVGGSFSPWRAGFDLVLSAVVAVAIGLVLGWGSNKLMSVLGDPTLQIGLTLLVPFVSYVAADELHGSGVLAVLTTAMFLAEYASDADDVMTRLGGHTVWDVVDTLVTGVAFGLIGLELHNAVRTASGRWTELLGWAAAILVVVVLVRLLWLLPATWLTQRLHARRDQDEDIPTSWRETVVMWWAGMRGVASVALALAIPLETDDGAAFPHREEIVFIAFGVIMGTLLLQGLTLPWLVGRLGVRADTEREQEFERDLALRAAKAAKQRLKEIESVEELPEELSEQMLRRAFDIGIRISPDLGDEERREAQEQRARRIKRVRRIQGEMLSAARHEVLAARSEPGADPEIVDRVLRHLDVRSLR

SEQ ID NO: 88018 - protein, 241 aa, Rickettsia sibirica 246
MIDLTGKTSLITGASGGIGGAIARLLHKLGSHVIISGSNEEKLKALGKVVKDNYTIEVCNLADKEECSNLISKASKLDILVCNAGITSDTLAIRMKDEDFDKVIDINLKANFILNREAIKKMIQNRYGRIINISSIVGISGNPGQANYCASKAGLIGMTKSLSYEVATRGITVNTVAPGFIKSDMTDKLNEKQREAIIQKIPLGTYGMPEDVANAVAFLASDQASYITGQTIHVNGGMLMV

SEQ ID NO: 88019 - protein, 373 aa, Mycobacterium avium subsp. paratuberculosis K-10
MSGKAQLVLEDGRVFTGTAFGAIGQTLGEAVFSTGMSGYQETLTDPSYHRQIVVATAPQIGNTGWNGEDAESRGDKIWVAGYAVRDPSPRVSNWRATGSLEDELIRQRIVGIARIDTRAVVRHLRTRGSMKAGVFSGDALADPDELVQRVRGQQSMLGADLAGEVSTPDAYIVEPEGPPRFTVAALDLGIKTNTPRNFARRGIRSHVLPSSATFEQIADLRPDGVFLSNGPGDPATADHIVAVTREVLGAGIPLFGICFGNQILGRALGLSTYKMVFGHRGINIPVIDHATGRVAVTAQNHGFALQGEAGQSFDTPFGAAVVSHTCANDGVVEGVKLADGRAFSVQYHPEAAAGPHDANYLFDQFIELMEGDR

SEQ ID NO: 88020 - protein, 286 aa, Picea sitchensis
MRGKILAFVGDSIGRNHMQSLVCLLSQVDDPRDIYKDETDKFRRWLFPSYNFTLAVLWSPFLVKEMTKKIEGSASEQLHLYLDIADKKWTSQLHEFDIVLLSGGQWFLKAAIYLEKDEVMGCHYCPGTNFTQLGFYFAYRKALRLAFKSINTSPDYKGLTFLRTFTPDHFENGRWDNGGTCERTVPYKNNEIVMEGMNTEMYKIQLEEFEKAAKDGAARGLKFRLIDTTWASLLRPDGHPGPYRYSHPFAKDKNAKVQNDCLHWCLPGPIDAWNEFLLEMLKRESM

SEQ ID NO: 88021 - protein, 340 aa, Salinibacter ruber DSM 13855
MAHQLTLLPGDGIGPEVTEATLQVIEAAGVDIDWDRHRVIGANAVERGRPALPSDIVDSIQERGTALKGPVTTPVGQGFTSVNVQLRQRLDLYSNVRPATSLEGLDTPFDDVDLIIFRENTEGLYSGIEYYDERLDIADSIARVTKRGAERIIRFCFEYAQAHGREHVTLAHKANILKKTSGLFLDIGRDLAAEYPDIEFEDSIIDNLCMQLVTNPENYDCIVSTNLFGDILSDLTAGLVGGLGVTPGANIGDELAVFEAVHGSAPDIAGQNVANPTAMTRTAAMMLQHIGEDEAAAAIEQSLFAMYRDGDTLTQDVGGDASTSEFADALSDRVASKVEA

SEQ ID NO: 88022 - protein, 592 aa, Xanthomonas campestris pv. vesicatoria str. 85-10
MSTFSRRFSSRGVLLLAFVLAPAAWCADAAKPATATTAAVAAHPPGAAIASGHALATDAGLQILREGGNAFDAAVAVSSTLAVVEPISSGLGGGGFFLLHDAKTGKDVMLDARETAPASATEAQFLDKKGELDRDRSVNGPWSAGIPGLPAALVELAAKHGRLPLKQSLAPSIRIATEGFPVYARMAKGYASRREVMERYPGTREVYLRGGKPIAEGDTFKQPELAQTLQLLGDKGFDGFYKGETAKKLLAGVKQAGGQWSAAELAGYRVKERAPIQFDYRGWKITTAPPPSSGGIALAAMLQILEGWDLNTLDEVHRTHLVVESMRRAYRDRTFFLGDPDFVDVPQRVLTSKDYAQGLRATINPDKATPSDLLSGNPTPLEDDETTHFSIIDGEGNRVGATQTVNLLYGSGLIPKGTGVLLNNEMDDFALKPGTPNAFGVMGYAANAPKPGKRMLSSMTPTFMESADKAIVLGTPGGSRIITMVLLGILGYDAGLDAQAVSALPRYHHQWLPDVIDAETNAFSAQTAKGLQAMGHALKLPGDTAEGGRGSSHVWGNLQTVEWDKRRNVLSGGSDPRNPVGKAQVQLDATAR

SEQ ID NO: 88023 - protein, 453 aa, Vitis vinifera
MASHAALASSRIPTTNTRLPSKASHSFPTQFFAKRLEVAEFSGLRSGGCVTFAKNAREPSFFDVVASQLTPKAGGPAPVRGETVAKLKVAINGFGRIGRNFLRCWHGRKDSPLDVIVVNDSGGVKNASHLLKYDSMLGTFKAEVKIVDNETISVDGKPIKVVSSRDPLKLPWAELGIDIVIEGTGVFVDGPGAGKHIQAGAKKVIITAPAKGADIPTYVVGVNEGDYSHEVSNIVSNASCTTNCLAPFVKILDEELGIVKGTMTTTHSYTGDQRLLDASHRDLRRARAAALNIVPTSTGAAKAVSLVLPQLKGKLNGIALRVPTPNVSVVDLVVNVEKKGITAEDVNAAFRKAADGPLKGILAVCDVPLVSVDFKCSDVSSTIDASLTMVMGDDMVKVVAWYDNEWGYSQRVVDLAHLVAAKWPGFAAEGSGDPLEDFCKTNPADEECKVYEA

SEQ ID NO: 88024 - protein, 229 aa, Methanothermobacter thermautotrophicus str. Delta H
MEIVIMIQEALKALRRGEIVLVFDADNRERETDMIVAAEKIKPEHIRIMRNDAGGLICVPVSWENSEKLGIPYMTDIMEEASGRYPVLGKLSPHDIPYDEKSAFSITVNHRKTFTGITDNDRALTIGELAGICRDDRHESFGDLFRSPGHVTLLRAADGHVLRRGGHTEMSIALMEMAGLTGVAVCCEMMDDRTGNSLSTEDAMKYAREHDLIFMSGAELIESYMEFRS

SEQ ID NO: 88025 - protein, 188 aa, Corynebacterium efficiens YS-314
MTEATTGPLILPFNGKTPRIHESAWIAPNATIIGDVEIGADASVFYGVVLRGDVNAIRIGARTNIQDNCVLHVDADAPCTLGDDVTVGHMALVHGSTVGNGTLVGMKAGLLSRSVIGPGSLIAAGAIVLEGQEIPAKSLAAGVPAKVRRELSDEQSSAFIPHAGRYVQTSKAQASISETLPLDEVRFS

SEQ ID NO: 88026 - protein, 470 aa, Erythrobacter sp. SD-21
MAQYDYDVLVIGAGPGGYVAAIRAAQLGLKTACAESRETLGGTCLNVGCIPSKAMLHASEFFDAAANGTMADMGIEVAPKLNLDKMHAQRRDAVKGLTSGIEFLFKKNKVDWKKGHATFQDAHTVKVGDETVTAKNVIIATGSSVTPLPGVEVDNDKQVVVDSTGALELASVPKKMVVIGGGVIGLELGSVWNRLGAEVIVVEYLDKLLPGMDDDVRKEAAKIFKKQGMELKLKTKVTGVTVKGKKATLTLEPSAGGDEETLEADCVLVSIGRKPNTEGLGLENIGLETNKRGQIETDHDFRTAVDGVWAIGDVVPGPMLAHKAEDEGIACAENIAGQTGIVNHDIIPGVVYTLPEFAGVGLTTEEAIEKMGGDKAKVKVGKFPMMANSRAKTNHEPDGFVKVIAEADTDRVLGVWAIASVAGTMIAQAAQAMEFGATSEDIAYTCHAHPTHSEAIKEAAMAVQGKPIHI

SEQ ID NO: 88027 - protein, 87 aa, Streptococcus pyogenes MGAS10394
MTGVFLIRTRSRPLIRKGLAVSLARSVKPDLKLGICGEHGGDPASIAFCHSQGLTYVSCSPFRVPLTRLAAAQAAIKASGHSLTQDK

SEQ ID NO: 88028 - protein, 405 aa, Coxiella burnetii RSA 493
MPNSLNVRDDFPLLKQLIHGKPLVYLDTGATAQKPQAVMDAVSHYYCQDNANVHRGIYELSERATRNYEESREKIKTFINAADAREIIFTHGATGSINLVAASFGALQVKRGDEILISAMEHHSNIVPWQLLCERVNAKLKVIPVDDNGVLDIDAYQRLLTKRTKLVGLIHISNVLGTVNPVKDMIQLAHQNKTPVLLDGAQAISHREVDVQDLDCDFYVFSSHKLYGPTGVGVLYGKAKWLETMPPYQGGGDMISRVSFEKTDYNVVPYKFEAGTPNMGGVIGMGAAIDYVTRIGFEKIKLHENELMCYAAEQLQKIPGLRIIGNAPDKASAISFVMAQAHPHDISTILDNEGIAIRAGHHCAMPLMDRFNLPATARVTFGIYNTTQDVDRLVEGLHRVIQLFG

SEQ ID NO: 88029 - protein, 411 aa, Erythrobacter sp. SD-21
MATEVKVPTLGESVTEASIGELLKNVGDSVAVDEPIVSLETDKVAVEAPSPVAGVIKEFKVAVGDTVEVGAVLAIVEEGGAGASPSSEPKAAAPDAGVEKAAPAQAKEATGSDASQTLSPAVRRAVLEHGVDPSTIKGTGKDGRLTKEDVIAAAKAKGDSPAPAPAASAPSPAPAATGDRREERVKMTRMRQTIAKRLKGAQDNAALLTTFNDVDMSAVMEARAKYKDMFAKKHDIRLGFMGFFAKAACLALKDVPAVNAYIEGDEIVYHDYVDISVAVSAPNGLVVPVIRDAQDKGFARIEKDIADFGKRAKEGTLTMEDMKGGTFTISNGGVFGSLMSTPIINPPQSAVLGLHRIEDRPVVVDGEIVIRPMMYIALSYDHRLIDGREAVTALKIIKEAIEDPTRMLIDL

SEQ ID NO: 88030 - protein, 639 aa, Oryza sativa
  misc_feature (48)..(48): Xaa can be any naturally occurring amino acid
MDEEDYSWVRRTRFSHSVVRSKSGREQFGAFVEQFNRGAARRQRGPGXSGFMPPWPSTLEPRARLPATTSANSSVPRTTGSSNAQPSSETKPASSSSDAKLEQHEKSLNLEPRTRLSATTSANSSVPWTTGSSNAQPLSETKTASSSSDAKPEQQEKPRDHQPSQEVSTKQDDKAENDTKATATSGPLEFSFHPDEQTLRLERACSSPVPFPSNKNMLVADAAARSSSLKVAGEGPKPKPKQRARSPPLRRDVPELFKEAKSSSKRFSTPPPRRKPSSPPAPSRSPPHVFATARAHGKPKHKKDSSANGRAKVAALEVLEKWTVDRSQLLIGHRFASGAHSRLFHGIYKEQPVAVKFIRQPEDEEDAELAAQLEKQFNTEVTTLSRLNHPNVIKLIGACSSPPVFCVITEFLSGGSLRTFLHKQEHKSLPLEKIISIGLDIANGIGYIHSQGVVHRDVKPENIIFDSEFCAKIVDFGISCEEAECDPLANDTGTFRWMAPEMMKHKPYGRKVDVYSFGLILWEMFTGSVPYEDLNPFQAAFAVFDKNERPVIPSSCPAPLRLLIEQCWASQPDKRPEFWQIVQILDKFKAVLDKDGTLDNMPCLNLQGTHDHKNWLAHWVQKLKHTHHDLSGPPPPKLM

SEQ ID NO: 88031 - protein, 331 aa, Populus trichocarpa
MTAGGSSARLPTWKERENNMRRERRRRAIAAKIYTGLRTQGNYKLPKHCDNNEVLKALCAEAGWIVEEDGTTYRKGCKPPPSEIAGMPANISACSSIQPSPQSSNFASPVPSYHASPSSSSFPSPTCFDGNSSTYLLPFLRNIASIPTNLPPLRISNSAPVTPPRSSPTCRSSKRKVDWESLSNGSLNSFRHPLFAASAPSSPTRRPHLTPATIPECDESDASTVDSGRWLSFQAVAPQVAPPSPTFNLVKPVDQQCAFQIGVDRHEGLSWGVAAERGRGAEFEFENCRVKPWEGERIHEIGVDDLELTLGSGKVHGQASIDDLAWERSNK

SEQ ID NO: 88032 - protein, 239 aa, Streptomyces coelicolor A3(2)
MTDRKHELAANLAKVEQRITDACAAAGRPRQDVTLIVVTKTYPADDVRILSELGVRHVAENRDQDAAPKAAACSDLPLSWHFVGQLQTNKVRSVVGYADVVQSVDRARLVTALSKEAVRAGREVGCLLQVALDAEEGGRGERGGVPPAGIEELADLVAGSEGLRLDGLMTVAPLSGEYAGRQQAAFEHLMDLSTRVRRTHPAANMVSAGMSADLEQAVAAGATHVRVGTAVLGVRPRLG

SEQ ID NO: 88033 - protein, 270 aa, Prosthecochloris aestuarii DSM 271
MTGSSITVRFGIVADIHMSDCAAEKARTVEDLEKCIDSLENEGITHLIQMGDLVEGPQENAEQQLDEVSAILNRFSGTIHHIIGNHCLDVPITTLMHRLALDAPYYTFRIGALRCIALHGMDITVASSPESPADRERRQLLHTEAMARQYTGAIGQQQIDWLKRELQTAADNREKVIICSHLPLHPETTDERHGILWNHREITNLLSGYPDIIACISGHYHPGGSHRQNGVHFLTIPAFCRRSEPPFFSYGIVEIRNTLLTVDNPKSQPH

SEQ ID NO: 88034 - protein, 178 aa, Zea mays
MALTRIGLAGLAVMGQNLALNIAEKGFPISVYDRTTSKVDETVQRAKVEGNLPVFGFHDPASFVSSIQKPRVVIMLVKAGAPVDQTIATLAAHLDQGDCIVDGGNEWYENTERREKAMEERGLLYLGMGVSGGEEGARDGPSLMPGGSFEAYKYIEDILLKVAAQVPDSGPCVTYIGK

SEQ ID NO: 88035 - protein, 523 aa, Burkholderia xenovorans LB400
MRIQAAWYFSIRLKRRFGAANGFCNSRDKAPARIAALAWNTPMSFALLGLIDPLLRNVQDLNYQTPTPVQVKAIPAVLGGRDVMAAAQTGTGKTAGFALPLLQRLVQHGPAVSSNRARVLVLVPTRELAEQVLQSFIDYGKGLDLRFLAAYGGVSINPQMMKLRKGVDVLVATPGRLLDLNRQNAVQLDQVQTLVLDEADRMLDLGFARELNAVFAALPVRRQTLLFSATFTDDIRAMAAGILRDPVNISVSPPNATASKIRQWVVTVDKKNKPDLFMHLVAGNNWRHALVFVKTRNGVDYLAAMLDAAGYAVDTIHGDKPQPARLRALERFKTGEVQMLVATDVAARGLDIDDLPLVINVDLPIVAQDYVHRIGRTGRAGASGVAVSLVCADEAPQLAAIEALIRQTLRREEEPGFEAEHRVPQTSATGEIIRKPKKPKKSKVPQAAPREMQVLSKKPHPQRGENKPKLAAQRAVAVGKDTSPVSGSPFSVQKPRSKAAGKPVAGSRKPAGKPAGGRGKRQS

SEQ ID NO: 88036 - protein, 327 aa, Rhizobium leguminosarum bv. viciae 3841
MAGETVLVVGGAGYIGSHTCLDLANKGYTPVVFDNFSNGHREFVKWGPAEEGDIRDRARLDEVLAKHKPAAILHFAALIEVGESVKDPVSFYENNVIGTLTLLSAAQAAGINAFVFSSTCATYGLPQSVPLDETHRQVPINPYGRTKYIVEQALADYDQYRSLRSVVLRYFNAAGADFEGRIGEWHQPETHAIPLAIDAALGRRQGFKVFGSDYETRDGTCVRDYIHVLDLADAHVRAVEYLLKGGDSVALNLGTGTGTTVKELLGAIEDVSNRPFPVEYIGRREGDSHTLVANNDKARDVLGWVPQYDLSEIIRSAWDWHAKSNQH

SEQ ID NO: 88037 - protein, 178 aa, Zea mays
MALTRIGLAGLAVMGQNLALNIAEKGFPISVYNRTTSKVDETVQRAKAEGNLPVYGFHDPASFVNSIQKPRVVIMLVKAGAPVDQTIATLAAHLEQGDCIIDGGNERYENTERREKAMEERGLLYLGMGVSGGGEGARNGPSLMPGGSFDAYKYVEDIVLKVAAQVPDSGPCVTYIGK

SEQ ID NO: 88038 - protein, 320 aa, Mycobacterium avium subsp. paratuberculosis K-10
MPRLDNPADEKPGIDPILQKVLDAVPFRLSTEDGIDAARQRFRDLPRRPLHPELRVEDRTIPGPQGAIAVRIYWPPSHSESCPAPVVLYFHGGGFVIGDLDTHDGTARQHAVGAGAIVVSVDYRLAPEHPYPAAVEDAWAATLWAAENAAGLHGDPGRIAVAGDSAGGTLAAVTAQRARDRGGPPVRFQLLWYPSTMWDASLPSFAENATAPILDVKAVAEFSRWYAGDVDLSDPPADMAPGRATDLSNLPPAYIGVAGYDPLRDDGIRYGEPLAAAGVAAQVHNAETLVHGYLGYAGVVPAATAAMERGLAALRTALQG

SEQ ID NO: 88039 - protein, 694 aa, Bordetella parapertussis 12822
MSVAIAMRGDIGVVTLDSPPVNALGRTLRHGLAQCLEQAYARPDVRALLLVSARPGIFSAGADIKEFDQAGSDQDAGLAELIDRIENAPVPVVALLDGAALGGALELALGCHYRLASPRASLGLPEIKLGLLPGAGGTQRLPRLVGARHAVEMVLGGEPVGGETALRCKLADALLSADDTLEQALAWMRNAPGGLARRRVASLPALAPASIAEAARAAAIRPVGSAAAREAALACLAAAQGPFDAGRALERESFARLRDGAEARALRYAFFAERPRPPAGDVSARRIEQVAVVGAGTMGTGIVICLADAGLPVIWHDVDADRLAQGRAQVCQHFERLAARKRLTSRQAEQRVAAVATTGEMAGIARADLAIEAVFEDMAVKCAVFRELDRVLKPGAILGTNTSTLDVDRIAHSTRRPQDVVGLHFFSPAPAMPLLEIVRGAATHADVVAAAQGLARRLRKTAVVAGVCDGFIGNRMWHQYLRQAALMVHEGAMPMEVDAALRDWGFAMGPFQVADLAGLDVGDSIRLRQRSEMPHRPWPDWLDRVSAAGRLGLKGGSGIHAYPDGGRQPRRDAEVEAMIAAASREAGVSRRAIAADEIVERCLHALVVEAARLLEEGIAASATDVDAVFLAGYGFPRWRGGPCHSADAMGLPAVVAGLRRRAATAEPEFWQPPGLLARLAAHGGRLQDHGQEGA

SEQ ID NO: 88040 - protein, 399 aa, Rickettsia sibirica 246
MALIIQKFGGTSVANIDRIKKIVPIIKTEIAKNNQVIVVVSAMAGVTNQLVTLCNEVSSLNNISQFAEYDVALSSGEIVTASLLALALQEEDIKARSFLAWQLPMLTDNNHSKALVESITTDLLEKYLQLNTIPIIAGFQGINKSNRLTTLGRGGSDTTAALIAAAMKADRCDIYTDVEGIFTADPRIIPNAKKIKEIDFLEMLELASSGAKVLHPRAGELVMRYKIDMRVLSTFSPDTEGTLITSKDKNMENGIINSITSNKNLLKIFVKSISLSFLQVANMITQNNNHIEFMQTNNEEYSFITNLTDKNNLQALLTNLKEDKQIQDFTFDTEIATISLIGYGIKNDCKLLETILSKLTNDNIDVHMIQLSEVKITLFINDQDAEKTIFNLYNLFKIS

SEQ ID NO: 88041 - protein, 755 aa, Yarrowia lipolytica CLIB122
MKFGGQSLVLTSMKRGIERHVGKFYTRKIAAKNIKVERRQSSNDGEAIQRFFEQQQQVLLAQTKIIALDGGAVTVPEEELYRMVETFCRHGKGAQCWQSLFKECIEPLTTKCLENIEAISQAGLKSITAAFLDEYDMWRSRILKLQLIYFYLDRSFLLQSGNGGSDILRRCQDLVRDRIYAVISQRVETDFASIFANLVRGASDSALLLQQCENVVRELCGESSEQYQRIIKTVAVQSRLYFKLQAEKWQIMSPVQYLQLVVDTQVTEHRRIQELIKDSSRVEMIMSALPEEMIVPHVQFIRRGVTESFEDELMFPYIRQLSLLSFEGSEQQLRIGDIFRQWIETVLGPTFTNIDIVVQSYHKSSRVTEALADADLINKAPDWVAGFRNSMRGKRNLSEQLAKFSDSLLRKGAKGGDSLKNTADVKTLTFLLSCIPEKDVFEVYYKRYLSKRLLVGRALGLESESELLTILRDEFGPELTESMETMLKDVRTNSPATMAQYRDSEIYTKYGNFDLNVNMLSQNAWPQFPASTSPIRLPSQMYSQLDNFSKFLSQDPKNTKKKVTWQHALSSCTIRAHLNEDTKEFDVSLHQALVMMQFVDEKKRPHMTFADLLAATGISERELTMSLHSLMTPKVKILIKEEGDETRYKFNWNFSSKLRRVKVPSVARGADDIMLPHKAIQDTLERDRNMEIQAVIIRIMKARRTVGHAELVMEVLDKTKSRGILEVADVKKNISKLITDDFISRQGRDVYDYVA

SEQ ID NO: 88042 - protein, 181 aa, Brassica napus
MAKATSPIFLLLLLVILSSTLLSVKPNTTTIETTCKTTNYYRLCVSALKSDPRSPTADTKGLATIMVGFGMKSATATATYIAGNHTAAAANDTVLRKVLKDCSDKYALAADSLRLTVQDLDDEAYDYAYMHVLAAQDYPNVCRNIFRRAKGLVYPTEIRRREVSLRRICGVVSGILDRLAE

SEQ ID NO: 88043 - protein, 244 aa, Synechococcus sp. CC9311
MAATHRPIQIIPSVLPADWAAMGQCVKDLEDAGVDRIQFDVMDGNFVPNLTFGPELIKACRRYCNVPFETQLMVSQYNCETMLEEYVEATKGANGEPGVVIAHVEANTHLHRILGRIRQLGGSPSVALNPHTPMEMVKDVLDLVDHVLVMTVNPGFGGQAYIPTMLNKISELRKNIVERNLDVDIEVDGGIKANWTISQCCAAGANCFIAGSGMFAYPSLKEGCDDLRRVASEAQSGNVLSTPA

SEQ ID NO: 88044 - protein, 550 aa, Shigella flexneri 2a str. 2457T
MPFRALIDVCWKEKYTAARFTRDLIAGITVGIIAIPLAMALAIGSGVAPQYGLYTAAVAGIVIALTGGSRFSVSGPTAAFVVILYPVSQQFGLAGLLVATLLSGIFLILMGLARFGRLIEYIPVSVTLGFTSGIGITIGTMQIKDFLGLQMAHVPEHYLQKVGALFMALPTINVGDAAIGIVTLGILVFWPRLGIRLPGHLPALLAGCAVMGIVNLLGGHVATIGSQFHYVLADGSQGNGIPQLLPQLVLPWDLPNSEFTLTWDSIRTLLPAAFSMAMLGAIESLLCAVVLDGMTGTKHKANSELVGQGLGNIIAPFFGGITATAAIARSAANVRAGATSPISAVIHSILVILALLVLAPLLSWLPLSAMAALLLMVAWNMSEAHKVVDLLRHAPKDDIIVMLLCMSLTVLFDMVIAISVGIVLASLLFMRRIARMTRLAPVVVDVPDDVLVLRVIGPLFFAAAEGLFTDLESRLEGKRIVILKWDAVPVLDAGGLDAFQRFVKRLPEGCELRVCNVEFQPLRTMARAGIQPIPGRLAFFPNRRAAMADL

SEQ ID NO: 88045 - protein, 409 aa, Bacillus licheniformis ATCC 14580
MIKRYTCQNGVRIVFENNPTVRSVAIGVWIGTGSRHETPEINGISHFLEHMFFKGTKTRTARDIAESFDRIGGQVNAFTSKEYTCYYAKVLDEHASYALEVLSDMFFHSSFDEEELKKEKNVVYEEIKMYEDTPDDIVHDLLSKASYGSHSLGYPILGTEETLAEFDGDSLRKYMNEYYTPDRVVISIAGNVPETFIKEAEKHFGSYEAKGKRTGMTKPDFHHEKMTRKKETEQAHLCLGFNGLEAGHPEIYDLIVLNNILGGSMSSRLFQDVREDKGLAYSVFSYHTSYEDSGMMTIYAGTGANQLQLLSETIHETLRALKSDGITPKELENSKEQMKGSLMLSLESTNSKMSRNGKNELLLGKHRTLDEIIEKLNAVSLERVNNLANRIFTDDYSSALISPSGELPK

SEQ ID NO: 88046 - protein, 315 aa, Shigella flexneri 2a str. 2457T
MPDMKLFAGNATPVLAQRIANRLYTSLGDAAVGRFSDGEVSVQINENVRGGDIFIIQSTCAPTNDNLMELVVMVDALRRASAGRITAVIPYFGYARQDRRVRSARVPITAKVVADFLSSVGVDRVLTVDLHAEQIQGFFDVPVDNVFGSPILLEDMLQLNLDNPIVVSPDIGGVVRARAIAKLLNDTDMAIIDKRRPRANVSQVMHIIGDVAGRDCVLVDDMIDTGGTLCKAAEALKERGAKRVFAYATHPIFSGNAANNLRNSVIDEVVVCDTIPLSDEIKSLPNVRTLTLSGMLAEAIRRISNEESISAMFEH

SEQ ID NO: 88047 - protein, 321 aa, Streptococcus pyogenes MGAS10394
MKKILVLHTGGTISMQADNSGRVVPNQDNPMTKIHAAAQNIQLTVSDFLNLPSPHITPHHMLSIYHHIQERTDVFDGIVITHGTDTLEETAYFLDTMALPTNIPVVLTGAMRSSNEVGSDGIYNYLTALRVASSDKAKEKGVLVVMNDEIHAAKYVTKTHTTNISTFQTPTHGPLGIIMKNDLLFFKTAEPRIRFDLRCISGTIPIIKAYAGMGDGSILSLLTPGSIQGLVIEALGAGNVPPLAVGEIEHLITLGIPIVLVSRCFNGMAEPVYAYEGGGAMLQEAGVMFVKELNAPKARLKLLIALNAGLTGQELKDYIEG

SEQ ID NO: 88048 - protein, 138 aa, Glycine max
  misc_feature (32)..(32): Xaa can be any naturally occurring amino acid
  misc_feature (42)..(42): Xaa can be any naturally occurring amino acid
  misc_feature (47)..(47): Xaa can be any naturally occurring amino acid
ISSHSHRHTDTVTLLQILHCYCSSLPSDLRRXSTVTRAYLDXKLAAXRRCSREAAVAGAKAAAVATVAAAVPTLASVRMLPWARAHLNPTGQALIISTVAGMAYFIVADKTILSMARKHSFDDAPDHLKNTSFHISPQ

SEQ ID NO: 88049 - protein, 418 aa, Shigella flexneri 2a str. 2457T
MTLLALGINHKTAPVSLRERVSFSPDKLDQALDSLLAQPMVQGGVVLSTCNRTELYLSVEEQDNLQEALIRWLCDYHNLNEEDLRKSLYWHQDNDAVSHLMRVASGLDSLVLGEPQILGQVKKAFVDSQKGHMKASELERMFQKSFSVAKRVRTETDIGASAVSVAFAACTLARQIFESLSTVTVLLVGAGETIELVARHLREHKVQKMIIANRTRERAQILADEVGAEVIALSEIDERLREADIIISSTASPLPIIGKGMVERALKSRRNQPMLLVDIAVPRDVEPEVGKLANAYLYSVDDLQSIISHNLAQRKAAAVEAETIVAQETSEFMAWLRAQSASETIREYRSQAEHVRDELTAKALAALEQGGDAQAIMQDLAWKLTNRLIHAPTKSLQQAARDGDNERLNILRDSLGLE

SEQ ID NO: 88050 - protein, 313 aa, Triticum aestivum
ARSKEAAGMMALHEALRNVCLNSDWTYSVFWTIRPRPRCRGGNGCKVGDDNGSLMLMWEDGFCRPRMAECLEDMEGEDPVRKAFSKMSIQLYNYGEGLMGKVASDKCHKWVFKEPSECEPNIANYWQSSFDALPTEWTDQFASGIQTIAVIQAGHGLLQLGSCKIIPEDLHFVLRMRHMFRVPEPGEPLEQGEEDGEHPERQVQEELHVAGEDELVQLAVPVGVGVDGAGAAAAAAARDGVPSAARGQRLLGPHGDVLGVATQRNACMHASIDHPHDDKRTDFTFSCSHFLFCSNQPGYVQALLASGLEFASA

SEQ ID NO: 88051 - protein, 289 aa, Spinacia oleracea
MASAAFSLLPSTSSTTFNRHATTKLLNLKFLHNHRNKPFFTTTIKSLSSPSPTPVLTQDDLKKLAAEKAVDSVKSGMVLGLGTGSTAAFAVSRIGELLSAGKLTNIVGIPTSKRTAEQAASLGIPLSVLDDHPRIDLAIDGADEVDPDLNLVKGRGGALLREKMVEAASDKFIVVVDDTKLVDGLGGSRLAMPVEVVQFCWKYNLKRLQEIFKELGCEAKLRMEGDSSPYVTDNSNYIVDLYFPTSIKDAEAAGREISALEGVVEHGLFLGMASEVIIAGKTGVSVKTK

SEQ ID NO: 88052 - protein, 311 aa, Arabidopsis thaliana
MEKYEKLEKVGEGTYGKVYKAMEKTTGKLVALKKTRLEMDEEGIPPTALREISLLQMLSQSIYIVRLLCVEHVIQSKDSTVSHSPKSNLYLVFEYLDTDLKKFIDSHRKGSNPRPLEASLVQRFMFQLFKGVAHCHSHGVLHRDLKPQNLLLDKDKGILKIADLGLSRAFTVPLKAYTHEIVTLWYRAPEVLLGSTHYSTAVDIWSVGCIFAEMIRRQALFPGDSEFQQLLHIFRLLGTPTEQQWPGVMALRDWHVYPKWEPQDLSRAVPSLSPEGIDLLTQMLKYNPAERISAKAALDHPYFDSLDKSQF

SEQ ID NO: 88053 - protein, 525 aa, Burkholderia vietnamiensis G4
MADLNPQITPAWQALERLAGHYALGFDLRQAFATEPKRFQQHSVRAPHMLVDLSKNLWDEPVVEQLLALAMQMGLPDRRSQLLNGEIVNHTEHQAAVHAALRLAFTSGTATALPAMAQNCADLSAMLAMAEIIRADVTVHDVVHIGIGGSSLGPELALQALRPYWRTQQRIHVVSNLDGHDLAETLAQCHPAHTLFVAASKSWSTFETLQNLHSATGWLQQSGINPADRIVAITAKPHVAQAAGVKHILRMPADLGGRYSVWSAVGLPVAVAIGKAGFRELLAGAAAMDAHFAQAPLVQNAPVLLGLLDVWYNSFLRMPSRCVAPYHHRLRRLPAYLQQLDMESNGKTVRQNGDAVAYATGMALWGESCTNGQHAFFQWLHQGPQRTQVEFVAASQAEHALPGHHTPLLANAVAQAQALMLGSKAGLGQLPGHQDFPGNRPSTFLLLDGPLSPPALGALLALYEHRTFVSGVVWGINSFDQWGVELGKELAQDILQRVPGGHWQGLDASTAGLLNAACVTSEAHS

SEQ ID NO: 88054 - protein, 427 aa, Hordeum vulgare
MANKHLSLSLFLVLLGLSASLASGQVLFQGFNSESWKHNGGWYNFLMGKVDDIAAAGITHVWLPPASQSVAEQGYMPGRLYDLDASKYGNKAQLKSLIGALHGKGVKAIADIVINHRTAEHKDGRGIYCIFEGDTPDARLDWGPHMICRDDRPYADGTGNPDTGADFGAAPDIDHLNLRVQKELVEWLNWLKADHRLDGWRFDFAKGYSADVAKIYIDRSEPSFAVAEIWTSLAYGGDGKPNLNQDQHRQELVNWVDKVGGKGPATTFDFTTKGILNVAVEGELWRLRGTDGKAPGMIGWWPAKAVTFVDNHDTGSTQHMWPFPSDRVMQGYAYILTHPGTPCIFYDHFFDWGLKEEIDRLVSVRTRHGIHNESKLQIIEADADLYLAEIDGKVIVKLGPRYDVGNLIPGGFKVAAHGNDYAVWQKI

SEQ ID NO: 88055 - protein, 715 aa, Pseudomonas fluorescens PfO-1
MIYEGKAITVKALESGIVELKFDLKGESVNKFNRLTLNELRQAVDTIKADASIKGVIVSSGKDVFIVGADITEFVDNFKLPDAELVAGNLEANKIFSDFEDLNVPTVAAINGIALGGGLEMCLAADYRVMSTKAKIGLPEVKLGIYPGFGGTVRLPRLIGADNAIEWIAAGKENRPEDALKVGAVDAVVAPEKLQDAALELIKRAVSGEFDYKAKRQPKLEKLRLNAIEQMMAFETAKGFVAGQAGPNYPAPVEAIKTIQKAANFGRDKALEVEAAGFVKLAKTSAAQSLIGLFLNDQELKKKAKAYDEIAKDVKQAAVLGAGIMGGGIAYQSASKGTPILMKDINEHGIEQGLAEAAKLLVGRVDKGRMTAAKMAEVLNGIRPTLSYGDFGHVDLVVEAVVENPKVKQAVLAEVEDKVKEDTILASNTSTISISLLAKALKRPENFVGMHFFNPVHMMPLVEVIRGEKSSELAIATTVAYAKKMGKNPIVVNDCPGFLVNRVLFPYFGGFAKLVSAGVDFVRIDKIMEKFGWPMGPAYLMDVVGIDTGHHGRDVMAEGFPDRMKDDRRSAIDVLYEAKRLGQKNGKGFYAYEADKKGKQKKVADPSVLEVLKPIVYEQREVTDEDIINWMMIPLCLETVRCLEDGIVETAAEADMGLVYGIGFPPFRGGALRYIDSIGVAEFVALADQYADLGALYHPTAKLREMAKNGQSFFG

SEQ ID NO: 88056 - protein, 429 aa, Hordeum vulgare
MANKHMSLSLFLILLGLSCSLASGQVLFQGFNSESWKHNGGWYNFLMGKVDDIAAAGITHVWLPPASQSVAEQGYMPGRYYDLDASKYGNKAQLKSLIGALHGKAVKAIADIVINHRTAERKDGRGIYCIFEGGTPDARRDWGPHMICRDDRPYPDGTGNPATRRRADFGAAPDIDHLNPRVQKELVEWLNWLRTDVGFDGWRFDFAKGYSADVAKIYVDRSEPSFAVAEIWTSLAYGGDGKPNLNQDPHRQELVNWVNKVGGSGPATTFDFTTKGILNVAVEGELWRLRGTDGKAPGMIGWWPAKAVTFVDNHDNGSTKHMWPFPSDRVMQGYAYILTHPGNPCIFYDHFFDWGLKEEIDRLVSIRTRQDIHSESKLQIMEADADLYLAEIDGKVIVKLGPRYDVGHLIPEGFKVVAHGNDYAVWEKV

SEQ ID NO: 88057 - protein, 409 aa, Legionella pneumophila subsp. pneumophila str. Philadelphia 1
MSIEVKVPVLPESVADATVAAWHKKVGDKVSRDENLVDLETDKVVLEVPSPVDGVLSDILFNTGDTVGSGDLLAKISQSVSVESQKTEKEEKPVKKEEIKISESESVSTKEDKSTSPVVRRMMAENDLKAGQIQGTGKDGRITKEDVLSYIESNREKANQTAEVQKEPSMRALSFGGREEKRVPMTRLRAKIAERLLQAQHNAAMLTTFNEVNLKAVMDMRSQYKDSFEKKHGVKLGFMSFFTKAVVESLKRFPAVNASIDGQDIVYHGFYDIGIAVSTERGLVVPVIRDADQLSMAEIELAINDAASKARTGKLSMEEMQGGTFTITNGGVFGSLLATPIINPPQTGILGMHKIEERPIVEKGQIVIRPMMYVALSYDHRLIDGKDSVQFLVSVKELLEDPSRLLLNV

SEQ ID NO: 88058 - protein, 406 aa, Legionella pneumophila subsp. pneumophila str. Philadelphia 1
MFNCKARLDGSCFFKKVIRMNLHEYQAKQLFASYDLPVPRGEVAYNVEDALLVASQLSTSRWVVKAQVHAGGRGKAGGVKLVSSKDELAAVAKSMLGTRLVTYQTDARGQPVNAILVEETCEIDKELYLGAVVDRSTRRVVIMASTEGGVEIEKVAHETPEKIFKVVVDPLVGVMPFQCRETAFKLGLKDDQIKQFTHLMMGLGKMFVECDLSLLEINPLVITKSGQLICLDGKINIDGNALFRQPKLKNMRDVSQEDDRENRASDWELNYIPLDGTIGCMVNGAGLAMATMDVIKLHGGEPANFLDVGGGATKERVSEALKIIVSDEKVKGILVNIFGGIVRCDLIADGILAAVKEVDVKIPVVVRLEGNNAQLGAEILNKSNLNVIAATSLTDAAKKIVAAVSE

SEQ ID NO: 88059 - protein, 520 aa, Oryza sativa
MLMATVSPARREPTPQAVRASPMPSAAAALVRRGGGGSGGTVLGKYELGRVLGQGSFAKVYQARHLETDECVAIKVLDKEKAVKGGMVHLVKREINVLRRVRHPNIVQLFEVMASKTKIYFVMEYVRGGELFSRVSKGRLREDTARRYFQQLVSAVDFCHARGVFHRDLKPENLLVDENGDLKVSDFGLAAGPDQFDPDGLLHTFCGTPAYVAPEVLRRRGYDGAKADIWSCGVILFALMAGYLPFHDHNIMVLYRKIYNGEFRCPRWFSKDFTRLITRLLDANPKTRITVPEIIESDWFKKGYKPVKFYIEDDKLYNLSDDVLNLEPADPVPPPLGLAPPVPPPPQGDDPDGSGSESDSSVVSCPATLSTGESQRVRGSLPRPASLNAFDIISFSKGFNLSGLFEERGNEIRFVSGEPMSDIVKKLEEIAKVKSFTVRRKDWRVSIEGTREGVKGPLTIGAEIFELTPSLVVVEVKRKAGDNEEYEDFCNMELKPGMQHLVHQMLPAPNGTPVSEKVER

SEQ ID NO: 88060 - protein, 232 aa, Mycobacterium avium subsp. paratuberculosis K-10
MPCNTGQPRGPLIAPSILSADFSRLADEAAAVTGADWLHVDVMDNHFVPNLTIGLPVVQSLLATTTIPMDCHLMIENPDRWAPPYAEAGAHNVTFHAEATDNPIGVARDIRAAGAKAGISVKPGTPLEPYLEILPQFDTLLIMSVEPGFGGQSFIPEVLGKVRTARKLIDAGELTILVEIDGGINADTIEQAAEAGVDCFVAGLAVYGADDPAAAVEALRRQALGASQHLRR

SEQ ID NO: 88061 - protein, 338 aa, Helicobacter hepaticus ATCC 51449
MINIAINGFGRIGRSIMRVALQHKYKEHISIVAINDINDWEILSYLLENDTTHRTLPFEVSHTSNTLILKNNHNTYPPIRTFNHSNPKELDFAACGADIVIESSGQFLDSKQLTHHCEKGIKRVILSATPTDNMPTFALGVNHTLYAKESIISNASCTANALAPLCKIIDECFGIEVASFCIMHSYTNEQSLLDSVYPTNKRRSRAAAQNIIPTHTGATRTLMRILPELEGKIDGHSVRVPISNVLLIDITFNLSRQTTITELNNALINASKTSMKGIIGIDSKQGVSSDFIGNPHSVVFAPDLSYIVNGNMARVMAWCDNEWGYANRLLDMAQFISS

SEQ ID NO: 88062 - protein, 228 aa, Oryza sativa
GLGKLATRSPRLRKLHVDGWKANRIGDRGLAAVAQKCAALQELVLIGVNLTSASLELIAANCPALERLALCGSDTFGDAEISCVATKCAALRKLCIKACPVSDAGMDKLAQGCPRLVKVKVKKCQGVTPECAERLRASRNGALAVNVDTPGGAGELQDARSVDESGVLENAGSDTLPDDLDDRIGGPDLSCGSSGRPSGWKARMGAFMSRSLSVSMFRRRPRVSCYES

SEQ ID NO: 88063 - protein, 80 aa, Zea mays
  misc_feature (38)..(38): Xaa can be any naturally occurring amino acid
EIIDRQAAWRRVVCLAINNGVSTPGMSASLAYFDSYRXDRLPANLVQAQRDYFGAHTYERVDMPGSFHTEWFKIARNSKI

SEQ ID NO: 88064 - protein, 425 aa, Mycobacterium avium subsp. paratuberculosis K-10
MTRLDSVERAVADIAAGKAVIVIDDEDRENEGDLIFAAEKATPEMVAFMVRYTSGYLCVPLDGAICDRLGLLPMYAVNQDKHGTAYTVTVDARNGVGTGISASDRATTMRLLADPTSIAEDFTRPGHVVPLRAKDGGVLRRPGHTEAAVDLARMAGLQPAGAICEIVSQKDEGSMAQTDELRVFADEHDLAMITIADLIEWRRKHEKHIERIAEARIPTRHGEFRAIGYTSIYEEVEHVALVRGEIAGPNSDGDDVLVRVHSECLTGDVFGSRRCDCGPQLDAAMAMVAREGRGIVLYMRGHEGRGIGLMHKLQAYQLQDAGEDTVDANLKLGLPADARDYGIGAQILVDLGVRSMRLLTNNPAKRVGLDGYGLHIIERVPLPVRTNAENIRYLMTKRDKMGHDLAGLDDFHESVHLPGEFGGAL

SEQ ID NO: 88065 - protein, 160 aa, Mycobacterium avium subsp. paratuberculosis K-10
MSPAAGVPEMPALDASGVRLGIVASTWHSRICDALLAGARKVAADSGVDNPTVVRVLGAIEIPVVAQELARNHDAVVALGVVIRGQTPHFEYVCDAVTQGITRVSLDASTPVANGVLTTDNEQQALDRAGLPESAEDKGSQAAGAALSAALTLRELRARS

SEQ ID NO: 88066 - protein, 181 aa, Oryza sativa
MGLTFSSLFQQLFGKKQMRILMVGLDAAGKTTILYKLKLGEIVTTIPTIGFNVETVEYKNISFTVWDVGGQDKIRPLWRHYFQNTQGLIFVIDSNDKERVSEARDELQRMLSEDELRDAILLIFANKQDLPNAMNAAEITDQLGLHSLRNRQWYIQSTCATSGDGLYEGLDWLSNQLKNVK

SEQ ID NO: 88067 - protein, 404 aa, Bacillus licheniformis ATCC 14580
MKIIVQKFGGTSVKDDRGRKLALNHIKEAVNEGYKAVVVVSAMGRKGDPYATDSLLDLLYGGQDTITEREQDMLLSCGETISSVVFASMLLENGIKAAALTGAQAGFLTDNNHTNAKILEMKPERLVSMLADHDAVVVAGFQGATAKGDITTIGRGGSDTSAAALGAALDAEFIDIYTDVEGVMTADPRIVEKAKPLPVITYTEICNLAYQGAKVIHPRAVEIAMQAKVPIRVRSTYSNETGTLVTSHHNSKAGSDVFERLITGIAHVKDVTQFKVPAKEGQYNVQTEVFKAMANAGISVDFFNITPSEIVYTVAGNMTDRAHSILKELGYEPAVTRNCAKVSAVGAGIMGVPGVTSKIVTALSEKGIPILQSADSHTTIWVLVHEKNMATAVNALHEVFELSK

SEQ ID NO: 88068 - protein, 511 aa, Glycine max
  misc_feature (362)..(362): Xaa can be any naturally occurring amino acid
MYRNAASRLRAIKARSCSSSSRVPASARFASSVATQQSSSSGLGGLFGWLTGDRTSSLPSLGFPLPGVTLPPPLPDYVAPGKTIITTLPNGLKVASETSPSPTASIGLYVDCGSIYESPISFGATHLLERMAFKTTRNRSHFRVVREVEAIGGNVQASASREQMGYTFDALKTYVPEMVELLVDCVRNPVFLDWEVNEQLLKVKAEIGEASKNPQDLLLEAIHSAGFSGALANPLLASESAVNRLNSTILEEFVAENYTAPRIVLAASGVEHEELLSIAEPLLSDLPSVPRPEEPKSVYTGGDYRCQKESGRTHFALAFELPGGWHKLKDAMVLTVLQMLLGGGGSFSAGGPGKGMYSRLYXKFLNEYPQVHEISAFNNIYNDTGIFGIQVTTGSDFVSKAIDIAANEILAVATPGQVDQVQLDRAKQATKSAILMNLESRMVVSEDIGRQILTYGERKPVEDFLKAVDEVTSKDITSISRKLICSPLTMASYGDVLYVPSYESVSLKFRA

SEQ ID NO: 88069 - protein, 473 aa, Pyrococcus furiosus DSM 3638
MIHYETLVYGGDHVNIKKLTPLLTLLLFFIVLASPVSAAKYLELEEGGVIMQAFYWDVPGGGIWWDHIRSKIPEWYEAGISAIWLPPPSKGMSGGYSMGYDPYDYFDLGEYYQKGTVETRFGSKEELVRLIQTAHAYGIKVIADVVINHRAGGDLEWNPFVGDYTWTDFSKVASGKYTANYLDFHPNELHCCDEGTFGGFPDICHHKEWDQYWLWKSNESYAAYLRSIGFDGWRFDYVKGYGAWVVRDWLNWWGGWAVGEYWDTNVDALLSWAYESGAKVFDFPLYYKMDEAFDNNNIPALVYALQNGQTVVSRDPFKAVTFVANHDTDIIWNKYPAYAFILTYEGQPVIFYRDFEEWLNKDKLINLIWIHDHLAGGSTTIVYYDNDELIFVRNGDSRRPGLITYINLSPNWVGRWVYVPKFAGACIHEYTGNLGGWVDKRVDSSGWVYLEAPPHDPANGYYGYSVWSYCGVG

SEQ ID NO: 88070 - protein, 438 aa, Hordeum vulgare
MGKNGSLCCFSLLLLLLLAGLASGHQVLFQGFNWESWKQSGGWYNMMMGKVDDIAAVGVTHVWLPPPSHSVSNEGYMPGRLYDIDASKYGNAAELKSLIGALHGKGVQAIADIVINHRCADYKDSRGIYCIFEGGTSDGRLDWGPHMICRDDTKYSDGTANLDTGADFAAAPDIDHLNDRVQRELKEWLLWLKSDLGFDAWRLDFARGYSPEMAKVYIDGTSPSLAVAEVWDNMATGGDGKPNYDQDAHRQNLVNWVDKVGGAASAGMVFDFTTKGILNAAVEGELWRLIDPQGKAPGVMGWWPAKAATFVDNHDTGSTQAMWPFPSDKVMQGYAYILTHPGIPCIFYDHFFNWGFKDQIAALVAIRKRNGITATSALKILMHEGDAYVAEIDGKVVVKIGSRYDVGAVIPAGFVTSAHGNDYAVWEKNGAAATLQRS

SEQ ID NO: 88071 - protein, 453 aa, Pseudomonas fluorescens PfO-1
MSFIIWVAVLGAVLLTLALTSSYLRWMPVTTSAVCLLLGVGIGPASLDLLKLPLNEASLWMEHLTEVAVLFSLFVCGLKLRLPLRDKRWRIAFGLAGPVMVLTIIGVCLLLHFGLDLNWGSSLLIGAILAPTDPVLAALVQVNDARDVDSVRFGLSGEAGLNDGVAFPFVIFGLLLLNGEGFAAEWPDWVLRSLVWAVPAGLLCGYWMGRGIGRLTLSLRIRNDDSTLSPNDYLALALIALAYVVAESIGGYGFLSVFAAGLGLRQEEVKSTGAHQPPAEHMVQPVVGHQNVEPQQAVHGDTERLEDSQVAAGIMMGDMLAFGGLVERAMEVFLVTLLGVVLVSHWDWRALLVGGVLFCVIRPVCVALMPWGSLLAGGQRLLIGWFGIRGIGSLFYLFYALNHGLGDSVGTLCTDLTLSVVALSILLHGISTQPILARYERRKKPVNPKQDGR

SEQ ID NO: 88072 - protein, 437 aa, Hordeum vulgare
MGKKSHICCFSLLLLLFAGLASGHQVLFQGFNWESWKQSGGWYNMMLGKVDDIAAAGVTHVWLPPPSYSVAGEGYMPGRLYDIDASKYGNAAELKSLIGALHGNGVQAIADIVINHLCADYKDSRGIYCIYEGGTSDSRLDWGPHMICRDDTKYSDGTANLDTRADYADAPDIDHLNHRVQSELKEWLLWLKSDLGFDAWPLDFARGYSAEMAKVYIDGTSPSLAVAEIWDGMVPGGDGKPNYDQDAHRQNLVNWVDKVGGRASAGMVFDFTTKGILNVAVEGELWRLIGPASKAPGVMGWWPAKAVTFIDNHDTGSNGSKWPVPSDKIMQGYAYILTHSGIPCIFYDHFFNLGFKDEIAALVAIRKRNGITATSALKILMHDGDAYVAEIDSKVVVKIGSRYELGAVIPARFVTSANGKDYAVWEKIAAGPTLQRS

SEQ ID NO: 88073 - protein, 548 aa, Burkholderia vietnamiensis G4
MGTVSLGKIAFTWRGAYDASATYARQDVVGHHGDSFVCLADATKGVAPHANSPAWDLFAQGTQGVSNLPGEVIYFDGNQLVALPAGQSGQVLTIGAQGVPVWAMPDVRSGTKALKLPENASNTQPNSYRQFGLIMTDGSIRAWGRNVNFKLGDGTTFARSYPARTAFPPGFPGADKLYYSHDTNGYCIDKNGQLWGWGFNGYGQLGTGNTTNQPVPYNMSANASNSIAGKTVLQLALNCGTEGYNSTLVLCSDGTVHACGYNGYGQLGLGDVTQRNNFVQLPVLSGITHIAAGRERYTACYAVNNDGTLYSWGYNGNGQLGDGTTNQANVAMPRAGGSLAGKTLVKVFGGYVHAFALDSTGALHAWGTNDYGQLGNGNLANQFTPLQVATNVADVYAGSYDYPLTFLKKTDKTLWACGAGAYWGNANGSNSGNFVQVPVGNTVVKAVHGGTGSYNYGAALLENGTVCAWGYNGNGALGLGDATNRSSVELVRIAQRRVVDLSSYGSSSEQGLVFLLDDGQVLASGYAGEAQLPEDDSETSYVPYPVIL

SEQ ID NO: 88074 - protein, 427 aa, Hordeum vulgare subsp. vulgare
MANKHMSLSLFIVLLGLSCSLASGQVLFQGFNWESWKHNGGWYNFLMGKVDDIAAAGVTHVWLPPASQSVAEQGYMPGRLYDLDASKYGNKAQLKSLIGALHGKGVKAIADIVINHRTAERKDGRGIYCIFEGGTPDARLDWGPHMICRDDRPYADGTGNPDTGADFGAAPDIDHLNPRVQKELVEWLNWLRTDVGFDGWRFDFAKGYSADVAKIYVDRSEPSFAVAEIWTSLAYGGDGKPNLNQDPHRQELVNWVNKVGGSGPATTFDFTTKGILNVAVEGELWRLRGTDGKAPGMIGWWPAKAVTFVDNHDTGSTQHMWPFPSDRVMQGYAYILTHPGTPCIFYDHFFDWGLKEEIDRLVSIRTRQGIHSESKLQIMEADADLYLAEIDGKVIVKLGPRYDVGHLIPEGFKVVAHGNDYAVWEKV

SEQ ID NO: 88075 - protein, 558 aa, Burkholderia vietnamiensis G4
MNLDISALGYRWCGLYSPYLGYRDGDVVFKEGGAWVMRHGQPQPFALGQQDATLKGHLLTGGVSVGGIGSMVLHANGANGVDGVEFRFMADRNGTVATALMNTDRAAADYHSANFFMAALMNDGSVRAWGRALTGQQGTGNTGDISRTFPARVAFPPGTPRITSITCMWDETFFIDASGGLWHAGANSDGGSPTATANPVPRRVNGVGQLPAAAVVKRVFTGHDWYGYRMFACLDDVGRVYVWGNNRYGSLGLGHSTTVSTPTLVPFTLDTPIREVFLSGGFHAASYLVDTQGKLWVAGEANACGFGSDQSVHRLLMPWGSDKRVKKVFCSESDGHWVAGAQYYRAYGVVLEDGSLYRWGHDSGQVGGSWGTGFTGDIWTGHALFPYKVLDGVTDAYAISGGYGRTLALMQDGTVRHTGYNGYSIGGGSDRTTWATIGGDFLTQVTKLRVYGSSYGSSAMALRSDGKAVGWGMGATGQCGHGYADTSNAPSRFVLIDRPIVDFSRSGTMGCGEGGEYHNGAYHFLTVDGQVMSTGNGSHAQTGDDDHDHRYAPSPILF

SEQ ID NO: 88076 - protein, 167 aa, Triticum aestivum
  misc_feature (4)..(4): Xaa can be any naturally occurring amino acid
  misc_feature (56)..(57): Xaa can be any naturally occurring amino acid
  misc_feature (76)..(77): Xaa can be any naturally occurring amino acid
  misc_feature (82)..(84): Xaa can be any naturally occurring amino acid
  misc_feature (106)..(106): Xaa can be any naturally occurring amino acid
  misc_feature (116)..(116): Xaa can be any naturally occurring amino acid
  misc_feature (129)..(130): Xaa can be any naturally occurring amino acid
  misc_feature (135)..(140): Xaa can be any naturally occurring amino acid
  misc_feature (147)..(148): Xaa can be any naturally occurring amino acid
  misc_feature (152)..(153): Xaa can be any naturally occurring amino acid
  misc_feature (162)..(166): Xaa can be any naturally occurring amino acid
MDHXDTGCQSREGPILCVNNCGFFGKAATMNMCSKCHKDMAMKQEQAKLAASSFDXXINGGDAAKEHLAAGNTAVXXAHVEXXXLITAQPADIDGPSDAAMDNPKXPSRCSTCRKXVRLTGFNCRCGNXXCATHXXXXXXECKFDYXXAAMXXISNANPVVXXXXXD

SEQ ID NO: 88077 - protein, 231 aa, Oryza sativa
  misc_feature (68)..(68): Xaa can be any naturally occurring amino acid
  misc_feature (82)..(82): Xaa can be any naturally occurring amino acid
MEGKEEDVRLGANKFSERQPIGTAAQGSDDKDYKEPPPAPLFEPGELKSWSFYRAGIAEFMATFLFLXYITVLTVMGVNNSXLHCLGAICGAGVVKGFQKGLYETTGGGANVVAPGYTKGDGLGAEIVGTFILVYTVFSATDAKRNARDSHVPILAPLPIGFAVFLVHLATIPITGTGINPARSLGAAIIYNRGHAWDDHWIFWVGPFIGAALAAIYHQVVIRAIPFKSRS

SEQ ID NO: 88078 - protein, 122 aa, Oryza sativa Japonica Group
FKWAEVSGDGTLQVDYFTFSPSIADYIRDASLVISHAGSGSIFETLRHGKPLIVVVNEDLMDNHQSELAEELATRKHLFCASPQTLGETIQEMDIETLNPYVPGDAKPVVSLINKFFGFPDD

SEQ ID NO: 88079 - protein, 315 aa, Legionella pneumophila subsp. pneumophila str. Philadelphia 1
MSTMMIFTGNANPELALKISSHLQIPIGKATVGTFSDGETMVEILENVRGKDVFVLQSTCAPANNNLMELLIMADALRRSSAGRITAVVPYFGYARQDRRVRSARVPITAKVVADMMASVGICRVLTVDLHADQIQGFFYMPVDNVYSTPVLLEDITKQKLNNIMIVSPDVGGVVRARAVAKRLNDAELSIIDKRRSGPNKSEVMHIIGEPANKNCIIVDDIVDTAGTLCTAAHELKKNGAKSVRAYITHPVLSGPAVNNIKHSGLDEVVVTDTIPLSAEAQNCEKIRVVSLADMLAQAIKRVNVEESVSSMFAE

SEQ ID NO: 88080 - protein, 176 aa, Physcomitrella patens subsp. patens
PSKQMNRLIALGSVVFAVGLFVSGRLEGVARPGLSQLSANAVPYEEALANGRPTVVEFYADWCEVCREMAKDVYQVEEEYRDRINFVMLNVDNPKWEPELDEFGVEGIPHFAFLDAKGNEEGNIVGRLPPKFLRENVMALAKGETAVPHSSVVGSFSSADSRQAPQLVGPRSHSEN

SEQ ID NO: 88081 - protein, 508 aa, Aspergillus oryzae
MVHLSRVKRGKQAQKPQQEQDQGESAASPYVYGTHYATEELPEHVMSEREMPADVAFRLIKDELSLDGNPLLNLASFVTTYMEDEAQNLMTDAMSKNFIDFEEYPQTAHIQNRCINMIAHLLNAPTTEGDGELDTIGTSTIGSSEAIMLATLAMKKRWQNKRKAEGKDWTRPNIVMNSAVQVCWEKAARYFDVEEKYVYCTDTRYVIDPKTAVDMVDENTIGICAIMGTTYTGQYEDVKAINDLLKAKNIDCPIHVDAASGGFVAPFVRPELEWDFRLEKVVSINVSGHKYGLVYPGVGWVFWRSPEYLPEELIFNVNYLGSNQATFTLNFSKGASHVIGQYYQLIRLGKHGYRSIMQNLTKTSDYFADELKKLGFLIMSDGNGRGLPLVAFRMKPDDDRLYDEFALAHVLRQRGWIVPAYTMAPHSNQLKLMRVVLREDFTIHRCNILLEDIKAALKSLQEMDAEMIQKYTLHLRAHSAKKLPQQHAHYKNEKHSLQGKTGKTHGVC

SEQ ID NO: 88082 - protein, 181 aa, Physcomitrella patens subsp. patens
MASVVATSTVVAPAAFAASSSAVSTSESTSVKAFSGLKSSTLFSSKAQSLSSVQNGSRVQCMQVWNPIGMTKFETFSYLPPLSDDAIAKQVDYMIQQKLIPCLEFDNADGVSRTNNSSPGYYDGRYWTMWKLPMFGCQDPAQVLREIEECKKTFPGCFVRVLGFDNVKQVQICGFLVARPN

SEQ ID NO: 88083 - protein, 490 aa, Helicobacter hepaticus ATCC 51449
MKTILVITDGIGYSDKTQYNAFYHAKKPTYDYLFKNVPYGMIDTFGLSVGLPQGQMGNSEVGHMCIGSGRVLYQDLVRISRAIEYDEIKDNPALVEVTQQSAVVHLCGLLSDGGVHSHIVHLKALAQILSTQGKRVYLHLITDGRDVLPKSALNYLADIESICEDNVSIASVSGRFYAMDRDKRWDRVQKAYESIALGKNPTNLSPKEYIQSQYDEGIFDEFLTPVSFGGFQGMNDDESFVFVNFRSDRAREIVDCLGNPQFKEFKRERYVKLHIATMTEYDATFPYPILFPKQNVQNTLAEVISSHRLKQFHTAETEKYAHVTFFLNGGREEAFIGEERVLIPSPNVKTYDLQPQMNASAVGDAVIKAVEQGYDFVVVNFANGDMVGHTGNLEAAIKAVEAVDKELGRIVESAQKHHYALFITSDHGNCEEMKDEKGNMLTNHTVGQVWCFGMIEGVSKIENGGLNNIAPSVLKAMNLPIPPEMDKPLF

SEQ ID NO: 88084 - protein, 381 aa, Zea mays
  misc_feature (224)..(224): Xaa can be any naturally occurring amino acid
MASSTQGQVITCKAAVAYEANKPLVVEDVQVAPPQAGEVRIKILSTALCHTDYYTWSGKDPEGLFPCILGHEAAGIVESVGEGVTDVQPGDHVIPCYQAECRDCKMCNSGKTNLCGKVRGATGVGVMMSDRKSRFSVNGKPIYHFMGTSTFSQYTVVHDVSVAKINPQAPLDKVCLLGCGVSTGLGAVWNTAKVEAGSIVAVFGLGTVGLAVAEGAKSAGASRXIGIDIDIKKFDVAKNFGVTEFVDPKEHGKPIQQVLVDFSDGGGDYSFECIGNVLVLGGALECCPKGWGTSVFVGVAAFGQGIAPRPFQLVTGGVWKGTAFGGFKSRTPVPWLVGKYMKKEIKGGGFISPNMNLGGINDAFPLLHEGGCLRCVLPMQI

SEQ ID NO: 88085 - protein, 113 aa, Arabidopsis thaliana
  misc_feature (49)..(49): Xaa can be any naturally occurring amino acid
  misc_feature (93)..(93): Xaa can be any naturally occurring amino acid
NDPRRRGGNHSGGEYIFSHHHPHEAGGVNLGKGQTPTAQATKVAPFTGXKTTANYPGTRTDNNDITSITSNGGRVSSTKERPPIGKKKIETLXYLTEQSDVETAKEGDNQSRN

SEQ ID NO: 88086 - protein, 228 aa, Picea sitchensis
MAAAGAAAVFSCMPTMPTTGITTSSTRLAVGPIFKGANNGCKIQVTPLCTDFDGNANHWRRKSNTFTVSAAARQLTGSITKTEGLHFAVVAARFNDIVTKPLVEGALEAFRRYSVQEEDIDVIWVPGSFEIPLVVQTVAKSGKYHAVLCIGAVIRGDTTHYDAVANSAASGIVSASLNSGIPCIFGVLTCDNMEQALDRAGGKVGNKGAEAAVTAIEMASLFQHHIGR

SEQ ID NO: 88087 - protein, 321 aa, Bacillus cereus E33L
MVVNEKVELATFAGGCFWCMVSPFEEMEGIIKVVSGYTGGHKENPTYKEVCSETTGHYEAVQITFDANKMPYEELLNIYWRQIDPTDVGGQFHDRGQSYETVIFYHNEEQHKKAEASKEELAKSERFSKPIATKILPAATFYPAEEYHQGYHKKNTFRYELYRKGSGRDAFIKQHWPKDNAHLKEKLNEMQFYVTQENGTEPPFRNEYWNHKEEGLYVDIVSGEPLFTSIDKFDSGCGWPSFTKPVMSASVKEKMDVSHNMTRTEVRSKEGDSHLGHVFPDGPGPNGLRYCINSAALRFIPKEELEKEGYGDFLMLFGNKK

SEQ ID NO: 88088 - protein, 248 aa, Pyrococcus furiosus DSM 3638
MIIAFLGTAGSGKTTLTGAFGRYLEENYRVAYVNLDTGVENLPYKPDIDVRDFITVRDLMKEGYGPNGAIVESYDRLLTRVEHYINKILELEKSNDYVLIDTPGQMETFIFHEFGVKLMNNLPYPLVVYLSDPEILKRPHDYCFVRFFSLLIDLRLGATTVPALNKVDLLSEKEFERHKKYFEDIEYLTTKLKFDVSTQGLLAYKMCQVFPELSPPVRVLYLSAKTGVGFEDLETLAYEHYCTCGDLT

SEQ ID NO: 88089 - protein, 139 aa, Candida albicans SC5314
MKAYESGNGAYFATPAVQTITALKTSLDEILSQPIDERFAKHAQVSDKFKSNVEKLGLKILPVDHKVAAHGLTAVYFPDGINGPDLLKKLSEKGFVVAGGIHKKLVGKYFRVGHMGYSVYAGHVDKLTKALEESLNELK

SEQ ID NO: 88090 - protein, 639 aa, Vitis vinifera
MKPFHFLLFFTFSSLILLPTGKSDLASERAALLVLRSAVGGRSLLWNVSQSTPCLWVGVKCQQNRVVELRLPGMGLSGQLPAGSIGNLTELHTLSLRFNALSGSVPPDLASCVNLRNLYLQGNFFSGDIPEFLFTLSNLIRLNLAGNNFSGEISSDFNKLTRLGTLYLNDNHLTGSIPKLNLNLQQFNVSNNQLDGSIPSKLSNFPATAFQGNSLCGGPLQSCPHKSKLSGGAIAGIIIGSVVAFVLILVVLILLCRKKSSKKTGSTDVAPVKHTETEMLGEKSVGDGDSTSMGYPIRGAAVLAAAATSKGSGDKRLVFFRNSNRIFDLEDLLRASAEVLGKGTFGTAYKASLDMEVERVVVAVKRLKDVSVSEKEFREKIEIAGAMDHENLVPLRAYYYSKDEKLIVYDYMPMGSLSALLHGNRGAGRTPLNWEARSGIALGAARGIAYIHSRGSASSHGNIKSSNILLTKSYEARVSDFGLAHLVGPTATPNRVAGYRAPEVTDARKVSQKADVYSFGVLLLELLTGKAPTHALLNEEGVDLPRWVQSVVREEWTAEVFDLELLRYQNVEEEMVQLLQLALDCAAQYPDKRPSMLDVTSRIEELCRSSSQHEQEPDHNIINDVHSVDSGAPVPSVVD

SEQ ID NO: 88091 - protein, 215 aa, Candida albicans SC5314
MFKTLTTSKVIINKFNYKLIKPISLTNFKSISTTTTNLFNTNNNKMSFQYKQPEHKLTLIPGPIEFSDDVLASMATPSQAHTSPEFISTFQSVLKSLRKVFKSTDTNTQGYVLSGSGTLGWDVASSNLLNPGEKVLVLSTGFFSDSFAECLKVYGADVDVLTAEVGDVVPLDKIEQQLQKEKYSAITITHVDTSTSVVSDVEAISKVVKKFLSIL

SEQ ID NO: 88092 - protein, 663 aa, Oryza sativa
MSSKFLAMYLLLALLSHGTYSYSATTASGWEDQDFFRHCPVSRCSDGGPEIRFPHGLQSSNTSSACGASCAKLACSGQDTILHHPFLGPCKVTSIDYKEAIMSIIPLVYSSSPCPLQKLIFDNLQPYDYHRCKLYSWAPAKIVRCSKEFTPNGTSPVDGYAFMNNADYITGPISCPSEASHFSYLVDARLCMYVLPLDCRIVSRGSIPIPGPAYSDIGGPTFKERAEKFINFAETTVSWYSDDEVTINCTECERQKHRCAFSSQRNRTFCMSREHHGTIANFSKSNPITLLSILLQCADFPFSVYSATSSAAAFVVLSLIIATVLYISLKSRYDEEVHLKVEMFLRTYGTSKPTRYNFSDVKKIARRFKEQLGQGGFGSVYKGELPNGVPVAVKMIEHTTGNGEEFINEVATIGQIHHINIVRLLGFCSDGTRHILIYEFMPNESLEKYIFLHDPNTSQELLAANKMLDIALGIARGMEYLHQGCNQRILHFDIKPHNILLDYNFNPKISDFGLAKLCARDQSIVTLTKARGTMGYIAPELYSRNFGEISYKSDVYSFGMLVLEMVSGRRNSDPSIQNQNEVYFPEWIYEKVITGQDFVLSREMTEEDRLKVRQMALVALWCIQWNPRNRPSMTKVVNMLTGRLQNIEVPPKPFVSYESHAVP

SEQ ID NO: 88093 - protein, 421 aa, Oryza sativa Indica Group
MAFLGNGYCSSGSEGEDEDEGMEGYRKGGYHAARPGDRFAGGRFVAQRKLGWGNFSTVWLAYDTLLNRFVALKIQKSARDYAQAALHEIELLSAIAKGDPTNSKNAVQLLDHFKHAGPNGHHVCLVTEFLGDSLLRLIRYNRNKGIGLSRVKEICRSVLVGLDYLHRELGIIHTDLKPENVLLVSTINPSKDPVRSGFTPILERTVSNQYSGSVISFSEKMLKMRARRAVAKISLRRESLGGVAAEMEKERSLDGISLKCKIVDFGNACWGSQQLAGEIQTRQYRAPEVIIGAGYSYSADMWSFACMAFELATGEVLFAPKTCQGCSEDEDHLALMMETLGKMPKKIASSGTRSKDYFDRHGDLKRIRRLKFWPLERLLVQRYNFTEPDAQGLADFLRPILDFTPENRPTAAACLKNPWLN

SEQ ID NO: 88094 - protein, 396 aa, Salinibacter ruber DSM 13855
MGRRLHLEPLPKSCILGAKKPCFPHVSSHIPSTHVMTGSHRTSHAGDGAPEDDLGTFQTLEQFILDRQDSFPHSTGAFSRLLRDISLAAKIVNRDMRRAGLLDVYGSTGERNVQGEVQQKMDALAHREFVQALRRGGECCLIGSEEHAEAIPLSTVSKEGDGKYIVLLDPLDGSSNIDVNVSVGTIFSIYRLPDGYEEEEPDPAAALQPGTEQVAAGYVVYGSSTMLVYTTGNGVNGFTLDPSIGEFLLSHPDIQTPSRGRLSSINSGYYHSFEEGLRDYLDWLQQKDPETNRPAKTRYIGSFVSDFHRNLLKGGIYMYPATESSPAGKLRLMYEANPMGFIAEQAGGAASDGHRRILEKEPDKLHQRTPLFIGSEEMVRRAEAFLQGEPERALSA

SEQ ID NO: 88095 - protein, 193 aa, Bacillus licheniformis ATCC 14580
MFNLPNKITLSRIALIPVFMVIMLVPFQWGAVSFGSESIPVTHLIGALLFIFASVTDWVDGYYARKLNLVTNFGKFLDPLADKLLVSSALIILVHYHLAPAWMAIVIISREFAVTGLRLVLAGTGEVVAANMLGKVKTWAQIIAISALLLHNLPFELVSFPFGSLALWVAVFFTVVSGWDYFAKNWDALKTSN

SEQ ID NO: 88096 - protein, 325 aa, Oryza sativa Indica Group
MAAPDMSPKAGKPLVQNDAGSYLAWSGKDQPALAGEKLGCGLLVLKPLGFALPHYADSGKFGYVLGGSAVVGVLPVGVDARERVVRLEAADVIAMRAGEGTWCPGDFSYFILAGPMGVLGGLDAGLLATASGLTSPEQAATAFRSQPAALLTRLSRKLHGVRPREHDRHGIVVNAARVPPDSTGGKTVTAAHLPALAQLGLSVGLALLDAGAAVRGPWVLRDAAAQAVYVARGSGRVQVASAGGASTLLDAEVAAGSLLVVPRYAVALVAADDAGGMELVSLIKSSRPAMEQFTGKGSVIGGLTPEIVQAALNASPELVEQLRTK

SEQ ID NO: 88097 - protein, 340 aa, Oryza sativa Indica Group
MGWRPDMTGVKQTDKRVAIIGAGPAGLACADVLTRNGVKAVVFDRHPEIGGLLTFGIPAFKLEKEVMTRRREIFTGMGIEFKLNVEVGRDVQLDDLLKDYDAVFLGVGTYQSMRGGLENEDAPGVFDALPFLIANTKQIMGYGETADEPFVSMEGKRVVVLGGGDTAMDCVRTSIRQNAAHVICAYRRDEENMPGSKREVKNAREEGVEFQFNIQPLGIEVNANGKVSGVKMARTEMGAPDAKGRRRAEIVAGSEHVIPADAVVMAFGFRPHSMEWLAKHSVELDSQGRIIAPEGSDNAFQTSNPKIFAGGDIVRGSDLVVTAIAEGRKAADGIMNYLEV

SEQ ID NO: 88098 - protein, 619 aa, Zea mays
MSSISRNLRRSLAPDRLRRLSQHPREYVTSECHRPVVLHKRGPDILHDPWFNRGTAFSMTERDRLGLRGLLPPNVVSSQQQIDRFMLDLKRLQRYARDGPSDTYPLAKWRILNRLHDRNETMYYKVLIDNIEEYAPIVYTPTVGLVCQNYSGLFRRPRGMYFSAEDRGEMMSMVYNWPADQVDMIVVTDGSRILGLGDLGVHGIGIAIGKLDLYVAAAGINPQRVLPVMIDVGTNNEKLLKDPLYLGLQEHRLEGDEYVSVIDEFMEAVFTRWPNVIVQFEDFQSKWAFRLLQRYRKTYRMFNDDVQGTAGVAIAGLLGAVRAQGRPMIDFPKQRIVVAGAGSAGIGVVNAASRTMARMLGNNDVAFESARSQFWIVDAHGLITEDREDIDPDARPFARRKSELGHQGLSEGASLVEVVKKVKPDVILGLSAVGGLFSKEVLEALKDSSSSRPAIFAMSNPTKNAECTPGEAFSILGEKVIFASGSPFHDVDLGDGKIGHSNQGNNMYLFPGIGLGTLLSGARVISDGMLQAAAERLASYMKEEEVLEGIIYPPISRIRDITKEVAAAVVREAVAEDLAEGYRDMDARELARLSEEETNEYVKTNMWSPVYPTIIYKKD

SEQ ID NO: 88099 - protein, 497 aa, Pseudomonas putida GB-1
MSIVQHLIHGELVSKGERTADVFNPSTGQAVRKVELASRATVQEAIDSAKAAFPAWRNTPPAKRAQVMFRFKQLLEQNEAKISQMISEEHGKTLEDAAGELKRGIENVEFACAAPEVLKGEYSRNVGPNIDAWSDFQPLGVVAGITPFNFPAMVPLWMYPLAIACGNAFILKPSERDPSSTLYIAQLLLEAGLPKGILNVVHGDKEAVDALIEAPEVKALSFVGSTPIAEYIYAEGTKRGKRVQALGGAKNHAVLMPDADLDNAVSALMGAAYGSCGERCMAISVAVCVGDQVADALIAKLEPQIKALKIGAGTSCGLDMGPLVTAAARDKVVGYIDDGVAAGAKLVVDGRGLRVAGNEDGYFVGGTLFDKVTPQMRIYKEEIFGPVLCVVRVNSLEQAMQLINDHEYGNGTCIFTRDGEAARLFCDEIEVGMVGVNVPLPVPVAYHSFGGWKRSLFGDLHAYGPDGVRFYTRRKAITQRWPQRASHEASQFAFPSL

SEQ ID NO: 88100 - protein, 448 aa, Pseudomonas putida GB-1
MNMPETAPAGIASQLKLDAHWMPYTANRNFQRDPRLIVAAEGNYLVDDQGRKIFDALSGLWTCGAGHTRKEITEAVTRQLGTLDYSPAFQFGHPLSFQLAEKIAELVPGNLNHVFYTNSGSECADTALKMVRAYWRLKGQATKTKIIGRARGYHGVNIAGTSLGGVNGNRKMFGQLLDVDHLPHTVLPVNAFSKGMPEEGGIALADEMLKLIELHDASNIAAVIVEPLAGSAGVLPPPKGYLKRLREICTQHNILLIFDEVITGFGRMGAMTGSEAFGVTPDLMCIAKQVTNGAIPMGAVIASSEIYQTFMDQPTPEYAVEFPHGYTYSAHPVACAAGIAALDLLQKENLVQSAAELAPHFEKLLHGVKGTKNVIDIRNYGLAGAIQIAARDGDAIVRPYEVAMKLWKAGFYVRFGGDTLQFGPTFNTTPQELDRLFDAVGENLNLID

SEQ ID NO: 88101 - protein, 528 aa, Xanthomonas campestris pv. vesicatoria str. 85-10
MTTHAATTQGKFHKRLSLTDLTFIGLGSIFGSGWLFSASHVSSIAGPAGIVSWILGGIAVLLLGLVYCELGAALPRAGGVVRYPEYSHGALLGSLTGFITLIAFSSLIAIEVEAARQYAAAWFPWLSQPHSTHPSVAGWLVQLALLVLFFVLNYFSVKTFALANNIVSIFKFLVPILVIVLLMQHFDAGNLSVHGFAPSGMAGVEAAISAGGIIFAYLGLTPIVSVASEVRDPQRNIPIALILSVALSTVIYVLLQLAFLGSIPAAQLAQGWACIDKAFSLPYHDIALALGMAWLAALVICDAMVSPSGTGNIYMNATPRVVYGWARSGGFLPVLTRVDPASGIPRPALWLSLGLSIFWTLPFPSWETLIGVVSAALVLSYAVAPITVAALRRSAPDLPRPFFVRGLPVMGPLSFMVAALIVYWSTWPTLSWLLGLQVLAFVLYVLFRLPLRQGRARLVRQVRASLWLIVFFVLVMLVSWAGTFGGHGWIAHPFDTLSVAVIAFCIYHWGARSGLRSDELALEEDDGE

SEQ ID NO: 88102 - protein, 337 aa, Oryza sativa Indica Group
MAALPKAGKPLVENDAGSYLAWSGKNQPALAGEKLGCGLLVLKPLGFALPHYADSGKFGYVLGGSAVVGVLPVGLDARERVVRLEAGDVIAMRAGEVTWWYNDTDGEDVTIVFMGDTAGAASPGDISYFVLAGPMGVLGGLDAGLLATASGLTSPEQAATSFRSQPAVLLTRLSRKLQDVRPREHDRHGIVVNAARVPADSSTGGAAAGTKIVTAAHLPVLGLLGFSVGLTPLDAGAAAVYVARGSGRVQVAGAGGASTLLDAEAAAGSLLVVPRYAVALVGVDAGGMELVSLIKSPRPAMEQFTGKGSVIGGLTAEIVQAALNVSPELVEQLRMTK

SEQ ID NO: 88103 - protein, 258 aa, Coxiella burnetii RSA 493
MPISIKTPEELEKMRIAGQLAAEVLEMIEPYVKAGITTNELNAICHDYITQTQKAIPAPLNYHGFPKSICTSVNHVVCHGIPNDKKLKEGDIINIDITVIKNGYHGDTSKMFAVGKIPSHAQRLVRITQECLYIGISMVKPGTPLGDIGAAIQAHAEKNHYSVVREYCGHGIGSIFHEPELQVLHYGRPGTGAVLRPGMTFTIEPMINAGKRYVKLLNDDWTVVTKDRRLSAQWEHTLAVTETGYEVFTLRKDEKISV

SEQ ID NO: 88104 - protein, 260 aa, Oenococcus oeni PSU-1
MSTINKVAIVTGSAGGLGKAIALRLAHNGFSVMIHDINKDALTKTLQEFKDKGYDSDAFVGDVSKKSDQEKLVQTTVEKFGRLDVFVNNAGIEAVTPFIDIEEDELKKCFDINVFGTVFGTQAAAKQFIKQHSKGKIINACSIAGQESYTMLGTYSATKHAVRAFTQVAAKELAKHQITVNAYCPGVAKTKMWDRIDEEMVKSDPSLKPGDAFKKYSSEIALGRYEKPDDVANLVDFLASSKSDYITGQAILVDGGLVYR

SEQ ID NO: 88105 - protein, 574 aa, Legionella pneumophila subsp. pneumophila str. Philadelphia 1
MKDHYKWLSCLFFFICNIYQVNAKTFPQHPPGYAVASAHPLATHAGLEILAAGGNAFDAAVAVAAALAVVEPYHSGLGGGGFWLLHQEKEHLNLFIDGREVAPLAASKDMYLAPDGQVIPGLSLNGGLSAAIPGQPAALVYIAKNYGRLPLSKTLAPAIKLAEEGFPVDPQFRYFSTLDDRLENLKKYPDTAAIFLKNGQPFEIGEKLVQKDLAKTLRLIAKYGNAGFYSGETASLLVQGVNAAGGTWSLDDLAQYKIKVRPPLISAYHNMLIITAPLPSAGGVALVTMLNILSKFPLSSFPKLKWVHYVVESMRLAYWQRDQFLGDPDFIKVPLDKLISSDNAKQLSRLISPNKAIDSKVLQGSVPTGKHSNTSHISIIDTEGNRVAATMTINYIFGSSVVAKGTGVLLNDEMDDFSTKVGEQNVFGLVGSERNAIEPRKRPLSSMAPTFLEMPGRVAILGTPGGSRIPTMVLLASLLFYDGYGAISMVSAMRFHHQYLPDVLQFEPDTFPSSIQQGLQAMGYHLMPLKQYYGDMQAITWDKESNVLTAASDPRHIGLAAAISNMAYGYGVNY

SEQ ID NO: 88106 - protein, 277 aa, Glycine max
MRAKLFVFPIRGRNWCFSRTIDHSLSASHASSQSPSTLKDLWTNINVGDKPLNTKTELFVDYIANKMNNAWIGLEKAPEGSFKNKIHGLGLRLLSRVKPSEIFLKSISKEITSVEIIYPSSLNAQLVRRRLRHIAVRGAVIHRNYLYGLVSLIPLTSALSILPLPNVPFFWVLFRTYSHWRALQGSERLFQLVSDNSKTSNTCTYEKKTEHKESKSQRHSSNEPCWVLRPSKELENLVHLEDGQESLSQHAIINICKIYDLNPVDVIKYFFFLVGRR

SEQ ID NO: 88107 - protein, 245 aa, Bacillus cereus E33L
MVTTDTIHMLEDKIQFIHQDGKDIYLVGPIKLPINLYGETKVFQWYSWLQCSEVTNSVEGMIEKLSSINLADMQQSSVLVYGDFENSEDALIRMHSICHTGDIFGSKRCDCGFQLKQSLQMITEHGSGALFYLANHEGRGIGLFSKAMTYLLQENGLDTVEANLNLGFEDDVRNYDDTIEVLKALRSKPVKLITNNPKKLEALQKAGLNVTSREPLWGDVSEFNEKYLQTKIQRSGHFEGGHLHA

SEQ ID NO: 88108 - protein, 274 aa, Zea mays
  misc_feature (221)..(221): Xaa can be any naturally occurring amino acid
MAFRLSNNLIGVLNFVTFLLSVPILGAGIWLGHRADGTECERYLSAPVIALGAFLLAVSLAGLVGACCRVTWLLWAYLLAMFVLILVLFCFTVFAFVVTNRGAGEAVSGRGYKEYRLGDYSNWLQKRVENTRNWDRIRSCLRDSKVCKSLQDKNETVAQFMSSSLSPIESGCCKPPTSCGYTYVGGTDWTPVTTNSTDPDCKTWSNDASALCYNCQSCKAXGVVAPFQRNWKRVAVVCIVFLVFIIIVYSVGCCAFRNNRRDNAYRGGWKGGYA

SEQ ID NO: 88109 - protein, 333 aa, Methanosarcina thermophila
MVTFLEKISERAKKLNKTIALPETEDIRTLQAAAKILERGIADIVLVGNEADIKALAGDLDLSKAKIVDPKTYEKKDEYINAFYELRKHKGITLENAAEIMSDYVYFAVMMAKLGEVDGVVSGAAHSSSDTLRPAVQIVKTAKGAALASAFFIISVPDCEYGSDGTFLFADSGMVEMPSVEDVANIAVISAKTFELLVQDVPKVAMLSYSTKGSAKSKLTEATIASTKLAQELAPDIAIDGELQVDAAIVPKVAASKAPGSPVAGKANVFIFPDLNCGNIAYKIAQRLAKAEAYGPITQGLAKPINDLSRGCSDEDIVGAVAITCVQAAAQDK

SEQ ID NO: 88110 - protein, 480 aa, Rickettsia sibirica 246
MHNYELGKFIPMSTLMFCILFNQNVLRILKDSILISEISAEIAGFAKVYCVTPAAALFVIIYAKMINYLTFEKIFYYLSAFFISFFVLFTFVIYPNIHIFHVHPDNLTDWMERYPHFKWYISLVGNWGYIVYYSLAELWPNIFYVLLFWQFANELTTTEEAKRFYTLFSLFGNSSLILVGFLMMNLSSEDTIIKKFMSIADSKITLVQVSTTIVAIVAIICCLLVRFISKNVFTNPLFYAKAKSGRSTSERMGLIKSFKYIAKSKYLWLLLICSAAFGFAINLVEAVWKAKIKELYPTVNTYAEFNSLYILWTGVAIMVMTVIGNNIMRMHNWFVAAVISPVIIMVTGILFFVLIVFDQQILSLFDGAILMSPLALAVSIGGIQNILAKGTKYSIWDTSREMLYIPLDEELKTKGKAAVDVISAKVGKSSSGLVQSIIFTLVPTATFTLISPILMVVFTFVCLAWIYAVRKIYFEYQKIA

SEQ ID NO: 88111 - protein, 125 aa, Pyrococcus furiosus DSM 3638
MATFKLVISDPKSGIAKQVEITGAETEKLIGKRIGDQIPAKELNINLNELFGKEFPEDVKLEIRGGTDKDGFPMRPDIHGPRRVRVLLSKGPGFRPKEKGERRKKTVRGNTISPEIVQVNVKLVY

SEQ ID NO: 88112 - protein, 431 aa, Candida glabrata CBS 138
MNFNISSKETVELEQKYSAHNYHPLPVVFHKASGAHVWDPEGKEYLDFLSAYSAVNQGHCHPKIVKALVDQASTLTLSSRAFSNDVFAVFAKYVTEYFGYEMVLPMNTGAEAVETALKLARRWGYEVKKIPDNEAIVLGAQGNFHGRTFGAISLSTDEEDSRKHFGPFLTNTTAKNPSKGQAIRYGHIEDLEQAFESHGDKIAAVILEPIQGEAGIVVPPKGYLLDVQNLCKKYNSLFICDEIQTGIGRTGKLLCFEHTEGVKPDVVLLGKAISGGVLPVSCVLSSREIMSCFTPGSHGSTFGGNPMASRVAIAALDVIKEEKLVERAQKLGDLLQDELRKLQAQSDGMISEVRGVGLLTAIVIDSQKAQGRTAWDLCLLMKDKGVLAKPTHDHIIRLAPPLVISEEDLLKGVQAMKEALVELPSAPISGH

SEQ ID NO: 88113 - protein, 553 aa, Zea mays
MTGSAASLGLRSGSYGSLAAAAVVGSGGRKAGATACRTLRVEKERLHRALRLVGRRRTGVLLLLAVASAALFCSLFAVVKDDANSTSIVNNYEVPNAIQKSVYPSRTRPLMMSGNQESTSVVNKIDFPNRLHLSFANFTHPCEGFSVPPPLVDKKRTGPRPCPVCYVSVDQAFALMPLQASPSPVLKDLNYVSEDGVTANLSNQGSGFGGHPSLDQRNDSFNINESMTVHCGFVRGKKPGQGTGFDIKDDDLLEMEQCHDLVVASAIFDEETEAYVKNSSSLYNNNKVGLWRLVVVRNLPYEDPRRTGKIPKLLLHRLFPNVRFSVWIDAKLELVVDPYLLLERFLWRKNTTFAISRHYKRFDVFEEAEANKAAGKYDNASIDYQIEFYRNEGLTHYSSAKLPITSDVPEGCVIIREHIPITNLFTCVWFNEVDRFTSRDQISFSTVRDKIRARVGWMPEMFMDCERRNFVVQVYHRELLEQMIASGRMPPLAAAVTHANVRVGSRKAPPTKKPSVKRKREKKSSSRRRLPKPIAQGLDANVTQVFFSVAESG

SEQ ID NO: 88114 - protein, 498 aa, Hortaea acidophila
MAFLINNQFPGPMIKANWGDTVVVKLTNLLPNSIDNGTSLHFHGVRQNGTNEYDGVSSITQCPLAPGDTMTYTWRATSYGSSWWHSHFSLQTYEGMFGPLVIEGPSTLSYDEEQFVILQDWNHATADSLFDDSQVVVPGVRGGGLTLDTGLINGKNVWGNGGEYWSMTVTPGKSYRLRVLNAAIQSTFKFHIDGHSFQVIAMDFVPIHPYTTDIVSVNIGQRYDLILTANQAPANYWIRSDNQQPCGQLEQPNVQAILNYEGVKFATPTTTGLNYQPDCLDEPSASLVPYLAQDAGAQSAGEFVETSIIAANGAVPNLYKWTLSGSTFQANWNDPTLFSIWYDGDVPQYGGDLTVELPNAGEWVYFVIDSPMPLPHPIHLHGHDFLLLASGVGTYSADVPLQLTNPPRRDVAVMPADPLTGSGGYLVVAYQVSNPGVWLMHCHIGWHNTMGFALQIVEMIDSIKIENTCQLQETCVNWLNYANANSIFDAPFDDGSGG

SEQ ID NO: 88115 - protein, 338 aa, Bacillus cereus E33L
MAILITGGAGYIGSHTCVELLNNNYKIIVVDNLSNSSIESLNRVKEITGKQFEFYKENVLNREKMNEIFLENNIEAVIHFAGFKAVGESTTIPLTYYYNNIISAIVLCDVMQKHNVKNFIFSSSATVYGIPKTSPITEEFPLSVTNPYGQTKLMIEQIMRDVAKADDEWSIALLRYFNPFGAHQSGRIGEDPNGIPNNLMPYVTQVAVGKLKELNIFGNDYPTKDGTGVRDYIHVVDLAKGHVKALEKVLKTKGIEAYNLGTGKGYSVLEMVKAFEKVSGKKIPYKVIGRRPGDVAICFADVSKAKRELGWEAEYGLEEMCVDSWRWQVNNKNGYQMI

SEQ ID NO: 88116 - protein, 343 aa, Synechococcus sp. CC9311
MPMLAIKFLENNSSLMSRVYADNSQAIGNTPLVRLNHVTKGCKATVLAKIEGRNPAYSVKCRIGANMIWDAEKRGVLSEGKTIVEPTSGNTGIALAFTAAARGYKLILTMPESMSIERRRVMAVLGAELILTEAAKGMPGAIAKAKEIADSDPSKYFMPGQFDNPANPEIHEKTTGPEIWDDCDGAIDVLVAGVGTGGTITGVSRYIKQEKGKAITSVAVEPSHSPVITQTMNGEALKPGPHKIQGIGAGFIPNNLDLSVVDRVEQVTNEESIEMALRLAQEEGLLVGISCGAATAAAIRLAQQDEFAGKTIVVVLPDLAERYLSSVMFADVPTGIIEQPVPV

SEQ ID NO: 88117 - protein, 401 aa, Streptococcus uberis
MKIAVAGSGYVGLSLSVLLAQKNPVTVVDIIEKKVNLINQKQSPIQDVDIENYLKEKKLQLRATLDADQAFRDADILIIATPTNYDVEKNFFDTSHVETVIEKALALNSQALLVIKSTIPLGFIKKMRQKYQTDRIIFSPEFLRESKALKDNLYPSRIIVSFEDDDSMEVIEAAKTFAQLLKDGSLDKDVPVLFMGSAEAEAVKLFANTYLAMRVSYFNELDTYAEKNGLRVDNIIEGVCHDRRIGIHYNNPSFGYGGYCLPKDTKQLLAGYDGIPQSLIKAIVDSNKIRKEYIASQILQQLSDINVDPKDATIGIYRLIMKSNSDNFRESAIKDIIDHIKSYQINIVLYEPMMNEDFDLPIIDDLSDFKAMSHIIVSNRYDLALEDVKEKVYTRDIYGVD

SEQ ID NO: 88118 - protein, 556 aa, Synechococcus sp. CC9311
MMRACWIPRTLSHSAVASESMDPIFDSIPDALNAIRNGECVVVVDDERRENEGDLICASQFATPEQINFMAKEARGLICLAIEGDRLDALDLPLMVDRNTDENQTAFTVSIDAGPEHGVSTGISAEDRSRTIQVVLQADAKPSDLRRPGHVFPLRARSGGVLKRAGHTEAAVDLAQLAGLIPSGVICEIQNSDGSMARLPELQNYSKQFGLRLISIADLISYRLQNERFVRRHAQCVMPSRFGQFQAIGFRNELDNSEHVALVKGVPGQLQEPVLVRMHSECLTGDSFGSLRCDCGPQLEAALSQIEQEGEGVVVYLKQEGRGIGLINKLKAYSLQDGGLDTVEANEKLGFGADLRNYGVGAQILGDLGIHRLRLLTNNPRKIAGLGGYGLEVVSRVPLIINPGDHNANYLATKRDKLGHLFNEYNAAEIATLAWDCGEEFIAKLPDLLHRAEALAVKSSLTLQAEQTPRLLALWERPQFVWTVSGETSAIELFLKTLASWTETKRLGFLKTAKAEQRLHPSLQLNREERDLASLLSDKKNSWSDESDQPILIHWS

SEQ ID NO: 88119 - protein, 390 aa, Coxiella burnetii RSA 493
MNLHEYQSKHLLKKYNIPVPASEVVFNPDAAVDAAAKIGGDRWVVKAQVHAGGRGKAGGVRLVKNKEELKSAVKALLGTRLVTYQTDERGQPVNQILVEQTSDIARELYLGAVIDRASQRIVFMASTEGGVEIEKVAEKSPEKILKVTIDPAIGLQPFQCRQLFFGLGLQDLKQMRSFTDIVMGLYRLFTERDLSLLEINPLVITGSGELICLDAKINIDDSALYRQSELREMRDTTQEDEHETMAQQWELNYIKLDGNIGCMVNGAGLAMATMDLIKLSGGDPANFLDVGGSATKERVTEAFKIIVSDKNVKGILVNIFGGIVRCDLIADGIISAVKEVGIDVPVVVRLEGNNAQLGAKKLADSGMNIIAAKGFADAAEQIVKQVGVIA

SEQ ID NO: 88120 - protein, 268 aa, Brassica napus
RRPTRPESFQELDTYLQELLDETLDPSRPKPETESFIDLLMQIYKDQPFSIKFTHENVKAMILDIVVPGTDTAAAVVVWAMTYLIKYPEAMKKAQDEVRNVVGDKGYVSEEDIPNLPYLKAVIKESLRLEPVIPILLHRETIADAKIGGYDIPAKTIIQVNAWAVSRDTAAWGDNPNEFIPERFMNEQKGVDFKGQDFELLPFGSGRRMCPAMHLGVAMVEIPFANLLYRFDWSLPTGIKPEDIKMDVMTGLAMHKKDHLVLAPRTHI

SEQ ID NO: 88121 - protein, 405 aa, Coxiella burnetii RSA 493
MAIEIKVPTLPESVSDATVAKWYKKEGDSISRDENLVDLETDKVMLEVPAPKDGVVEKIVAKEGEVVKADQILALLKEGGAVAKEKEKKDEKETKKEKEKKEEKKDKEKKEKTEEKESDLSPAVRRMVSEKDVDVEEIEGSGKGGRITKKDVEDYLEKQKEKPSEGKEGPADERTEKRVPLSRIRQRVAERLVQVQQEAALLTTFNEINMQLVMELRKKYREEFEKKFKVRLGFMSFFTKAVVEALKRFPMVNASIDGSDIIYHNYYDIGIAIGTERGLIVPILRNAEKMNMADIEKQIREYASRAQEGRLNIEELTGGTFTITNGGTYGSLLSTPIINPPQTAILGMHKIMDRPTVENGEVVVRPIMQVALSYDHRVIDGREAVLFLVTIKELLEDPARMILEC

SEQ ID NO: 88122 - protein, 585 aa, Oryza sativa Indica Group
MESNGGGGGSPKEAAVVVPSSGDATLGGHLARRLVQVGVSDVFAVPGDFNLTLLDYLIAEPGLSVVGCCNELNAGYAADGYARARGVGACAVTFTVGGLSVLNAIGGAYSENLPLICIVGGPNSNDYGTNRILHHTIGLPDFSQELRCFQPITCYQAVVNNLDDAHDQIDTAISTAIRESKPVYISVSCNLAAVPHPTFSRDPVPYFLSPRLSNQASLHAALDATLDFLDKAVKPVLVAGPKLAVAKAGEGFVDLADASRYGFAVMPSAKGLVPETLPAFIGTYWGAVSTAFCAEIVESADAYLFAGPIFNDYSSVGYSCLLKKEKAVVVQPDRVTVGNGPAFGCVMMRDFLSELAKRVRKNTTAFDNYKRIFVPDRQLRSARPGEPLRVNVLFKHIQGMIGGDEAVVAETGDSWFNCQKLRLPEGCGYEFQMQYGSIGWSVGALLGYAQAVQKRVVACIGDGSFQVTAQDVSTMLRCGQKSIIFLINNGGYTIEVEIHDGPYNVIKNWDYVGLVNAIHNGEGRCWATRVRCEEELEAAIATATGDKADSLCFIEVVAHKDDTSKELLDWGSRVSAANSRPPNPQ

SEQ ID NO: 88123 - protein, 336 aa, Alteromonadales bacterium TW-7
MTIKVGINGFGRMGRLTLRAALEWPEVEFIKVNDVAGDAKTHAHLLEFDSVHGRLAHSVTANENSFSVGKHTIAVTNYKTISDTDWSDCDVVIEASGKMKTTELLNQYLAQGVKRVVVTAPVKEDGILNVVMGVNDDLYNPNEHKIVTAASCTTNCLAPIVKVLQEKVGIKHGSMTTIHDITNTQTIIDAPHKDLRRARSCGTSLIPTTTGSATAITHIFPELKGKLNGHAVRVPLTNASITDCVFELERGVTAAEVNEWFAQASKSELAGVLGYEEKPLVSIDYKTDPRSSIIDALSTMVINNTQLKLYAWYDNEWGYANRTAELMLKVAKSDVV

SEQ ID NO: 88124 - protein, 469 aa, Pantoea agglomerans
MSAEHVLSMMNEHEVKFVDLRFTDTKGKEQHVTIPAHQVNADFFEEGKMFDGSSIGGWKGINESDMVLMPDATTAVMDPFFEDSTLIIRCDILEPGTMQGYDRDPRSIAKRAEDFLRSSGIADTVLFGPEPEFFLFDDIRFGSSTSGSHVAIDDIEAAWNTGKEYEGGNKGHRPGLKGGYFPVPPVDSSQDIRSAMCLTMEQMGLVVEAHHHEVATAGQNEVATRFNTMTKKADEIQIYKYVVHNVAHAYGKTATFMPKPMFGDNGSGMHCHMSLSKGGQNLFAGDKYGGLSEMALFYIGGIIKHAKAINALANPTTNSYKRLVPGYEAPVMLAYSARNRSASIRIPVVASPKARRIEARFPDPAANPYLAFTALLMAGLDGIINKIHPGDAMDKNLYDLPPEEEAEIPKVAGSLEEALNALNEDREFLTRGGVFTDESIDAYIELRKAEMDRVRMTPHPVEFELYYSV

SEQ ID NO: 88125 - protein, 645 aa, Sinorhizobium meliloti 1021
MTQLPTNPMPATPLLDKVDYPDDLKKIDDRDLPQLAAELRAEMVDAVSRTGGHLGAGLGVVELTIAIHKIFDTPHDRLIFDVGHQCYPHKILTGRRDRIRTLRQEDGLSGFTRRAESEYDPFGAAHSSTSISAGLGMAVAAELDGKSRNVIAVIGDGAMSAGMAFEALNNAGALDARLIVILNDNDMSIAPPTGAMSAYLARLASGRTYMGIREVGKKLTAYLGKTVDRAITRAVEHARGYVTGGTLFEEMGFYHIGPIDGHSFDHLLPVLRNVRDNAKGPVLIHVVTQKGKGYPPAEAAADKYHGVNKFDVITGAQAKAKPNAPAYTSVFADALTQEASLDDKIVAITAAMPSGTGLDKFASVHPSRCFDVGIAEQHAVTFAAGLAAEGYKPFAALYSTFLQRAYDQVVHDVAIQGLPVRFPIDRAGFVGADGPTHAGSFDTTYLATLPGFVVMAAADEAELKHMVRTAAAYDEGPISFRYPRGEGVGVELPERGEILAIGKGRIVKQGNKVALLSFGTRLADCLLAAEDLDAAGLSTTVADARFAKPLDHDLIRQLARHHEVLITIEEGAVGGFASHVLQFLAEEGLIDGGLKVRPMVMPDIWMEQAKPEAMYARAGLDRAGIVSTVFKALGQKHGVGLGAAG

SEQ ID NO: 88126 - protein, 299 aa, Mycobacterium tuberculosis
MTRPDNEPARLRSVAENLAAEAAAFVRGRRAEVFGISRAGDGDGAVRAKSSPTDPVTVVDTDTERLLRDRLAQLRPGDPILGEEGGGPADVTATPSDRVTWVLDPIDGTVNFVYGIPAYAVSIGAQVGGITVAGAVADVAARTVYSAATGLGAHLTDERGRHVLRCTGVDELSMALLGTGFGYSVRCREKQAELLAHVVPLVRDVRRIGSAALDLCMVAAGRLDAYYEHGVQVWDCAAGALIAAEAGARVLLSTPRAGGAGLVVVAAAPGIADELLAALQRFNGLEPIPDALEHHHHHH

SEQ ID NO: 88127 - protein, 339 aa, Mycobacterium avium subsp. paratuberculosis K-10
MTVRVGINGFGRIGRNFYRALLAQQEQGTADIEVVAVNDITDNSTLAHLLKFDSILGRLPYDVSLEGEDTIVVGPAKIKALEVREGPAALPWGDLGVDVVVESTGLFTNAAKAKGHLDAGAKKVIISAPATDEDITVVLGVNDDKYDGSQNIISNASCTTNCLAPLTKVLDDEFGIVRGLMTTIHAYTQDQNLQDGPHKDLRRARAAALNIVPTSTGAAKAIGLVMPNLKGKLDGYALRVPIPTGSVTDLTAELKKPASVEDINAAFKAAAEGRLKGILKYYDAPIVSSDIVTDPHSSIFDSGLTKVIDNQAKVVSWYDNEWGYSNRLVDLVALVGKSL

SEQ ID NO: 88128 - protein, 415 aa, Mycobacterium avium subsp. paratuberculosis K-10
MAVHNLKDLLAEGVSGRGVLVRSDLNVPLDSDGEQGRITDPGRITASVPTLSALVEAGAKVVVAAHLGRPKNGPDPALSLAPVAAALGEQLGRHVQLASDVVGTDALARAEGLTDGDVLLLENIRFDARETSKDDAERLALARQLAELVGPTGAFVSDGFGVVHRKQASVYDVATLLPHYAGTLVAEEIAVLEQLTGSTKRPYAVVLGGSKVSDKLGVIESLATKADSIVIGGGMCFTFLAAQGFSVGKSLLETEMVDTCRRLLDTYVDVLRLPVDIVAADRFAADAAPQTVPADAIPDDLMGLDIGPGSVKRFTALLSNAETIFWNGPMGVFEFPAFAAGTKGLAEAIAAATGKGAFSVVGGGDSAAAVRALGIPESGFSHISTGGGASLEYLEGKALPGIEVLGRPQPTGGAA

SEQ ID NO: 88129 - protein, 261 aa, Mycobacterium avium subsp. paratuberculosis K-10
MSRKPLIAGNWKMNLNHFEAIALVQKIAFALPDKYYDKVDVTVLPPFTDLRSVQTLVDGDKLRLSYGAQDLSQHDSGAYTGDISGAFLAKLGCTFVVVGHSERRTYHNEDDALVAAKAATALKHELTPIICIGEHLEVREAGNHVIHCEEQLRGSLAGLSAEQIGKVVIAYEPVWAIGTGRVASASDAQEVCAAIRKELASLASAQIADSVRVLYGGSVNAKNVGELIAQDDIDGGLVGGASLDGEQFATLAAIAAGGPLP

SEQ ID NO: 88130 - protein, 543 aa, Zea mays
EDGGGIMIGPPRPPPPSARGEGDDGDGMIGPPRPPPADDEDVDDDEDDDEEEMEDDGEGGFNRIPLSNEIVLRGHNKVVSALAVDHTGSRVLSGSYDYTVRMYDFQGMNSKLQSFRQLEPFEGHQVRSLSWSPTSDRFLCVTGSAQAKIYDRDGLTLGEFVKGDMYIRDLKNTKGHISGLTGGEWNPKSKETILTSSEDGSMRLWDVSDFTSQKQVIKPKLVRPMRIPVTSCAWDHEGKRIVGGIGDGSIQVWTIKAGWGSRPDIHVEKTHTEDITGVKFSTDGQSLLSRSMDSTLKIWDLRRMKTPLKVFEDLPNHYAETNAAFSSDEQLIFTGTSIEKDGDNGGLLCFFDRKKLELVSRVGISAHYSVIRCLWHPRINQVFATVGDKKEGGTHILYDPSISQRGALVCVGRAPRKKSVDDFEVQPVIHNPHALPLFRDQPSRKRQREKILKDPLKSHKPEAPVNGPGFGGRVGTTKGSLLTQYLLKEGGLIKETWMDEDPREAILKYADAAEKDPKFIAPAYSQTQPKPVFAESDSDNEEK

SEQ ID NO: 88131 - protein, 495 aa, Oryza sativa Japonica Group
MSAVSGIDSPSSKLLQFEGKLKDGFARSNNSEHENGAGTVSISSKKSKHRVDSEKKPHVDISGVIDSDSQKCNSEQIHSANGIVSRDVNHDHIENCKVESNDFPLNTISETRYPTDNWNSSQFALSNDGSPVLNNQSTPQTGHGYGDNDLTYIDWPAIDNFEDVDNLFRRCDSTYGQQQLPNTDELSWIPSSDAMYSSDVAMQPGFESSYSDYGILDDLSAFNCTEDKSLTTADPSSAAYQRDAMELLSSDQICTGQENLDMIGNRYSSENAMEQPEDQKFSIASGSQLSSSQNLLNQKNHLDSTSPMQKKVASSASGQLISDNVTGHPGHQTLTRRASYPCENHEIGKRSLGKRGLGHSDVAMGTSMVVDGSFVSSISSDNSVEENSFRQLQDAVSQLDVKTKMCIRDGLYRLARSAQNRQVFPNTMNNNGDSHNVKDMQNAETSGKFVDPGSIETQTNPIDRSIALLLFHQPSEHVTGAVDEAASLKSHLAAV

SEQ ID NO: 88132 - protein, 411 aa, Candida albicans
  misc_feature (207)..(207): Xaa can be any naturally occurring amino acid
MDNHQQQQQLQQYQQQFQQPQQQLYPGEQIVHPAAAQTGQNTTNVTAVSSSNITQSATSSLHSQQLQHVDVSKSAAEEAIRRSLLPERSTVSKGKYSLTDFSIMRTLGTGSFGRVHLVRSVHNGRYYAIKVLKKHQVVKMKQVEHTNDERRMLKLVEHPFLIRMWGTFQDSKNLFMVMDYIEGGELFSLLRKSQRFPNPVAKFYAAXVTLALEYLHSHDIIYRDLKPENILLDRNGHIKITDFGFAKEVSTVTWTLCGTPDYIAPEVITTKPYNKSVDWWSLGVLIFEMLAGYTPFYDSTPMKTYEKILAGKIHYPSFFQPDVIDLLTKLITADLTRRLGNLINGPADIRNHPWFSEVVWEKLLAKDIETPYEPPITAGVGDSSLFDHYPEEQLDYGSQGEDPYASYFLDF

SEQ ID NO: 88133 - protein, 333 aa, Eremothecium gossypii
MQTSAEMGGIIEAMPALAQDGYALEQAPPEQCPGPAAENAGKGDACQGCANKDICESLPKGPDPDVALITQNLAPVRHKVLVLSGKGGVGKSTFSAMLGWALSADEALQVGVMDLDICGPSLPHMLGCVNETVHESSVGWTPVYVADNLAAMSIQFMLPEDDSAVIWRGAKKNALIKRFLKDVYWDELDYLVVDTPPGTSDEHITINTLLKESGIDGALVVTTPQEVALLDVRKELDFCRKAGIRVLGLVENMSGFVCPSCENESTIFKPTTGGGRALCEELGIKFLGAVPIDPRIGRCCDSGESFLDAYPDSPASTAIMHVVEALRDAVGDV

SEQ ID NO: 88134 - protein, 189 aa, Candida glabrata CBS 138
MGKAKKTRKFALVKRTLNAKKDQRLKGNQEKQKSQEDPELTRNIPQVSSALFFQYNEAIKPPYQVLIDTNFINFSIQKKIDIVKGMMDCLLAKCNPLITDCVIAELEKLGPKYRIALKLARDPRIKRLTCTHKGTYADDCIVNRVLQHKCYIVATNDAGLKQRVRKIPGIPLMSVGGHAYVIEKLPDVF

SEQ ID NO: 88135 - protein, 331 aa, Candida albicans
MSPSQTQIEKSQLAAPEPEHCPGPESELAGQGDACKGCANQEICSSQTVKGPDPDLPIITERLSAIDHKILVLSGKGGVGKSTFTSMLAWAIAADEEIEVGAMDLDICGPSLPRMLGAEGESVHQSNSGWSPVYVADNLGLMSISFMLPDPDSAIIWRGAKKNGLIKQFLKDVNWGEKLDYLVVDTPPGTSDEHLSVTTYMKEVGIDGALIVTTPQEVALLDVRKEIDFCRKANIKILGLVENMSGFVCPNCKGESQIFKATTGGGKKLCEELGIPFLGSVPLDPRIGKACDMGECFFDSYPDSPAATAILDVVDALRDQVELSLENLAIK

SEQ ID NO: 88136 - protein, 340 aa, Pseudomonas fluorescens PfO-1
MSNAANTPTSTGEPIKKRLTTSAMIASIASEGQATRSAPFGHALAALADQRPDIVGLSADLSKYTDLHIFAKAHPDRFYQMGMAEQLLMSAAAGMAREGFVPFATTYAVFASRRAYDFICMAIAEENLNVKIVCGLPGLTTGYGPSHQATDDLAIFRAMPNLMIVDPCDALEIEQAVPAIAAHQGPVYMRLLRGNVPLVLDEYGYQFEIGKAKTLRTGNDVLIISTGLMTMRALEAAKALQTDGVDVAVLHVPTIKPLDEQTILAEARKSGRLVVTAENSSIIGGLGEAVAGVLLRNGVTPTFRQIALPDAFLDAGALPTLHDRYGISTDAVCAQIKSWL

SEQ ID NO: 88137 - protein, 335 aa, Saccharophagus degradans 2-40
MPRIAINGFGRIGRNVLRAIYERNLQNEMQVVAINDLGSPDINAHLLKYDTVHGRFGFDVEASEGAIRVNGDEIKITAERNPADLPWAALNVDIVFECTGLFVARDKAALHLDAGAKNVLISAPGKDVDLTVVYGVNHESITADHKVLSNASCTTNCLAPMTSALHSAIGVKTGLMNTIHSYTNDQRVTDAYHSDTLRARAAALNMIPTKTGAAAAIGLVIPDLAGKLDGLSIRVPTVNVSCLDFTFEAARDTTVEEVNQVLRDAAAGPLKGVMDVNTIPLVSSDFNHDAHSCIVDLSHTRVMGNQVKVLAWYDNEWGFSNRMLDTTMAIVKANA

SEQ ID NO: 88138 - protein, 491 aa, Saccharophagus degradans 2-40
MNTDMLIVGGDGDLALRKLYPSLYYLELNNCMPENTRIIGMARTGQTREEFLVKVKEWLKANVAAELFSEEKWESYSQKIFFAQGDATNAESLGKVREEFLGEGNQLVVYLAIPPLIFGKVCNALEGCGLAKETTRLVVEKPLGDSRESFIAINNELARTFPEKQLFRIDHYLGKETVQNLIALRFANDIFEPLWNSRYVDSIQITVSEEVGVGNRWSFYDQTGATRDMVQNHLLQVLCLTCMEPPAVLDADSVRAEKLKVLNSLKMIEGEEVLKDTVRGQYERGVVGGKEVPGYLEEESDKYEIDPNSQTETFVAIKAEIQNWRWSGVPIYLRTGKRLRGRHSEIVVHFKQSKHKIFQENHENHASNRLIIRLQPDEGIRLRVMNKVAGLEPGIPLESGCLNLWFSDKKEIKTHDAYSRLLFDVLRNDQTLFVSAAEVEAAWKWVDTIFAGWKSTGMKAQGYPAGSIGPVAANELLSRDGREWHEIEPRD

SEQ ID NO: 88139 - protein, 500 aa, Mycobacterium sp. JLS
MAPETPQSIAYPAPGSHPHRIEEEKLDPHVIVLFGATGDLAKRKLLPGMAYLVQSALAPKIRVVGTSLEDLSGDEFRALAREAVDAFGSHELSDEEWEGFACRISYVPQSAGPEALAEAVKAAEAELGPDTRRLHYLSVPPKAAKAVITMLKESGLVDRSRVVMEKPFGTDLASACELNAFVHDTFDESQIFRIDHFLGKEAAQNILAFRFANGLFEPIWNRNFIDHIQIDIPEKLGLDERADFYESTGAYKDMVVTHLFQVMAFVVMEPPTALEPRAISEEKNKVFRSMLPVDPAKVIRGQYVGYRREDGVAPDSETETFIALQVGIDNWRWAGVPIYLRTGKKMAEGQRIISIAFREAPRSMFPAGSGVGSQGPDHLTFDLADNSKVSLSFYGKRPGPGMKLDKLSMQFSTQETGRVGDVLEAYERLILDAMRGDHTLFTTAAGIESLWDRSTPLLEDPPPVKVYQPGTWGPNAIHQLIAPNAWRLPFEREWREKAPE

SEQ ID NO: 88140 - protein, 131 aa, Triticum aestivum
MATISAGEATTVVARAEIARPQALGLPQLRTRSERVRCSYSKDAKEATPAATVRGASASLLAAAGAVTASAGPALALVDERMSTEGTGLSLGLSNNLLGWILLGVFGLIWSLYTVYTSGLDEDEESGGLSL

SEQ ID NO: 88141 - protein, 159 aa, Helicobacter pylori
NDSVASSIVAQLLFLEAEDPEKDIGLYINSPGGVITSGLSIYDTMNFIRPDVSTICIGQAASMGAFLLSCGAKGKRFSLPHSRIMIHQPLGGAQGQASDIEIISNEILRLKGLMNSILAQNSGQSLEQIAKDTDRDFYMSAKEAKEYGLIDKVLQKNVK

SEQ ID NO: 88142 - protein, 427 aa, Vitis vinifera
MEMAENLICNGKAYVDDTPREQMQKERMDGIESKCRNNSPQKNMELWKEMIAGSERGLMCCLRGKLDMQDPNKSLRDPVYYRCNPLPHHRIGSKYKLYPTYDFACPFVDAKEGITHALRSSEYHDRNAQYHRIQEDMGVKKVHIYEFSRLNMVYTLLSKRKLLWFVQNGKVDGWDDPRFPTVQGIVRRGLKIDALIQFILEQGASKNLNLMEWDKLWTINKKIIDPVCPRHTAVIDEKRVLVTLADGPEKPFVRIIPRHKKFEGAGEKCTTYTKRIWIDYADAVSISENEEITLMDWGNAIIKEIRKDQDGNITQLIGVLHLEGSVKATKLKLTWLPETSELVNLSLMEFDYLITKKKLDEGDDFLDALNPCTKRETAAVGDSNIRNLKRGEIVQLERKGYYRCDAPFIRPSKPVVLFAIPDGRQQK

SEQ ID NO: 88143 - protein, 508 aa, Helicobacter pylori J99
MILVLDFGSQYTQLIARRLRESGIYAEIVPFFESVENIQKKAPKGLILSGGPASVYAKDAYKPSEKIFDLNLPILGICYGMQYLVDFFGGVVAYANEQEFGKAILEIVQNSVIFEGVKIKSLVWMSHMDKVIELPKGFTTLAKSPNSPYCAIESDKIFGLQFHPEVIQSEEGGKILENFALLVCGCEKTWGMQHFAQREIVRLKEKIANAKVLCAVSGGVDSTVVATLLHRAIKDNLIAVFVDHGLLRKNEKEKVQAMFKDLQIPLNTIDAKEVFLSKLKGVSEPELKRKIIGETFIEVFEKEAKKHHLKGKIEFLAQGTLYPDVIESVSVKGPSKVIKTHHNVGGLPEWMDFKLIEPLRELFKDEVRLLGKELGVSQDFLMRHPFPGPGLAIRILGEINENKIKRLQEADAIFIEELKKANLYDKVWQAFCVLLNVNSVGVMGDNRTYENAICLRAVNASDGMTASFSFLEHSFLEKVSNRITNEVNGINRVVYDITSKPPGTIEWE

SEQ ID NO: 88144 - protein, 122 aa, Oryza sativa Japonica Group
MASRLAQLRSKAAQASELVSKHGCAYYKEVMEKNKQHVVQPPTVEKCQELSKQLFYTRLASLPGRYEAFWKEFDGVKQVWKNRKELKVEDLGIVTLFGVELYAWFCVGEIVGRGFTITGYKV

SEQ ID NO: 88145 - protein, 160 aa, Oenococcus oeni PSU-1
MLNIRILVVGKIKEKYFRNALDQYLKRLSRFTKIEIIEVKDEATPEKASKSENLEILQTEGGRLLDKINNRDFVIALAIEGKLITSPDLADMIREIPLDGYSTIDFVIGGSLGLSNEIKNRANAKISFGRITLPHQLARVLLTEQIYRSFMINEGSPYHK

SEQ ID NO: 88146 - protein, 628 aa, Oryza sativa Japonica Group
MNGQTPMGLAAAAAAAVRPCRRRLLSSATAAAAAATVATATPLFPRCPHPHHHLHGRRLPFLASAASQQQQQSGQTAASPATPPIPSDPRAAVSGNLPFFDRVLFPDTFPVETPPPSSAAASAAAAADEEVASALKAREETEAEREAWRLLRRAVVSYCGEPVGTVAAEDPECTETLNYDQVFIRDFVPSALAFLMRGETEIVRNFLLHTLQLQSWEKTVDCYSPGQGLMPASFKIRAVPLDDNNEAFEEVLDPDFGESAIGRVAPVDSGLWWIILLRAYCKITGDNALQERVDVQTGIKLILSLCLSDGFDMFPTLLVTDGSCMIDRRMGIHGHPLEIQALFYSALRCSREMLVMNDGSKNLLRAINNRLSALSFHIREYYWVDMKKINEIYRYKTEEYSHDATNKFNIYPEQIPSWLVDWIPEKGGYLIGNLQPAHMDFRFFSLGNLWAITSSLTTPKQAEGILSLIDEKWDDLIANMPLKICYPAMEDDEWRIITGSDPKNTPWSYHNGGSWPTLLWQFTLACIKMGRPELARRAIAVAEEKLAADKWPEYYDTRSGRFIGKQSRSYQTWTIAGFLTSKMLLENPELASILTCDEDLELLEGCACCLSKKRTRCSRRAAKSHVVE

SEQ ID NO: 88147 - protein, 95 aa, Oryza sativa Japonica Group
MALRALISEIRGMKVREVPGYLKPRLSWENVKKSSDQAVDRYIDKYIETSSPEPLFHVIYGLMAFSYLINLPKERRHLAHLEELERQGAAGAAHH

SEQ ID NO: 88148 - protein, 514 aa, Mycobacterium avium subsp. paratuberculosis K-10
MSPARTAQQWHNPLRDKRDKRLPRIAGPCGMVIFGVTGDLARKKVMPAIYDLANRGLLPPSFSLVGFARRDWSTQDFGKVVYEAVKEHCRTPFRQENWDRLAEGFRFVPGAFDDDEAFGRLAETLDKLDAERGTGGNHAFYLAIPPKSFPVVCEQLHKSGLARPQGDRWSRVVIEKPFGHDLESAQSLNKAVNAVFPEESVFRIDHYLGKETVRNILALRFANQLFDPIWNSHYVDHVQITMAEDIGLGGRAGYYDGIGAARDVIQNHLMQLLALTAMEEPVSFSPLALQAEKIKVLSATHLAHPLDETTSRGQYTAGWQGGEKVVGLLDEEGFAKDSITETFAAITLEVDTRRWAGVPFYLRTGKRLGRRVTEIALVFKRAPHLPFDATMTDELGANAMVIRVQPDEGVTLRFGSKVPGTAMEVRDVNMDFSYGSAFAEESPEAYEQLILDVLLGEPSLFPVNAEVELAWHILDPVLDNWASGGRPEPYEAGTWGPDSAFEMLHRTGREWRRP

SEQ ID NO: 88149 - protein, 227 aa, Oryza sativa
  misc_feature (70)..(70): Xaa can be any naturally occurring amino acid
LQRCASVDLTPRQARKAYGGDGGTYYEWSPADLPMLELANIGGGKLSLNAGGLALPSFSDSGKVAYVLQXKSGQKLPEPSAADREGMALNCLEAPLDVDIKNGARVVVLNTANLPMVKEVGLGADLVRIDGHSMCSPGFSCDSAYQVTYFIRGSGRVQVVGADGKRVLDTHVEGGNLFIVPRFCVVQRDAGDGEAVPVQKDRLGDLLRAQLSSFPLPLRRRVGVVLN

SEQ ID NO: 88150 - protein, 650 aa, Listeria monocytogenes str. 4b F2365
MEIFELILLMLSAVFLSNVLSRFLPGIAVPLIQVILGIILAIPLGDHTMDLNPELFLLLFMAPILFNDGASTDKKSLWKNRKAILSLSIGLVFVTVGVLGAFIHYLIPAIPFAAAFALAAALAPTDAVAVGALAEKVRVPHKIMHILEGESLINDASGLVSFQFAVLALVTGTFSFMSAGTSFLLLSLGGIALGAALSLLKIMLMRGLRQLGIENMTSFMLMEILLPFLIFMVAEKVGVNGILAVVSGGMVHSFSYKGLNPEIAQLNLLSKNTWSVIIFSLNGLVFILLGTQLPQILMTIWQDANIQKGMLFVYILGITFLLLGLRFLWILFFRNYEENPKVDLVSRLKNTFLYTVAGVRGTITLVSALSLPFVLGNGNAFPERDLLIFIAAGVIITTLLLANFTLPLFADKKDKIAADHTTDIVLLRDIVQQLQAYKTDENAVEMNKVLNMYNNRIFSLMEHKEVNATEKELRRLTQEWQLENTRRLVFERKIDTGVGLSHMMRLGKRLYVQTRAEKYRARMRYRQLLSHRFRDFRFVPLTFEERRKEIAKLQNENNLFVIQKLQELDSNEYNPEIISLYLMNFERALGRGKNKKESNDEALQTTIDLASQIERETIQHYFEKGTITRKEMKVYRDNLLAIEANMQLEF

SEQ ID NO: 88151 - protein, 361 aa, Oryza sativa Japonica Group
MASPPEDAPAIPSNPSVPQEGRPKGVTPKFSLAPLVPRLSELLGIQVTKAEDVIGPDVEKLVSELPNGSVLLLENVRFYKEEEKNDPEFAKKLASLADLYVNDAFGTAHRAHASTEGVTKFLKPSVAGFLLQKELDYLVGAVSSPKRPFAAIVGGSKVSSKIGVIESLLEKCDILLLGGGMIFTFYKAQGLSVGSSLVEEDKLELATSLLAKAKEKGVSLLLPSDVIIADKFAPDANSQVVPASAIPDGWMGLDIGPDSVASFSSTLETTQTVIWNGPMGVFEFDKFAVGTEAIAKKLADLSGKGVTTIIGGGDSVAAVEKVGVADVMSHISTGGGASLELLEGKELPGVIALDEAVTVAV

SEQ ID NO: 88152 - protein, 328 aa, Candida glabrata CBS 138
MSSGKISGRNAINIVKNVKVKPTSDSLISGSNKVNVKRSGLLSKPHKKHASSDKSHSWINLNKYMNNSYAYPSASQLNAINHFFNRAECKYEWSVADFGNIPSEQMKSVYGHNSGMNHEGGKLYNGKTRYPFQLLNPLPEIAFLGKTNVGKSTILNNLITSFKQKDLDVHARMSNRAGFTKTLNCYNVGNKFRIIDTPGYGFHSAIEQGNVTLDYLSNRKELKRCFLLISAKKEISEHDRYLMDLMTESGIPFELIFSKMDKVTDVDEFVQWIDSSGLRNLPTLPKLIFTNSMVSKFIKKRYGVDLLRYSIFEACNLDSSVKPERIKY

SEQ ID NO: 88153 - protein, 331 aa, Mycobacterium avium subsp. paratuberculosis K-10
MPGHDKHMHAIEVSETGGPEVLRYVETPTPTAGPGQVLIKAEAIGVNYIDTYFRSGQYPRELPFIIGQELCGTVAAAGDGVDGFNVGDRVVSAAATGGYAEYATAPASLTAHVPDGVAADVAASALLKGLTAHYLLKSVYPVQAGDTVLVHAGAGGVGLILTQWAHLLGARVITTVSTPEKARRSAQAGADEVLSYPDDADEFGSRIRALTDGAGVAAVYDGVGASTFDASLASLAVRGTLALFGAASGPVPPFDPQRLNAAGSVFLTRPSLAHFIRTGQEFSWRAEELFAAIAAGDITVEVGGRYPLADAARAHRDLQGRKTTGSIVLLP

SEQ ID NO: 88154 - protein, 81 aa, Acidobacteria bacterium Ellin345
MASVEEKVKQIIVEQLGVDEGEVTPNASFVDDLGADSLDTVELVMAFEEAFEIEIPDEDAEKIRTVKDAVDYITAHAKGGK

SEQ ID NO: 88155 - protein, 439 aa, Vibrio cholerae O1 biovar eltor str. N16961
MLALADRLAQYKVEGHTTRPMASGKLVRVVGLTLEATGCKAPVGSLCKVETMNGEMEAEVVGFSGDNLFLMPSEQIIGVLPGAKVTPITTESGLPVGMELLGRVIDGVGNPLDGLGPIYTDQRASLNAIPINPLARKPINEPLDVGIKAINGLLTVGKGQRIGLFAGSGVGKSVTLGMMTRGTTAQVVVVGLIGERGREVKEFIEEILGVDGRQRSVVVAAPADSSPLMRLKGCQTALTIAEYFRDQGLDVLLLMDSLTRFAQAQREIALSVGEPPATKGYPPSVFAKLPALVERAGNGGPHQGSITAFFTVLTEGDDLQDPIADASRAILDGHIVLSREMADAGHYPAIDVEKSVSRVMPQITTDEHLLMSKAVRQILSVCRKNQDLVSIGAYKPGTDKAIDAAFTLKPKLDQYLQQAMKETVPYDMCVNMLRHVLSS

SEQ ID NO: 88156 - protein, 489 aa, Oryza sativa Indica Group
MDLADPNHRLIAGAALLVATLAFIKLLLSSAGGGKKRLPPTIPAAPLVGGLLRFMRGPIPMIREEYARLGSVFTVPILSRKITFLIGPEVSAHFFKGNEAEMSQQEVYKFNVPTFGPGVVFDVDYSVRQEQFRFFTEALRANKLRSYVDQMVVEAEEYFSKWGESGTVDLKYELEHLIILTASRCLLGREVREKLFDDVSALFHDLDNGMQPVSVIFPYLPIPAHRRRDRARQRLKEIFATIIKSRKASGQAEEDMLQCFIDSKYKSGRSTTEGEITGLLIAALFAGQHTSSITSTWTGAYMLRFKQYFAAAEEEQKEVMKRHGDKIDHDILAEMDVLYRCIKEALRLHPPLIMLLRQSHNDFSVTTKDGKEFDIPKGHIVATSPAFANRLPHIFKNPDSYDPDRYAPGREEDKAAGAFSYISFGGGRHGCLGEPFAYLQIKAIWTHLLRNFEFELVSPFPETNWKAMVVGIKDEVMVNFKRRKLVVDN

SEQ ID NO: 88157 - protein, 459 aa, Pyrococcus furiosus DSM 3638
MEYPKIITKLPGPKATEIIERESRILSPGIGVKLFPLVPKRGFGALIEDVDGNIFIDFLAGAAAASTGYSHPKLVKAVQEQVALIQHSMIGYTHNERAIRVAEKLAKISPIKNPRIIFGMSGSDAVDMAIKVSKFSTRRPWILSFIGAYHGQTLGATSIAAFQSSQKRGFSPLMPNVIWLPYPNPYRNIWGIDGYEEPNELINRFLDYLENYVFSHLSPSDEVAALFAEPIQGDAGIVVPPENFFKEVQKVLNDLGILLVMDEVQTGIGRTGKWFASEWFSVEPDLIIFGKGVASGMGLSGVIGRKELMDLTSGAALLTPAANPVVSAAAEATLEIIEEENLLENALKVGNFIKKRLEEMKEVFEVIGDVRGKGLMIGVEIVKDRESKKPDPELTGKICWRAFELGLILPSYGMFQNVIRITPPLVITQEIAEKGLEIMERAIKDALAGKVERKVVTWH

SEQ ID NO: 88158 - protein, 425 aa, Synechococcus sp. CC9311
MTPERLGLLWGITVFAGAGARLLAALSNINGVVLLLLSGLLIGRSGLGLVEPLDLGQGLQTIVGLLVSLVLFDGGLNLRLPGDTIKATVLRISVLRIFISLGAGILAAHWLAGLGWSLAAVFSAIVLATGPTVVTPIVKQIRLAHPLGDVLEAEGLVLEPIGAVLALLLLELALGDLHGWRELAQGLLARLGGGVLIGVTVGWLLSEGLRRLTSLQPVGLRLQLTLGALFLMFGIAEWLLPESGLPASVAAGVVVGRRSTEEAGQLDELIRELASLAITMLFPLLAADVSWTELSPLGWGGVSCVLLLMFVVRPVAVSLATVGLPLVWRQKLFMAWLAPRGIVTAAVASLFAIRLEQAGILGAGRLQGLVFLTILMTVGIQGLTAQPLARALGLIAESPEESDATTSAVSEATTQALPIMPESGQ

SEQ ID NO: 88159 - protein, 276 aa, Zea mays
  misc_feature (240)..(240): Xaa can be any naturally occurring amino acid
MAPRKFFVGGNWKCNGTGDDVKKIVTFLNEAEVPSEDAVEVVVSPPFVFLQQAKGLLRPDFAVAAQNCWVRKGGAFTGEISAEMLVNLQVPWVILGHSERRALLNESNDFVADKVAYALAQGLKVIACIGETLEQREAGTTMEVVSAQTKAIAEKTSDWTNVVLAYEPVWAIGTGKVASPAQAQEVHDGLRKWLHANVGPAVAESTRIIYGGSVNGANCKELAAQPDLDGFLVGGASLKXPEFVDIIKSATVKSSSCLVVFEMHAVACRSGFCLSL

SEQ ID NO: 88160 - protein, 383 aa, Candida albicans SC5314
MSFLGSSSTGTSTTATSSAVTGQELLNDITINNPPEDSIEDISFSPQQDLLAVASWDKKVRIYEIDPNSGNNMGRAMYEHEAPVFSSRWSIDGTKIISGGADNQVKIFDLATQQAQQIGQHDSAVKSVRYVECGPTNTQVIASGSWDKTLKYWDMRSPQPVSTINLPERVYSMDNSQKLLVVGCADRHISIIDLNNPQQIFKSSQSPLKWQTRCVSCYPQANGFAVGSIEGRCAIQYITENEQKKFGFSFKCHRKSGGNTTGTTNTTGGAGAGLRTTSSSNANESHAYSVNAISFHPIYGTFSTAGSDGTFCFWDKDAKQRLKSFPELPGAISATAFNKTGTIFAYAISYDWSLGYMGNRQDYPNIIKLHATKDLEIKQKNKR

SEQ ID NO: 88161 - protein, 134 aa, Arabidopsis thaliana
  misc_feature (17)..(17): Xaa can be any naturally occurring amino acid
  misc_feature (42)..(42): Xaa can be any naturally occurring amino acid
  misc_feature (72)..(72): Xaa can be any naturally occurring amino acid
  misc_feature (86)..(86): Xaa can be any naturally occurring amino acid
  misc_feature (121)..(121): Xaa can be any naturally occurring amino acid
  misc_feature (128)..(128): Xaa can be any naturally occurring amino acid
IRKQWSKPFIMIKPDGXQRGLIGEVICRVEKEGFHFGKGLKXIGVERSFAEKHYEDLSSSLFFSGLVTTLYXGPVVAMIWEGKNVXLTGRKIVGATNPAAFEPGNIRGDFAIDMGRNGIMXGDSVESXRKEMAL

SEQ ID NO: 88162 - protein, 418 aa, Bacillus sp. TP10A.1
MMKCCRRVALVLLGLWLVFCLSVPGGRAEAAASRANDAPIVLLHGFTGWGREEMFGFKYWGGVRGDIEQLLNAQGYRTYTLAVGPLSSNWDRACEAYAQLVGGTVDYGAAHAAKHGHARFGRTYPGLLPELKRGGRVHIIAHSQGGQTARMLVSLLENGSKEEREYAKAHNVSLSPLFEGGHNFVLSVTTIATPHDGTTLVNMVDFTDRFFDLQKAVLKAAAVASNVPYTSQVYDFKLDQWGLRRQPGESFDQYFERLKQSPVWTSADTARYDLSVPGAEALNQWVQASPNTYYLSFATERTYRGALTGNYYPELGMNVFSAAVCAPFLGSYRNAALGIDDRWLENDGIVNTFSMNGPKRGSTDRIVPYDGTLKKGVWNDMGTYNVDHLEVIGVDPNPLFDIHAFYLRLAEQLASLRP

SEQ ID NO: 88163 - protein, 440 aa, Helicobacter pylori J99
MRAFLNRSFAPLLNPNENLLDQVKSSIILKKGVSYFDWGASGLASALVEKRVKSLLPYYANAHSVASKHAILMGMLLKECQEKLKRSLNLSANHCVLSAGYGASSAIKKFQEILGVCIPSKTKKNLEPYLKDMALKRVIVGPYEHHSNEVSWREGLCEVVRIPLNEHGLLDLEILEQTLKKTPNSLVSVSAASNVTGILTPLKEVSSLCKEYRAILALDLANFSAHANPKDCEYQTGFYAPHKLLGGVGGCGLLGISKDLIDTQIPPSFSAGGVIKYANRTRHEFIDELPLREEFGTPGLLQFYRSALAYQLRDECGLDFIHKKENNLLRVLVYGLKDLPAINIYGNLTASRVGVVAFNIGGISPYDLARVLSYEYAIETRAGCSCAGPYGHDLLNLNAQKSSDFNAKPGWLRVSLHFTHSINDIDYLLDSLKKAVKKLR

SEQ ID NO: 88164 - protein, 378 aa, Aspergillus nidulans FGSC A4
MGLRVKALAVAALATLSQASPVLYTREDTTSNTTYAFTNSNGLNFTQMNTTLPNVTIFATGGTIAGSAASNTATTGYQAGALGIQTLIDAVPEMLSVANIAGVQISNVGSPDVTSTILLEMAHRLNKVVCEDPSMAGAVVTHGTDTLEETAFFLDATVNCGKPIVIVGAMRPATAISADGPYNLLQAVTVASTKEARNRGAMVVMNDRIASAYYVSKTNANTMDTFKAVEMGYLGAIISNTPFFYYPAVQPSGKTTVDVSNVTSIPRVDILYSFQDMTNDTLYSSIENGAKGVVIAGSGAGSVDTAFSTAIDDIISNQGVPIVQSTRTGNGEVPYSAEGGISSGFLNPAKSRILLGLLLAQGGKGTEEIRAVFGKVAV

SEQ ID NO: 88165 - protein, 190 aa, Zea mays
MSGAIAELLKESGATDIWICDSKGIVGKHRTDLNSKKQSFAVDAEGTLADAMAGADVFLGVSAPGVVTKEMVQSMAKDPIVFAMANPIPEIQPELIQEDAAVIATGRSDYPNQINNVLAFPGVFRGAIDCRASIITTTMCIEAAKAIASLVHSNTLDSEHIIPSVFDNRVATTVASAVQLAARNEGVAGQ

SEQ ID NO: 88166 - protein, 367 aa, Oenococcus oeni PSU-1
MSLTAGIVGLPNVGKSTLFNAITKAGAEMANYPFATIEPNVGVVEVPDSRLARIQEIEPADKVVPTTFEFTDIAGIVKGASKGEGLGNKFLENIRQTDAIIEVVRAFEDSEITHVTGKVDPIADIETINTELIIADMEQIDKRYSKIEKAAVNSKDKAAIAEYNVLKKIKPVLEAGKPVRSLQFDEEEKKIVHNLFFLTDKPMLYVANISEGDMADPASSQFYQAISDYAAKDGAEVIGLAAKTEEEISEMDQADKADFLEMAGVSEPGLNKLIRAAYHLLGLRTFFTAGGKETRAWTFKSGMKAPQVAGIIHSDFERGFIRAETISFPDLDKLGSVAAVKAAGKLRSEGKEYLVQDGDIINFRFNV

SEQ ID NO: 88167 - protein, 518 aa, Arabidopsis thaliana
MESCFPAMKLNQCTFGLNNEIVSERVSAFWGTQVVKPNHLRTTKLRSAPQKKIQTNLIRSVLTPFVDQESHEPLLRTQNADPKNVASIILGGGAGTRLFPLTSKRAKPAVPIGGCYRLIDIPMSNCINSGIRKIFILTQFNSFSLNRHLSRTYNFGNGVNFGDGFVEVLAATQTSGDAGKKWFQGTADAVRQFIWVFEDAKTKNVEHVLILSGDHLYRMDYMNFVQKHIESNADITVSCLPMDESRASDFGLLKIDQSGKIIQFSEKPKGDDLKAMQVDTSILGLPPKEAAESPYIASMGVYVFRKEVLLKLLRSSYPTSNDFGSEIIPLAVGEHNVQAFLFNDYWEDIGTIGSFFDANLALTEQPPKFQFYDQKTPFFTSPRFLPPTKVDKCRILDSIVSHGCFLRECSVQHSIVGIRSRLESGVELQDTMMMGADFYQTEAEIASLLAEGKVPVGVGQNTKIKNCIIDKNAKIGKNVVIANADGVEEGDRPEEGFHIRSGITVVLKNATIRDGLHI

SEQ ID NO: 88168 - protein, 470 aa, Pseudomonas fluorescens PfO-1
MSVATSLIEESSARIASAPAETLYQFNESPLLARQSRQESNARSYPRRIPLALKRAKGLYVEDVEGRSFIDCLAGAGTLALGHNHPVVIEAIQQVLSDELPLHTLDLTTPVKDQFVQDLFGLLPPALAKEAKIQFCGPTGTDAVEAALKLVRTATGRSTVLSFSGGYHGMSQGALSLMGSLGPKKPLGALLSSGVQFMPFPYDYRCPFGLGGAAGVKANLSYLENLLNDPEAGVQLPAAVIVEAVQGEGGVIPADIEWLRGLRRITEKAGVALIIDEIQSGFARTGKMFAFEHAGIIPDVVVLSKAIGGSLPLAVVVYREWLDSWQPGAHAGTFRGNQMAMAAGSAVMRYLVEHKVCEHAAAMGERLSEHLRILQRDFPQLGDIRGRGLMLGVELVDPSGTPDALGHPPAFARLAPLVQRECLKRGLILELGGRHGAVVRFLPPLVITAAEIDRVAEIFGRALSAATATL

SEQ ID NO: 88169 - protein, 366 aa, Sinorhizobium meliloti 1021
MSYDQKRVVEAIRAFEAGEIVVVTDDGGRENEGDLIVAAVHCTPEKMAFIVRHTSGIVCTPMPREEAKRLNLNAMVAENDSAHTTAFTVSVDFKHGTTTGISADDRTLTVRNLANPNVGPTDFVRPGHIFPLVAREGGVLMRSGHTEAAVDLCRLASLPPIGVICELVNDDGTVMRGPQVEAFAETHGLKQVSVADLIAYRQRKETLIEQGHSFEMDTPYGKAKGHTYSLPWDTMQHLAVVFGDIRDGVDIPVRLHLENVGADVFGRGRQIDEIMKRIAAEGRGVIVYLREGSVGVGISQTARKGKHEREVHSEAQERESEWLEIGLGAQILKDLGITSIRLLSSRERHYVGLEGFGIKIAATEIL

SEQ ID NO: 88170 - protein, 237 aa, Oenococcus oeni PSU-1
MAKLVFIRHGQSEWNALNLFNGWVDTKLSEEGIRQAKEAGELLAEKGIQFDQAYTSVLTRAIQTLHIALEEIDQLWIPEEKSWRLNERHYGALQGLNKKASAEKWGDEQVHIWRRSYDTLPPLQDEIQKSITVNGKTYPALDRRYAELDPKTLPLGENLKVTLERVMPFWEDKIAPDLRAGKNVIIAAHGNSLRALSKYIENISDADIMGLEIANGQPIIYDFDENLKFTNKELLSK

SEQ ID NO: 88171 - protein, 448 aa, Zea mays
MVLQRFSWPYGGRSATFCGSFTGWRECPMGLVGAVFQVVFDLPPGVYQYRFLVDGVWRCDETKPFVRDEYGLISNEVLVENNVQPVVQPEPSIRGTNMDKGTILKTMPPEPSSQNPSMQIAVIRHVVSGILLHNTIYDVVPLSSKLTVLDTQLPVKQAFKIMHDEGLALVPLWDDRQGTITGMLTASDFVLILRKLQRNIQVIGNEEPISAWKEAKLQFYGGPDGAAMQRRPLIHVKDSDNLVDVALTIIRNEISSVPIFKCMADSSGVPFLNLATLQGILKFLCSKLQEEAEGCSLLHNQLLSIPIGTWSPHTGRSSSRQLRTLLLSSPLNTCLDILLQDRVSSIPIVDDNGSLRDVYSLSDIMALAKNDVYARIELEQVTVQNALDVQYQVHGRRQCHTCLQTSTLLEVLEGLSIPGVRRLVVIEQSTRFVEGIISLRDVFTFLLG

SEQ ID NO: 88172 - protein, 464 aa, Listeria monocytogenes str. 4b F2365
MLYSKENKESYLEPVFGSSAEDRDIPKYTLGKEPLEPRIAYRLVKDELLDEGSARQNLATFCQTYMEDEATKLMSETLEKNAIDKSEYPRTAELENRCVNIIADLWHAPKNQKFMGTSTIGSSEACMLGGMAMKFAWRKRAEKLGLDIYAQKPNLVISSGYQVCWEKFCVYWDIDMRVVPMDKDHMQLNTDQVLDYVDEYTIGVVGILGITYTGRYDDIYALNEKLEEYNSKTDYKVYIHVDAASGGFFTPFVEPDIIWDFRLKNVISINTSGHKYGLVYPGIGWVLWKDESYLPEELIFKVSYLGGEMPTMQINFSRSASHIIGQYYNFLRYGFEGYRTIHQKTSDVAQYLAHAVEQTGYFDIYNDGSHLPIVCYKLKDDANVKWTLYDLADRLQMRGWQVPAYPLPKNLENIIIQRYVCRADLGFNMAEEFIQDFQASIQELNNAHILFHDTQQSGVHGFTH

SEQ ID NO: 88173 - protein, 415 aa, Mycobacterium avium subsp. paratuberculosis K-10
MTATQLDVAAIRADFPILKRIMRSGNQLAYLDSGATSQRPLQVLDAEREFLLTSNGAVHRGAHQLMEESTDAYEQGRADIAAFVGADPDELVFTKNATEALNLVSYVVGDNRFEGAVGPGDVIVTTELEHHANLVPWQELARRTGASLRWYGVTDDGRIDLDSLQLDERVKVVAFSHHSNVTGAVAPVAELVGRARAVGALTVLDACQSVPHQPVDFHALDVDFAAFSGHKMLGPNGIGVLYGRREVLSQLPPFLTGGSMIETVTMESSSYAQVPQRFEAGTPMTSQVVGLAAAARYLGAFGMDAVQAHEERLVAAAIEGLSGIDAVRIVGPTSTENRGSPVSFVVDGVHAHDVGQVLDDEGVAVRVGHHCALPLHRRFGLAATARASFAVYNTAEEVDRLVAGVRRALDFFGGV

SEQ ID NO: 88174 - protein, 291 aa, Zea mays
  misc_feature (243)..(243): Xaa can be any naturally occurring amino acid
  misc_feature (274)..(274): Xaa can be any naturally occurring amino acid
MATKRSVGTLGEADLKGKKVFVRADLNVPLDDAQKITDDTRIRASIPTIKYLLEKGAKVILASHLGRPKGVTPKFSLKPLVPRLSELLGLEVVMAPDCIGEEVEKLAAALPDGGVLLLENVRFYKEEEKNDPEFAKKLASVADLYVNDAFGTAHRAHASTEGVTKFLMPSVAGFLMQKELDYLVGAVANPKKPFAAIVGGSKVSSKIGVIESLLAKVDILILGGGMIFTFYKAQGLAVGKSLXVEEDKLELATSLIETAKSKGVKLLLPTDVVXVADKFAADAESKIVPAL

SEQ ID NO: 88175 - protein, 182 aa, Mesembryanthemum crystallinum
MASSMVSSAAVATVNRTPAQASMVAPFNGLKSVAAFPVTKKNNDITSVATNGGRVQCMQVWPPLGKKKFETLSYLPPLSEESLMKEVQYLLNNGWVPCLEFEPTHGFVYREHGNTPGYYDGRYWTMWKLPMFGCTDPSQVVAELEEAKKAYPEAFIRIIGFDNVRQVQCISFIAYKPASYDA

SEQ ID NO: 88176 - protein, 180 aa, Mesembryanthemum crystallinum
MASMMSNAAVVGRTTPAQASMVAPFTGLKSVSAFPVTKKSNDITSIASNGGRVQCMQVWPPLGKKKFETLSYLPPLSEESLMKEVQYLLNNGWVPCLEFEPTHGFVYREHGNTPGYYDGRYWTMWKLPMFGCTDPSQVVAELEEAKKAYPEAFTRIIGFDNVRQVQCISFIAYKPASYDA

SEQ ID NO: 88177 - protein, 183 aa, Mesembryanthemum crystallinum
MASSLMSNAATTMAAATTTAQANMVAPFNGLKSVSAFPVTRKNNDITSVASNGGRVQCMQVWPPLGKKKFETLSYLPPLSEESLMKEVQYLLNNGWVPCLEFEPTHGFVYREHGNTPGYYDGRYWTMWKLPMFGCTDPSQVVAELEEAKKAYPEAFIRIIGFDNVRQVQCISFIAYKPASYDA

SEQ ID NO: 88178 - protein, 416 aa, Triticum aestivum
  misc_feature (216)..(216): Xaa can be any naturally occurring amino acid
  misc_feature (230)..(230): Xaa can be any naturally occurring amino acid
MGATEPQWVLMATGRSPTNIAVIKYWGKRDEALILPVNDSISVTLDPDHLSATTTVAASPSFPSDRMWLNGKEIALSGGRFQSCLREIRKRARDVEDEKKGIKIKKEDWEKLHVHIASYNNFPTAAGLASSAAGLACLVFTLGKLMNVNEDYGELSSIARQGSGSACRSIYGGFVKWCMGKNDDGSDSMAVQLVDESHWDDLVIIIAVVSSKQKEXSSTSGMRDTVETSXPLLQYRAQTVVPSRILKMEDAIKNRDFESFARLTCADSNQFHAVCLDTSPPIFYMNDTSHRIISLVEKWNHSEGTPQVAYTFDAGPNAVLIARNRKTATLLLQRLLYTFPPQKNDLDSYMLGDKSILSDAGLQSIADVEALPAPPEMKAPNQKFKGDVSYFICSRPGAGPKVLTDESHALIDSATC

SEQ ID NO: 88179 - protein, 183 aa, Mesembryanthemum crystallinum
MASSLMSNAATTMAAATTTAQANMVAPFNGLKSISAFPVTRKNNDITSVASNGGRVQCMQVWPPLGMKKFETLSYLPPLSEESLLKEVQYLLNNGWVPCLEFEPTHGFVYREHGNTPGYYDGRYWTMWKLPMFGCTDPSQVVAELEEAKKAYPEAFIRIIGFDNVRQVQCVSFIAYKPASYGA

SEQ ID NO: 88180 - protein, 229 aa, Triticum aestivum
  misc_feature (164)..(164): Xaa can be any naturally occurring amino acid
  misc_feature (183)..(183): Xaa can be any naturally occurring amino acid
MEEVDPASANSQASTGDAAADQPINVYVWDLDETLILLKSLLDGSFAGHFEGLKDHEKGTEIGKRWENIILELCDEHFFYEEIENYNQPYLSSLHEYDDGKDLTKYDFEADCFSSPFDDVNKRKLAYRHRAIGDKYAKGWQKILDHRMFKVWSDLYSPTDKYTXDGGVSSAHHSCWEEALGKXTLTRCQTSKYIAYYFKALVPTCQCLLPWMSGPTNKFLGNGNSCLNG

SEQ ID NO: 88181 - protein, 390 aa, Pyrococcus furiosus DSM 3638
MKEKRKYFMAHRIGVIQRSKIRELFERASKMENVISLGIGEPDFDTPNNIKEAAKRALDEGWTHYTPNAGIPELREAIAEYYKKFYGIDVEVDNVLVTAGAYEATYLAFETMLEQGDEVIIPDPAFVCYVEDAKLAEAKPIRLPLREENDFKPDIDELLERITKRTRMIVINYPNNPTGAVLDKETAKAIADVAEDYNIYILSDEPYEHFLYDDAKHYPMIKFAPDNTILANSFSKTFAMTGWRLGFVIAPTQIIREMIKLHAYIIGNVASFVQVAGIEALRSKESWKAVEEMRKEYNERRKLVLQRLRKMPYIKVREPKGAFYVFPNISETEMSSEEFSEWLLEKAKVVVIPGTAFGENGEGYVRISYATSREKLIEAMDRIEKALEEI

SEQ ID NO: 88182 - protein, 85 aa, Glycine max
  misc_feature (47)..(47): Xaa can be any naturally occurring amino acid
  misc_feature (61)..(61): Xaa can be any naturally occurring amino acid
RGALPPRPGKKLSNPPKIQKMGAPLTLGRNRAKSGLKNKRFAWAFFXTAGGHKLEAHRFKXPRDRPTQSLAKKKSELSSDAKAAV

SEQ ID NO: 88183 - protein, 258 aa, Streptomyces avermitilis MA-4680
MGKLDGRVVLISGAARGQGEQEARLFVEEGAKVVVADVLDDQGEALAKEIGARYVHLDVGREDDWQAAVTVAKDAYGHIDGLVNNAGILRFNDLVGTPLAEFQQIVQVNQVGVFLGIKTVAPEIEAAGGGTIVNTASYAGLTGMAYVGAYTATKHAIVGLTRVAALELAAKKIRVNAVCPGAIDTAMSNPSQLDPGADPEETARALSELYGRLVPLGRIGRPEEVARLALFLSGEDSSYITGQPFVIDGGWLAGVSVI

SEQ ID NO: 88184 - protein, 630 aa, Zea mays
MESGLVASHRLRVPPPSASAGHHHLIRHRHAHAPVAAAPLRLSLPRHLPRSTPLRLPAALPLRHCLPPLRAASAAAAAVPAPGDDASPKFLGVETKTIKKIVPLGLMFFCILFNYTILRDTKDVLVVTAKGSSAEIIPFLKTWVNLPMAVGFMLLYTKLADVLSKEALFYAVIFPFIAFFGAFAYVLYPMRDAIHPTALADRLLASLGPSFLGPVAILRVWSFCLFYVMAELWGSVVISVLFWGFANQITTVEEAKEFYPLFGLGANVALIFSGRTVKYFSNMRKNLGPGVDGWAISLKAMMSIVVVLGLVITGIYWGVNKFVIDNSSVPVVERKKKDKPKLSMGESMKVLLSSRYVRDLATLVVAYGISINLVEVTWKSKLKAQFPSPNEYSSFMGDFSTATGIATFTMMLLGRVILRKFGWGVAATITPAVLLLTGVGFFSLILFGEPLTPLMTKFGMTPLLAAVYVGAMQNIFSKSAKYSLFDPCKEMAYIPLDEDMKVKGKAAIDVVCNPLGKSGGALIQQFMILSFGSLANSTPYLGGILLVIVLAWLGAVRSLDLQFSSLAKQELGREKLLKTQAVETVAEVVGTGNGSLQETLASEPSANGAATKQSQEPESTAPEKSGQQSQ

SEQ ID NO: 88185 - protein, 196 aa, Oryza sativa
MLTSTPPLFSAMEHHHHHVRPDGELRLLLLPATAPTTPRDDDGAAATLFPPAQPPRDHPQLDLSLSIRIGPPPPPPSHTRTATATAQAQAGQQKKASAAAGFDDGDGDDVRALKQQAAEQARLASAERAYAERVMELARRELEVAEREFARARAIWERARGEVHKVERMKEVAAARRIGAAALEITCHACMQRFHS

SEQ ID NO: 88186 - protein, 222 aa, Helicobacter pylori J99
MLDYRQRIDTLITKIEKARIAYSRHHIVKIVAVSKNASPEAIQHYYNCSQRAFGENKVQDLKIKMHSLEHLPLEWHMIGSLQENKINALLSLKPALLHSLDSLKLALKIEKRCEILGVNLNALLQVNSAYEESKSGVVPEEALETYSQISETCKRLKLKGLMCIGAHTDDETKIEKSFTTTKKLFDQIKNASVLSMGMSDDFELAIACGANLLRIGSFLFKE

SEQ ID NO: 88187 - protein, 380 aa, Thermobifida fusca YX
MKAVVYKEPFTVAVEEVADPRIEDPNDVIIRVTTSAICGSDLHMYEGRTGATPGMVFGHENMGIVEEVGSGVASIRKGDRVVLPFNVACGFCKNCLAGKTGFCLTVNPGFAGGAYGYVAMGPYQGGQSEYLRVPFADFNCLKLPPGTEFEDDFALLADIFPTGYHATELAQVSPGETVSVFGAGPVGLMAAYSAILRGASRVFVVDRVPSRLSLAERIGAIPIDYSKGDPVAQIKEHTNGEGTDKGIDAVGYQATAPEGEEQPALVLNTLVDTVRPTGALGVVGLYVTEDPGAPSESAKQGELLFAMGKLFEKGQRMGTGQANVKAYNRQLRDLIIAGRAKPSFVVSQRIPLQRAPEAYEKFDKREEGWTKVLLKPQQES

SEQ ID NO: 88188 - protein, 398 aa, Lactococcus lactis subsp. lactis Il1403
MAKLTVKDVELKGKKVLVRVDFNVPIKDGVITNDNRITAALPTIKYILEQGGRAVLFSHLGRVKEEADKAGKSLAPVAKALSEKLGQDVVFPGTTRGAELEAAINELKDGEILLVENTRFEDIDGKKESKNDPELGKYWASLGDGIFVNDAFGTAHRAHASNVGISANVDKAVAGFLLENEIAYIQEAVEAPERPFVAILGGSKVSDKIGVIENLLSKADKVIIGGGMAYTFLKAQGYEIGTSLVEDDKLDLAKELLEKAAGKLILPLDHKVANAFAGYTEVKETADQNIPAGFMGLDVASKTIADYNTQLEGAKTVVWNGPVGVFENTDFQAGTVGLMEAIVKQPGVKSIIGGGDSAAAAINLGYADKFSWISTGGGASMELLEGKVLPGLAALTEK

SEQ ID NO: 88189 - protein, 362 aa, Pseudomonas putida GB-1
MNDLSHTHMRAAVWHGRNDIRVEQVPLPADPAPGWVQIKVDWCGICGSDLHEYVAGPVFIPVEAPHPLTGIQGQCILGHEFCGQIAKLGEGVEGFAVGDPVAADACQHCGTCYYCTHGLYNICERLAFTGLMNNGAFAELVNVPANLLYRLPQGFPAEAGALIEPLAVGMHAVKKAGSLLGQTVVVVGAGTIGLCTIMCAKAAGAAQVIALEMSSARKAKAKEVGASVVLDPSQCDALAQIRALTAGLGADVSFECIGNKHTAKLAIDTIRKAGKCVLVGIFEEPSEFNFFELVSTEKQVLGALAYNGEFADVIAFIADGRLDIRPLVTGRIGLEQIVELGFEELVNNKEENVKIIVSPGVR

SEQ ID NO: 88190 - protein, 132 aa, Glycine max
HWGDLKEEWAACKIGQIQSPIDLSTNGVEVIPKLGGLKYWNYKPQHATVSNRGHDVAVIWEGDAGSIDINGTPFFLQQAHWHWPSEHTINGRRYDLELHMVHVSPQPDGTNKTAVVGILYKYGSPDPLLSKL

SEQ ID NO: 88191 - protein, 351 aa, Oryza sativa Indica Group
MGVYLSTPKTEKYSGEGGNDRLRYGLASMQGWRTTMEDAHTALPRLDECTSFFGVYDGHGGKAVSKFCAKHLHLQVLKNEAYSSGDLATSVLKSFFRMDEMMKGQRGWRELAELGDKGQKFTGMLEGIIWSPKPGESDKPEDTWTEEGPHSHFPGPTSGSTACVAIIRNDELIVANAGDSRCVLSRKGRAYDLSKDHKPDLDAEKERILNAGGFIVAGRVNGSLNLARAIGDMELKQNEFLPAERQIVTAEPELNTVKLSEDDEFIVLACDGIWDCMSSQEVVDFVHKEMNTEDSLSAVCEKLLDHCLAPVSGGDGCDNMTVIIVKFKKPSKSAATSSTNQSVSSEEMRPK

SEQ ID NO: 88192 - protein, 700 aa, Arabidopsis thaliana
MGSASIGYQFGISARFYGNFNLSSDITVSSLPCKLDVSIKSLFSAPSSTHKEYSNRARVCSLPNTDGYCDEKFETPILDSIETPLQLKNLSVKELKLLADEIRTELHSVLWKKTQKSMNPSFAAIELTLALHYVFRAPVDNILWDAVEQTYAHKVLTRRWSAIPSRQNSGISGVTSRLESEYDSFGTGHGCNSISAGLGLAVARDMKGKRDRVVAVIDNVTITAGQAYEAMSNAGYLDSNMIVILNDSRHSLHPNMEEGSKASISALSSIMSKIQSSKVFRKFRELAKAMTKRIGKGMYEWAAKVDEYARGMVGPTGSTLFEELGLYYIGPVDGHNIEDLVCVLREVSSLDSMGPVLVHVITEGNRDAETVKNIMVKDRRTYSDCFVEALVMEAEKDRDIVVVHAGMEMDPSLLTFQERFPDRFFNVGMAEQHAVTFSAGLSSGGLKPFCIIPSAFLQRAYDQVVHDVDRQRKAVRFVITSAGLVGSDGPVQCGAFDIAFMSSLPNMIAMAPADEDELVNMVATAAYVTDRPVCFRFPRGSIVNMNYLVPTGLPIEIGRGRVLVEGQDVALLGYGAMVQNCLHAHSLLSKLGLNVTVADARFCKPLDIKLVRDLCQNHKFLITVEEGCVGGFGSHVAQFIALDGQLDGNIKWRPIVLPDGYIEEASPREQLALAGLTGHHIAATALSLLGRTREALLLMS

SEQ ID NO: 88193 - protein, 471 aa, Geobacillus kaustophilus HTA426
MNLFRKKPIQLLMKESGAKGASLRKELGAFDLTMLGIGAIIGTGIFVLTGVAAAEHAGPALVLSFILSGLACVFAALCYAEFASTVPVSGSAYTYSYATFGELIAWILGWDLILEYGVASSAVAVGWSGYFQGLLSGFGIELPKALTSAYDPAKGTFIDLPAIIIVLFITFLLNLGAKKSARFNAVIVAIKVAVVLLFLAVGVWYVKPENWTPFMPYGFSGVATGAATVFFAYIGFDAVSTAAEEVRNPQRDMPIGIIVSLLVCTLLYIAVSLVLTGIVPYEQLNVKNPVAFALNYIHQDWVAGFISLGAIAGITTVLLVMMYGQTRLFYAISRDGLLPKVFARISPTRQVPYVNTWLTGAAVAVFAGIIPLNKLAELTNIGTLFAFITVSIGVLVLRKTQPDLKRAFRVPFVPVVPILAVLFCGYLVLQLPAMTWIGFVSWLLIGLVIYFIYGRKHSELNEMARTEEKAG

SEQ ID NO: 88194 - protein, 320 aa, Oenococcus oeni PSU-1
MSEFITIGEPIVTFASTDADADLVHAENFKKIVGGAELNVAIGVSRLGHSTQYISRVGNDPLGTFVKNEIKSNQVGADYVSSDNDNWTAFQLKEKVTVGDPLTFNFRRNSAAAHLSSGIIDRVDLSDVKIAHMSGIFPAISKTAQTSFRHLFERLNQRNIFTTFDPNLRPSLWPNEKTMIKTINELAAFADVVLPGTNEGEILIGSKDPETIADFYLQADKTKTVIVKVGPQGAYVKNKGQSGYYVNGFKVGKVVDTVGAGDGFALGYITATLEGKSQKSAVMRGNAVGALQVQTPGDNDGYPTVKKLADFYAKEGVSEK

SEQ ID NO: 88195 - protein, 288 aa, Zea mays
MGKEVDVSTLEAGGVRDRDYADPPPAPLIDIDELGKWSLYRAVIAEFVATLLFLYITVATVIGYKHQTDASASGPDAACGGVGILGIAWACGGMIFILVYCTAGISGGHINPAVTFGLFLARKVSLVRALLYMAAQSLGAVCGVALVKGFQSGFYARYGGGANEVSAGYSTGTGLAAEIIGTFVLVYTVFSATDPKRNARDSHVPVLAPLPIGFAVFMVHLATIPITGTGINPARSLGAAVVYNNSKAWSDQWIFWVGPFIGAAIAALYHQIVLRASARGYGSFRSNA

SEQ ID NO: 88196 - protein, 341 aa, Populus trichocarpa
MACDKKIKIGINGFGRIGRLVARVALQRDDVELVAINDPFITTDYMTYMFKYDTVHGRWKHSELKVKDEKTLLFGEKAVAVFGIRNPEEIPWAQAGAEFVVESTGVFTDKDKAAAHLKGGAKKVVISAPSKDAPMFVVGVNEKQYTPDLDIVSNASCTTNCLAPLAKVIHDRFGIVEGLMTTVHAITATQKTVDGPSMKDWRGGRAASFNIIPSSTGAAKAVGKVLPALNGKLTGMSFRVPTVDVSVVDLTVRLEKKATYEAIKSAIKEESENNLKGILGYVEEDVVSTDFIGDSRSSIFDAKAGIALNDNFVKLVSWYDNEWGYSSRVIDLIAHMAKTQA

SEQ ID NO: 88197 - protein, 431 aa, Arachis hypogaea
GRGEFGVTYLCIDRGSRELLACKSISKRKLRTAVDVEDVRRKVAIMRHLPRSSSIVSLREACEDDNAVHLVMELCEGGELFDRIVARGRYTERAAAVVARTVVEVVQLCHRHGVIHRDLKPENFLFANKKENSPLKAIDFGLSVFFKPGEKFSEIVGSPYYMAPEVLKRNYGPEIDIWSAGVILYILLCGVPPFWAESEQGGAQAILRGLIDFKREPWPSISESAKSLVKQMLEPDPKLRLTAKQVLEHPWIQMLRRAPNIPLGDAVKSRLKQFSMMNRFQKKALRVIADFLSNEEVEDIKDIFQKMDTDNDGIVSIEELKAEFQNFGSQLAESEIQMLLEAVNTNGKGTLDYGEFVAVSLHLKRMANDEHLRKAFSYFDKDGNGYIEPDELRNALMEDGTDDCADVANDIFQEVDTDKDGRISYEEFVAM

SEQ ID NO: 88198 - protein, 165 aa, Bacillus cereus E33L
MNQIEKITHAAMNGDMPTIQEILNENPDLVNTFSQDGWTPLHLAAYFGKEEAARLLLSLGADVHARAKNSNENMPLHAAVANKQAKLVELLIKNGADINAKQSGGWTSLHEAALLGNTEIVELLIKEGANIQLRKDDEKTPLDIALEKEQNEVVNLIKQHINTAS

SEQ ID NO: 88199 - protein, 161 aa, Sinorhizobium meliloti 1021
MTIAVGDKLPNATFKEKTADGPVEVTTELLFKGKRVVLFAVPGAFTPTCSLNHLPGYLENRDAILARGVDDIAVVAVNDLHVMGAWATHSGGMGKIHFLSDWNAAFTKAIGMEIDLSAGTLGIRSKRYSMLVEDGVVKALNIEESPGQATASGAAAMLELL

SEQ ID NO: 88200 - protein, 538 aa, Pseudomonas fluorescens PfO-1
MPQIQSQLDPHSEAFARNRAAMLAAIEQVQQLEQNLLHKAAEAKPKFDKRGQLLPRERLNLLLDPGAPFLELASLAGYKLHDDKDGSSAGGGLIAGIGYVSGVRALIVANNSAIKGGTISPSGLKKSLRLQQIAQENKLPVITLAESGGANLNYAAEIFVEGARSFANQARMSAMGLPQITVVHGSATAGGAYQPGLSDYVVVVRGKAKLFLAGPPLLKAATGEVATDEELGGAEMHAQVAGTAEYLAENDADGVRQVREIVSLLNWNEQLPWLPEPQFKEPLYPIDELLGLIPDDPKKPYDVREIIARIADESRFLEFKGEFDQQTVCGHLKIQGRACGFIGNNGPITPNGASKAAQFIQLCDQSQTPLLFFHNTTGFMVGTESEQHGVIKHGSKLIQAVANARVPKLTIVVGGSYGAGNYAMCGRGLDPRFIFAWPNSRTAVMGGAQAGKVLRIVTEAKQLKDGLVPDPKMLDMLEQVTAQKLDSQSTALYGSANLWDDGLIDPRDTRTLLGYLLDICHEADVRRLQPNSFGVSRF

SEQ ID NO: 88201 - protein, 315 aa, Setosphaeria turcica
TNIISGEEIAIKLESVKAKHPQLEYEARVYKSLAGGVGIPFVRWFGTECDYNAMVLDLLGPSLEDLFNFCNRKFSLKTVLLLADQLISRIEYIHAKSFIHRDIKPDNFLMGIGKRGNQVNVIDFGLAKKYRDPKTHFHIPYRENKNLTGTARYASINTHLGVEQSRRDDMESLGYVMLYFCRGSLPWQGLKAATKKQKYDRIMEKKMTTPTEVLCRGFPNEFAIYLNYTRSLRFDDKPDYSYLRKIFRDLFVREGFQYDYVFDWTVYKYQKNAQAIAQAANQGQGDEDEQGRGRHVTTTAAANAGTAAGTKRGPV

SEQ ID NO: 88202 - protein, 182 aa, Mesembryanthemum crystallinum
MASSLMSNAATTMAAATTTAQANMVAPFNGLKSISAFPVTRKNNDITSVASNGGRVQCMVWPPLGMKKFETLSYLPPLSEESLLKEVQYLLNNGWVPCLEFEPTHGFVYREHGNTPGYYDGRYWTMWKLPMFGCTDPSQVVAELEEAKKAYPEAFIRIIGFDNVRQVQCVSFIAYKPASYGA

SEQ ID NO: 88203 - protein, 186 aa, Mesembryanthemum crystallinum
MASSMLSNAAVATTAASRSAGAQASMVAPFTGLKSVSAFPVTRKSSNDLSTVPSNGGKVQCMQVWPPLGKKKFETLSYLPPLSEESLLKEVQYLLNNGWVPCLEFEPTHGFVYREHGNTPGYYDGRYWTMWKLPMFGCTDPSQVVAELEEAKKAYPEAFIRIIGFDNVRQVQCVSFIAYKPASYDA

SEQ ID NO: 88204 - protein, 678 aa, Ostreococcus tauri
MSAARAPVTRGADEDADVCATRRVDRAREVRCPRVITETRRGPDGAPRYRRYVRERLLGRGGFAAVFAVREMSTGRELACKVIAKSTLTKPRQWKKMKTEIEIHARARSERVVRFERCFEDERHVYILMEMCSSKTLWDIVKARGGMGETHAACYVREALTATAHLHSIRIVHRDLKLGNLFLTQEGLEEIDAAGPGWNDALGKRGGPGRLKIGDFGLACVLEHRGDRRKTICGTPNYIAPEVLRGKDGVGHSYEVDTWSLGVILYTLLYGTPPFQSKDVKLTYKRIRENDYEFPEEPLVSDSTKALIRAALHPEPSKRPSLAQFAAHPFMRLGARDWSLENELVAAPEPALIMDKPSINVKSRKLQERDNVVSNTNDAPLRSPLQTIDQNAPKHHAPSPRAEAKRERFSPEDAHNRDADRALLSTKLQVMSLDAPSSEAHEMLGYFPKLWVDSWIKWEYTRDYGMPYQLSDGTVGVYFNDDSSMVFMTDADDSPVVYTPPANERESSTRRDGDGDNSGETKRANVRIIGRTIINPDDARSMYGRAVAKKVLLAMHFRAYFLGKIEDTMNAVVRSCGGLRSVDDARLRSPHAMPPYVKHWTQSSKGISWRLSNKTIQTNFEDGTEMLISTTYRLVVRNDPRLGEQTVHSLDADNATFPQPLVDGLKHVQRILPALCTE

SEQ ID NO: 88205 - protein, 545 aa, Mycobacterium avium subsp. paratuberculosis K-10
MITATDLEVRAGARILLSPDGPDLRVQPGDRIGLVGRNGAGKTTTLRILAGETEPYTGTIARSGEIGYLPQDPKEGDLDVLARDRVLSARGLDVLLTDLEKQQALMAEVADDDARDRAIRRYGQLEERFVALGGYGAESEASRICASLGLPERVLTQQLRTLSGGQRRRVELARILFAAAEGGATGSGSATTLLLDEPTNHLDADSIGWLRDFLRAHTGGLVIISHNVELLADVVNRVWFLDAVRGEVDVYNMSWQKYLDARATDEQRRRRERANAERKAAALRTQAAKLGAKATKAVAAQNMLRRADRMMAALDEERVADKVARIKFPTPAACGRTPLTATGLSKSYGSLEVFSGVDLAIDRGSRVVVLGLNGAGKTTLLRLLAGAETPDTGRIEPGHGLRIGYFAQEHDTLDNDATVWQNIRHAAPDSGEQDLRGLLGAFMFSGPQLDQPAGTLSGGEKTRLALAGLVASTANVLLLDEPTNNLDPASREQVLDALRSYTGAVVLVTHDPGAAEALDPQRVVLLPDGTEDYWSDEYRDLIELA

SEQ ID NO: 88206 - protein, 246 aa, Bifidobacterium longum DJO10A
MTYKLVLLRHGQSAWNKTNQFTGWVDVPLTEQGEAEAKRGGELLKEKNVLPDIVFTSLLRRAINTANIALDAADRLWIPVQRDWRLNERHYGALQGKNKTEIREEYGDEKFMLWRRSYATPPPEIDPNDQYAQNNDPRYAGDPVPEAECLANVVERVKPYFESAIEPELKAGKTVLIAAHGNSLRAIVKMLDNLSEEEIAKVNIPTAIPLLYELDENFKPIKPRGEYLDPEAAAAGAAAVAAQGQK

SEQ ID NO: 88207 - protein, 895 aa, Coccidioides immitis RS
MPSPSNVRTPPVHGRGTSQGGIKPRVVSSSRAYNASTSRHERVASKENVPLGSDMVPGLKTSTRERDSRAPSELRTERSHTTTREKVQVRTKRPTRETASSANRDWDRSRTKTNAGSPVAKAKEKELNEAPWIPKVSLIPHSAAPLSCRVSVPPLSSTVPQRLRPKPLKELSMDAQEAAILQDLLFVFMGYEGEYIHFANTYNPELESDRLVGPSYQIMPGLDPSLRDLTMGMLKMATHYSAMEAFVEVQSRAEFGAVNHALCAAIRKLLKDYLILIAQLESQLLNNPNFTLHVLHLHTMPTAQSLAQLYSFGQELLKRNSLLAQDPDESIDDFDDVENILEQLREGGDLAPGGMSNKKFCKGGNVLGLLTQRLATFSGDPATKVLLQTLLRESSRPYMRMLNEWLHHGEIKDPHAEFLVKEQKGIKRDKLEEDYTDEYWDKRYTIRETEVPPQLETVKDKVLLAGKYLNVVRECGGVDISKEMKDVPQTFDDPRFLDNVNGAYTHANASLLNLLLTKNSLTTRFRSLKHYFFLDRSDFFSYFLELGASELRKPAKSVNEGKLQSLLDIVLRQPGSIAAQDPFKEDVKVRMNQVGLTKWLMRVVSVSGIDQDNPETNPEKYQTPASQAVDDDKDIAGFDALELDYLVPFPLSLVISRKTVLRYQLIFRHLLSLRYLESLLVNCWQDHIKVVSWTHKSSDRRVELWKRKAWALRARMLVFVQQLLYFCTAEVIEPNWQILMDRVNGDDAESTEVMVNGTKQVNRTVDELMQDHVDFLDTCLKECMLTQGKLLKVHSKLMTCCTMFASWTASSLARSLAAADPDLSGNNAKQTPGLESSRSYDPARLAKLEDTLKRYEDHFGRHLRILMDSLNYFAATESVVLLKLAHALSAIMKDE

SEQ ID NO: 88208 - protein, 453 aa, Listeria monocytogenes str. 4b F2365
MKVIKFGGSSLASGIQLNKVFQLVAEDPDRKIVVVSAPGKRFKEDTKVTDLLIDCAAKALLGEDTSELFESVIARYAGIALDTGMSDEIINQIRADLQATISSDKSDPDKFLDRMKASGEDNNAKLIAAYFKFKGLNANYINPKDAGLLVTDEHASAQVLPESYDRLFALREREGIIVFPGFFGYTKDGEISTFSRSGSDITGAIVANGAQAELYENFTDVDAVYAVNPAIVKNPKKVLELTYREMRELSYAGFSVFHDEALIPAFHAGIPVHIKNTNNPDSCGTRVVHERENNNGPVVGIASDDGFCSIYISKYLMNREIGFGRKVLQILEDAGLNYEHMPSGIDDLTIIIRENQFGEDTEQTIMSRLKEELNADQVIMQHGISLIMVVGETMRHNVGITSRASKALSDAKVNIEMINQGSSEVSIMFGVKEEQENTAVRALYNEFFSEVLV

SEQ ID NO: 88209 - protein, 124 aa, Arabidopsis thaliana
  misc_feature (2)..(2): Xaa can be any naturally occurring amino acid
  misc_feature (10)..(10): Xaa can be any naturally occurring amino acid
  misc_feature (12)..(12): Xaa can be any naturally occurring amino acid
  misc_feature (31)..(31): Xaa can be any naturally occurring amino acid
  misc_feature (39)..(40): Xaa can be any naturally occurring amino acid
  misc_feature (42)..(42): Xaa can be any naturally occurring amino acid
  misc_feature (52)..(52): Xaa can be any naturally occurring amino acid
  misc_feature (54)..(56): Xaa can be any naturally occurring amino acid
  misc_feature (59)..(59): Xaa can be any naturally occurring amino acid
  misc_feature (62)..(63): Xaa can be any naturally occurring amino acid
  misc_feature (65)..(65): Xaa can be any naturally occurring amino acid
  misc_feature (67)..(68): Xaa can be any naturally occurring amino acid
  misc_feature (73)..(73): Xaa can be any naturally occurring amino acid
  misc_feature (78)..(78): Xaa can be any naturally occurring amino acid
  misc_feature (80)..(80): Xaa can be any naturally occurring amino acid
  misc_feature (82)..(82): Xaa can be any naturally occurring amino acid
  misc_feature (84)..(84): Xaa can be any naturally occurring amino acid
  misc_feature (86)..(86): Xaa can be any naturally occurring amino acid
  misc_feature (88)..(88): Xaa can be any naturally occurring amino acid
  misc_feature (91)..(91): Xaa can be any naturally occurring amino acid
  misc_feature (93)..(94): Xaa can be any naturally occurring amino acid
  misc_feature (96)..(96): Xaa can be any naturally occurring amino acid
MXSSMLSSTXGXTSPAQATMVAPFTGLKSSXSFPVTRKXXNXITFITSKGGXVXXXKVXPPXXKXKXXTLSLXSLTLXTXKXGXGXVXTFXPXXRXIPWQAFCYPHEPPPTLFVHNIRPVKKIN

SEQ ID NO: 88210 - protein, 179 aa, Candida glabrata CBS 138
MDKKGKYVVLVSGEGEKFTVEKKIAQRSLLLKNYLNDMHESSLDDEDEEQDEDEDEDDEIVMPVPNVRSSVLQKVIEWAEHHRDSNFPDEDDDDSRKSAPVDAWDREFLKVDQEMLYEIILAANYLNIKPLLDAGCKVVAEMIRGRSPEEIRRTFNIVNDFTPEEEAAIRRENEWAEDR

SEQ ID NO: 88211 - protein, 597 aa, Ureaplasma parvum serovar 3 str. ATCC 700970
MSESTLYRKYRPHKFKNVIGQDLIKQALMNACLNNKITHAYIFSGPRGIGKTSIARIFASSINCLNPNKGDCCGKCSVCESILKEQSVDLIELDAASNNGVDQIRIITDNINYLPTFFKYKVYIIDEAHMLSTSAWNALLKTVEEPPQHVIFIFATTEYQKIPLTIISRCQRYDFKRLNNSELQELIDSILTKEDIKIDNNAIDKLIQLADGSGRDCLSILDQLTTVKKNIDLDLINKTFGLVDNFKVISLIELIQKNDILLLREFIYELYNQGVNLEAFCVQIINVLIDYLIYLKTNDINNLKKVSVDELKKMLLINFNGNYLLNNFISLFNNLKKSLNQVFEFEIYLYKIINANNDKLENKKIELSINPEENKINNSQIITTKKIDCFEEINKNTVDFDKLYKTKIFYHKKINNQNDKESGINQKEELSTELVNDNKLICNSNDILDNYELAKQAFFNKDIKLSKEMSQKFKDFKNEETIENSYIDIIKQADLVLWCSPNALVLGVEFLGLINRINKVTHSFEFIKEFVKKFDSIKLVIAISKKQALNIINIKKQGLKTNIINDVLIDDIKMLLKQEEQRKQEQTALLNEIEDEE

SEQ ID NO: 88212 - protein, 427 aa, Rhodopirellula baltica SH 1
MMNSVWRPYCQMKTAPPPMKIVATEGCHLIGQNGECWIDGMASWWSACHGYNHPQVRDAVTEQLHRMPHVMFGGITHEPAERLANRLAELAPDDLNHVFFSDSGSVAVEVAMKMAIGHWRRHDRPGRTRFLAFDNAYHGDTTGAMSLCDPQRSMHARYSGAITQQYHVALPRDATTEAVLERTLAAHSDSIAGVFVEPLVQGAGGMRFHDVITLRRIRDACKRHDVLLIADEIATGFQRTGKMFAVDHTADLQSPVVPDILCLGKALTAGTMSMAVTIARSHVFDSFYSDDPGAALMHGPTFMANPLACSAANASLDLFEGNPYDVEKIETILRERLSVLRDIDNVADVRCFGAIGVVQFRDPPKMQMVQDELVRRGVWLRPFGDCLYTTPPLCINEDALHRICDAMIEATRATMPRSDSPMCNQLR

SEQ ID NO: 88213 - protein, 512 aa, Magnetospirillum magnetotacticum MS-1
MHEIIQQLEEKREGARMGGGEKRIAAQHKRGKLTARERIELLLDPDSFEEWDMFKEHRCTDFGMDSDENMIPGDGVVTGYGTINGRLVFVFSQDFTVFGGSLSEAHAEKICKIMDKAVQVGAPVIGLNDSGGARIQEGVASLAGYAEVFQRNVMASGVVPQISMIMGPCAGGAVYSPAMTDYIFMVKDSSYMFVTGPDVVKTVTHETVTAEELGGAVTHSTKSGVADLAFENDVEALLQLRRFMDFLPSSNREKPPVRPTNDGPERIEASLDTLIPDNPNKPYDMKELILKVVDEGDFFEVQPGYAGNIIVGFARMEGRTVGIVANQPMVLAGCLDISSSIKGARFVRFCDAFNIPVVTFVDVPGFLPGTSQEYGGIIKHGAKLLYAYAECTVPKITVITRKAYGGAYDVMSSKHLRGDVNFAWPTAEIAVMGPKGAVEIIFRSDIGDAEKIAARTEEYRQKFANPFIAGHRGFIDDVIMPRNTRKRICRSLAMLKDKDVKNPWRKHGNIPL

SEQ ID NO: 88214 - protein, 391 aa, Silicibacter sp. TM1040
MIPSVLPTYNRAPLNFVKGEGSWLIEADGRRFLDLGSGIAVNALGHAHPALVEALTAQAQNLWHVSNLYEIPQQQALADKLVAESFADTVFFTNSGTESCELAVKMARKYHYEKGHPEKVEIITFEGSFHGRSSAGIAAAGSEKMTKGFGPLLPGFVHLPWGDAQAVAAAIDDKTAAILVEPVQGEGGIRPMPDQDLKDLRALCDEHGLLLILDEVQCGVGRTGKLFAHEWAGIAPDIMMVAKGIGGGFPLGAVLASEEAASGMTAGTHGSTYGGNPLGCAVGCAVMDHVAAPDFLSEVNRKAGLLRQKLEGLVASHPDVFEEVRGSGLMLGLKCRAVNAEVVKAGYDAEVITVPAADNVIRLLPALTITDADIEEAITRLDAAATAVEAA

SEQ ID NO: 88215 - protein, 308 aa, Silicibacter sp. TM1040
MNHFLDIHKTAPEDLRQIIDQAGQMKTARLGRPKGTPDDEQPLAGHMVALIFEKPSTRTRVSFDVGVRQMGGETMVLSGKDMQLGHGETIADTARVLSRYVDMIMIRTFDETVLTEMAEYADVPVINGLTDRTHPCQIMADILTYEEHRGPIKGKKVVWTGDGNNVCASFLHAAGQFGFDLTFTGPAQLDPEDEFIGFARNAGSKITIERDAAKAVEGADLVVADTWVSMHDSQSSKERRHNMLRPYQVNDALMAHAKPDALFMHCLPAHREEEVTSAVMDGPQSVIFDEAENRLHAQKAVMRWCLGV

SEQ ID NO: 88216 - protein, 454 aa, Bacillus subtilis subsp. subtilis str. 168
MKVVKFGGSSLASGAQLDKVFHIVTSDPARKAVVVSAPGKHYAEDTKVTDLLIACAEQYLATGSAPELAEAVVERYALIANELQLGQSIIEKIRDDLFTLLEGDKSNPEQYLDAVKASGEDNNAKLIAAYFRYKGVKAEYVNPKDAGLFVTNEPGNAQVLPESYQNLYRLRERDGLIIFPGFFGFSKDGDVITFSRSGSDITGSILANGLQADLYENFTDVDAVYSVNPSFVENPKEISELTYREMRELSYAGFSVFHDEALIPAFRAGIPVQIKNTNNPSAEGTRVVSKRDNTNGPVVGIASDTGFCSIYISKYLMNREIGFGRRALQILEEHGLTYEHVPSGIDDMTIILRQGQMDAATERSVIKRIEEDLHADEVIVEHHLALIMVVGEAMRHNVGTTARAAKALSEAQVNIEMINQGSSEVSMMFGVKEAEERKAVQALYQEFFAGVLIS

SEQ ID NO: 88217 - protein, 506 aa, Pseudomonas putida GB-1
MRYAHPGTEGAKVSFKSRYGNYIGGEFVPPVKGQYFENTSPVNGKLIAEFPRSTAEDIDKALDAAHAAADAWGRTSVQDRSNVLLKIADRIEQNLELLAITETWDNGKPIRETLNADIPLAVDHFRYFAGCIRAQEGGAAEINEGTVAYHIHEPLGVVGQIIPWNFPILMAAWKLAPALAAGNCVVLKPAEQTPLGITVLLEVIGDLLPPGVLNVVQGYGREAGEALATSKRIAKIAFTGSTPVGSHIMKCAAENIIPSTVELGGKSPNVYFEDIMQAEPSFIEKAAEGMVLAFFNQGEVCTCPSRALVQESIYPQFMEVVMKKVLQIKRGDPLDTDTMVGAQASQQQFEKILSYLDIAQKEGAELLTGGKVEKLEGSLATGYYIQPTLLKGNNKMRVFQEEIFGPVVSVTTFKDEAEALAIANDTEFGLGAGVWTRDINRAYRMGRGIKAGRVWTNCYHLYPAHAAFGGYKKSGVGRETHKMMLDHYQQTKNLLVSYDINPLGFF

SEQ ID NO: 88218 - protein, 703 aa, Pseudomonas fluorescens PfO-1
MCDLIHYRVVDGLALIGLDRAPVNALDQTLRAALIDACERAATDIAVGAVILYGVQGLFSAGTDIKEFGTEACFAEPDLPGILTRLSALHKPLIAAIGTFALGGGLELALACGYRIGAPDARLGLSEINLGLMPGAGGTQRLPRLIGAESALNLILSGEQIDAERARMLGILDRISSSTEQLLEEARAYANELIECCAPARPAEAWPNPAEDLPDDFLARYRVEHEPRWKSRLAPRLVLSALEAACLLPLEEGLVRELTLFKQAEASRQSKALRHVFFAEQDARRTPRIDTADPSRKINKVAVIGAGTLGGGIAMSFADVGIPVALMDLDGRTLDRGLKRVRENYQLSVKRGKLSAVQMQQRMELLFGTLDYADLSDADLIIEAVCEKMESKHQVFLALESVCKPGAILATNTSSLDIDALAKMVSRPQDVIGMHFFSPANVMRLVEIVLCQTTAPDVVTAVMDIARRIGKLPVISGNSAGSIGNRMLEPYAREAHRLVLEGATPVQVDAVLTSLDLNMGVFSMLDLAGIDVSFLMRDANREAIAHDQSYCCLAEELYALGRYGQKTGRGFYLYEGRSPREDREVIMLAEQLAREHNVTRRNIEDLEIHDRCLFVMINEGIRLLDEGIALRASDIDLVWINGYGFPAHLGGPMHYAEQLGLETVLSRIHHYRSALGEYGEMWFRPAALLERLVAAGRSRIEIF

SEQ ID NO: 88219 - protein, 490 aa, Oenococcus oeni PSU-1
MDNKPTELPLVLLLFGGTGDLAKRKLYPSLFNLFKKGYLQKHFAVIGTARHPLDDEKFQEVVRQSIAKNGTEGQVKEFAAHFRYSSHDVTDLKDYGKLKNMLAKLDKEFDAGGNRIFYMSVAPRFFGQIAQAIKSEGLMSDTGYNRLMVEKPFGTSYKTAEELQNQLESGFSDDQIFRIDHYLGKEMVQNIPAVRFGNPILDATWNKNYIKNVQVTLAEQLGVEERAGYYNTAGALLDMIQNHAFQIVGWLAMEKPSSFSDTDIRAAKNTVFSKLKMYDEREVVANFVRGQYGRGREVWQKSYTEEPNVPADSKNDTYVAGRLQFENDRWTGVPFYIRTGKRLAAKQTRVDIVYKKSSFDFGKFNQDKLSEPVLSILIDPVGGINFSLNGKNVTTEFETRSDLLKWSISDQDKVKTPDPYERMLHDAMNGDGSNFADWNGVSISWKFVDQIAKVWAEDKAPLEIYESATMGSVASDRLLAETGDRWIYRG

SEQ ID NO: 88220 - protein, 482 aa, Pseudomonas putida GB-1
MPSDHSAGSPAGSSVDFEKVGSDYFQQRELKKGAAGWVLLVGLGVAYVISGDYAGWNFGLAQGGWGGMFLATLLMATMYLCMCFSLAELSSMIPTAGGGYGFARSAFGPWGGFLTGTAILIEYAIAPAAIAVFIGAYCQSLFGIGGWMIYLAFYIVFIGIHIFGVGEALKLMFIITAIAAIALAVFLVSMVPHFDAANLFDIAKTDAVGASSFLPFGYVGVWAAIPYAIWFFLAVEGVPLAAEETKNPKRDLPRGLIGAMLVLLAFALLILVVGPGGAGSEALKASGNPLVEALSKAYGGNTWMGGFVNLVGLAGLIASFFSIIYAYSRQIFALSRAGYLPRKLSQTNKSKAPVLALIIPGIIGFALSLTGQGDLLILVAVFGATLSYVLMMAAHITLRIRRPKMERPYRTPGGVFTSGVALVLACIAVVAGFLVDPRVVIGAAVIYAVLIAYFAFYSRHHLVAGTPEEEFAAIQKAEEALH

SEQ ID NO: 88221 - protein, 389 aa, Lactococcus lactis subsp. lactis Il1403
MKKITVRTKAAKKLRAGYPLLVAEDLNSPFLEDDFAQFFDEKGQALGTGYLSKQNKGVGWLLDSSSVKIDHHFYVEKFVNARALRANFYQDELTNAFRLFNGEGDGLGGLTIDFYNGFAVFSWYNQFIYSQKKAIVKAFQVVFPDIKGAYEKLRFSEAALESQHIFGQEAAEPLLVMENGVTYATYLNEGLMTGIFLDQKNVRGALAGGLSTGKTLLNMFSYTGAFSVAAAFGGSSQTTSVDLAKRSLDKTREQFLVNGIEPESQKIYVMDVFGYFNYAKKKELTYDMIVLDPPSFARNGKKTFSVAKNYGDLVKEAVEILENNGTLIASTNAANVSDKKFRQMIEEALKNKGVKFTVFQEEKLPADFHIADSFPEGNYLKVLFIKIKK

SEQ ID NO: 88222 - protein, 448 aa, Helicobacter pylori J99
MYVEKILQSLQKKYPYQKEFHQAVYEAITSLKPLLDSDKSYEKHAVLERLIEPEREIFFRVCWLDDNHQIQVNRGCRVEFNSAIGPYKGGLRFHPSVNESVIKFLGFEQVLKNSLTTLAMGGAKGGSDFDPKEKSEHEIMRFCQAFMNELYRHIGATTDVPAGDIGVGEREIGYLFGQYKKLVNRFEGVLTGKGLTYGGSLCRKEATGYGCVYFAEEMLQERNSSLEGKVCSVSGSGNVAIYTIEKLLQIGAKPVTASDSNGMIYDKDGIDLELLKEIKEARRGRIKEYALEKTSAKYTPTENYPKGGNAIWHVPCFAAFPSATENELSVLDAKTLLSNGCKCVAEGANMPSSNEAIELFLQAKISYGIGKAANAGGVSVSGLEMAQNASMHPWSFEVVDAKLHHIMKEIYKNVSQTAKEFKDPTNFVLGANIAGFRKVASAMIAQGV

SEQ ID NO: 88223 - protein, 178 aa, Triticum aestivum
  misc_feature (99)..(99): Xaa can be any naturally occurring amino acid
MAPAVMASSATTVAPFQGLKSTAGLPVSRRSSGSLGRVSNGGRIRCMQVWPIEGIKKFETLSYLPPLSTEALLKTVDYLIRSKWVPCLEFSKVGFAFRXHNSSPGYYHGRYWTMWKLPMYGCTDATQVLNQVEAVQNEYPDAYVRVIALNDLRRVECCNFFPFRPPGCEESGECLPTS

SEQ ID NO: 88224 - protein, 349 aa, Zea mays
MGLLGRRPWLLLLALASAAVAVAVAVEASEGDADPLYRACVEGCQKTGSLKEASIKHCMVPTYGQPADKSWYAHEPLYLQWKDWNCKSECRYHCMMEREGERAKLGLQPVKYHGKWPLKRASVFQEPLSAALSALTLVVQFNGWLSFFLLLYYKLPLRPETHKTYYEYTGLWHIYGLLAMNSWFWSAIYHSCDTIWTEKLYFSSAAAFLGYSLILAILRTSSLRDEASRVMVAAPILAFVTTHILYLNFYELDKGLNMKVCTVISIAQCLLWALWAVMSGHRSRLKIISVAVGGAVAVLVEAYDIPPRWGYADGRAICLAVAIPLSYLWWSFAKEDAEMRTSAILKKTR

SEQ ID NO: 88225 - protein, 378 aa, Geobacillus kaustophilus HTA426
MKAVTYQGIKDVAVKQMPDPKILKDDDIIVKITSTAICGSDLHLVHGMIPNMPEDFIIGHEPMGIVEEVGPAVTKVKKGDRVIVPFTIACGQCWYCQHGLESQCDASNPNGESGGYFGYSETFGGYPGGQAEYLRVPFANFTPFVVPENCELEDEKLLFLSDIIPTAFWGVDEAGVKDGDTVVVLGCGPVGLLTQKFAWMKGAKRVIAVDYIDYRIEHAKKTNKVETLNFTEYENVGEYIKEMTGGGADVVIDCVGLDGKMTPLELIGSALKLQGGAMGAIVIASQAVRKGGTIQLVGVYGARYNQFPLGDLFSRNITLKMGQAPVIHYIPTLYEWIVEGKFDPTDIITHRLPLDEAQYAYEIFDEKKDGCIKVVLKP

SEQ ID NO: 88226 - protein, 414 aa, Sinorhizobium meliloti 1021
MPHLESVALGVWIKSGSRNETVNEHGIAHLLEHMAFKGTRRRSARQIAEEIENVGGEVNAATSTETTSYYARVLKDHLPLAVDILADILTESTFEADELRREKQVILQEIGAADDTPDDVVFDRFAETAYRGQTVGRPILGTPETVMSFSADQIRQYLGRNYTTDRTFIVAAGAVDHDTIVRQVEERFASLPAEPVCAPVIETARYTGGDSRESRDLMDAQVLLGFEGKAYHARDFYCSQILANILGGGMSSRLFQEVREHRGLCYSVYAFHWGFSDTGIFGVHAATGGENLPELMPVIVDELRKSSLSIDQQEIERARAQIRAQLLMGQESPAARAGQIARQMMLYGRPIPNEELMERLSGITIERLTDLAGRLFFDTVPTLSAIGPLGQLAPLNDILSSLTTKADAIHAAAS

SEQ ID NO: 88227 - protein, 268 aa, Pseudomonas fluorescens PfO-1
MLRLSALYRYPLKSAKGEVLQGIGLDKLGLEGDRRWMLVDEASGRFLTQRAEAKMSQLSALWNATGGLTLSAPGHSAIDVALPGGDDDLRGVTIWRDTLRVPDAGEEAARWVSDFIGKPTRLVQVPLERARTTQAGYGNDDDQVAFADGFPLLLIGEASLQHLSQEVGRPLEMLRFRPNLVIEGSDAYAEDGWKRIRIGDVEFRVVKSCSRCILTTIDPQTGERSADREPLATLQKTRAQADGAMFGQNLVNDSNGRLEIGMPVEILE

SEQ ID NO: 88228 - protein, 380 aa, Zea mays
MGGEKETFDTSDLNASLPAAAAALSAEDRAGLVNALKDKLQSLAGQHADVLETLSPNVRKRVEFLREIQSQHDEIEAKFFEERAALEAKYQKLYEPLYTKRYGIVNGEVEVDGVCDEPASENTVEGKEPDAKGVPDFWLTAMKTNEVLSEEIQERDEAALKYLKDIKWSRIEDPKGFKLDFFFDTNPFFKNSVLTKTYHMVDEDDPILEKAIGTEIEWYPGKNLTQKILKKKPKKGSKNTKPITKTEDCESFFNFFNPPQVPEDDDDIDEDTADELQSQMEHDYDIGTTIRDKIIPHAVSWFTGEAVQGEDFGELGDDDEDDDDEDDDEDDEDEEEDDDEEEDDEEESKPARKSGSGRRHKAPQKVSQGNAEQPAECKQQ

SEQ ID NO: 88229 - protein, 560 aa, Arabidopsis thaliana
MASSTALICDTEAWKDLKGHVEDIKKTHLRDLMSDANRCQSMMMEFDGLLLDYSRQRATVETMDKLLNLAKASQLTEKISRMFNGEHINSTENRSVLHVALRAPKDAVIKADGMNVVPEVWNVLDKIKEFSDKIRSGSWVGATGKPLKDVIAIGIGGSFLGPLFVHTALQTDPEALESAKGRQLRFLANIDPVDVARNISGLNPETTLVVVVSKTFTTAETMLNARTLREWITAALGASAVAKHMVAVSTNLALVEKFGIDPNNAFAFWDWVGGRYSVCSAVGVLPLSLQYGFSMVEKFLKGASSIDQHFQSTPFEKNIPVLLGLLSVWNVSFLGYPARAILPYSQALEKFAPHIQQVSMESNGKGVSIDGLPLPFETGEIDFGEPGTNGQHSFYQLIHQGRVIPCDFIGIVKSQQPVYLKGEVVSNHDELMSNFFAQPDALAYGKTPEQLQKENVSENLIPHKTFSGNRPSLSLLLPELTAYNVGQLLAIYEHRVAVQGFVWGINSFDQWGVELGKVLATQVRKQLHSSRTQGTAPEGFNYSTTTLLKRYLETSSEPQM

SEQ ID NO: 88230 - protein, 369 aa, Caulobacter crescentus CB15
MKTRAAVAFEAKKPLEIVEVDLEGPKAGEVMVEIKATGVCHTDAYTLDGFDSEGIFPSILGHEGAGVVVEVGAGVTSVAVGDHVIPLYTPECRQCKSCLSGKTNLCTAIRATQGKGLMPDGTSRFSYKGQPIYHYMGCSTFSNYTVLPEIAVAKIRRDAPFKTACYCGCGVTTGVGAVTNTAKVEPGANAIVFGLGGIGLNVIQGLKLVGANMIVGVDINPDREEWGRKFGMTHFVNPKDVQGDLVAHLVALTDGGADYTFDATGNTGVMRTALEACHRGWGESIIIGVAEAGKEISTRPFQLVTGRVWKGTAFGGARGRTDTPKIVDWYMDGKIQIDPMITHVLPLEEINKAFDLMHAGESIRTVVTF

SEQ ID NO: 88231 - protein, 359 aa, Acidobacteria bacterium Ellin345
MDTAAKPSAVQPQNSSSAEVGTIVTGGERKVNPGPDPKNDRKPTRTPDPKFKIFSGAANEPLAQEICAFLGIPLGQTKLTKFSDGEIYVQILENVRGGDIFLVQPTCHPVDHHLMQLLLMIDALKRASARRITTVIPYFGYARQDRKDKPRVPVSAKLVADLLTTAGADRALVVDLHAPQIQGFFNIPVDHLFGSPVLVDYFKKLELPDLTVVSPDAGGVERARFFAKKMDSALAIVDKRRTDMNVTEVMHVIGDVHGRTCLILDDIIDTAGTLVKTAQALADAGASEVYACASHAVLSGEAINRISKSVLKELVVTNTIPLTDAGKAEPKIKVLSIAGLIARAIQSIHEETSVSKLFL

SEQ ID NO: 88232 - protein, 395 aa, Methanosarcina barkeri str. Fusaro
MNEQGLSEKEIFSYLEDVKSEDTDYYRVLSSMCTHPHRIAVEAHRLFIEANLGDLGLFAGAHRLEKEVIRMLGELLHAQSVEIPSGEACESSVCGYLTTGGTESNIQAIRGMKNLVTEDGKKSGEILNIVVPESAHFSFDKVANMMGIEVKRASLDPEFRVDIASAESLIDANTIGLVGIAGNTEFGQVDPIEELSKLALENELFLHVDAAFGGFVIPFLEKPYSFDFKVPGVTSIAIDPHKMGLSTIPSGALLFRSPFFMDSLKVNTPYLTTKSQFTLTGTRSGASAAATYAVMKYLGREGYRKNVQYCMQLTTKLVKEARKFGFEPLIEPVMNVVDLRVPNPDIVREQLLKKFGWNVSITRNPRSLRLVLMPHNTARDIEEFLQDLRKVTTEL

SEQ ID NO: 88233 - protein, 417 aa, Saccharophagus degradans 2-40
MMQAGNAVKGFDVEKIREDFPILHQEVNGHPLVYLDNAATTQKPNAVIDAISDYYRGYNSNVHRGAHALSDKATAGFEGARDTLAAFINSPSREQVLWTRGTTEAINLVAFTWGKQNLEAGDRVLVSNLEHHSNIVPWQMVAQEKGASVVAIPVSDSGAIDLDAFKALLVSNEGPVKFVSVGHVSNALGTVNPVEEIVALSHEVGAKVLIDGAQSVGHWAVDVQALDCDFFAFSGHKMFGPTGIGVLWGKRDLLEAMPPYQGGGEMIETVSFEGTTYNALPYKYEAGTPDIAGAIGLAAAVDYLNSFDREAAVAHENDLLQYAWQKAEGFAGLTRVGTAPKVAGVFSFLLNGAHPSDVGMLIDQQGVAVRTGHHCAQPLMARLGIPGTVRASFSFYNNRNDVDRLFEALEKAKTFLV

SEQ ID NO: 88234 - protein, 318 aa, Arabidopsis thaliana
MAVASLSICFSARPHLLLRNFSPRPKFVAMAAMSEDPIREWILTEGKATQITKIGSVGGGCINLASHYQTDAGSFFVKTNRSIGPAMFEGEALGLEAMYETRTIRAGELPTGGSYIIMEFIDFGGSRGNQAELGRKLAEMHKAGKTSKGFGFEVDNTIGSTPQINTWSSDWIEFYGEKRLGYQLKLARDQYGDSAIYQKGHTLIQNMAPLFENVVIEPCLLHGDLWSGNIAYDKNNEPVILDPAYGHNEADFGMSWCAGFGESFYNAYFKVMPKQAGYEKRRDLYLLYHYLNHYNLFGSGYRSSAMSIIDDYLRMLKA

SEQ ID NO: 88235 - protein, 320 aa, Phytophthora sojae
MAANRTADFAQLCQHYAAAKGSASLQKPVHTPLQENAQFNAAASDISKEVYQASKRLQQLTQLVRQNNMFNDPTEAINELAALVKKDITDINMQLDNLQEYINSKRQSAPSRQAARHSDAIVSLMKSNLMATTRGFKDILEVRQENMKLQQSRRARYGKTASSALGKPLAFKAPQPPRSNNSHTGRLQEVNLSSTLPRPGVSASESSNEEIQPLITTMTQEQIVAEQQNYTESRAEAVSQIESHIVDIGQLFGRLSTLIHEQGDLVRRIDDNVEDSLVNVSSGEQELLKYFSSLSNNRLLALKVSAILLVFLIFFMFFLA

SEQ ID NO: 88236 - protein, 436 aa, Bacillus subtilis subsp. subtilis str. 168
MSQTTASITTAQWQQKRDQFVSKGVSNGNRSLAVKGEGAELYDLDGRRFIDFAGAIGTLNVGHSHPKVVEAVKRQAEELIHPGFNVMMYPTYIELAEKLCGIAPGSHEKKAIFLNSGAEAVENAVKIARKYTKRQGVVSFTRGFHGRTNMTMSMTSKVKPYKFGFGPFAPEVYQAPFPYYYQKPAGMSDESYDDMVIQAFNDFFIASVAPETVACVVMEPVQGEGGFIIPSKRFVQHVASFCKEHGIVFVADEIQTGFARTGTYFAIEHFDVVPDLITVSKSLAAGLPLSGVIGRAEMLDAAAPGELGGTYAGSPLGCAAALAVLDIIEEEGLNERSEEIGKIIEDKAYEWKQEFPFIGDIRRLGAMAAIEIVKDPDTREPDKTKAAAIAAYANQNGLLLLTAGINGNIIRFLTPLVISDSLLNEGLSILEAGLRA

SEQ ID NO: 88237 - protein, 205 aa, Physcomitrella patens subsp. patens
GNVYVLTLVGDGEHRFTPQSIPEIMAALDKVEADPKACALVTTGEGKFYSNGLSLSLEDRGSKENMQLIDQFHALLKRILTYPIPTVAAVNGHAVAGGCMVALAHDYRFMRADRGFMFLSEIDIKLPFSPGMNAIIRCKLPVMTYHKAMLSAFRYTGQTAVEAGMVHSSPSDLQSTYQEALKLAKGLASRNFDRVVYQTIKKQMF

SEQ ID NO: 88238 - protein, 462 aa, Bacillus subtilis subsp. subtilis str. 168
MPDQLTVYNPATGEEIKTIPQQSATEVEEAIERSHQAFKTWSKTSANERTSLLKKWYELIVEHKEELADLITKENGKPYQEAVGEVLYGAGYIEWFAEEAKRVYGRTVPAPTTGKRIVVTRQPVGPVAAITPWNFPNAMITRKAAPALAAGCTFIIKPAPDTPLSAYELARLAYEAGIPKDVLQVVIGDGEEIGNVFTSSPKIRKITFTGSTPVGKILMKNSADTVKHVSMELGGHAPLIVDEDADIDLAVEQAMASKYRNAGQTCVCANRLIVHESIKDEFAAKLSEQVSKLKVGNGLEEGVNVGPIINKRGFEKIVSQIDDAVEKGAKVIAGGTYDRNDDKGCYFVNPTVLTDVDTSMNIMHEETFGPVAPIVTFSDIDEAIQLANDTPYGLAAYFFTENYRRGIYISENLEYGIIGWNDGGPSAVQAPFGGMKESGIGREGGSEGIEPYLETKYLSIGL

SEQ ID NO: 88239 - protein, 295 aa, Shewanella sp. MR-4
MSAKHPIIAVTGSSGAGTTTTTTAFSHIFRQLGINAAFVEGDSFHHFTRAEMEVMIRKSQAENRNLSYFGPEANNFARLEQCFRDYGATGQGETRSYLHTFDEAVPFNQMPGTFTQWRPLPENTDMLYYEGLHGGVVTGDANVAQHVDLLIGMVPIVNLEWIQKIIRDTSERGHSREKVMGSIVRSMDDYIKHMTPQFSRTHINFQRVPTVDTSNPFSAKDIPSLDESFVVIRFRGINNVDFPYYLSMIQGSFMSRVNTLVVPGGKMSLAMELILTPLIKDLMEKRQQLNSPQAN

SEQ ID NO: 88240 - protein, 289 aa, Populus alba
EENWAEEVREDWFQDELEGESYCSNNSNKLNTFPILLEQDLSWEDEELSSLFAKEEQNQLCKDLETNPSLARARCEAVEWILKVNEHYSFTALTAVLAVNYLDRFLFSVHLQKEKPWMAQLAAVSCLSLAAKVEETQVPLLLDFQVEDSKYVFEAKTIQRMEILVLSTLKWKMNPVTPISFLDYITRRLGLEHYLCLEFLKRCERMVLSILADSRSMPYVPSVMAAATMLYVIDNIKPSLAAEYQSQLLSILGIDKDKVEDCSKFLMEFALREHFKLLSNKRKFCSLPG

SEQ ID NO: 88241 - protein, 898 aa, Sinorhizobium meliloti 1021
MAKWVYTFGAGQAEGSAEDRDRLGGKGANLAEMCNLGLPVPPGLTIVTAACNSYLEKGRSMPEGLREQVREGITRMEKITGRVFGDTNRPLLLSVRSGARASMPGMMDTVLNLGLNDQSVHALGHDAGDARFAWDSYRRFIQMYGDVVMGVDHEVFEEVLEDEKARLGHEQDTELSAVEWQHVISRYKEAIEEVLGLPFPQDPEVQLWGAIGAVFSSWMNPRAITYRHLHGIPAGWGTAVNVQAMVFGNLGNSSATGVAFTRNPSTGEKELYGEFLVNAQGEDVVAGIRTPQNITEAARIASGSDKPSLEKLMPEAFAEFEKICNALERHYRDMQDIEFTIERGKLWMLQTRSGKRTAKSALKIAVDMAEEGLISKEEAVARIDPASLDQLLHPTIDPHARRDIIGSGLPASPGAATGEIVFSSDEAVQAVKEGRKVILVRVETSPEDIHGMHAAEGILTTRGGMTSHAAVVARGMGTPCVSGAGSIRVDQRNELLIAASVTLRKGDVITIDGSSGQVLKGEIPMLQPELSGDFGKIMQWADASRRMTVRTNAETPADARAARSFGAEGIGLCRTEHMFFEDDRINVMREMILAEDEAGRRTALAKLLPMQRSDFVELFSIMHGLPVTIRLLDPPLHEFLPKTDEEIAEVARVLTIDPAELRQRVDALHEFNPMLGHRGCRLAISYPEIAEMQARAIFEAAVQAAHDTGAAVVPEIMVPLVGLRAELDYVKARIEAVAKEVIGEAGVNIDYLIGTMIELPRAALRADTIAESADFFSFGTNDLTQTTFGISRDDAALFLATYQQKGIIEQDPFVSLDFEGVGELIQIAAERGRRTKNGLKLGICGEHGGDPASIRFCEEAGLDYVSCSPFRVPIARLAAAQATINGREVAEVQALAAS

SEQ ID NO: 88242 - protein, 395 aa, Geobacillus kaustophilus HTA426
MTMEIPFSELLEQLPKQFFASLVAKVGEKIKAGCDVINLGQGNPDQPTPKHIVEAMQRAAANPKYHKYSPFQGYFFLKEAIAAFYAREYGVNVDPDREVAILFGGKAGLVELPLCLVNPGDVVLVPDPGYPDYWSGIALARARMEMMPLSSENGFLPDYEAIPESVADRAKLMFLNYPNNPTGATATKEFFAETVAFAAKHGIAVVHDFAYGAIGFDGRKPVSFLEADGAKDVGVEIYTFSKTYNMAGWRVAFAVGNERIIRALELLQDHLYVSLFGAIQEAAAAALLGPQDCVTELVALYEARRNAFIAALCEIGWEAPAPYGSFFAWLPLPKGISSAEFADMLLERAHVAVAPGIGFGEHGEGYVRVGLLTDEARLREAAERIGRLGLFEKNF

SEQ ID NO: 88243 - protein, 296 aa, Oenococcus oeni PSU-1
MDPGIDDAVALSVLLNNKNCQVELITTVAGNVTVDKTTKNALKIANFFNSEVPLAAGASQPLVKAFEDAARIHGESGMEGYDFPEGNSHLLKQPAVEAWHDVLNKTEKKITLILTGSYTNFALWYREYPEDVLKIERVIVMGGSLSGGNMTSAAEFNVFTDPEAAKILLSSNLSVTMIGLDVTLKALVDRDWIQKVAALNESGKMLAALISHYNDWHADGWPIHDVNTVAYLLHPEFYSSKKLWVDIATDGPAIGETVADIRAAYHQGRTNATVATDIDADAFRNWLKQEISSMTR

SEQ ID NO: 88244 - protein, 79 aa, Arabidopsis thaliana
  misc_feature (68)..(68): Xaa can be any naturally occurring amino acid
MAGYMLSSATMVDCSAQATMVAPLNGLKSCADLPVTRMANNDITFMTRNGGRVNCMHVWTSIGKKKWXTLSHLTDLTES

SEQ ID NO: 88245 - protein, 570 aa, Pseudomonas fluorescens PfO-1
MFANLLIILASSLVMIALFRRLRLPPVLGYLCVGLMVGPKAFDWINESEHLPDLAELGVVFLLFSLGLEFSLSKMIALRQVVFRLGSQQVMITTLLLGGVLMLLGMPATPALLLGAGLSLSSTAIVTKELGSLGEIFSSHGQNAVGVLLFQDVVAVLLLTLVPVFAGSSDQAWYWALPLTLLKTVLLFFGLLLASRWLLPRLFQEVAASRSAELFVLLALVIVLLTAWLTHLLGLSPALGAFLAGMLLGESHYRHQIEADIRPFRDILLGLFFVSIGMLIDLQLFASHSLLIIGMTLGLLVIKGLVVALLVKWRGSDSETAWRSGLALAQGGEFCFALMAQMQQTRLLPAELGALLLAATFCSMLLTPLLLRAAPRIAAALHRKPNQEAQIEEISALNAGFDGHVVICGYGRVGQSIGRFMRNAGQSYVALDNDPVRIQEAATAERDVHYGDSTRGDLLTAVGLLRARLLVIAVDQADVALRVLKEARRLNPTVPILVRTRDDSQSAELKAAGASEVVPELLESSLMLGSHALILLGFPAHRVQEKVDQVRIDRYRLLHGFYPGADDEET

SEQ ID NO: 88246 - protein, 402 aa, Zea mays
MAAAEGQWVLMATGRTPTNIAVIKYWGKRDEALILPINDSISVTLDPDHLSATTTVAVSPSFPSDRMWLNGKEISLLGGRFQSCLREIRKRARDFEDKEKGVKIKKEDWDKLHVHIASYNNFPTAAGLASSAAGLACFGTDRDCEFFTLGKLMNVKEDYGELSSIARQGSGSACRSIYGGFVKWCMGEKDDGSDSIAVQLADETHWNDLVIIIAVTVVPGRVLKMEEAIKNRDFESFAKLTCADSNQFHAVCLDTSPPIFYMNDTSHRIISLVEKWNHSEGTPQVAYTFDAGPNAVLIAQNRKTAAHLLQKLLYYFPPQDKDLSSYLVGDKSILGDAGLHSMKDVEALPAPPETKIPDQKFKGDVSYFICSRLGARPKVVVDEGQALIDSVTGLPKGVQSYI

SEQ ID NO: 88247 - protein, 261 aa, Zea mays
MSSRSLPPKDRRMRTERTSYRDAPYRRDSRHGPSRFRNDLCNNCKRPGHFARECPSVAVCHTCGLPGHIAAECSSKGVCWNCKEPGHMANSCPNEGICRNCGKSGHIARDCTAPPVPPGEVILCSNCYKPGHFREECTNEKACNNCRQSGHLARNCTNDPVCNLCNVAGHLARQCPKSDTLGERGGPPPFRGVGAPFHDVGAPFRGGFSDVVCRACNQIGHTSRDCMAGAFMICHNCGGRGHMAYECPSASLMDRFPPRRF

SEQ ID NO: 88248 - protein, 293 aa, Listeria monocytogenes str. 1/2a F6854
MQDLTLFLEQYKKVIDESLFKEINERNIEPRLKESMLYSIQAGGKRIRPMLVFATLQALKVNPLLGVKTATALEMIHTYSLIHDDLPAMDNDDYRRGKWTNHKVFGDATAILAGDALLTLAFSILAEDDNLSFETRIALINQISFSSGAEGMVGGQLADMEAENKHVTLEELSSIHARKTGELLIYAVTSAAKIAEADLEQTKRLRIFAENIGIGFQISDDILDVIGDETKMGKKTGADAFLNKSTYPGLLTLDGAKRALNEHVTIAKSALSGHDFDDEILLKIADLIALREN

SEQ ID NO: 88249 - protein, 604 aa, Listeria monocytogenes str. 1/2a F6854
MDLLKIKDPSFMKRLDIQELEALAADIRAFLITSTSKSGGHIGPNLGVVELTIALHYSFNSPKDKFIWDVGHQSYVHKILTGRANQFGTLREHGGLDGFPKRKESIHDVFETGHSSTSLSAAAGMVIARDIKKEDFYVIPIIGDGALTGGMALEALNHIGDMGKDMIVILNDNDMSIAPNVGAIHNILGKLRTSDTSKQTKTNVDGAFFEELGFMYLGPIDGHDIEEVITNLELAKRAKGPVLLHIVTKKGKGYQPAELDSRGTWHGTGPYKVETGSFIKPAKRAASWSSVISNELIRLAEMDERIVAITPAMPVGSKLEKFAKAFPERFFDVGIAEQHATTMAAGLATQGMKPFLAIYSTFLQRAYDQLVHDVCRQKLNVVIGIDRAGLVGADGETHQGIFDISFLNSIPNMTISMPKDEVEARQLMDTAFSYNDGPFAIRYPRGEAPGVQVVESNTLIPIGQWETIIQPLDAVILTFGPTIELALKAAEQLEIEGYRVGVINARYIKPLDEALLHKILKQKIPILTVEESLLKGGFGASVLEFIEANNYRDVIMHRIGLPDEFISHGSVSIILESFGISTTGLVLKIKEMLAQSGKLRAKRL

SEQ ID NO: 88250 - protein, 444 aa, Magnetospirillum magnetotacticum MS-1
MSERILIVDFGSQVTQLIARRVREAGVYCEIHPFNRVSVDSIREFGPKGVILSGGPASVPEAGSPRAPQGLFDMGLPILGICYGQQTMCEQLGGKVSPGDHREFGRAMLSVSGEPCALFDGIAAKGDEVQVWMSHGDRVTAIPPGFKVVATSEGAPFAAIANADKRFYGVQFHPEVVHTPIGKQLLSNFVHKIVGCAGDWTMKAFRAQEIAKVRAQVGSGRVICGLSGGVDSSVVAALLHEAIGDQLTCVFVDTGFMRAGESEQVVSVFRDRFNIKLVHKDASGLFLDKLAGLTDPEKKRKIIGATFIDVFEEEARAVGGADFLAQGTLYPDVIESVSFTGGPSVTIKSHHNVGGLPERMNMKLVEPLRELFKDEVRALGRELGLPADMVGRHPFPGPGLAIRIPGQPLTRENLDILRKADSIYLDEIRKAGLYDEIWQPSPCC

SEQ ID NO: 88251 - protein, 389 aa, Phytophthora arecae
ELGEYRAAVPSGASTGEFEALEMRDGGKAYMGKGVLNAVKNVNEIIAPALVGKDVTQQAELDRFMVETLDGTQNEWGWCKKKLGANAILGVSLALCRGGAAAKKQPLWQYIADLAGNPTPCLPVPSFNIINGGSHAGNKLAMQEFMILPVGATSFTEAMQIGSEVYHNLKKVIKGRYGLDATAVGDEGGFAPNIQSNGEAIDLIEEAIKAAGYTNQVRLGMDVAASEFYTGAADARYNLDFKNENAPDSEKIPADKLQEVYEGFIAKCAGSSKIVSIEDPFDQDDWESWIKFTGKVGKDVQIVGDDLTVTNPTRVKKAIEQKACNALLLKVNQIGSITESIEAVTMAKKAGWAIMASHRSGETEDTFIADLAVGLSAGQIKTGAPCRSE

SEQ ID NO: 88252 - protein, 304 aa, Debaryomyces hansenii CBS767
MGLIRKLFGGGNNINIEEEIERKGFSTSDCSFDCDSCSSKFPASVSVEEKDELWNSTKEYGLHIVVASGKTDWPHDACLVPGTVGKAVSGWADLSNDKFPELGTSSSIKVTMSSLCSAELDTNEEYILGRRGDILILPFFIWIKNVSAENVGSLLDVMMPKLIESRDKKIPPPSKVENFDDVTVQADGFQSYIFLCSHRTRDKRCGVTAPLMKREMEIYLRDLGLYRDFNDYRPNGVRVAYINHVGGHKYVANVLMYSKTGKNIWLARCRPQNVRPIIDECILADGKVWADKVRIIQRFDPIEW

SEQ ID NO: 88253 - protein, 390 aa, Phytophthora primulae
TEIGEYRAAVPSGASTGEFEALEMRDGGADYMGKGVLNAVRNVNEIIAPALVGKDVTKQAELDRYMVETLDGTQNEWGWCKKKLGANAILGVSLALCRAGAAAKKQPLWQYIADLAGNPSPCLPVPSFNIINGGSHAGNKLAMQEFMILPVGATSFTEAMKIGSEVYHNLKKVIKGRYGLDATAVGDEGGFAPNIQANAEAIDLIEEAIKDAGYTNQVRLGMDVAASEFYTGAKDARYNLDFKNAEGAESEKISADKLLEMYEGFISKCADSSKIVSIEDPFDQDDWESWVKITAKIGKDVQIVGDDLTVTNPTRVKKAIEQKACNALLLKVNQIGSITESIEAVTMAKKAGWAIMASHRSGETEDTFIADLAVGLSAGQIKTGAPCRSE

SEQ ID NO: 88254 - protein, 299 aa, Acidobacteria bacterium Ellin345
MKTIRKAVFPAAGLGTRFLPATKAQPKEMLPIVDKPIIQYGVEEALDAGCDQIIIVTGRGKSSIEDHFDVSYELEKMLEERGKTELLSIVRKISDMIHVAYVRQKEALGLGHAVLMSKELVGDEPFAVLLADDVIDAEPSCLKQMVEVFNATQCSVIATQVVEGKAISSYGVLDAKPVTSGPFAGRLFEISDLVEKPKPEEAPSNQAIIGRYLLTPTVFDCLQNIPTGAGGEIQLTDGLRALLKREKIYGFQFEGKRHDAGDKLGFLKATVEFALKNPELGPGFAKYLRELNVEEFAMK

SEQ ID NO: 88255 - protein, 362 aa, Mycoplasma mycoides subsp. mycoides SC str. PG1
MRPIMTKHEIINELLEKNNADAILLYSPENRYWFSKFHSSLGYLIITKTQSHLFLDGRYITAARNNKNINKDIQLHHFSKSLKQDLIDILNQNNVKTLAFESDWTYFEQYQAYKDHWFKDFNLIGINCSKIRMIKDDWEIANIKKACDITDQVFQAALDFIKPGITEKQLQRFIDDKFLEFGADKISFDTIIASGVNGSMPHAVPSDKVINNNELITIDMGCFYNGYCSDQTRTIALGDVDPKLVEIYNIVYEAQSLGISLVKEGVIAGDIHKQVYDFIDKKGYGKYFDHGLGHGIGVEIHEEPSVGSTGSEVLKENMTITIEPGIYIPDLGGVRIEDDVLVTKTGCKLLTSSPRILLKLQK

SEQ ID NO: 88256 - protein, 109 aa, Mycoplasma genitalium
KASDGIMVARGDLGLEIPYYQVPYWQRYMIKACRFFNKRSITATQMLDSLEKNIQPTRAEVTDVYFAVDRGNDATMLSGETASGLYPLNAVAVMQKIDKQSETFFDYQY

SEQ ID NO: 88257 - protein, 386 aa, Phytophthora primulae
IGEYRAAVPSGASTGEFEALEMRDGGADYMGKGVLNAVRNVNEIIAPALVGKDVTKQAELDRYMVETLDGTQNEWGWCKKKLGANAILGVSLALCRAGAAAKKQPLWQYIADLAGNPSPCLPVPSFNIINGGSHAGNKLAMQEFMILPVGATSFTEAMKIGSEVYHNLKKVIKGRYGLDATAVGDEGGFAPNIQANAEAIDLIEEAIKDAGYTNQVRLGMDVAASEFYTGAKDARYNLDFKNAEGAESEKISADKLLEMYEGFISKCADSSKIVSIEDPFDQDDWESWVKITAKIGKDVQIVGDDLTVTNPTRVKKAIEQKACNALLLKVNQIGSITESIEAVTMAKKAGWAIMASHRSGETEDTFIADLAVGLSAGQIKTGAPCR

SEQ ID NO: 88258 - protein, 390 aa, Phytophthora ipomoeae
TELGEYRAAVPSGASTGEFEALEMRDGGKDYMGKGVLNAVKNVNEIIAPALIGKDVTKQAEIDRFMVEKLDGTQNEWGWCKKKLGANAILGVSLALCRAGAAAKKQPLWQHIADLAGNPTPCLPVPSFNIINGGSHAGNKLAMQEFMILPVGAKNFTEAMKIGSEVYHNLKKVIKGRYGLDATAVGDEGGFAPNIQSNGEAIDLIEEAIKAAGYTNQVRLGMDVAASEFYTGAEDARYNLDFKNENAAESEKIPADKLLEVYEGFIAKCADSSKIVSIEDPFDQDDWESWVKITGKVGKDVQIVGDDLTVTNPTRVKKAIEQKACNALLLKVNQIGSITESIEAVTMAKKAGWGIMASHRSGETEDTFIADLAVGLSAGQIKTGAPCRSE

SEQ ID NO: 88259 - protein, 264 aa, Brassica napus
MADSTRNLTGLGGEASKHEEEEEENDDYMGDLSQFIPPELTQKSKRKESEKKTVAVEPSRKKLKNLPWHERRRLEKERKQIEEDAQTLARIEDTPIGESNVGFKLLKQMGYKPGSALGKQGSGRAEPVTMDIRRSRAGVGREDPHKEKKKREEVEAENEKRKVEEMLEDFGDRQKSQWRNKRVVINFKKAKAALDQLENVEVVVPEKKKEEDEDGKVGEEEEEQEEVITEEDLEEILNELRDEHRYCPFCGFQYETSEALSFNL

SEQ ID NO: 88260 - protein, 281 aa, Lactococcus lactis subsp. lactis Il1403
MTLTDTYTLNNGIKIPKVGFGTWQSASGEEAYNAVKAALEAGYRHIDTAAVYKNEESVGQAIADSGIPREELFVTTKLWGVGTTEDAAKALDESLKKLGLDYVDLYLIHWPNPKAFRPDFETRNLAVWKAMEAGVKAGKIRAIGVSNFHPRHLKPLLKFAEIKPAVNQIMVNPSDQQEEIVSFNVDNNILTEAYSPLGTGKIFEVPELADLASKYNKSIAQVVLRWSLHKGYLPLPKSVTPARIKENAEIFDFDLSIEDIAFIDSLHGKAGLAKNPDEVDF

SEQ ID NO: 88261 - protein, 517 aa, Coriolopsis gallica
MLHTRTRLGNVLALLSLLGTAWGAIGPKTDLHIVNKVIAPDGFPRDTILAGGTFPGPLITGKTGDRFLIDVYDDLTNTTMLTPTSIHWHGLFQHTTNWADGPAFVTQCPISSGHNFLYNFRVPDQSGTYWYHSHFGLQYCDGLRGPIVVYDPHDPQKHLYDVDDDSTVITLSDWYHVAAASVPVPPQSDSTLINGLGRWGGDPTSELAVITVEHGKRYRFRLASLSCDPFFTFSIDGHDMTIIEADGVNTQPLKVDQLDIFAAQRYSFVLEANQPKGNYWMRANPNHANFVGFENGINSAILRYKGAPVAEPNTTQTPSKKPLLETNLHPLTKQAVPGKPHPGGADVNINLELGVDVNAGLFLVNGSPFIPPDIPVLLQILSGNYSAQSLLPPGVVYTLPPNQSVELSIPGGVLGGPHPFHLHGHAFSVVRSAGSSVYNYKNPVQRDTVSIGDSTDNVTIRFFTDNPGPWFLHCHIDFHLNAGLAVVFAEDPKDTAFVNPVPSSWKELCPTYYAENP

SEQ ID NO: 88262 - protein, 393 aa, Phytophthora ipomoeae
LVTELGEYRAAVPSGASTGEFEALEMRDGGKDYMGKGVLNAVKNVNEIIAPALIGKDVTKQAEIDRFMVEKLDGTQNEWGWCKKKLGANAILGVSLALCRAGAAAKKQPLWQHIADLAGNPTPCLPVPSFNIINGGSHAGNKLAMQEFMILPVGAKNFTEAMKIGSEVYHNLKKVIKGRYGLDATAVGDEGGFAPNIQSNGEAIDLIEEAIKAAGYTNQVRLGMDVAASEFYTGAEDARYNLDFKNENAAESEKIPADKLLEVYEGFIAKCADSSKIVSIEDPFDQDDWESWVKITGKVGKDVQIVGDDLTVTNPTRVKKAIEQKACNALLLKVNQIGSITESIEAVTMAKKAGWGIMASHRSGETEDTFIADLAVGLSAGQIKTGAPCRSER

SEQ ID NO: 88263 - protein, 216 aa, Pseudomonas putida GB-1
MSTQHLSQFPNVSAAIAAFQAGRPVLLLDDNDREDEADIIAAAENITLQTMAMMIRDCSGIVCLCLDEATVDALQLAPMVQNNQARHGTGFTVTIEAAEGITTGVSAQDRITTIDAALRSSAEQRHIVSPGHVFPLRARNGGVLTRRGHTEGSVDLARLAGLRPAAVLCELMNPDGSMARGEQVAVYARQYNLPVLTIEELARYREALLELEAEPA

SEQ ID NO: 88264 - protein, 141 aa, Saccharophagus degradans 2-40
MAIERTLSIVKPDAVEKNIIGKVISRFEKAGLKIVAAKMMHLTEEKARGFYAEHEGRPFFAGLVEFMTSGPVVVQVLEGENAIALNRELMGATNPAEAAEGTLRKDFADSVGRNAVYGSDSPASAEREINYFFDASEICPR

SEQ ID NO: 88265 - protein, 349 aa, Streptomyces avermitilis MA-4680
MRGVVFDGKQTQVVDDLEIREPGPGEVAVAISAAGLCHSDLSVVDGTIPFPVPVVLGHEGAGVVEAVGSGVTHVRPGDHVALSTLANCGACAECDRGRPTMCRKAIGRPQQPFARGGRPLYQFAANSAFAERTVVKAVQAVRIPKDIPLPSAALIGCGVLTGVGAVLNRARVEHGDSVLVIGTGGIGLNVLQGARIAGALTIVAVDANPAKEAVARQFGATHFLTSTEGVRDILPTGADHAFECVGRAALIRQAVDLLDRHGQAVLLGVPPATAEASFLVSSLFLDKSILGCRYGSSRPQRDIALYADLYREGRLLLDELVTATYPVEDFEKAAADAHEGRVARAVLTF

SEQ ID NO: 88266 - protein, 120 aa, Arabidopsis thaliana
MDKSFTLFLTLTILVVFIISSPPVQAGFANDLGGVAWATTGDNGSGCHGSIAECIGAEEEEMDSEINRRILATTKYISYQSLKRNSVPCSRRGASYYNCQNGAQANPYSRGCSKIARCRS

SEQ ID NO: 88267 - protein, 431 aa, Thermobifida fusca YX
MSEIYMPRLSDTMEEGVISSWVKQVGDKVSVGDVLVEIETDKAVMEYEAYEDGYLVQQTVREGETVPIGAVIGVIADSPDAVPAAPEGGEGAEQKAEEPQQPAPAAQEAKEEQPTVPAPAAPAEQGGKPRPLSSPLARRLAREYGLDITKIQGSGPKGRVVRADVEAAAQQKREQEAAAPQPAAAKAPAPAAAPPQPEFEDLRASEEVPVTNIRRVIARRLTQAKQEIPHFYLRRRIDAEALREFRAQINEQLAPTGVKVSVNDLIVKAVATVLRDHPEVNSSWVDDKLLRHKRINVGIAVAVDTGLVVPVLHDADTLALSEVARRSRALVEKARDGKLSPQDMSGGTFSVSNLGMFGVESFSAVINPPEAAILAVGAMQQEPVVRDGEIVARHTIALELSVDHRAVDGAVGAAFLKDLAEVLESPMRIVL

SEQ ID NO: 88268 - protein, 297 aa, Shigella boydii
MTNLKAVIPVAGLGMHMLPATKAIPKEMLPIVDKPMIQYIVDEIVAAGIKEILLVTHASKNAVENHFDTSYELESLLEQRVKRQLLAEVQSICPPGVTIMNVRQGEPLGLGHSILCARPAIGDNPFVVVLPDVVIDDASADPLRYNLAAMIARFNETGRSQVLAKRMPGDLSEYSVIQTKEPPDREGKVSRIVEFIEKPDQPQTLDSDTMAVGRYVLSADIWPELERTQPGAWGRIQLTDAIAELAKKQSVDAMLMTSDSYDCGKKMGYMQAFVKYGLRNLKEGAKFRKGIEKLLSE

SEQ ID NO: 88269 - protein, 396 aa, Brassica napus
MGSTVILSSDEEDSDISDSEMEEYGDKIYLSLKSGKLKVKLSPHSFTCPYCPNKKKPSFQYKDLLQHASGVGNSNSDKRSAKEKASHLALAKYLQQDLADDSQAEPSSKRRKTGDPIQDCDQDEKLVCPWKGVVVNIPTTKTENGRTAGESGSKLRDEYIQRGFNPTRVRTLWNHWGFSGTAIVEFNRDWNGLHNALLFDKAYLVDGHGKKDWLRKDGPPKSGLYAWIARADDYNGNNIIGEDLREEGDLKTIAEVTEEEARKQQKLVQNLTQLVEEKKKGVKEIEELHSAKSKELKEKLEEKEKSLQKHNSELNAIQERTMGHVNKIFADHERLKMQLELEKKKLEIKGVELAKREAHNETERKNLAEDLQENASKNSSLELASMETQKGDEEVK

SEQ ID NO: 88270 - protein, 295 aa, Pseudomonas putida GB-1
MIGTYQASCQARVDTALEPLFIAPTKELERLYAAMRYSVMNGGKRVRPLLAYAACEALGAPAEQANGAACAVELIHAYSLVHDDLPAMDDDDLRRGQPTTHKAFDEACAILAGDGLQSLAFSALLDPHLSPQADNIRLAMVQALAKAAGPAGMVGGQAIDLGSVGLKLDQQALEFMHRHKTGALIEASVRLGALASARAEQAQLDALQTYAQAIGLAFQVQDDILDVESDTATLGKRQGADIARDKPTYPALLGLEAAKAYAIELRDQALIALQGFGETAEPLRALARYIVERRN

SEQ ID NO: 88271 - protein, 631 aa, Pseudomonas putida GB-1
MPTTFQEIPRERPVTPLLDRADTPAGLRRLAEADLETLADELRQELLYTVGQTGGHFGAGLGVIELTIALHYVFDTPDDRLVWDVGHQAYPHKILTGRRNRMLSLRQKDGIAAFPRRSESEYDTFGVGHSSTSISAALGMAIAARLQNSARKSIAVIGDGALTAGMAFEALNHAQEVNADMLVILNDNDMSISRNVGGLSNYLAKILSSRTYASMREGSKKVLSRLPGAWEIARRTEEYAKGMLVPGTLFEELGWNYIGPIDGHDLPTMIATLRNMRDLKGPQFLHVVTKKGKGFAPAEVDPIGYHAITKLEPADKPAAPKKVSGPKYSAVFGQWLCDMAAADNRLVGITPAMKEGSDLVDFSERYPQRYFDVAIAEQHAVTLAAGMACEGSKPVVAIYSTFLQRAYDQLIHDVAVQNLDVLFAIDRAGLVGEDGPTHAGSYDLSYLRCIPGMLVMTPSDENELRKMLSTGHLYNGPAAVRYPRGTGPNAPISGDLQPLEIGKGVVRRQGEKIALLVFGVQLAEAMQVAEQINATVVDMRFVKPLDEALVLELAGSHELLVTIEENAIMGGAGAAVGEFLASQAVLKPLLHLGLPDIYVEHAKPAQMLAECGLDAAGIEASVKARMAKLGL

SEQ ID NO: 88272 - protein, 315 aa, Thermobifida fusca YX
MSNRYAYLGPEGTFTEAALRALKPETPSAEFVPCNGVDMVFAAVRSGEVEGGVVPLENSVEGGVSATTAELVNGEPLLITAEITVPVEFTLFARPGTTLHDVKRVATHSHALAQCRGWLAENLPNTESYVVSSTAAAAQSVSDPASPYDAAICARIAGERYGLVPLAEGIGDRADAATRFIYLSRPGPLPEPTGADRTSLVAFLPHDHPGALVELLTQFAVRDVNLTRLESRPTGDGLGTYCFFMDAEGHVAEARIGEALMGLRRICRDVRFLGSYPRSDAGMQQRRPRARVSTTDDDFHEAERWLARIRAGQVD

SEQ ID NO: 88273 - protein, 182 aa, Sulfitobacter sp. EE-36
MAAGNHTTLTTPRFDTPVKVLIVISPYYSDIAEGLLKGAKAELEAAGAEWDVVEMPGALEIPTAIGISDRKSNFDGYVALGCVIRGETTHYETVCNDSSRALQLMGLQGICIGNGILTVENHEQAAVRADPEGQNKGGGAAAAALHLIALSRKWGDIRKDIGFKPRSDEYLMAGDNDGPKTA

SEQ ID NO: 88274 - protein, 637 aa, Shewanella sp. MR-4
MISINQAQLIRGSKTLLDEASLTIYPGHKVGLVGANGTGKSSLLALIMGHLSLDKGEFSMPSGWQIATVAQETPALEVSALEYVLDGDKEYRQLEADLHIAQEHNDGHAIATLHGKIDAIGGYAIRARAGALLAGLGFSEAEQNNPVKSFSGGWRMRLNLAQALLCRSDLLLLDEPTNHLDLDTMYWLEGWIKSYQGTLILISHDRDFIDEIVDEIVHVENQKLNYYKGNYSAFERIRAERMAQQQVAYERQQKERAHMQSFVDRFRYKASKAKQAQSRLKALERMTELLPSQADSPFYMEFRPPEALPNPLIKMEQVAVGYGDKQILSKVHLNLVPGARIGLLGRNGAGKSTLIKLLSGQLSPMTGLYEPNPGLNIGYFAQHQIEFLRLDDTPLQHLVRLAPNAREQELRNFLGGFGFHGDMALSPVRPFSGGEKARLVLALLVWQRPNLLLLDEPTNHLDLEMRHALTMALQTFEGAMVIVSHDRHLLRLTCSDYYLVDQGQVQAFDGDLEDYHQWLLDAAKAASANSTVNGDDAKPAVDKKQQKRLEAELRQKVSPLKRKQAKLETDQQKLSERLAELEHLLADSELYDQDNKAKLTSVLSERTSLTQTLEESEMQWLELQEEIDSMELELMGQ

SEQ ID NO: 88275 - protein, 344 aa, Helicobacter pylori J99
MALLFTGACGYIGSHTARVFLEKTKENIIIIDDLSTGFLEHIKALERYYPNRVAFIQANLNETQKLDAFLNKQQLKDPIEAVLHFGAKISVEESMRLPLEYYTNNTLNTLGLVKLCLKHAIKRFIFSSTAVVYGESGSSLSEESPLNPINPYGASKMMSERILLDASKVADFKCVILRYFNVAGACMHNDYTTPYTLGQRTLNATHLIKIACECAVGKRKKMGIFGTNYPTRDGTCIRDYIHVDDLANAHLASYHTLLEKNKSEIYNVGYNQGHSVKEVIEKVKEISNKDFLVEILDKRQGDPASLIANNSKILQNTPFKPLYNNLDTIIKSALSWEEHLLKFQ

SEQ ID NO: 88276 - protein, 205 aa, Pseudomonas putida GB-1
MPVVFVAASKLPTPFATFTMHGFLDEATGREHVVLSLGDIADGQPVLGRLHSECLTGDALFSQRCDCGSQLEAALQAIAREGRGVLLYLRQEGRGIGLLNKIRAYELQDGGADTVEANERLGFAADQRDYAMCLPMLEHLGVKSLRLMTNNPRKVKALTDMNIVVAERVPLHTGHNPHNRYYLATKAGKLGHMLGNEHQGEAPQA

SEQ ID NO: 88277 - protein, 374 aa, Sulfitobacter sp. EE-36
MQFETPGPVEAELADAIAPIEEIIEEARQGRMFVLVDHEDRENEGDLVIPAQFADADAINFMATHGRGLICLPMTEERVNTLGLPMMAVNNSARHETAFTVSIEAREGVTTGISAADRALTVKVAIDEDKGAVDIATPGHVFPLRARDGGVLVRAGHTEAAVDISRLAGLHPSGVICEIMKEDGTMARLPDLVAFCQQHDMKIGTISDLIAYRHKHDNLLVERDSRTVTSAYGGDWKMQIFTDEISGTDHVVLSKGDITTDAPVLVRTHAINALEDILGLGPSPADELPRAMQIIADEGRGAVLLFRDPDPRLRFEDEEDDRPRTVKRTGLGSQIMASLGLHKLILLTDNPDTRYLGLDAYDLSIVGTRPITQE

SEQ ID NO: 88278 - protein, 287 aa, Triticum aestivum
MAAAPPQPAAPAPGPANGGDAFRLGFVGAGNLAESIARGVAASGVLPASAVRTAPHRRPERGAAFASLGATILASNAQVVDGSDVIVISVKPQIVKQVLVELKPLLSEEKLLVSIAAGIKMKDLQDWSGQRRIIRVMPNTPSAVGQAASVMCLGETATEKDENRVKSLFSAIGKVWTAEEKYFDAVTGLSGSGPAYIFLAIEAMADGGVAAGLPRDLALGLAAQTVLGAATMVSETGKHPGQLKDQVTSPAGTTIAGVHELEKGSFRGTLINAVVAATTRCRELSKN

SEQ ID NO: 88279 - protein, 422 aa, Lactococcus lactis subsp. lactis Il1403 [sequence omitted]

SEQ ID NO: 88280 - protein, 188 aa, Glycine max
MAPGALARLIIGRRAASPLLARPFAAKARAPQRAPEPEPLSEEDDDFTSGGEAAPIPTEGISKPLAGILKELGKRVPESLLKTRLEDNGFALKYIPWHLANKILNMHAPEWSGEVRNIVYSSDGKSVSVVYRVTLYGTDAEIYREATGTASVEEKGFGDPVQKAEGMAFRRACARLGLGLHLYHEDMS

SEQ ID NO: 88281 - protein, 233 aa, Oenococcus oeni PSU-1
MDAELQNKLKKEAARKAASYVKNGMVVGLGSGSTVKMLVDELGRRVKEEDLQFTGVATSIFTAQQAKSLGIKIVDLDMVDSIDLTIDGADQVDSNFNGIKGGGGNLLWEKIVAINSKKIVWVVDKSKVVDTIGAFPLAVDVIPFGSQHVMQNFDKAGYEPVLRLDKEGKPFKTDSNNLIIDLHLHKIEEPTQLADNLIQTVGVVEHGLFLNMVSEVVVGKEGQPEILVNPNIG

SEQ ID NO: 88282 - protein, 125 aa, Brassica napus
  misc_feature (6)..(6): Xaa can be any naturally occurring amino acid
  misc_feature (9)..(12): Xaa can be any naturally occurring amino acid
  misc_feature (14)..(16): Xaa can be any naturally occurring amino acid
  misc_feature (18)..(19): Xaa can be any naturally occurring amino acid
  misc_feature (22)..(23): Xaa can be any naturally occurring amino acid
  misc_feature (25)..(25): Xaa can be any naturally occurring amino acid
  misc_feature (28)..(30): Xaa can be any naturally occurring amino acid
  misc_feature (33)..(34): Xaa can be any naturally occurring amino acid
  misc_feature (36)..(38): Xaa can be any naturally occurring amino acid
  misc_feature (40)..(40): Xaa can be any naturally occurring amino acid
  misc_feature (44)..(44): Xaa can be any naturally occurring amino acid
  misc_feature (48)..(48): Xaa can be any naturally occurring amino acid
  misc_feature (52)..(52): Xaa can be any naturally occurring amino acid
  misc_feature (56)..(56): Xaa can be any naturally occurring amino acid
  misc_feature (63)..(63): Xaa can be any naturally occurring amino acid
  misc_feature (84)..(84): Xaa can be any naturally occurring amino acid
  misc_feature (87)..(87): Xaa can be any naturally occurring amino acid
  misc_feature (100)..(100): Xaa can be any naturally occurring amino acid
  misc_feature (110)..(110): Xaa can be any naturally occurring amino acid
  misc_feature (112)..(114): Xaa can be any naturally occurring amino acid
  misc_feature (117)..(124): Xaa can be any naturally occurring amino acid
DQSSMXSSXXXXTXXXQXXMVXXFXVLXXXAAXXVXXXAXNDIXSIAXNGGXVSCXKVWPPVXKKKFETLSYLPDLTEVELGLXKSXTLLRNKCIPCVEXELEHGFCAPXSXXXPPXXXXXXXXM

SEQ ID NO: 88283 - protein, 458 aa, Shewanella sp. MR-4
MAFSTLKLKPELLENLTTMGYYEMTPIQAQSLPAILAGEDVIGQGKTGSGKTAAFGLGLLNKLDVKRFRIQTLVLCPTRELADQVAQEIRTLARGIHNVKVLTLCGGVPMGPQIGSLEHGAHIIVGTPGRIVDHLERNRLDLSNLNMLVLDEADRMLEMGFQPQLDAIIEQSPRERQTLLFSATFPEQIQSIAKQIMYDPVMVKVAVTHEKSTIEQHFYHLDDDKARMQALQLLLLDRKPESAVVFCNTKRETQKVADELSDAGFSVIALHGDLEQRDRDETLLQFANKSACVLVATDVAARGLDIDALDAVFNYHVAYDTEVHIHRIGRTGRAGSKGAAFTFFNDQDGYKIALLEEYLERDIQSEALPSLSLLGTAPNAPTMITLQIDGGKKEKLRPGDILGALTGENGIEGSQVGKILVTDYRAYVAVNRKVAKKALSKITSGRIKGKSYRAWLMK

SEQ ID NO: 88284 - protein, 341 aa, Shigella flexneri 2a str. 301
MKALSKLKAEEGIWMTDVPVPELGHNDLLIKIRKTAICGTDVHIYNWDEWSQKTIPVPMVVGHEYVGEVVGIGQEVKGFKIGDRVSGEGHITCGHCRNCRGGRTHLCRNTIGVGVNRPGCFAEYLVIPAFNAFKIPDNISDDLASIFDPFGNAVHTALSFDLVGEDVLVSGAGPIGIMAAAVAKHVGARNVVITDVNEYRLELARKMGITRAVNVAKENLNDVMAELGMTEGFDVGLEMSGAPPAFRTMLDTMNHGGRIAMLGIPPSDMSIDWTKVIFKGLFIKGIYGREMFETWYKMAALIQSGLDLSPIITHRFSIDDFQKGFDAMRSGQSGKVILSWD

SEQ ID NO: 88285 - protein, 336 aa, Oenococcus oeni PSU-1
MTANEHHMVLMSLSANRPLAEKIAKRLHQPLADVNLDRFADGEIRLNITNSVRGDNVFVIAPTSASPHGSVNDNIMELFIAVDALRRASAHAINIVMPYYGYARQDRKARSRESIAARVIADHLEQAGVTRVIAFDLHASQIQGFFDIPVDHLMGAPILADYLISHHIVDLDNAVVVSPDHGGVRRARELNQFLGLPDSYAVIDKRRPVDKKNAVEVMNLIGDVSGKTAIIIDDMIDTGHTIVEGAKLLRAKGAKKIIVVASHALLSGDASKLLQKSDFDHVIVTDSIDIPESKRFDKLQIVSADDLFAKAITAVQENGSVSPLFQNKYHRGFEND

SEQ ID NO: 88286 - protein, 315 aa, Mycobacterium sp. JLS
MPRIAYLGPQGTFTESALLQMISGAMVPGGDADDTAVTPVPTDSTPAGLEAVRSGAADYACVPIENSIEGSVLPTLDSLAVGAPLQIFAELTLAVSFSIVVRPDHDGDVATVAAFPVAAAQVRRWLAEHLPAAQLVPAHSNAAAAADVAGGRADAGISTALAAERYGLRSLAAGVVDEPNARTRFVLVGRPAPPPARTGADRTSVALRLPNTPGALVAAMTELSIRDIDLTRIESRPTRTELGTYVFFLDCVGHLEDDAVAEALKALHRRCEDVRYLGSWPTGTAAGAPPPSSDEATRWLTRLREGLPTPPEGGR

SEQ ID NO: 88287 - protein, 475 aa, Listeria monocytogenes str. 1/2a F6854
MAKEYDVVILGGGTGGYVAAIQAAKNGQKVAVVEKGKVGGTCLHRGCIPTKALLRSAEVLQTVKKASEFGISVEGTAGINFLQAQERKQAIVDQLEKGIHQLFKQGKIDLFVGTGTILGPSIFSPTAGTISVEFEDGSENEMLIPKNLIIATGSKPRTLSGLTIDEEHILSSDGALNLETLPKSIIIVGGGVIGMEWASMMHDFGVEVTVLEYADRILPTEDKEVAKELARLYKKKKLNMHTSAEVQAASYKKTDTGVEIKAIIKGEEQTFTADKILVSVGRSANTENIGLQNTDIATENGFIQVNDFYQTKESHIYAIGDCIPTIQLAHVAMEEGTIAANHIAGKAAEKLDYDLVPRCIYTSTEIASVGITEEQAKERGHEVKKGKFFFRGIGKALVYGESDGFIKIIADKKTDDILGVSMIGPHVTDMISEAALAQVLNATPWEVGNTIHPHPTLSESFREAALAVDGNAIHG

SEQ ID NO: 88288 - protein, 416 aa, Listeria monocytogenes str. 1/2a F6854
MAVEKITMPKLGESVTEGTISSWLVKPGDTVEKYDAIAEVLTDKVTAEIPSSFSGTIKEILAEEDETLEVGEVICTIETEEASSSEPVAEAEQTEPKTPEKQETKQVKLAEAPASGRFSPAVLRIAGENNIDLSTVEGTGKGGRITRKDLLQVIENGPVAPKREEVKSTPQEKEATPNPVRSAAGDREIPINGVRKAIAKHMSVSKQEIPHAWMMVEVDATGLVRYRNTVKDSFKKEEGYSLTYFAFFIKAVAQALKEFPQLNSTWTGDKIIEHANINISIAIAAGDLLYVPVIKNADEKSIKGIAREISELAGKARNGKLSQADMEGGTFTVNSTGSFGSVQSMGIINHPQAAILQVESIVKRPVIIDDMIAVRDMVNLCLSIDHRILDGLLAGKFLQAIKANVEKISKENTALY

SEQ ID NO: 88289 - protein, 224 aa, Striga asiatica
PGRSLLDIGRFCTGYGIGIFSYVVPVFISEIAPKNLRGGLATLNQLMIVIRIIYSVYLRNSVNMENLALTGLLPCLLLLVGLFFIPESPRWLAKIGRQKEFELALRKLRGKNANVSKEAAEIQASFDTLRDLPKVNMFELFDAKYIRPLIVGVGLMFSQQFGGIKRVGFYTSQTFVAAGFSSGKMGTILYAIIQVPVTVVGAVLMDKSGRRPLLMVSPKDCPIL

SEQ ID NO: 88290 - protein, 419 aa, Vibrio cholerae O1 biovar eltor str. N16961
MSLLAIGINHNTASVELREKVAFGPEKLSLALNQLSTSSHVKGGVILSTCNRTEIYCDVRSASKNKVIEWLSQFHQVSLDELKPSLYVHEEQAAIRHLMRVACGLDSLVLGEPQILGQVKQAYAEARENHAVNPATEKLFQKAFSVAKRVRTETEIGGSAVSVAYAACTLAKHIFESLADATVLLVGAGETIELVAKHLAGHHCKRMIVANRTRERALSLAQQFGADVIALNEIPDYLAQADIVISSTASPLPIIGKGMVESALKARRHQPMLLVDIAVPRDIEPQVGKLNDAYLYSVDDLQSIVDSNIEQRKVEAIQAEAIVSEESATFMSWMRSLQAVDSIRDYRKQANEAREELLNKSLQALAAGGDPEKLLIELSNKLTNKLIHTPTRALQTAAEQGEPAKLAVIRQSLGLDDLN

SEQ ID NO: 88291 - protein, 393 aa, Phytophthora capsici
LVTEIGEYRAAVPSGASTGEFEALEMRDGGKDYMGKGVLNAVKNVNEIIAPALVGKDVTKQAELDRFMVEELDGTQNEWGWCKKKLGANAILGVSLALCRGGAAAKKQPLWQYIADLAGNPSPCLPVPSFNIINGGSHAGNKLAMQEFMILPVGATSFTESMKIGSEVYHNLKKVIKGRYGLDATAVGDEGGFAPNIQSNGEAIDLIEEAIKAAGYTNQVRLGMDVAASEFYTGASDARYNLDFKNENAPESEKIPADKLQEVYEGFIAKCADSSKIVSIEDPFDQDDWASWVKFTAKVGKDVQIVGDDLTVTNPTRVKKAIEQKACNALLLKVNQIGSITESIEAVTMAKKAGWAIMASHRSGETEDTFIASLAVGLSAGQIKTGAPCRSER

SEQ ID NO: 88292 - protein, 270 aa, Striga asiatica
MSSIGLAHNVSILGSGETTVVLSHGYGTDQSVWKLLVPHLVDDNKVLLYDNMGAGTTNPDYFDFERYSSLEGYSYDLIAILDEFHVSKCIYVGHSMSAVAGAVASIFRPDLFHKLIMISPSPRLANTEDYYGGLEQKEIDEVVGSMEENYKSMALGSAPLILACDLESAAVQEYVRTLFNMRPDISCCIARMIFGLDLRPYIGHIKVPCHIIHSAKDFMVPVAVGEYLCKHLGGPSVVEVMPTEGHLPHLSAPEVTIPVVLRHVRQDIEV

SEQ ID NO: 88293 - protein, 393 aa, Phytophthora drechsleri
LVTEIGEYRAAVPSGASTGEFEALEMRDGGKDYMGKGVLNAVKNVNEIIAPALVGKDVTKQEELDRYMVETLDGTQNEWGWCKKKLGANAILGVSLALCRGGAAAKKQPLWQYIADLAGNPSPCLPVPSFNIINGGSHAGNKLAMQEFMILPVGATSFTEAMKIGSEVYHNLKKVIKGRYGLDATAVGDEGGFAPNIQANAEAIDLIEEAIKAAGYTNQVRLGMDVAASEFYTGVKDARYNLDFKNANAPESEKIPADKLQEMYEGFISKCADSSKIVSIEDPFDQDDWESWVKFTGKVGKDVQIVGDDLTVTNPTRVKKAIELKACNALLLKVNQIGSITESIEAVTMAKKAGWAIMASHRSGETEDTFIAGLAVGLSAGQIKTGAPCRSER

SEQ ID NO: 88294 - protein, 393 aa, Phytophthora cambivora
  misc_feature (157)..(157): Xaa can be any naturally occurring amino acid
LVTEIGEYRAAVPSGASTGEFEALEMRDGGKAYMGKGVLNAVKNVNDIIAPALIGKDVTKQAELDRYMVEELDGTQNEWGWCKKKLGANAILGVSLALCRGGAAAKKQPLWQYIADLAGNPTPCLPVPSFNIINGGSHAGNKLAMQEFMILPVGATXFTEAMKIGSEVYHNLKKVIKNRYGLDATAVGDEGGFAPNIQSNGEAINLIEEAIKAAGYTNQVRLGMDVAASEFYTGAEDARYNLDFKNEBAAESEKISADKLQEVYEGFIAKCADSSKIVSIEDPFDQDDWASWVKITGKVGKDVQIVGDDLTVTNPTRVKKAIELKACNALLLKVNQIGSITESIEAVTMAKKAGWAIMASHRSGETEDTFIADLAVGLSAGQIKTGAPCRSER

SEQ ID NO: 88295 - protein, 209 aa, Glycine max
  misc_feature (62)..(62): Xaa can be any naturally occurring amino acid
MAIRNSLTGQFLRRSSVAGARLMSSSSSWFRSIEPAPKDPILGVTEAFLADQSPNKVNVGVXEYLPMGGSIKMIEESLKLAFGDNSEFIKDKRIAAVQALSGTGACRLFAAFQQRFHPNTQIYIPVPTWANHHNIWRDAGVPMKTFRYYHPESRGLDFSGLMDDIKNAPDGSFFLLHACAHKPTGVDPFEEQWRENSSQIKGKGHFPFF

SEQ ID NO: 88296 - protein, 271 aa, Phytophthora hedraiandra
TKQAEIDRFMVEELDGTQNEWGWCKKKLGANAILGVSLALCRAGAAAKKQPLWQHIADLAGNPTPCLPVPSFNIINGGSHAGNKLAMQEFMILPVGATSFTEAMKIGSEVYHNLKKVIKGRYGLDATAVGDEGGFAPNIQSNGEAIDLIEEAIKAAGYTDKVRLGMDVAASEFYTGAEDARYNLDFKNENAADSEKISADKLQEVYEGFIAKCAGSSKIVSIEDPFDQDDWESWVKITGKVGKDVQIVGDNLTVTNPTRVKKAIEQKACNA

SEQ ID NO: 88297 - protein, 479 aa, Physcomitrella patens subsp. patens
MNLPPGPKAMPLLGNLLQMGSHPHRTMTAMHKKYGHILYIRLGCIPTVVVDSPQLIAEITKEQDNVFSSRPHMTFTDIVAYDAHDFAMAPYGPHWRYVRRICVHELLTPKRLEITMKERIEESRCMIMAVAEAAQKGEIVDMRDVFAGVSMTVMCRMLLGRREFAATGKKAKDFKHLIHELFRLMGALNLRDFVPALGWLDLQGFERDMYKLRDEFDEVFDAVIQEHRDLASGKLPGGKPNDFISVLLDLPGENGAPHLDDKTIKAITLDMMAGATDTSAVTNEWAMAEIIRNTEIQRKLQEEIDSVVGLERNVQESDINKLPYLMCVVKETFRLHPAGPFAIPRETMADTKLSGYRIPKGTRVLINIFSLGRSSETWKDPLKFQPERWANENLSAIHDMGFRILPFGYGRRQCPGYNLGTTMVLLTLARLLHGFKWSFPPGVTAENIDMEELYGCTTPLRTRLRTIATPRLAPHLYSQ

SEQ ID NO: 88298 - protein, 256 aa, Lactococcus lactis subsp. lactis Il1403
MEAQKLSAQEIIQFIGNAEKKTRVKVTLSGMPSFKAAGFLAENGRPNFKALANKGIQVLGDFHTHYSLKIIIGDWQAVRPLLSGLTENKDYTLELEGRNSAVPLLDTREINARIEPGAIIRDQVTIGDSAVIMMGAIINIGAEIGEGTMIDMGAILGGRATVGKNSHIGAGAVLAGVIEPASAEPVRVGDNVLVGANAVVIEGVQVGSGSVVAAGAIVTQDVPENVVVAGVPARIIKEIDEKTQQKTALEDALRNL

SEQ ID NO: 88299 - protein, 363 aa, Pseudomonas putida GB-1
MALNSIEELVEDIRQGKMVILMDDEDRENEGDIIMAAECCLPEHINFMAKHARGLICMPMTRERCETLKLPLMAPRNGSGFGTKFTVSIEAAEGVTTGISAADRARTVQAAAAKDAKAEDIVSPGHIFPLMAQPGGTLARAGHTEAACDLARMAGFEPSGVICEVMNDDGTMSRRAELEVFAAEHGLKIGTIADLIHYRMIHERTVQRVSEQPVESELGEFNLVTYRDAVEGDVHMALTLGKICAEEPTLVRVHNMDPLRDLLLVKQPGRWSLRAAMAAVAEAGSGVVLLLGHPLDGDVLLAHIRESAGDAPTKAPTTYSTVGAGSQILRDLGVRKMRLMSSPMKFNAISGFDLEVVEYVPSE

SEQ ID NO: 88300 - protein, 425 aa, Helicobacter pylori J99
MLDFDLVLFGATGDLAMRKLFVSLYEIYIHYGFKNDSRIIASGRKELSNEEFLALLCEKTQLHSREKGEEFLTHISYLRVRLDNPKDFEELSKIATNNKPLIFYFSISPSFFATTAQNLAQNALNHANTRLILEKPLGHDLKTCKEIFQSISAFFKEEQIFRIDHYLGKKGVQNILELRLNNPILNILWDQISAVEICVYETLGVEERGEFYDKIGALRDMVQNHLLQVLSLIATDLPNDLKDLRQEKIKVLKTLQPPKDFTKQVIRAQYQGYRDENKVHKESQTETFVAIKAFLDTPKFKGVPFYLKHAKKMPRNQASVKIHFNAVNTLEFFLSQDKITLTLKDHQNPLILETHNKQEFLQPYAKLLYDAIPNNHYNFAHQLELEASWVFIDTLIEGFINNATPLYSYESHNLNESEFLKPLYQ

SEQ ID NO: 88301 - protein, 223 aa, Sulfitobacter sp. EE-36
MTKTLFITGASSGIGAATARAAAKAGWNVGLFARSEDKLKDLAREIGDQALVLTGDATQYDDQEQAMSRLAQKFGQIDAVFANAGRGTSPGGTEKGDPDDWKSMIDLNVMGALYTAHAAMPYLRKTTGQYVVTGSAAGRRHIKGSIYGATKFFIHGFAGNLADEMAEWGGRCMVVSPGMVDTAFFDEAKPDKLKPEDVASAVMHALEAPAHAAVREIHLMPVD

SEQ ID NO: 88302 - protein, 499 aa, Thermobifida fusca YX
MSETPERGLGSRAGVVLVDRYRLDERIGVGGMGEVWRATDILLSRPVAVKLLHLAQVSDPVSQQRFRTEAQITAALSHPNIAQVYDYGEQDGFSFLVMELITGESLSAIIKRNPGLDPDITLDVVDQAAQALSAAHANGVIHRDIKPGNLLVTEDGTVKLTDFGIARGNESVTLTQTGMVMGTAQYISPEQVSGKPASPLSDIYALGIVAYECLAGHPPFTADTPLALALAHSREPPPPLPDSVPPAVRELVECMLAKDPQERPSSAAEVSQWAQRLRAALNGGDATEALGLVSATAATAVVPAQPGPPTGDSTPVDGPHSGAQAQTWPPPQGKDSDRVAERSAAPNSRLNLPVVFALIATVGAVAVGIFLVGLLGKEPGTNGTPTSHRSVVPTLSRSPDTTENITTDSQTPVPDNPGGQLPPLNDEPEESYSPAPHPEPTTPPQSEYPSPPGDGADSTPDPGEEPGGPSDEDDADGGGAAPGGPTGGTGEESRGSTPP

SEQ ID NO: 88303 - protein, 349 aa, Zea mays
  misc_feature (329)..(329): Xaa can be any naturally occurring amino acid
  misc_feature (337)..(337): Xaa can be any naturally occurring amino acid
  misc_feature (341)..(341): Xaa can be any naturally occurring amino acid
PPHLPLPLSPPSSDLLAAADDRRRRCRCRCEPFVNLRCPVFNVAGVPIEWEEHYVGTEVDPRTESFLTWESLESVRRNKVGLKGPMATPIGKGHRSLNLTLRKELGLYANVRPCNSLPGYKTRYDDVNLVTIRENTEGEYSGLEHQVVRGVVESLKIITRQASLRVAEYAFHYAKANGRERVSAIHKANIMRKTDGLFLKCCREVSEKYPEIQYEEVIIDNCCMTLVKNPGPFDVLVMPNLYGDIISDLCAGLIGGLGLTPSCNIGEGGICLAEAVHGSAPDISGKNLANPTALMLSAVMMLRHLQFNDQADRIHNAILQTIAEGKYRXTADLGGKXSTSXYPKAVCDH

SEQ ID NO: 88304 - protein, 174 aa, Thermobifida fusca YX
MSDTKELFARLNTTKGTIVVRLFPDKAPETVANFVGLAEGTKQWVDPRTGRPTTSKLYDGTVFHRVIKDFMIQGGDPLGNGRGGPGYKFNDEIHPSLKFDRPYLLAMANAGPNSNGSQFFITVTPTDWLNGRHTIFGEVVEGSEVAVAISEVATDQMDKPLEPVVLESVTIERR

SEQ ID NO: 88305 - protein, 389 aa, Xanthomonas oryzae pv. oryzae KACC10331
MNFHEYQSKQLLAEYGIPVPSGKVAATPDEAVDVATSLGKGPWMVKAQIHAGGRGKAGGVKFCKTTDDVKAAAAKMLGTKMSTYQTAGVELPINLVLVTTAGEIVKELYLSILVDRGTKTITYIASSEGGVEIEQVAAETPELIHALNVDFVEGVQGYHGRDFGFKLGLNAKQAGQFASIMVNLYKLFNEKDLALVEINPLAILDDGNLYALDGKFDSDDNAAFRQKQLVAMRDKTQEDETEVTASELDINYVTMDGNIGCMVNGAGLAMATMDVIKLNGGEPANFLDVGGGANKQRVIEAFKLILSSDKVEGIFVNIFGGIVRCDMIAEGIIAAVKEVGVKVPVVVRLEGTNVEEGKQLLRDSGMAIIPADNINDGAKKVVEAVKNAA

SEQ ID NO: 88306 - protein, 476 aa, Sulfitobacter sp. EE-36
MNPGTEPSFRDSVDIMFNRAVALMDLSPGLEEKIRVCNATYTVRFGVRLRGGIQTFTGYRSVHSEHMEPVKGGIRYSPGVNQNEVEALAALMTYKCALVEAPFGGSKGGLCIDPRDYDEHELELITRRFAYELIKRDMINPAQNVPAPDMGTGEREMAWIADQYKRMNTTDINGVACVTGKPINAGGIHGRTEATGRGVQYALHAFFRDTKGMEKAGLGGELDGKRVVVQGLGNVGYHAAKFLSEEDGCKITAIIERDGALFDDRGLDVEEVHRWISMHGTIKGYPDAPLEEDGAKLLEADCDILIPAALEGVINLTNAHNIKAPLIVEAANGPVTAGADDILRAKGVVIIPDMYANAGGVTVSYFEWVKNLSHIRFGRMQRRNEESRHQLLVDELERLSADSGVGWQLSPNFKDKYLRGAGELELVRSGLYDTMSDAYRSMAEVWHSRDDVEDLRTAAYLVSIGKVAASYRAKGL

SEQ ID NO: 88307 - protein, 207 aa, Rhizobium galegae
MCAHLPAGHSFEWRKACRRKTTNRVIMTASTKDILATAIRSIPDYPKPGIIFRDITTLLGDAAAFRLAVDELVKPYEGLGVDKIAGMEARGFILGGAMAHQLSAGFVPIRKKGKLPYRTVSMAYALEYGTDEMEIHVDAVKPGEKVILCDDLIATGGTAVGAVKLLRQIGAEVVSACFVIDLPDLGGRKALEALGVEVRTLAEFSGH

SEQ ID NO: 88308 - protein, 262 aa, Zea mays
MAGLGKAMYAVGFWIRETGQALDRLGCRLQGKYFFHEQISRHRTIMNIFDKTPHVHKDAFVAPSASLIGDVQVGSGASIWYGCVLRGDANIIQIGSGTNIQDNSLIHVAKSNLSGKVFPTTIGNNVTVGHSAVLQGCTVEDEAFVGIGATLLDGVVVEKHGMVAAGALVRQNTRIPCGEVWGGNPAKFLRKLTDDEISFIAESAANYSNLSKVHAAENAKPLEKIEFEKVLGKKFAHQDEYDSSIGVAEGAPPELTSPNPAQ

SEQ ID NO: 88309 - protein, 335 aa, Frankia sp. CcI3
MATRVGVNGFGRIGRNFWRALAASNRNDLEIVAVNDLTDNKTLAHLLKYDTTLGTLSAAVGVVDEGIRVGDTVIKVLAERDPAALPWADLGVDVVIESTGRFTKAADAGKHLQAGAKKVIISAPAKDEDITVVIGVNDDAYDPARHHILSNASCTTNCVAPMAKVLDEAFGISQGLMTTIHAYTNDQVILDFPHSDLRRARAAAQNIIPTTTGAAKATALVLPHLKGKLDGLAMRVPVLDGSVTDLVATLDKKASKEEVNAAFKAAAEGPLKGYLVYTEDPIVSSDIVNTPASCTFDSLLTMSAGNQVKVVGWYDNEWGYSNRLVDLTALVAARL

SEQ ID NO: 88310 - protein, 400 aa, Frankia sp. CcI3
MRTIDDLQVAGHRVLVRSDLNVPLDRSGDTPRITDDGRVRASVPTISALLDRGARVVVSSHLGRPKGEPDPKYSLEPVAGRLAELLGRPVAFAGDGSGDIAGAHAREVVAGLGDGEVALLENLRFAAGETSKDAAIRAAFADELSALAEFYVGDAFGAVHRAHASVADVPKRLPHAAGRLVLTELEVLRRLSSDPARPYSVVLGGSKVSDKLGVIRALLPKVDALLVGGGMCFTFLAALGHGVGGSLLETEMIETCKELLAEGGERIVLPTDVVVADRFAADADTAVVAADAIPAGWLGLDIGPASTELFAARLAGAATVFWNGPMGVFELAPFAAGTRGVAEAVAAGKGFSVVGGGDSAAAVRTLGIPEDAFSHISTGGGASLEYLEGKTLPGLAALDV

SEQ ID NO: 88311 - protein, 308 aa, Frankia sp. CcI3
MALLGRGRSERGSDRGSGKNRGSGKDEDGVGKDRSVKGAAGSKGAAGVKGTGRRTLVAGNWKMNLNHLEAIALVQKIAFDLKPAELETVEVVVLPPFTDLRSVQTLVDGDKLAIAYGGQDLSPYASGAHTGDISGAMLAKLGCDYVVVGHSERRADHHEDDALVAAKAKAAFSVGLTPILCVGEPEEIRAAGTQVEHVLRQLERSLAGITAEQAATIVIAYEPVWAIGTGRTASAQDAQDMCAAVRGQLASQYGDEIAAGIRVLYGGSVKAANAGELFTMPDVDGGLVGGASLVAEEFVGIVRSGPPA

SEQ ID NO: 88312 - protein, 314 aa, Vibrio cholerae O1 biovar eltor str. N16961
MPDMKLFAGNAIPELAQRIADRLYISLGDATVSRFSDGEVAVQINENVRGSDVFIIQSTCAPTNDNLMELVVMIDAMRRASAGRITAVIPYFGYARQDRRVRSARVPITAKVVADFLSNVGVDRVLTIDLHAEQIQGFFDVPVDNIFGTPVLLEDMKARNLEDPVVVSPDLGGVVRARATAKALGDIDIAIVDKRRPRANVSEVMNLIGDVEGRDCVIVDDMIDTGGTLCKAAEALKERGAKRVFAYATHAVFSGNAAKNIKNSVLDQVIVTDSITLSKEMAATGKVTQLTLSSMLAEAIRRISNEESISAMFN

SEQ ID NO: 88313 - protein, 401 aa, Populus trichocarpa
MATKKSVSSLKEADLKGKRVFVRVDLNVPLDDNFNITDDTRIRAAVPTIKYLMSHGARVILSSHLGRPKGVTPKYSLKPLVPRLSELLGVDVKMANDCIGVEVEKIVAEIPEGGVLLLENVRFYKEEEKNDPEFAKKLASLAEIYVNDAFGTAHRAHASTEGVAKYLKPAVAGFLMQKELDYLVGAVANPKKPFAAIVGGSKVSSKIGVIESLLEKVDLLFLGGGMIYTFYKAQGHSVGSSLVEEDKLDLATSLIEKAKVKGVKLLLPADVLVADKFAPDANSKVVPASEIPDGWMGLDIGPDSIKTFSEALDTTKTIIWNGPMGVFEFEKFAAGTEAIARKLAELSGKGVTTIIGGGDSVAAVEKAGLADKMSHISTGGGASLELLEGKPLPGVLALDDA

SEQ ID NO: 88314 - protein, 110 aa, Glycine max
MESSRGQGGIQQLLAAEQEAQHIVNAARTAKMARLKQAKEEAEKEIAEYKAKTEQDFQRKLEETSGDSGANVKRLEQETDAKIEQLKNEASRISNDVVEMLLKHVTTVKN

SEQ ID NO: 88315 - protein, 408 aa, Listeria monocytogenes str. 4b F2365
MIDIQKIRADFPILAQEINEKPLAYLDNAATSQKPKQVIEALTHYYEFDNANVHRGVHTLAARATDAYEAARGKVAKFIHAREVAEIIFTRGTTSAINLVVDSYAEANIEAGDEIVISYLEHHSNLIPWQQLAKRKGAVLKYIELEEDGTISVEQAKKTIGEKTKIVALAHVSNVLGTITPMKEIAAIAHQFGAVILVDGAQAVPHMEVDVVDLDADFYAFSGHKMMAPTGIGALYGKRELLDAMEPTEFGGEMIDFVELYDSTWKELPWKFEAGTPIIGGAIALGAAIDYLAEVGLANIHAHEQALASYAIEEMSKIEGITIYGPKDASKRCGLVTFNLEGAHPHDIATILDEDGIAIRAGHHCAQPLMKWLDVSSTARASFYIYNTKEEIDALIDGLKLTKEYFGL

SEQ ID NO: 88316 - protein, 130 aa, Debaryomyces hansenii CBS767
MSGGKGKAGSSEKASTSRSAKAGLTFPVGRVHRLLRKGNYAQRVGSGAPVYLTSVLEYLAAEILELAGNAARDNKKSRIIPRHLQLAIRNDEELNKLLGHVTIAQGGVLPNIHQNLLPKKSAKGKASQEL

SEQ ID NO: 88317 - protein, 464 aa, Ureaplasma parvum serovar 3 str. ATCC 700970
MTEVKKGKINQILGPVVDVRFPSEWLPEINTALELNNHGSKLVLEVSQLVGDNIARCIAMDTTDGLVRGQEVINTQKPITMPVGKQVLGRMFNVTGDPIDEQPAPTGKRMPIHRPAPSFAEQAESIEILETGIKVVDLLVPFAKGGKIGLFGGAGVGKTVLMQELIHNIAKNHGGLSVFAGVGERTREGNDLYYEMAESDVLDKTALVFGQMNEPPGARMRVALSGLTMAEEFRDAFGQDVLLFIDNIFRFTQAGSEVSALLGRMPSAVGYQPTLAFEMGQLQERITSTKKGSITSVQAVYVPADDLTDPAPATTFSHLDAKVVLDRAIASLGLYPAISPLQSTSRLLDPLVVGVKHYSVARRVIEILQRFMELQDIIAILGMDELSEEDRQLVMRARKVRNYLSQPSHVAEKFSGQPGLSVKLEDTIEGFRKILDGECDDIHEQHFLYVGKIDDVFEKAAKNK

SEQ ID NO: 88318 - protein, 339 aa, Physcomitrella patens subsp. patens
MGRTRRKKKRTQDPTQDNAGALPGDKIPKSFVFSRGKLPALLRNLEKDLRKVMMPHTALNLRESKRNSMKDFVHVAAPLGVTHFMILSNTKTSPYLRLARSPHGPTLTFKIHAYSLAADVARAQTRPRAPPAIFKSPPLVVMNGLTTGEEHLKLIAVVFQNIVPPINVNTVKLSNCQRVLLLNYDKTTKCIDFRHYSVSAQPVGVSRNIRKLVQRKKLPDLSKLSDVSEFVNKTGYGSESEAEDEASKVELADDFGKGNHASQRSAVKLHEIGPRMTLQLVKVEEGLCDGAVMFHEYVKKTEEEILALRNSKEQREALRKQRRAEQEANVKRKEEERNS

SEQ ID NO: 88319 - protein, 339 aa, Debaryomyces hansenii CBS767
MPTATSESTFLDKTVTVSPLVLLSVVDHYNRVAKDSKKRVVGVVLGDNSSDTIRVTNSYAIPFEEDEKNPSVWFLDHNFIESMGEMFKKINAKEKLIGWYHSGPKLKPSDLKINDAFKKYTLNPLLLIVDVQPRDVGIPTDAYYAVDDIKNDGSAAERTFVHVPSLIEAEEAEEIGVEHLLRDIRDQAAGNLSLRVTQSYQSLLGLHQKLREIANYLDKVYQKKLPINHTILGKLQNVFNLLPNLSNTDINTSSKIIDSQVPNQSTNPLSTAFTIKTNDELMMVYVSTLVRAIIAFHDLIENKLENKKLNERKPDDSNLEADAADVPTSDTTEDKPMST

SEQ ID NO: 88320 - protein, 228 aa, Triticum aestivum
MPPYHTTTCPPPSSLSLSLSLSPSLQTYKQGKEEEEEEEEANMSSPSKRREMDLMKLMMSDYKVDMINDGMHEFFVHFHGPKDSIYQGGVWKVRVELTEAYPYKSPSIGFTNKIYHPNVDEMSGSVCLDVINQTWSPMFDLVNIFEVFLPQLLLYPNPSDPLNGEAASLMMRDKNAYENKVKEYCERYAKPEDISPEEEEEEEESDEELSDAEGYDSGDEAIMGHADP

SEQ ID NO: 88321 - protein, 335 aa, Bradyrhizobium sp. BTAi1
MAVRVGINGFGRIGRNVLRAIAESGRKDIEVVGINDLGPVETNAHLLRFDSVHGRFPHTVTVDGDSIDIGRGKIKVTAERDPSKLPWKDLGVDIALECTGIFTSKDKASAHLTAGAKRVLVSAPADGADATIVYGVNHTTLTKDHLVVSNGSCTTNCLAPIAKVLNDLVGIETGFMTTIHAYTGDQPTLDTMHKDLYRGRAAAMSMIPTSTGAAKAIGLVLPELKGKLDGVAIRVPTPNVSVVDLKIVAKRNTDPKEINEAMKRASEQELKGILGYTTAPNVSIDFNHDPHSSTFHQDQTKVMNGNLVRVMSWYDNEWGFSNRMADTAVAIGKLL

SEQ ID NO: 88322 - protein, 396 aa, Bradyrhizobium sp. BTAi1
MTKFRTLDDVDPKGKRVLLRVDLNVPTENGHVTDTTRLERVAPTINEIATKGGKVILLAHFGRPKGRDPKDSLKPVAAALSAVIKRPVAFADDCIGEPAATAIAAMKDGDVLCLENTRFHKEEEKNDPAFVAELAKLGDIWVNDAFSAAHRAHASTEGLGHKLPAYAGRTMQAELDALEKALGSPVKPVIAIVGGAKVSTKIDLLENLVTKVDALVIGGGMANTFLHAQGVQIGKSLAEKDLAATALRIMEKAEASNCAIILPVDATVSYHFAANSPSFAYGLDAIPPDSMILDVGPQSTARIHAAIDDAATLVWNGPLGAFELTPFDRGTMVAAKHAAERTKAKKLISVAGGGDTVAALNQAGVASDFSYVSTAGGAFLEWMEGKPLPGVEVLKV

SEQ ID NO: 88323 - protein, 467 aa, Desulfovibrio vulgaris subsp. vulgaris str. Hildenborough
MTLDLAFSTRNCWETYASQTDAAAMNDLATRYVDFLSRCKTERETIDYVVERLRTAGYTENFAHDRVYRVFKGKTVFIARKGRQPLSQGMRLIGAHADTPRLDLKQRPLQEQAGVGQAKTHYYGGIRKYQWLARPLAIHGVVVREDGTTVQVTLGEDVTEPVFTIADLLPHLAQKQSGQTVADAFEAEKLNIVMGHRPQPKPETAGDEADAKDAPEAKDPIKARVLALLHEKYAIREEDLYSAELQAVPAGPARFVGLDGSLVGGYGQDDRICVFAALEALLNAENPAAPQCVLFWDKEEIGSEGSTGAKSKFFEYCVEDLIQSWQPAARFSDVMLNTRAVSADVHAALDPDWQELHEKLNAATMGHGPVFCKFTGHRGKYEANDAHPEYVGWLRGVLNERGIPWQMAELGKVDQGGGGTVAMYLAAYGMDIIDFGPAVLSMHSPFELASVADLYATRLAYTAFLER

SEQ ID NO: 88324 - protein, 346 aa, Bradyrhizobium sp. BTAi1
MRLEPNMNLSALNTVALAMVTPGKGILAADESTGTIKKRFDAIAVESTAQNRRDYREMLFRSDGMTFISGVILYDETIRQNAADGTPLVKLIEQAGSIPGIKVDEGTQPLPGCPGETVTVGLDRLADRLAAYYALGARFAKWRAVIDLDKDRIPSMTAVHVNAHALGRYAALCQAAGLVPIVEPEVLMDGDHDIGRCFDVTRRVMNEVFRELRIQRVALEGMILKPNMVVSGQKCPVQAGVTEVADRTVQLLKECVPAAVPGVAFLSGGQSDAVATAHLDAINRRGPLPWMLTFSYGRALQAAPQRVWAGRTANVPAAQRAFSHRARMNALASRGQWTTERENEAA

SEQ ID NO: 88325 - protein, 733 aa, Glycine max
MDIKTFAFAPSSPPLPVIAAAKLAGISPSIDTSLSPDSPPAFIFSDGLKLHGAYALLRYIGRVASLPNFYGQNALESSQIDEWLDYAPILSSGPAFENACKYIDEYLEKCTLLGGYSLSIADLAIWAGLAGSGKRWESLRKSKKYPNLARWFNSIVEEHGTALNEVTSVYAGKKGLGEPTATKSKEQSVNTDKVKKVNGDVSENNKGGSKPSAEIDLPDAEVGKVRLRFAPEPSGYLHIGHSKAALLNKYFAERYKGQVIVRFDDTNPAKESNEFVDNLIKDIDTLGIKYEQITYTSDYFPELMEMAEKLIRQGKAYVDDTPREQMQKERMDGIDSKCRNNSVEENLKLWKEMIAGTERGLQCCVRGKLDMQDPNKSLRDPVYYRCNPMPHHRIGSKYKVYPTYDFACPYVDSIEGITHALRSSEYHDRNAQYYWIQEDMGLRKVLIYEFSRLNMVYTLLSKRKLLWFVQNGKVDGWDDARFPTVQGIVRRGLKIEALIQFIVEQGASKNLNLMEWDKLWTINKKIIDPVCPRHTAVIADRRVLLTLTDGPEKPFVRIIPRHKKYEAAGDKATTYTKRIWLDLADAVSLSAGEEVTLMDWGNAIVKEIEKDQDGNIIGLSGVLHLEGSVKTTKLKLTWLPEIDELVSLTLVEFDYLITKKKLEEGEDFIDVVNPCTKKETLAYGDSNMRNLQRGDLLQLERKGYFRCDLPFIRPSQPIVLYAIPDGRQQTSLK

SEQ ID NO: 88326 - protein, 364 aa, Populus trichocarpa
MGSTGETQMTPTQVSDEEAHLFAMQLASASVLPMILKTAIELDLLEIMAKAGPGAFLSTSEIASHLPTKNPDAPVMLDRILRLLASYSILTCSLKDLPDGKVERLYGLAPVCKFLTKNEDGVSVSPLCLMNQDKVLMESWYYLKDAILDGGIPFNKAYGMTAFEYHGTDPRFNKVFNKGMSDHSTITMKKLLETYKGFEGLTSLVDVGGGTGAVVNTIVSKYPSIKGINFDLPHVIEDAPSYPGVEHVGGDMFVSVPKADAVFMKWICHDWSDAHCLKFLKNCYDALPENGKVILVECILPVAPDTSLATKGVVHIDVIMLAHNPGGKERTEKEFEGLAKGAGFQGFEVMCCAFNTHVIEFRKN

SEQ ID NO: 88327 - protein, 515 aa, Oryza sativa Indica Group
MGSTGDCGNGKAAAGGGGLVVPEIKFTKLFINGEFVDAASGKTFKTRDPRTGDVLAHIAEADKADVDLAVKAAREAFEHGKWPRMSGYERSRVMNKLADLVEQHADELAALDGADAGKLLTLGKIIDMPAAAQMMRYYAGAADKIHGESLRVAGKYQGYTLREPIGVVGVIIPWNFPTMMFFLKVSPALAAGCTIVVKPAEQTPLSALYYAHLAKLCTFDIIIQAGVPDGVINVVPGFGPTAGAALSSHMDVDSVAFTGSAEIGRAIMESAARSNLKNVSLELGGKSPMIVFDDADVDMAVSLSSLAVFFNKGEICVAGSRVYVQEGIYDEFVKKAVEAAKNWKVGDPFDAATNMGPQVDKVQFERVLKYIEIGKNEGATLLTGGKPTGDKGYYIEPTIFVDVKEEMTIAQEEIFGPVMSLMKFKTVEEAIEKANCTKYGLAAGIVTKNLNIANMVSRSVRAGTVWVNCYFAFDPDAPFGGYKMSGFGRDQGMVAMDKYLQVKTVITAVPDSPWY

SEQ ID NO: 88328 - protein, 510 aa, Frankia sp. CcI3
MAPTVSTNPLRDPRDRRLPRLPDASALVVFGATGDLARKKLIPAVYDLAHRGLLPPGFVLLGFARRDWPDEDFAEFARQAAEKGARTPFRAEVWDRLAGSVRFLPGSFDDDAAFDRLARTLESLEHSHGIRGNAAFYLSIPPSAFPVVLKQMQRTGLSSAAGSGGWRRVVVEKPFGHDLESARQLNALVDDVFTPSGVFRIDHYLGKETVQNLFALRFANTLFEPIWNSQFVDSVQITMAEDVGIGTRAGFYDETGAARDVLQNHLLQLLALTAMEEPVSFGAETIRTEKLKVLRAVSLPMDLTRYAVRGQYEQGWLAGERVPGYLDEQDIPAQSRTETFSAVRLGIETRRWAGVPFYLRTGKRLPRRVTEVAIFFKKAPHLPFDETATTELGNNQLVIRVQPDEGVTLKFGSKVPGSAMEVRDVAMDFLFGEAFTEALPEAYERLILDVLLGDATLFPNNAEVEESWRIVDPLERHWAGTTPHRYRAGTWGPAAADEMLAHDGRRWRRP

SEQ ID NO: 88329 - protein, 473 aa, Trichodesmium erythraeum IMS101
MAVKYDIVIIGGGSAGLVVASAAAQLKAKVALVERDKLGGDCLWFGCVPSKSLIHASRVAYQVKNAARFGIYTQPPEIEFAKVTSHVQQVIANIQPHDSPERFRGLGVEVIFGEGEFIDQKTFEVNGQKLTARAFVISTGSRPAIPSFEGLNSADFLTNEKVFDLKQRPNNLAIIGAGPIGCELGQAFSRLGSNVTIISSKSHILPKEEPEAALVVQKQFESEGINILKEVRAEKVEVVDGKKQVTAGGKNIIVDEILFAGGRLPNVESLNLEVAGVEVGKQGIIVNEKLQTTNSKIYACGDVIGGYQFTHVAGYEAVVALTNALFFPISKVNYRVIPWATFTDPELARVGLTEQQAKERYGDDVCVLKQPFSGVDRAQAEAATNGFCKIITKGNGEILGAHLVGISAGELIHEIVLAMSNNLPVSALTGIHVYPTLSEVNSKAGLLLKKQKYAKNLSQQNLLEQFFNWRRSF

SEQ ID NO: 88330 - protein, 197 aa, Glycine max
RVRENPLFLKEHVKDLPPASQEVGGRRFFIDISVPRNVGSCVSDLESVRVYNVDDLKEVVAANKEDRLRKAMEAQAIIAEESKQFEAWRDSLETVPTIKKLRAYAERIRLAELEKCLGKMGDDIPKKTRRAVDDLSRGIVNKLLHGPMQHLRCDGNDSRTLSETLENMNALNRMFNLETEISVLEEKIRAKVEQNQK

SEQ ID NO: 88331 - protein, 342 aa, Bartonella henselae str. Houston-1
MRALQLFNERQLEITTIAPPPPPNPDEVTVRIKAVALNHLDVWGWRGMAFAKRKMPLVIGAEASGEVTQLGSNVKNLQLGQIVSIYGAQTCGICQACREGRDNLCNDVKGVYGFHLDGFARELVNLPVRLLVSAPAKCDELQAAVAPITFGTVEHMLFDNAKLQTGETILIQAGGSGIGSAAIQLAKQKGCTVITTVGSDEKIAKAQSLGADHVINYRKDRFEGVVRKLTKKKGVDVVFEHVGAETWSGSLLCMKPGARLVTCGSTSGISTSFNLMQLFQQQLKIFGSFGCRIENMQNAMQKMAQGVVHPVIDTIVQFNEIDTALKRMESRDVFGKIILKID

SEQ ID NO: 88332 - protein, 774 aa, Bartonella henselae str. Houston-1
MSTERNNDFSSQKTELDSAALFYHQHPKPGKLEIQATTPLDNQRDLALAYSPGVAAPCLAIHKDPNLAAQYTSRSNLVAVISNGTAVLGLGNIGPLASKPVMEGKAVLFKKFANIDVFDIEIDASDIEQMVKTVSALEPTFGGINLEDIKAPECFEIEEKLRTKMNIPVFHDDQHGTAIIVSAAVLNALSLAGKKIENVKIVSSGAGAAALACINLLVRLGAKVENIWLSDLEGVVYEGRKTLMDRWKISYAQKTDARTLSEIIDDADIFLGVSAGGVLKPEYLKKMAQNPLILALANPTPEIMPEEARSVRPDAMICTGRSDYPNQVNNVLCFPYIFRGALDVGATAINEEMKIAAVHAIAALAREETSDIAARAYSKKPPSFGPDYLIPSPFDPRLILRIAPAVAKAAMETEVAIRPIEDMEAYHDILNRFVFRSGLTMKPVFAAAKTAKRKRVIYANGEDERVLRAAQIVLEEQTAIPLLIGRPHVVETRLKRFGLKIRPGIDFELTNPEDDPRFRDYVSLFLRYTGRRGVSPEVAKTIVRTSTTAIAALAVMREEADAMICGLEGRFERHLELIEQVIGLDSNTRHFSAVSLLISPRRTLFLTDTYVNEDPSAEEIAEMTVLAAKEIEAFGITPKAALLSHSNFGSKNTESARKMRRATEILAQLYPNLEADGEMHGDAALSKVFRDRVFPDSRLKGEANLLVFPTLDAANITLNLVKNLTNALHVGPILIGASRPAHILTPSVTSRGVVNMTALAVLAANRKKLHNENK

SEQ ID NO: 88333 - protein, 332 aa, Frankia sp. EAN1pec
MAAIDVHKRVEPGTVALLDRLARWDLTSIATIRRSYAAVGPPSAPEDPRVRRRDQVIPGTDGRPDVRVRWYRPADAPAGAALPFLLWLHGGAYIMGNLDENDDRLDRMVIELGCAVASVDWRLAPEHPYPAGLEDAETVWRRVSANPADFGVDPARLVLGGASAGAGLAAGLCLRLRDLGVPQPVLQLLIYPMLDDRELTPSIRAIEDPGHWGLWHLRANRMCWAAYLGSLDGGEVPPTAAPARAEDLTGLAPAFLGIGDVDGFVDENVAYAARLSAAGVPIELHVYPGVIHGGFGAPPRTPRTAQFLRDVYAALAAAFVPADGSQEAGEGP

SEQ ID NO: 88334 - protein, 291 aa, Oryza sativa
  misc_feature (84)..(84): Xaa can be any naturally occurring amino acid
  misc_feature (96)..(96): Xaa can be any naturally occurring amino acid
  misc_feature (127)..(127): Xaa can be any naturally occurring amino acid
  misc_feature (283)..(283): Xaa can be any naturally occurring amino acid
NFYTTYPRLMKKATLSHLAKHLKPTSQILMRADFNVPIKEGKVKDDNRIKSTIPTIKNLLSYSPKSLVLLSHLGRPNGQNNPKXSLNVVIPLLEKXLGRPVTFLDDCIGDRIVRKVNDSNGEVFLCXNVRFHPEEEGSIKDKDGKKIKISQEKISSFRGELSRLGNVFVNDAFGSAHRAHSSVVGVNHKFKVAGLLMQKELEYLGGFLESPRKPVLVILGGSKVTDKIELILNMLNVADEIIIGGGMSNPFLKQFEGHKLGCTRIDMPEDPSTLQKIMDKARXKGVKIHLL

SEQ ID NO: 88335 - protein, 263 aa, Bradyrhizobium sp. BTAi1
MIHSALINVMVKAARRAGRNLKRDLGEIEHLQVSLKGPANFVSRADKKAEEMLYEDLSKARPGYGFIGEEGGTREGSDKSHTWIVDPLDGTTNFLHGIPQFAISIALRREDTVIAGVIYNPANDELYIAERGKGAFLNDQRLRVAARRQLHECVIACGLPHIGRGDHQLFLREMTALQPRVAGLRRFGAASLDLAFVAAGRFDAYWERDLQPWDIAAGMIMVREAGGTVSDVDGKTDALTTGHVLCGNEVIHRELARVLKAAA

SEQ ID NO: 88336 - protein, 218 aa, Mycoplasma mycoides subsp. mycoides SC str. PG1
MKIVPSIYCANLIDLKTEITNLTKAQINQIHFDVMDGVFVKNYALSNKLVDEIKQQFPNLIIEVHIMGIDLLDKISLFKNADYLTFHYNAINDLNQAKLWINEIKKYNLKPGIALDLNNEINDIKKILNEIEVVTFMSIKPGFTGQKFEESSWTKLNLIKELKLKYPHLKFQIDGGVRWENIKKLIDCQLDWIVVGSLLFNENDYLKVVSRIKQLETN

SEQ ID NO: 88337 - protein, 390 aa, Coxiella burnetii
MNLHEYQSKYLLNKYNIAVPASEVVFNPDAAVDAAAKIGGDRWVVKAQVHAGGRGKAGGVRLVKNKEELKSAVKALLGTRLVTYQTDERGQPVNQILVEQTSDIARELYLGAVIDRASQRIVFMASTEGGVEIEKVAEKSPEKILKVTIDPAIGLQPFQCRQLFFGLGLQDLKQMRSFTDIVMGLYRLFTERDLSLLEINPLVITGSGELICLDAKINIDDSALYRQSELREMRDTTQEDEHETMAQQWELNYIKLDGNIGCMVNGAGLAMATMDLIKLSGGDPANFLDVGGSATKERVTEAFKIIVSDKNVKGILVNIFGGIVRCDLIADGIISAVKEVGIDVPVVVRLEGNNAQLGAKKLADSGMNIIAAKGFADAAEQIVKQVGVIA

SEQ ID NO: 88338 - protein, 324 aa, Physcomitrella patens subsp. patens
MAPIVTFGELLVDFVPTVAGLSLSDAPAFKKAPGGAPANVAVGVCRLGGIAAFIGKVGKDEFGQMLVDVLKEEGVNVRGVRFDPNARTALAFVTLRTDGEREFMFYRNPSADMLMVQAELDMDLIRGARIFHFGSISLISEPSRSTHLAALKLAKESGALLSYDPNLRLPLWPSPEAARDRIMSIWREADIIKVSDEEVKFLTNGGDEKLDEVIMSLYHQAPNLKLFLVTDGPDGCRYYTPDFKGQVESYPVETVDTTGAGDAFVAGLLNKLVQDKSLLTDEAALRSALQFACACGAITTTGRGAIPSLPVVDDVLKLINNVAV

SEQ ID NO: 88339 - protein, 188 aa, Medicago truncatula
MTTTYGTIPTPLSPLQTNLQLISRTNESIKFVIGTRRPWKLFFNVQSFNLPRNFNDAISRYKINICFFEMNYTIILVIILFLSLLFHPTSLIVFLELMASWLFLYFLRDEPFTVFGRLISDRVVVFPMLILTVVFILFIGTIFNIFVAVFMCVVIVLHAAFRNTNDYSIADLFIDEEDVISFSPPNVS

SEQ ID NO: 88340 - protein, 209 aa, Lactobacillus acidophilus NCFM
MGKLEKPVIIGIAGGSGSGKTTIAHEIGNNIGAHDRIVTMTQDSYYKDNTGVPMEERMKINYDHPDAFDMPLLEAQLSQLMHRKPIEMPIYDFTEHTRSNETIHVEPADIIILEGILVLFNEDIRNLMDIKVYVDTDDDIRFIRRLERDMKERGRSLDSVINQYLGTVKPMYNQFIEPTKRYADIIVPEGGENDVAIDMLTTKIQSVLN

SEQ ID NO: 88341 - protein, 527 aa, Triticum aestivum
MAASSLWDELVVAASTGGSSGTVVSICVFTAVLCLCLVAGHLLEENKWVNESITALIIGCIVGALIFLLSKGRNSHILRFDEQLFFIYVLPPIIFNAGFQVKKKQFFHNFLTIMSFGGFGVFISVAIVSAGFYWLLPKVGFGKLDAVDYLALGVIFSSTDTVCTLQVISQDETPRLYSLVFGEGVVNDATSVVLFNAIKNMDITKIKSRAVLKVIGDFLYLFATSTILGATIGLFTAYVLKALYFGRHSTDREVALMALMAYLSYMLAELLSLSGILTVFFCGIVMSHYAWHNVTESSRITTRHIFATLSFIAETFIFLYVGMDALDMDKWKTTQASFKTSIGIFGVIISLILLGRAAFVFPLSILSNFMSGNSEKAPITFKHQVVIWWAGLMRGAVSIALAYNQFTFSGVTQDPVHATIITSTIVVVFFTTLVFGFLTRPMISAMLPQHRHREPTGGRSTGSNSPKDEFILPFLGDEDASGSGSGFVQAKRSISMMLERPIHTVHIYWRKFDDRFMRPIFGGPRSY

SEQ ID NO: 88342 - protein, 414 aa, Triticum aestivum
MAEPVANAAAPAPAPGRLRNAFGGVLCAFTLILIGVLAFSIRLFSVIKYESVIHEFDPYFNFRVTQFLSKNGIYEFWNWFDDRTWYPLGRVIGGTVYPGLTLTAGSIWWLVNALNIPLSVETVCVFTAPIFSAIASWATYPRPKEAKGTGAGLMAAAILAMVPSYISRSVAGSYDNEAVAIFALVFTFYLYVKTLNTGSLFYATLNALSYFYMVCSWGGYTFIINLIPMHVLLCIVTGRYSSRLYIAYAPLVILGTLLAALVPVVGFNAVLTSEHFASFLVFIILHVVAFVYYIKGLLTPRLFKMAMTLVITVGLAVCFADVAILVALVASSPTKGWSGRSLSLLDPTYASKYIPIIASVSEHQPPTWPSYFMDINVLAFLVPAGIISCFLPLSDASSFMVLVLGPLPVYFFRK

SEQ ID NO: 88343 - protein, 331 aa, Sulfolobus shibatae
MSDELSSYFNDIVNNVNFHIKNFVKSNVRTLEEASFHLFTAGGKRLRPLILVSSSDLIGGDRQRAYKAAAAVEILHNFTLVHDDIMDRDYLRRGLPTVHVKWGEPMAILAGDYLHAKAFEALNEALKGLDGNTFYKAFSVFINSIEIISEGQAMDMSFENRVDVTEEEYMQMIKGKTAMLFSCSAALGGIINKASDDIIKNLVEYGLNLGISFQIVDDILGIIGDQKELGKPVYSDIREGKKTILVIKTLSEATDDEKKILVSTLGNREAKKDDLERASEIIRKYSLQYAYNLAKKYSDLALEHLRKIPVYNETAEKALKYLAQFTIERRK

SEQ ID NO: 88344 - protein, 256 aa, Xanthomonas oryzae pv. oryzae KACC10331
MSIQILDHGRLREIRLARPPVNALDSALCQALSVAVQQAGEEVDGIVLSGSERIFSGGMDVPHLLAHGTDRAALLASWTAFFEAAQALANSRVPVVAAIGGHAPAGGCVLALCCDYRVMARSADTAKPYAIGLNEVQVGLAAPEGIQRLLRRVVGAHRAERLLIAGQLLPAEQAVKIGLVDELVDGELVTARALAWLQELQQLPRQPMLTTRAIARADLRAALAPELIQLERFVDGWYAPDAQTALHGLVARLQKA

SEQ ID NO: 88345 - protein, 233 aa, Zea mays
  misc_feature (12)..(12): Xaa can be any naturally occurring amino acid
  misc_feature (72)..(72): Xaa can be any naturally occurring amino acid
KKWLCRRWWWTXVVFPPAARPPGSAGSHFLGGAGVRGLEIEGNFVKFTAIGVYLEDAAVPALARKWAGKTAXELASDAAFFRDVVTGGFEKFARVTMIRPLTGEQYAGKVAENCVAYWKAAGLYTDAEGVAVEKFKQVFKPHTFPPAASIHFTHSPAGVLTVAFSRDSSVPVAGGVAIDNKLLCEAVLESIIGEHGVSPAAKLSLAARVSELLTKGTAAAAAALRAEPVSVTA

SEQ ID NO: 88346 - protein, 442 aa, Frankia sp. CcI3
MTLTDAAVRPGSGPRLVGGFDVEQVRRDFPVLARTVHGDRPLVYLDSAATSQKPLAVLDAERTYYELHNANVHRGIHVLAEEATGLYEASRDKVAAFIGAGDRREVVFTKNSSEALNLVAYAMSNAGAAGAEAERFRVGPGDEIVVTEMEHHSNLVPWQMLARRTGATLRWIGLTDDGRLDLSNLDSIITERAKVVAFVHQSNILGTINPVAQVVARAREVGALTVLDGSQSVPHNPVDVTELGVDFLAFTGHKMCAPTGVGVLWGRYELLGVMPPFLGGGEMIELVTMEGSTYAAPPHRFEAGTPMIAQVVGLGAAVDYLTALGMPAVAEHEHAVTAYALDAFAEVPGLRIIGPPAADARGGAISFVLHEDDGRPIHPHDVGQILDERGIAVRVGHHCARPVCLRFGVPATTRASFHLYTTTGEVDALVEGLHGVRRFFLR

SEQ ID NO: 88347 - protein, 157 aa, Striga asiatica
MPGIVFGRVDDSFSLASVKAYIAEFISTLLFVFAGVGSAIAFNKLTSDGDLNPPGLVAIAVCHAFALFVAVSVGANISGGHVNPAVTFGLAVGGQITILTGIFYWIAQLLGAVVGSFLLKFVAGGLAIPTHAVGAGVGAVEGVVMEIIITFALVYSV

SEQ ID NO: 88348 - protein, 279 aa, Oryza sativa Japonica Group
MRKRERENPCGICGHYHKYELGEVCGVCGHRPPASAGAQAAAGAAQAAAPRQDSAFPSEILKDFLFLGSYDNASRSELLKTIGISHILNTVPLCQNLYRNSFTYHCLQDEKTLQFDDAIQFLEQCERDKARVLVHCMSGKSRSAAFVIAFLMKTKGWRLSQCFQWVKERRPQVQLADAAQRQLIEYEQKLFNSTVGIPAQAFVPTDAFPSLGFGFPKPSGDIQVPIFNQQASIFERVSPHNIPSNFTFGAERTTEVKLPDNNSFGVVNSSGGDSMMDSS

SEQ ID NO: 88349 - protein, 155 aa, Bartonella henselae str. Houston-1
MTIEICKKLHVLIVEARFYDGISDALLTGAVSTLQKAEATYDIVTVPGALEIPGAIAFAEKNSKIYYDGYVALGCVIRGETYHFEIVANDSCRALMDLTIHKHLAIGNGILTVENEKQAWARAKQDEKNKGGFAAQAALCMIALKKRFGEIIKYG

SEQ ID NO: 88350 - protein, 518 aa, Colletotrichum lagenarium
MPTLGFLKKKRTREGNQDPQGSLPTSPVTPTSSKPFDSSISTTLSSLSNNSQATSQPSGPGQKQQEDPASSEAAKNQQMYPVTVHPAPNQQHYNQQGEPQQNLPSISNLINPTQHDASSNGHNYLAQPTQTSQPNPSPGTDPTRLQQQQAQSMLHPPTQPQQQQQQQQQQQQQQQTQQLQQQKNGMPQQAPDQQVRQTKGKYTLQDFDILRTLGTGSFGRVHLVQSKHNQRFYAVKVLKKAQVVKMKQVEHTNDERRMLGEVKHPFLITLWGTFQDSKNLYMVMDFVEGGELFSLLRKSGRFPNPVAKFYAAEVTLALEYLHSRDIIYRDLKPENLLLDRHGHLKITDFGFAKRVPDKTWTLCGTPDYLAPEVVSNKGYNKSVDWWSLGILIYEMLCGYTPFWDSGSPMKIYENILKGKVKYPAYINPDAQDMLSKLITADLTKRLGNLYGGPNDVKTHPWFQEVTWDRLARKDIDAPYTPPVKAGAGDASQFDRYPEDPERYGSSGHDEYGHLFTDF

SEQ ID NO: 88351 - protein, 106 aa, Brassica napus
  misc_feature (7)..(7): Xaa can be any naturally occurring amino acid
  misc_feature (20)..(20): Xaa can be any naturally occurring amino acid
  misc_feature (43)..(43): Xaa can be any naturally occurring amino acid
QRRTPEXEEVSVPIFSSLEXVYGEGSQLDEAKTRFDVLKSKFXQVFDASPQLFARSPGRVNLIGEHVDYEGYSVLPMAIRQDTIIAIRKREGQNQLRIANVNDKYS

SEQ ID NO: 88352 - protein, 464 aa, Edwardsiella tarda
  misc_feature (186)..(186): Xaa can be any naturally occurring amino acid
MKKGTDTRGGYLDSRFGSEAIRTAAEAHHFPQGEMREDIAFQVINDELFLDGNARQNLATFCQTWDDDYVHRLMDISINKNWIDKEEYPQSAAIDLRCVNMVADLWHAPRPADGQAVGTNTIGSSEACMLGGMAMKWRWRAKRLAQGKSVDKPNMVCGPVQVCWHKFARYWDVELREIPMAPGKLXMDPERMIAACDENTIGVVPTFGVTYTGNYEMPDVLHKALDDLQARTGLDIDMHVDAASGGFLAPFCAPDIVWDFRLPRVKSISASGHKFGLAPLGCGWVVWRDAASLPDDLIFKVDYLGGQVGTFAINFSRPAGRVIAQYYEFLRLGREGYTKVHTASYQVAQFLAAEIAKLGPYEFICSGDPQQGIPAVCFRIPAGKALGYSLYDLSERLRLRGWQVPAFALNGEMSDVVVMRIMCRRGFEMDFAQLLMEDFRAALAYLKAHPAVANVAHQNSFKHS

SEQ ID NO: 88353 - protein, 742 aa, Medicago truncatula
MAEEDEMIVAAPDCKRKFEDLHSNDGENKSPRLDDDNLNHLEENASSEEVQDVSKDNTEETTDPTDTKEIPVEDAKEIHVDSSSIDPTFQHYASSSRQNQPISGSDTTTTREIEVPSNKELNLKDLLGSIHEFENLMNAMFPEADAGGSLALLDRVLSPTQDIVESDQIQIQVPNEKEFNLNDFLESIDKAEKLLNAMIAEDDAGGSPAFVARGLSPADAIVGSDQIQIQVPNEKMPRGKANCSLVAKKSEPEPEKTVESDEKIDLEEENDPEEEMEEIEYEEVEEEEEVEEIEEEVEEKEEDAEEEEEEEEKEEEEVEEDDTMQNLDDDDEKKKHAELLSLPHHKSEVYVGGIPLDAKTEDLKEFCECIGEVVQVRIFKGKDASENRGFAFVTYRSIELASKAIKELNNTEFKAGKIKCSKSQAKSRLFIGNIPRSWGEKDLKKVVSDIGPGVTAVELIKDMKNISNNRGYAFIDYHNNQCAEYSRQKMTSPSFKLGDNFPTVNWAEPKNADSSASSQVKEVYVKNLPKNVTKEQLKKLFEHHGKITKVVLPPPKPGQEKNRIGFVHFAERSNAMKALKNTEKYVLDGQILECSLAKQQADPKAVVSNIQTQGSLPRYPPHVGYGLDGNPYGVLGAGYGAPGLAQPFTYGLGQTPGGIAMMPKLLVDRRIRYVLQQPGLQPHPTHPAHPTFTSKSEYKSIDPPSLDGVRGLGCRRLWWRSPKCQGDLRYQHDEDFTDHTYP

SEQ ID NO: 88354 - protein, 186 aa, Mycoplasma mycoides subsp. mycoides SC str. PG1
MKNNVISMVVEIPKGSSNKYEVDEKTKRIKLDRVLYGANFYPGEYGMIENTLDWDGDPLDVISLCTYPTLPGVEVNVRILGSIKMVDAGEVDTKLFGVFNDDPRFKEYQTLNDVPKHYRDEIENFFLQYKALQNKVVKINGWGTLDEALEELEECKSRFEEYKDRLAKGQKDQILAEWKEKGLGQA

SEQ ID NO: 88355 - protein, 302 aa, Daucus carota
MDNSCATLQEGCLVVQQQNTTAAATMATVDHSSSSTKAPVTRNSRWSLAGMTALVTGGTRGIGHAIVEELAELGACVYTCSRNEQELNERLEEWRAKGFDVTGSVCDVSSVTEREQLFQRISSCFGGKLHILINNVGTNIRRATENYTAEQYSIVMATNLEAPYHACQLAYPLLKASGSGCIVFNSSVAGLVHLGTPGSVYGAAKGAINQLTKNLACEWAKDNIRTNCVAPGYIKTPPVEKLFERKNFLDRLVSRTPLRRPGETEEVSSLVAYLCMPAASYITGQIIAIDGGLTVNCFERVV

SEQ ID NO: 88356 - protein, 457 aa, Triticum aestivum
MAASSLWDELVVAASTGGSSGTVVSICVFTAVLCLCLVAGHLLEENKWVNESITALIIGCIVGALIFLLSKGRNSHILRFDEQLFFIYVLPPIIFNAGFQVKKKQFFHNFLTIMSFGGFGVFISVAIVSAGFYWLLPKVGFGKLDAVDYLALGVIFSSTDTVCTLQVISQDETPRLYSLVFGEGVVNDATSVVLFNAIKNMDITKIKSRAVLKVIGDFLYLFATSTILGATIGLFTAYVLKALYFGRHSTDREVALMALMAYLSYMLAELLSLSGILTVFFCGIVMSHYAWHNVTESSRITTRHIFATLSFIAETFIFLYVGMDALDMDKWKTTQASFKTSIGIFGVIISLILLGRAAFVFPLSILSNFMSGNSEKAPITFKHQVVIWWAGLMRGAVSIALAYNQFTFSGVTQDPVHATIITSTIVVVFFTTLVVPLTGSRIFRYMMFYRRKTYTAH

SEQ ID NO: 88357 - protein, 527 aa, Triticum aestivum
MAASSLWDELVVAASTGGSSGTVVSICVFTAVLCLCLVAGHLLEENKWVNESITALIIGCIVGALIFLLSKGRNSHILRFDEQLFFIYVLPPIIFNAGFQVKKKQFFHNFLTIMSFGVFGVFISVAIVSAGFYWLLPKVGFGKLDAVDYLALGVIFSSTDTVCTLQVISQDETPRLYSLVFGEGVVNDATSVVLFNAIKNMDITKIKSGAVLKVIGDFLYLFATSTILGATIGLFTAYVLKALYFGRHSTDREVALMALMAYLSYMLAELLSLSGILTVFFCGIVMSHYAWHNVTESSRITTRHIFATLSFIAETFIFLYVGMDALDMDKWKTTQASFKTSIGIFGVIISLILLGRAAFVFPLSILSNFMSGNSEKAPITFKHQVVIWWAGLMRGAVSIALAYNQFTFSGVTQDPVHATIITSTIVVVFFTTLVFGFLTRPMISAMLPQHRHREPAGGRSTGSNSPKDEFILPFLGDEDASGSGSGFVQAKRSISMMLERPIHTVHIYWRKFDDRFMRPIFGGPRSY

SEQ ID NO: 88358 - protein, 123 aa, Sulfitobacter sp. EE-36
MTASTHSATCHCGSVTLTATLPEGLSSATRCTCSFCRRRAAPAVTALTSTLKVTKGAEHLTLYTWGTHTAKHYFCKICGIYMYHQRRSDPAQCGVNLGCIDGAAPWTQEPIPYTDGINHPSDK

SEQ ID NO: 88359 - protein, 307 aa, Lactobacillus acidophilus NCFM
MKKIVVIGSSNVDTTLHVKDFPKPGETINATEITTAAGGKGANQAIAAAKSGAETYFINRVGEDSEGGYITHQLKSYGVDTTYVQTTMGVKTGHAYITLNEAGQNNIVIDHGANYELTVEDIKAAGDLIKSWDCIIAQFETPIEVTTAAFKMAKKAGKITILNPAPAVEEIPEELLKYTDIITPNETESAKITGIQIKDKSSLAANAEKLHLLGVKNVVITYGDKGSYISTKDIETLIPAYKVEATDTTGAGDTFIGYLASNLNEDLSNFEDAAKIASRASSIAVQRLGAQPSIPTAQEVEQAMEDE

SEQ ID NO: 88360 - protein, 230 aa, Lactobacillus acidophilus NCFM
MDKKEQDRLKKEAAEKAANMVQSGMILGVGTGSTVAFFIDALGKRKDEEDLKLKAIVTTSNRSKKQLESLGFEVSELADIDQADLTVDGSDRVADNLDGIKGGGGALTLEKNVAINSKKIVWIVDESKLVHRLSGFPLPVEVLPISCEQNFRRFEQEGLKPQWRTDGDKRYITHYGNYIIDLAVDPIPAPHGLADYLDHTVGVVEHGLFLDMCDEVIIAHSDGTIEDKIK

SEQ ID NO: 88361 - protein, 714 aa, Alkalilimnicola ehrlichei MLHE-1
MTTHPKTAQENRPEQETAFHLALGDDGIAVITVDVPGERMNVLKGEMVREANALLDTLDEQPALRGVIFTSGKADNFIAGADVHMLAACETAEAARELAHAGQRLFDRLEAFPKPVVAAIHGTCLGGGLELALACHGRVATDHPATRLGLPEVQLGLLPGSGGTQRLPDRVGLPLALDLMLTGRQLRARQARKRGLVDDLVAPPILLDAARKRIDELAEPRRHRPKRPLTTRLLENNPLGRRLVYRQSERTVQAKTHGNYPAPPRIIDAVRAGRERGRQAGLETERRHFGELAMTPEARALMALYFATTALKKDSGTDAGVEPRPVRRVGVLGAGLMGAGIAYVTSAKAGTPVRLKDIALEGLNNGMRHIDGEIRARHKRGALTDFEATRQRTRVTPTLDYRGFGALDVVIEAVFEDPELKHRMLADVEAHGPEHVIFASNTSSLPISEIATGAQRPERVIGMHYFSPVEKMPLLEVIATDRTDPEVIATTVALGRTQGKTVIVVRDGAGFYVNRILAPYLNEACRLLQEGVAIDHIDRTLVRFGFPVGPFALLDEVGLDVSEKVAPILHRAFGERMTPVDVGGRMLADGRKGRKSGKGFYRYDRKRGKGGRPVDEGVYRLLGLAPGRDMAPEAIIDRTVLPMINEAVRCRDEGIIRCERDGDIGAVFGIGFPPFRGGPFHYLRQQGAAGVTERLQALAAEHGPRFAPAPSLQG

SEQ ID NO: 88362 - protein, 308 aa, Lactobacillus acidophilus NCFM
MTKKPLIISTDPGIDDIAAMTISLFADELDVRMIVPTWGNVALKYTVQNTLNLEKFLHTKVPVVVGANQPLVAPMISAASVHGKTGIAGFEFEKANTDLIKPGIAATLMAEEIKNSPEKVTLMGIGPLTDFALLFKQYPEVKDNVEQIVIMGGNIGRGNHSPLAEYNIAGDPEAAQVVFHSGLPIKVAPLEIGNKAHLTPDQMSKIEKCGEVGNMLYSLFSHIHEPDGDPRIKIYDPTAVGILLHPEMFTMKKANVEIELRGQFTYGASVINFMDQEHANAEIATDVDLDKFAKWFIDSIKKADQGRE

SEQ ID NO: 88363 - protein, 547 aa, Chlamydomonas reinhardtii
MAEKPATVNAELVKEMDAAPKKYPYSLDSEGKANYCPVWRFTQPHMMAFHLSWICFFMSFVATFAPASLAPIIRDDLFLTKSQLGNAGVAAVCGAIAARIFMGIVVDSIGPRYGAAATMLMTAPAVFCMALVTDFSTFACVRFFIGLSLCMFVCCQFWCGTMFNVKIVGTANAIAAGWGNMGGGACHFIMPLIYQGIKDGGVPGYQAWRWAFFVPGGIYILTATLTLLLGIDHPSGKDYRDLKKEGTLKAKGAMWPVVKCGLGNYRSWILALTYGYSFGVELTVDNVIVEYLFDQFGLNLAVAGALGAIFGLMNLFTRATGGMISDLVAKPFGMRGRIWALWIIQTLGGIFCIVLGKVSNSLSSTIVIMIVFSIFCQQACGLHFGITPFVSRRAYGVVSGLVGAGGNTGAAITQAIWFAGTAPWQLTLSKADGFVYMGIMTIGLTLPLFFIWFPMWGSMLTGPREGAEEEDYYMREWSAEEVASGLHQGSMRFAMESKSQRGTRDKRAAGPARVPQQLRLGARCCQARGGLIRCVLAQSLGATGCSD

SEQ ID NO: 88364 - protein, 412 aa, Frankia sp. CcI3
MPSPRVLGLVLAGGAGRRLAPLTADRAKPAVPFGGLYRLIDFVLSNLVNAGYLRIAVLTQYKSHSLDRHITTTWRMSNLLGNYVTPVPAQQRLGPRWFAGSADAIHQSLNLVYDDAPDIVVVFGADHVYRMDPRQMVAQHLDSGAGVTVAGLRVPRSEGRAFGVIQTAPDGRTIEAFLEKPADPPGLPGSPEETFASMGNYVFSTDVLIDALRKDAADEDSVHDMGGNIIPMLVAQRAAAVYDFAGNVVPGTTVRDRGYWRDVGTVDSYFEAQMDLCALDPVFNLYNREWPILTSIPSLPPAKFVHDGLQRTGTAVNSIVSNGVIISGGTVRSSVLSPGVRVSSWAEVDHTVLMDNVLVGRGAVVRDAILDKNVHVPAGAQVGVDKDRDRARGYTVSEQGITVVGKGVTIAD

SEQ ID NO: 88365 - protein, 1103 aa, Rhodopseudomonas palustris CGA009
MPFRKLLIANRGEIAIRIARAAAESGLTTVAIHPADDAASLHVRIADHAEQIPGRGARAYLDIEAVIVAAKAAGCDALHPGYGFLSENADLARRCAEEGITFIGPSPEALRLFGDKVAAKELAKRCGVPIIAGTIGPSTLEEVQAFFASLGDKPAVMIKAMAGGGGRGMRVVERAEELADAYARCQSEAKAAFGYEGVYAERLIRNARHIEVQIIGDRHGNVSQLWERECTIQRRNQKLIEIAPSPSLSEGLRSRIVDAAKTLAAAANYDSLGTFEFLVDSEAGEGDGAFAFIEANPRLQVEHTVTEEVLSVDLVRSQLAVAGGAMLTALGLDQASVPRPRGFAIQLRVNMETMDAKGATKPTGGTLAIFEPPSGPGVRVDTFGYAGYTTSAAYDSLLAKVIVHGRGDWAEAVAKASRALREFRAGGVVTNIPLLQAILAHNDFKANRVSTSFIDRHVADLVEAAQQFDQPLIATDGADNRSSAAAAASKEPVPEGAVAIAAPLQGTVVAITVAEGDVVRPGQQLAVIESMKMEHLVAAEQGGRIRRIVATDGVTLMQGEPILYFEPQEVEGDHVVAEQDVDLDAIRPDLAEMLARQANTLDENRPDSVGRRRKTNQRTARENVAQLVDEGSFMEYGSLAIAAQRRRRPLDDLIKNTPADGLVTGVATVNAKQFGEHAARCMVIAYDYTVLAGTQGHMNHKKIDRMLTLVEQWRMPLVFYAEGGGGRPGDTDRLGMTGLDGPSFVQFAKLSGLVPVVGIVSGYCFAGNAAMLGCCDVIIATQNASIGMGGPAMIEGGGLGVYHPAEVGPVSFQSPNGVVDILVQDEEEATRVAQKYLSYFQGAVAEWKAPDQRLLRQAIPENRLRVYDIRSVIDLIADEESVLELRRDFGVGMITAFIRIEGKPFGLIANNPKHLGGAIDADAGDKAARFLQLCDAFDIPIVSLCDTPGFMVGPEAEKTAIVRHVARMFVTGASLTVPLFGIVLRKGYGLGAQSMIGGGFHASFFTAAWPTGEFGGMGLEGYVRLGFRKEMEAIADPAEREAYYKNKVAELYANGKAVSIASVFEIDNVIDPAETRRWVMAGLRSVPTPPARTERKRPCIDTW

SEQ ID NO: 88366 - protein, 537 aa, Frankia sp. CcI3
MIIVSELELRAGARTLIEPVSFRVQPNDRIGLVGRNGAGKTTLLKVLAREGLPFAGTVDIRGEMGYLPQDPRTGDLADTARDRVLSARGLDVLLREMEKLQLEMAELVDATARDAAIRRYGSLEERFGTLGGYAAEAEAARICSSLGLADRVLAQPIGTLSGGQRRRVELARILFAGSGNADATLLLDEPTNHLDADSIGWLRDFLRAHTGGLIVVSHDVDLLDKCVNKVFHLDANRATLDVYNVNWKTYLNQRELDERRRRRERANAEKKIDSLKAQADKMRAKATKARAAHQMDRRAERLAAGLAEARVADRVAKLRFPDPAPCGRTPLTATGLSKSYGSLEVFTGVDLAIDRGSRVVVLGLNGAGKTTLLRILAGQEAPDVGQVHPGHGLRLGYYAQEHETLDTSRSVLDNMRAAAPGTSDVELRRILGAFLFSGDSVEQRAETLSGGEKTRLALAGLVCSSANVLLLDEPTNNLDPASRDEVLAALATYRGSVVLVTHDPGAVEALDPQKVLMLPDGVEDNWSPDLAELITLA

SEQ ID NO: 88367 - protein, 247 aa, Methanosarcina mazei Go1
MSENMAYECLKYSNENINRALEALRAGKMIQIYDSDSREGETDLVIPAKAVTYTDVKWMRKDAGGLICVAVDPVASKQLKLPFMADLVREASKTSDSLGEVVEKDGDLKYDAHSSFSLWVNHRDTRTGIPDIERALTIRKIGEITEESLSGNGVRFGNEFRTPGHVALLRAAEGLLDERMGQTELSVALARMAGITPAMVVCEMLDDDSGKALSKEKSKEYGKEHGLVFLEGREIVEAYLLWAGTDC

SEQ ID NO: 88368 - protein, 419 aa, Oceanobacter sp. RED65
MSDFKQDALDYHANPKPGKISVELTTAADSARDLSLAYSPGVAEPVKAIAEDPENAYKYTAKGNLVAVITDGSAILGLGNLGPLASKPVMEGKSLLFKRFAGIDSIDVEVESESPQAFIDTVRRIANTYGGINLEDIKAPECFEIERTLIEQCNIPVFHDDQHGTAIVTVAGMLNALEIQGKKVDEAKMVVLGAGAAAISCAKLLILAGMKPENIFMCDRKGVIHSGRDDLNQYKAMFAVDTDKRTFEEALEGADIFLGLSGPDMVTGEQIKTMAENPVVFACANPVPEIMPEIVAEVRPDAIMATGRSDFPNQVNNVLGFPFIFRGALDVRSRAINEEMKLAAAKALADLAREPVTQEVLDAYELDSLEFGKDYIIPKAVDSRLLGAVSTAVAQAAIDTGVADGPLPANYPLKSISDI

SEQ ID NO: 88369 - protein, 136 aa, Glycine max
  misc_feature (50)..(50): Xaa can be any naturally occurring amino acid
  misc_feature (58)..(58): Xaa can be any naturally occurring amino acid
MSIPDDYLLVPLKFVMVHIGKERKEAWASWFKAYIHEVSYSGIPDPERKXVMDSVNPXYTLSNYLCLPAIYASQIGDFGEVCSLFQLVEHPYHELPGMERYAGLPPDWAYRPGVCKSLCYSLRFPLGVKASYNLTL

SEQ ID NO: 88370 - protein, 436 aa, Streptomyces kasugaensis
MSDSVLLSARQPLPPIDYSHAAGAWIHTAEGDSLLDAASGLVCVNIGHAHPHVVEQITRQARTATFASPGVLLPAVQEELAGRLTEAVNRPGDGVSLACSGTSAVELAISYARLIQRSRGQDGRHHILTARLGYHGNSALTLGLSGHRRRRPHPDDALGLAPAFDPPYPGHHRDCPHDRCRASCADAVAEAIDRRGPESVAAVLIEPVNGTTGGAYTPPPGYLAALRRACHERGVLVIHDEVLTGLGRTGLPLGADHCTDAAADIVVLSKGLSAGYLPLAAVLVNPEGVARLRSGPRPLPLMGTMSATPLQAAAGLAVLDVLGEIGALDPARVRGGDVAAAVRAVAALPVVQETRGVGYFHAVELAPGTQAAALAAARDERLLLYPFNGFHADGTGEGLIVAPPLNSTPSEVEFLAQGLRRALERTAARSEDRSHR

SEQ ID NO: 88371 - protein, 316 aa, Frankia sp. EAN1pec
MTFALDPQLAAVIGPFLAAVPEVEPPPAGDWKARRVSVEAALAQMIAALPAPEDVATTDYEINSHDGAIIALRWYTARESMPGTAVLYFHGGGMILGSVGLYDPWVARYVSATGVPMLSVEYRLAPEHPHPTPVEDCYAALRWLADHAVELGVDPARIAVMGDSGGGGLAAAVALLARDRGGPALARQILIYPMLDDRNTTPDPAIAPFAGWNYDDNITGWGALLGMARGGPDVPPYAAPARADDLTGLPPAYVEVGELDIFRDESIEYARRLAMAGVSIELHVHPGAPHGFDALGPETDIGQRATADRVRVLTGL

SEQ ID NO: 88372 - protein, 280 aa, Oryza sativa
  misc_feature (80)..(80): Xaa can be any naturally occurring amino acid
  misc_feature (114)..(114): Xaa can be any naturally occurring amino acid
  misc_feature (225)..(225): Xaa can be any naturally occurring amino acid
MASPSSPSSLLPDLRFFVSFVFFVRLFFFFFRFMIYFFCVGFFFLGCFCLSINVFYCVPLFILLLLTLLSLREQVPAVEXGGRDWIHADVLDGRSVPHITIGPLVVVALRPVSXLPLDVHLMIVEPEQRVPDFIKAGADIVSVHCEQSSTIHLHRTVNQIKSLGAKAGVVLNPATPRAAIDYVLDVVDLVLIMSVNPGFGGQSFIESQVKKIAELRRLCAEKGVXPWIEVDGGVGPKNAYKVIEAGANAIVAGSAVFGAPDYAEAIKGIKTSQKPVAVPA

SEQ ID NO: 88373 - protein, 367 aa, Zea mays
  misc_feature (356)..(356): Xaa can be any naturally occurring amino acid
MGGEAEGGERRLGRVLSFGIPDTALGLVMGYVEDPWDRDAISLVCRHWCRVDALSRKHVTVAMAYSTTPERLFRRFPCLESLKLKAKPRASMFNLISDDWGGSASPWIRQLSATFHFLKKLHLRRMIVSNEDINILVRAKAHMLVALKLDRCSGFSTPSIALVARSCRKLETLFLEESTIDEKENDEWIRELATSNSVLETLNFFQTDLRASPEYLTLLVRNCQRLKTLKISECFMPDLVSLFRTAQTLQEFAGGSFEDQGQPVAEDHCQIVQRCPNLETLEVRDVIGDRGLQVVAETCKKLQRLRVERGDDDQGGLEDEQGRISQVGVMAIAQGCPELTYWAIYVSDITNAALEXVGTCSRNLNDF

SEQ ID NO: 88374 - protein, 965 aa, Arabidopsis thaliana
MEIKVKAKDVESTMMSTKEEDEIKKMKECVVIQKADEEVTKGQETMKILDGSRQNQDETRQADSKNIDSPSSSSLEMKKKLEIDQKFTSQNEENTKKEEEKKKETNNNNLSNMKHKKTSSHVWDCGSTLYDSFELNSFKRQLDSAISASSARTMSMSHLPDRRIPSLSSLSPEYSPPLPPPPTTSSSSSSGGKKHSNKISRSLQRFLKSMFKPKQHQSLTTPSSPVYKAVGHGGGDKDRYYVVYDKSGSLTTIPESTEKEVSPEINSLVRKTVSERFPASRVEDPNPEETAAKALELRSLQSQFMSNHHQKMYIHYTKEAIQLSAKLLITNPEFYTAWNYPKLAFESRLDEDSDPSLVNSIIDEELGVVQNALERNVKSYGAWYHRKWVLSKKGHYYPSLENELQLLNDYQKQAHQKQDDEKQDDPSRNFHAWNYRRFVVELTKTSEEDELQYTTDMISDISFTIYSAWHYRSVLVSSLVAKKADGFMPKETIRRELDYVHSAIFTLEEKQSGWFYYLWLLDQTVKMEIPLRFSSWPSDGSIIILSGPDCFNASSSTTKLTTFCSESGSFPLILYFDQAVSGVSSSTVTIGSELKDLVWEPVSDKKNSQVDSCVWVARLKFDCREPCFSRKETKVKVSLGGIVSSMGCNLTAPYEFVFTLRIHDTVEVELSQQESIVSWTDGFDNWDDNALSNDLNSLTALNADTGFEWRKKAIKIEIELFRTLPDSKIGKLILARLLMAEETMISNGVHYKEILQLYNDLMALDSWHNQYYKDEHSVALIHKVTSRTESMSRHLFRYRNMNNIICLRLNNLTLSRIAAVEKLLFVQMLDLSHNELHSAEGLEAMQLLCCLNLSHNRIRSFSALDSLRHLKQLRVLDVSHNHICGELPVDTTRYLCSSPLSNSGETGREVPNKYQDAYLVLRDLMKLKQLDIRGNDLIFAGEEFSSFVRQVVPKLVWLDGHKLTS

SEQ ID NO: 88375 - protein, 124 aa, secondary symbiont type 2 of Eulachnus pallidus
QCSQFINRFPHWKIEYCESTAAAMEKVAAANSPHVAALGSEAGGALYKLQVLEHNLANQQENITRFIILARKAIEVTDQVPAKTTLIMATGQQAGALVNALLVLRDQGIITTKLESRPINGNPW

SEQ ID NO: 88376 - protein, 175 aa, Triticum aestivum
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWNLPMFGCTDATQVINEVEEVKKEYPDAYVRIIGFDNMRQVQCVSFIAFKPPGCEESGKA

SEQ ID NO: 88377 - protein, 253 aa, Buchnera aphidicola (Macrosiphum rosae)
AGEYADRNFQKCITNECSTFEEVILSVENNESDYAVLPIENTCSGSIHEVFNLLKNTNLFIIGEINIFINHCLLALEKIELNKIKTVYSHPQPFQQCSNFIKQFPEWEIKYTKSTADAMKKITKYHEKTNAALGSEIGSKIYGLKILTKNLANKEKNITRFIILNRNSIKISEKIPTKTTLILSTGQESGALAKVLLILKENQLIMKKLTSQPLYKNPWEEMFCIDIQVNVSSVLMQDVLKKIKKITKFIKIL

SEQ ID NO: 88378 - protein, 150 aa, Brassica napus
  misc_feature (33)..(33): Xaa can be any naturally occurring amino acid
TNTGAELAANQVKCLGKYLSLSLVWSCFKWFFXGVGDACGFDNFPTLGLTLFKNTFYFDFSPTYVGCGLICPHIVNCSVLLGAIISWGFLWPFVSQHAGDWYPADLGSNDFKGLYGYKVFIAIAIILGDGLYNLVKIIAVTVKELCSNSS

SEQ ID NO: 88379 - protein, 534 aa, Silicibacter sp. TM1040
MKLQSKAMPSSEGFKANKAAHLSALAEISEAAEAARLGGGEKSRARHESRGKMLPRRRVANLLDPGSPFLEVGATAAHGMYGGAAPAAGVIAGIGRVHGQEVMVVCNDATVKGGTYFPMTVKKHLRAQEIAEENNLPCVYLVDSGGANLPQQDEVFPDRDHFGRIFYNQARMSAKGIPQIAVVMGSCTAGGAYVPAMSDVTIIVKEQGTIFLAGPPLVKAATGEVVSAEDLGGGDVHTRLSGVADYLAEDDAHALALARRAVSHLNRTKPQGVNWQSPEEPAYDPEEILGVVPGDLRTPYDIREVIARLVDGSRFDEFKPRFGETLVTGFAHLKGCPIGIIANNGVLFSEAAQKGAHFVELCSQRKIPLVFLQNITGFMVGRKYENEGIARHGAKMVTAVASTNVPKITMLVGGSFGAGNYGMAGRAYSPRFLWTWPNSRISVMGGEQAAGVLATVKRDAIERQGGTWSAEEEAQFKQPTIDMFAEQSHPLYASARLWDDGIIDPRKSRDVLSLSLSAALNAPIEDTRFGVFRM

SEQ ID NO: 88380 - protein, 170 aa, Glycine max
MATKRSVGTLGEADLKGKKVFVRADLNVPLDDAQKITDDTRIRASIPTIKYLLEKGAKVILASHLGRPKGVTPKFSLKPLVPRLSELLGLEVVMAPDCIGEEVEKLAAALPDGGVLLLENVRFYKEEEKNDPEFAKKLASVADLYVNDAFGTAHRAHASTEGVTKFLRPS

SEQ ID NO: 88381 - protein, 268 aa, Lactobacillus sakei subsp. sakei 23K
MKIGFIGVGNMAQAIIKGLVKADQIATTDILVHGAHPANYEAFAAEQHITPVADNIAVVAQADIVFLAVKPYIVPLILEETGAAFKEKQPLMVSMAAGLSLAKLSQQVDADNLPILRIMPNVNVANRAGITAVVGNAQVSADQLKSVKDVLSQLGGVVEIGEKDFTTFSALAGSSPAFVYLFIDSMARAGVKHGLTKKAATEIAAQAVLGSAQNVLLSDDSPWDLIDKVSSPGGTTVVGLLAMEEAGLMSAVVKGIDATIEKDLESQK

SEQ ID NO: 88382 - protein, 91 aa, Zea mays
MASGQESRKELDRKAREGETVVPGGTGGKSVEAQEHLAEGRSRGGQTRRDQLGQQGYSEMGKKGGLSTTDESGGERAAREGVNIDESKFTK

SEQ ID NO: 88383 - protein, 565 aa, Arabidopsis thaliana
MASTPKLTSTISSSSPSLQFLCKKLPIAIHLPSSSSSSFLSLPKTLTSLYSLRPRIALLSNHRYYHSRRFSVCASTDNGAESDRHYDFDLFTIGAGSGGVRASRFATSFGASAAVCELPFSTISSDTAGGVGGTCVLRGCVPKKLLVYASKYSHEFEDSHGFGWKYETEPSHDWTTLIANKNAELQRLTGIYKNILSKANVKLIEGRGKVIDPHTVDVDGKIYTTRNILIAVGGRPFIPDIPGKEFAIDSDAALDLPSKPKKIAIVGGGYIALEFAGIFNGLNCEVHVFIRQKKVLRGFDEDVRDFVGEQMSLRGIEFHTEESPEAIIKAGDGSFSLKTSKGTVEGFSHVMFATGRKPNTKNLGLENVGVKMAKNGAIEVDEYSQTSVPSIWAVGDVTDRINLTPVALMEGGALAKTLFQNEPTKPDYRAVPCAVFSQPPIGTVGLTEEQAIEQYGDVDVYTSNFRPLKATLSGLPDRVFMKLIVCANTNKVLGVHMCGEDSPEIIQGFGVAVKAGLTKADFDATVGVHPTAAEEFVTMRAPTRKFRKDSSEGKASPEAKTAAGV

SEQ ID NO: 88384 - protein, 293 aa, Bradyrhizobium sp. BTAi1
MKIRKAVFPVAGLGTRVLPATKAMPKEMLTIVDKPLIQYVFDEAKEAGIEHFVFVTGRNKTAIEDHFDRMYELDATLAARGKKTEIEILARDQPEAGAVSFTRQQAPLGLGHAVWCARDIVGDEPFAVVLPDELVLNTPGCLAQMIAAANRLPEKSNLLAVQEVPADQTHQYGICGVGKRDGKIFEVDGMVEKPAKGTAPSNFSITGRYILQPEIFKILATQERGAGGEIQLTDAMIGLSKTQTFYGVDFDGERHDCGSKSGFLKANIAFGMARADLRDGLRADMKRYLEGKS

SEQ ID NO: 88385 - protein, 131 aa, Eremothecium gossypii
MSGKGGKAGSAAKASQSRSAKAGLTFPVGRVHRLLRKGNYAQRIGSGAPVYMTAVLEYLAAEILELAGNAARDNKKTRIIPRHLQLAIRNDDELNKLLGNVTIAQGGVLPNIHANLLPKKSAKATKASQEL

SEQ ID NO: 88386 - protein, 402 aa, Sulfitobacter sp. EE-36
MPKLPNLSQGRGYLAIPGPSVMPEAVLNAMHRPAPNIYAGEIVDMMPPLMEDLRRIAGTQHHVAMYIGNGHAAWEASLSNVVAPGDKVLVPATGRFGHGWGDAATGIGADVEVMDFGLQSTMDIDRIADRLEADTNHEIKAVLAVHVDTSTSVVNDIAGLRAALDAADHPALLMVDCIASFACDRFEMDNWGADVMVTACQKGLMVPPGVSFVFFNDRAAAVRDAMPRVSRFWDWTPRANPEEFYQYHCGTAPTHHIYGLRAALDMIHDEGLEAVWQRHETLARAVWAACDAWGAEGDLSLNIADPALRSHAVTALRLKAPHATELRDWVEGNIGLTLGIGLGMAPKGSPESHGFFRLGHMGHVNGQMIMGMLGGIEAGMSALGIKRGSGALEAAAKVIGGA

SEQ ID NO: 88387 - protein, 625 aa, Streptococcus pyogenes MGAS315
MSHFLVEKLTKTVGDKTVFQDISFIIHDFDRIGIIGVNGTGKTTLLDVLSGRLGFDGDHSPFSKANDYKIAYLTQDPEFNDASSVLDTVLSSDVKAIQLIRQYELLMANYTEDKQETLESLMSEMDRLDAWSIESDVKTVLSKLGITDLEQKVGDLSGGMRRRVQLAQVLLGAADLLLLDEPTNHLDIDTIAWLTTYLKTAKKTVLFITHDRYFLDHVATRIFELDKAGLTEYQGNYQDYVRLKAEQDERDAANLHKKKQLYKQELAWMRTQPQARATKQQARINRFTDLKKEVHQDSSADKLEMAFETSRIGKKVIHFEDLSFAYGDRQLIKDFNLIIQNKDRIGIVGDNGVGKSTLLNIINGDLKPTSGKLDIGDTIRVGYFSQQLKDMDETKRVINYLQEVADEVKTSVGTTSISELLEQFLFPRSSHGTLIAKLSGGEKKRLYLLKLLIEKPNVLLLDEPTNDLDIATLTVLENFLANFAGPVITVSHDRYFLDKVATKILAFEEGDIRVFYGNYSDYLDEKAFEKETVEADLAKAIVTEEVPLPPKEEKKRMSYLEKQEWAQIEDKIATIEANIEEIENQMLTVVSDYGQLAQLQKELDQRNNDLLLAYERFEYLSGLDI

SEQ ID NO: 88388 - protein, 498 aa, Wolinella succinogenes DSM 1740
MLKCPHQFTFSIRQSSSHSRRKDMADQSKVKEFFRFCQENEVEFVDFRFTDIKGVWHHVSYSMASIDEESFNGLPFDGSSIPAWQPINRSDMQLIPDPVSYFLDPFTADTTVVVFCDVWDIYKNQPYEKCPRSIAKKALKYLESTGLGDVAYFGPENEFFVFDSIKIQDSINCQSYEVDVEEGTWNSNRAYENGYNLGHRPGTKGGYFPVAPVDSMVDIRAEMVKVLNQVGLETFVVHHEVAQGQGEIGVRFGDLIKAADNVQKLKYVVKMVAHMNGKTATFMPKPLYGDNGSGMHTHISIWNKGENTFAGDAYQGLSETALHFVGGVLNHAKSAAAFTNASTNSYKRLIPGFEAPSILTYSAQNRSASVRIPYVQGAKAKRVEFRFPDSSANPYLAFSALLMAGIDGIQTKANPGEPMEMDLFELSLDEIREKGIKQMPHTLRSAVENMLADKDYLKKGDVFSEDFLQTYKAYKFETEIWPWEARPHPFEFISTYSC

SEQ ID NO: 88389 - protein, 449 aa, Alkalilimnicola ehrlichei MLHE-1
MAARLDEKLEPIFQDVLRRNPGESEFHQAVHEVLETLGPVLVKYPELAERKIIQRICEPERQIIFRVPWQDDRGETHINRAFRVEFNSALGPYKGGMRFHPSVYLGIIKFLGFEQIFKNALTGLPIGGGKGGSDFDPKGKSEDEIMRFCQSLMTELYRHLGEYTDVPAGDIGVGQREVGFLFGQYKRITNRYESGVFTGKGLSWGGSRARKEATGFGTVYFLEEMLKARNDGLEGKTCVVSGSGNVAVYAMEKIYELGGKVIACSDSSGIVVDEKGIDLDRVKRIKEVERRRISTYADEVKHAKYIEDGNIWAVPCEAALPCATQNELNGKDAKKLLQNGCIAVAEGANMPSTPEAIRLFLESGIAYGPGKAANAGGVATSALEMQQNASRDSWTFEHTEQRLHEIMKNIHRNCYETADEFGAPGNYVTGANIAGFLKVSQAMEAMGLI

SEQ ID NO: 88390 - protein, 432 aa, Populus trichocarpa
MAARRISSLLSRSLSASASFLLSRGKNPSRGRSIYRFITAKALEEPITPPVQISYTQHFINGKFVDAASGKTFPAYDPRTGEVIAHVAEGDNEDVNRAVAAARKAFDEGPWPKMSAYERSLIMLRFADLVDKHRDELAALESWNSGKPYEQSAKSELPSFARLFRYYAGWADKIHGLTVPADSNHYVQTLHEPIGVAGQIIPWNFPLIMLAWKVGPALACGNTIVLKSAEQTPLTALHAAKLFQEAGLPPGVLNVVSGYGPSAGAALASHMNVDKLAFTGSTETGKIILELAAKSNLKSVTLELGGKSPFIVCEDADVDKAVELAHHALFFNQGQCCCAGSRTYVHERVYDEFIEKAKARALRRVVGDPFKKGVEQGPQIDSDQFEKVLRYIRSGVESNATLECGGQRFGSKGYFIQPTVFSNVEDDVDSSG

SEQ ID NO: 88391 - protein, 398 aa, Trichodesmium erythraeum IMS101
MTKKTVASLSKSDLSGKKVLMRADFNVPVDNGSITDDTRIRAALPTIQDLTEKGAKVILTSHFGRPKGKVNEKMRLTLVGERLSEVLGKEVKKCDDCIGDEVTSTVAEMKDGDVVLLENVRFYSGEEGNDPEFAKQLASVADLYVNDAFGTAHRAHASTEGVTKYLSPSVAGYLIEQELKFLQGAIDSPQKPLAAIIGGSKVSSKIGVIEALLDKCDKLLLGGGMIFTFYKARGLSVGKSLVEEDKIELAKSLEAKAKEKGVTMLLPTDVVVADKFDPEANTQTVSIEAIPDGWMGLDIGPESAKVFQDALADCKTVIWNGPMGVFEMEKFAKGTEAIAQTLADKQDAITIIGGGDSVAAVEQLGLGEKMSHISTGGGASLELLEGKKLPGIVALDDQ

SEQ ID NO: 88392 - protein, 595 aa, Prochlorococcus marinus str. MIT 9215
MIKVEKVKKKKEIPKQETVCLANGLEVSKFEKFKESSEFLKEPLASELKNESDHFTNDAVQLLKFHGSYQQDNRENRKSGTGKDWQMMLRLRSPGGEIPGKLFLSLDELSDKLGNGTLRATTRQAFQMHGIRKDNLKEVIQTIVSAMGSTLAACGDINRNVMAPAAPFEEPEYKTARSLAIKVADLLTPVAGQGTFLELWADGDLEYKIKPDKEIQENRKLQFNEHVFSGIKKEPLYGSTYLPRKFKCAVTVPGDNSVDLLTNDIGIVAFTSKEGEFEGCNFYIGGGMGRTHNNEETFARIADPLGYVEKDDTYELIQSIVAIQRDYGDRKSRKNSRMKYLLHRKGIKWFKKILLEKYFKKEIKSLRKEPNNKLIDYLGWHKQNGDYHFVGLPLLSGRLYGEKKSLIRDIVKKYNLDLRLTPNQDILLCNISNKHKSNIEKALSKIGYGNLNEINEIQRHALACPALPLCGLAMTEAERILPSVITRIDDLLKSLNIKKSILLRMTGCPNGCTRPYMAELALVGSGQNKYQLWLGGSKNLQRLAKPYLQRMELDDLEKTLKPLLINWKEFHSESDFGDFIKDQDESYILNLLNEI

SEQ ID NO: 88393 - protein, 471 aa, Frankia sp. CcI3
MPRRAKIVCTLGPATSSPEKVRALVDAGMDIARLNFSHGTHEQHAVTYARVREAAEAAGRSVGTLADLQGPKIRLGNFADGGVTLLPGQRFTVTIRDVPGDQHQVGTTYPGLPGDVAAGDRVLVDDGRLVLQIDGVTDTDVHTTVVVGGPVSDHKGMNIPNAALTVPALTEKDAADLRFALNLGVDMVALSFVRSAVDAAAVHAIMDEVGIRVPVHAKIEKPQAVAELDEIIEAFDGLMIARGDLGVELPLEDVPLVQKRAVSQARERAKPVIVATQVLESMVSAPRPTRAEASDCANAVLDGADAIMLSAETSVGAYPIEATATMARIIETAEADLGRIPPLRTEPRTLGGALAQAAASVGAAVGARYLVAHTLSGDTARRLARYRTEVPVLAFTPIPAVRNQMALFWGVETFLVPFADSTDEMVRQVDSALFHIGRCKPGELVVVVAGTPPGVAGMTNMMRVHRIGEAI

SEQ ID NO: 88394 - protein, 205 aa, Brassica napus
YKPRFWSGFPARPTRPAYQGFASGDLESDAQAVRMFVADGGECLIAQSFAKNMGLYGERIGALTIVCTSEDVARKVKSQLLLVVRPMYLSPPIHGASIVTTILKNSDMYKDWTIELKGMADRIISMRQQLYEAIQARGTPGDWSHIIKQIGMFSFTGLNEKQVRMMAKEYHIYMTYDGRISMAGLSSKTVPQLADAIHAAVTRIP

SEQ ID NO: 88395 - protein, 131 aa, Triticum aestivum
MATISAAAATTVVARAAIARPQALGLPQLRTRSERVRCSYSKDAKEATPAATVRGASASLLAAAGAVTASAGPALALVDARTPTEGTGLSLGLSNNLLGWILLGVFGLIWSLYTVYTSGLDEDEESGGLSL

SEQ ID NO: 88396 - protein, 253 aa, Buchnera aphidicola (Rhopalosiphum padi)
ASQYAERNFKTCIENACLNFNEVIHSVENNQADYAVLPIENSCSGFINEIFDILKKTNLLIVGEINILINHCLLAIKKIELNKIKVIYSHPQPFQQCSYFINQFPNWKIQYTNSTADAMKKIAKCYIETNAALGSELGSKIYGLEILSKNLANKKKNITRFILLSRKPIVSSSKIPTKTTLIFNTGQESGALAEVLLILKKKKLIMKKLTSQNIYKNPWEEMFYIDIQGNLSSSLMQETLEQIQKITKFIKIL

SEQ ID NO: 88397 - protein, 124 aa, secondary symbiont of Tetraneura caerulescens
QCSQFLNRFPHWKIEYTESTAAAMEKVAAMNSPTVAAIGSEAGGELYQLKVLERHLANQQQNITRFIILARKAVEVSSQVPAKTTLIMATGQQAGALVEALLVLRQHNLIMSKLESRPINGNPW

SEQ ID NO: 88398 - protein, 523 aa, Debaryomyces hansenii CBS767
MMNNDKICSTDDELSTDDEFEYVETEQLDDIIQTSQRQYRPGDNAKSTKNQLDESKEFFDKYADKYLEFTDNNPTTFHVIDYFKRLLEEHGFKYIPEGAAISEEISKRIREGGLFFSVRSDLSIVGFVVGGKWDAGSGIGVIGSHVDSLSIKLKPVSKHKAINGFNMLGVAGYSSTLTELCLDRDFGIGGTILVKNGDGKMTRKLVNSTPHPIAKIPKLAEHFGEIADKKYNQETQMVPIIGYGQNEDEPSEVEKKSPLYGKHSLELLRYISKISETPVDRIIGLDLELFDVQSATRGGLCKEFIFAPRIDDRLCSFAAVYSLIEYSKTFNEDFGEYDDFNAVLLVDNEEIGSGTRTGAKGKFLNAVLDRVIAIRGEKSPAANLAFANSVILSADVTHALNPNFKEAYLKDHYPLPNKGLTIKVDPNGHVMTDTIGQVLLGDIARKENQQLQTFHIRNDGRSGSTIGPALACDTGARVIDVGLPQLSMHSIRAMCGFKEVGLGVNIFKSFFKHWRKSYDEIDY

SEQ ID NO: 88399 - protein, 447 aa, Eremothecium gossypii
MASQEEFYRTQIFGTVFEITNRYADLNPVGMGAFGLVCSAVDTYTQQPVAIKKIMKPFSTAVLAKRTYRELKLLKHLRHENLICLEDIFLSPLEDIYFVTELQGTDLHRLLQTRPLEKQFLQYFLYQILRGLKYVHSAGVIHRDLKPSNILINENCDLKICDFGLARIQDPQMTGYVSTRYYRAPEIMLTWQKYNVEVDIWSAGCIFAEMIEGKPLFPGKDHVHQFSIITDLLGSPPKDVIDTICSENTLKFVTSLPHRDPVPFTERFKNLKPDAVDLLEKMLVFDPKKRITAGDALTHPYLAPYHDPTDEPVADAKFDWNFNDADLPVDTWRVMMYSEILDFHQVPDSQINPNDTFDDQVAAATAAAEAARQQQQQKQQQQKQQQQRHQGVEHGAQHVQLQHGAKQLSADPLVGDSNGGIPLNVSAANETLNNFANQAAQYATDFE

SEQ ID NO: 88400 - protein, 248 aa, Medicago truncatula
MTYLSAVLSTPTSTLPFRCRIDSHPSQPNLLFAPPRPKFNTTNIILPSSVAADSAKWRNMVSIFQGFLTGGRGNDVESLKVELYETIEPLERGAEATPEDQQRVDKIARKLEAMNSVKEPLNSDLLNGKWELLYTTSQSILQTQRPKFLRPNGKIYQAINTDTLRAQNIETWPFYNQATANLVPLNSRRVAVKFDFFKIASLIPIKSSGSGRGQLEITYLDEDLRISRGNRGNLFILKMVDPSYRVPL

SEQ ID NO: 88401 - protein, 287 aa, Streptococcus pyogenes MGAS315
MIPSTSSISLTLENMFTTTSVSFLPDTATSDQFYINGVLQNDEEHTKISTIIDQFRQPGQAFVKMETQNNMPTAAGLSSSSSGLSALVKACDQLFDTQLDQKALAQKAKFASGSSSRSFFGPVAAWDKDSGAIYKVETDLKMAMIMLVLNAAKKPISSREGMKLCRDTSTTFDEWVEQSAIDYQHMLTYLKTNNFEKVGQLTEANALAMHATTKTANPPFSYLTKESYQAMEAVKELRQEGFACYFTMDAGPNVKVLCLEKDLAQLAERLGKNYRIIVSKTKDLPDV

SEQ ID NO: 88402 - protein, 231 aa, Physcomitrella patens subsp. patens
MNKDQEQALAEQEGLLDECKLYRGEKEPDTKEPLTQEDEEDTVTGLPVGPGPATTVVSAQMPRTPWSTGLFQCLGNGDGHFSSDLEVCVLGFAAPCVLYGSNMERLYPAPRVFVDHCLHYSWLYFLGSLLFNANNIAPWSSVNSRVALRQKYNLEGYGNYCLGCCANPSEETRERCDSVCDLFIHGLFCLHPFALAQEARELRRRTLHPANQPYLVITMAPPTEQSMSNQI

SEQ ID NO: 88403 - protein, 252 aa, Prochlorococcus marinus str. MIT 9215
MTESNQTNLAGVNRPIQIIPSVLPADWANMGACVKELEEAGVDRIQFDVMDGNFVPNLTFGPEMITACRKYCNVPFETQLMVSQYNCETMLESYVNATKGANGEPGVVIAHAEANIHLHRVLGRIRDLGGSPSVALNPHTPFEMIKNIMDMVDHVLVMTVNPGFGGQAYIPTMLKKIREIRNFIIEKNLNVDIEVDGGIKANWTISQCADAGANCFIAGSGMFAYPTLKEGCDDLRKVAQEAQKGNVLSEPQ

SEQ ID NO: 88404 - protein, 151 aa, Glycine max
  misc_feature (19)..(19): Xaa can be any naturally occurring amino acid
TALVYNVDDLKEVVAANKXDRLQKAEEARGIILEELNKFEAWKDSLETVPTIKKFRAYVERIRASEMEKCLSKMGPDVSKQQKDAIYALSMGIVNKLLHGPMQHLRCDGKNDSSLSEVLENMRALNRMYDLETEISLIEEKIRVKMERVQK

SEQ ID NO: 88405 - protein, 436 aa, Prochlorococcus marinus str. MIT 9215
MHIVVVGVSHRTAPVEVREKLSIPDHSITESLKALKAFSEVLEVSILSTCNRLEIYALAKDKNTGISSIKEFLSEYSGIIFEDLDPHLFCFRQEEAVLHLMKVSAGLDSLVLGEGQILSQVKKMMRLGQENQSTGPILNRLLTQSVSTGKKVRSETNLGTGAVSISSAAVELAQLKIGQEKGFDTLVSLESENVLVVGAGRMSRLLITHLKSKGCHKLILVNRNIDRALNLAQDFPDLKIVCRGLNELDENISISSLVFTSTASEVPIIDLAKIEKLNLNNKLKFIDIGVPRNISNDVKQHEFVKSFDVDDLQEVVSRNQEFRQKIAKEAESLVEEERIIFLEWWASLEAVPVINKLRSDLELIRKEELQKALSRMGPDFSARERKVVEALTKGIINKILHTPVTKLRSPQSREERQVSLKIVEKLFSLAEEDKNN

SEQ ID NO: 88406 - protein, 351 aa, Alkalilimnicola ehrlichei MLHE-1
MSTMQAAVFVEPGRIEVQEKPIPEIGPTDALLRVTTTTICGTDVHILKGEYPVEPGRIVGHEPVGVIEKLGEAVTGYEPGQRVIAGAITPCGQCHACQDGVSSQCGGKAMGGWQLGNTIDGCQAEYVRIPNAQANLTPVPDELTDEQVLMCPDIMSTGFGGAENGHIRIGDTVAIFAQGPIGLCATAGAKLMGATRIIVVDGVPERLETARKLGADVGVNFREQDPVEAIMELTGGRGVDVAIEALGLQETFEACLRVLKPGGTLSSLGVYSGKLSMPLDAIAAGLGDHTIVTTLCPGGKERMRRLMEVVAAGRVDLTAMVTHRYTLDQIVEAYDLFSHQRDGVLKVAITP

SEQ ID NO: 88407 - protein, 431 aa, Prochlorococcus marinus str. MIT 9215
MKRVLAIILGGGKGSRLYPLTKMRAKPAVPLAGKYRLIDIPISNCINSGIEKMYVLTQFNSASLNRHIGRTYNLNGPFGQGFVEVLAAQQTPDSPKWFEGTADAVRKYQWLFQEWDVDEYLILSGDQLYRMDYSLFVQHHRDNEADLTVAALPVDEGQAEGFGLMRTDDLGNIKEFSEKPTGKKLKAMAVDTSKFGLSKYSAAEKPYLASMGIYVFSRNTLFDLLNKFPSYTDFGKDIIPEALNRGDKLKSYVFDDYWEDIGTIGAFFESNLALTEQPKPPFSFYDEKFPIYTRPRFLPPSKLVDAQITDSIVCEGTILKSCSILHCVLGVRTRIESDSVLEDTLVMGADFFESPEERIELRRGGGTPLGVGEGTTVKRAILDKNTRIGDNVVIINKDRVEEADKPELGFYIRNGIVVVVKNATIANGTVI

SEQ ID NO: 88408 - protein, 472 aa, Prochlorococcus marinus str. MIT 9215
MSKAHFGLIGLGVMGENLVLNAERNGFSSVVFNRTYSKTEDFLQGRGLGKNIEGAETLQEFVNKLERPRRILMMVKAGPATDAVIDNISGYLEEGDLLIDGGNSQFKDTERRVNTLESKSFGYIGMGVSGGAKGALEGPSMMPGGTKASYDAIESLLTKMAAKVEDGPCVAYVGPGGSGHFVKTVHNGIEYGIEQILAEAYDLMKRVKGMNGKQMSEVFGIWNNTDELASYLVEITEICLNTKDEITGDDVVEKILDKAGQKGTGLWTVVSALELGVSVPTIYASLNARVMSSLKEQRSEIEKTIPSKEIEDFDLGNISDGMKPLFDAVVLATIASYAQGMDILREASAVYNYGLNMPSIAQIWKGGCIIRSKLLSKIQDAYNKDPNLKNLIFDAWFNNEIATRLDNLANVVSLSTKAGIPVPCLSSTLDYLNSYRTNRLPQNLVQAMRDCFGSHTYERIDKEGSFHTEWMK

SEQ ID NO: 88409 - protein, 274 aa, Gibberella zeae PH-1
MSTLFTLPIAQCGAHPGGTLTCTEPSPRVYLLTLVSPPDNRLTTPVLNAFLNALDIIEFGYPHGVVATTSGIQKFYSNGLDLEHAVATEGFWYLLYNVWNRFLTYPMPTVALMNGHAFAGGLMLATAQDYRLAPSPRGFLCLNELIFGAPLKPAMSALFRVKYSHATYRSLVLEAKRFTGEDAVAAGIADDIAPQGVEDLLRFIKEKELIDKSKSGVYGVLKMEMYAGLVEFMKGPSMEAHEQRFDDAQAMEGERKEFGKVWYEQWLKDVKAKL

SEQ ID NO: 88410 - protein, 397 aa, Haemophilus influenzae Rd KW20
MIIKRSRQAFPYFQREDAVIYLDNAATTLKPQVLIDRTAEFYASAGSVHRSQYDAAQTVQYEQARTQVKEWVHAEDKHAVIWTSGTTHAINLVANGLMPQLNAEDEILISQADHHANFVTWHETAKKCGAKIQVLPILDNWLIDENALISALSEKTKLVALNFVSNVTGTEQPIKRLIQLIRKHSNALVLVDAAQAISHIKIDLQDLDADFLAFSAHKIYGPNGLGVLTGKLTALSQLQPLFFGGKMVDRVSNDRITFAELPYRLEAGTPNIAGVIGFNAVLDWLQKWDFTAAEQYAISLAESVKVRLKSYENCRLFNSPQASTVVCFVFDGIDCSDLSTLLSEQNIALRVGEHCAQPYLARLGERTTLRLSFAPYNTQEDVEAFFTALDKALDLLQ

SEQ ID NO: 88411 - protein, 676 aa, Gibberella zeae PH-1
MASPLQFAYRTQKTIGVFDAAPVYEPLAGFNKPEGNLRYCIYSPCGRYFGWASPEVVTVVDASTGQQVLSLPILNVYELGFSPCGTFVITWERPGKDENGDATKNLKVWRVVEEGVAGQDKQPLGRFVQKQQQGWNLQYTADEKYCARLVTNEVQFYESHDLVTVWNKLRVEGATNFALAPGSQNHAVAVFVPERKGQPAAVKVFNVPLFTNPISQKTFFKGDKVQLKWNKLGSSILVLAQTDVDRSGKSYYGETTLYLLSTTGAFDARVSLDKEGPIHDVSWSPNSREFGVVYGYMPAKATIFNHRAVATHSFPIGPRNTITFSPTGRFVLVAGFGNLAGQIDIYDLEKDFRKVTTIESGNPSVCEWSPDSRYIMTATTSPRLRVDNGIKLWHVNGGIMYNEDMIELYNVIWRPQSPESIAPGDPLSPVPTPHSSATALLATAKTPSKPAGAYRPPGARGLATPLHFKREDEGGAAHVVGNGVPNVGPNGFGRPRRGVPGAEFAEQTPTVRTVPGAEPMGDENSSKSKNKKKRNKKNAQGEGGRPQGEPNGGASLAPPSHDRGHEGRSPERRNHRNRSQSRNNQPRSRSNTHRNGHGNQQQAQSSGATAAAAAAAADASQNPNAKKIRSLQKKVRAIEDLEMRLAGGEKLEDTQLKKINTKSSVLKELDGLEKEN

SEQ ID NO: 88412 - protein, 249 aa, Triticum aestivum
  misc_feature (196)..(196): Xaa can be any naturally occurring amino acid
  misc_feature (212)..(212): Xaa can be any naturally occurring amino acid
  misc_feature (224)..(224): Xaa can be any naturally occurring amino acid
PIESFCTKNHDRSGTPGISPTHASLIIRNLSICTSNWRCTETLDEYLKKRNIMGIYDVDTRAITRRLREDGSLIGVLSTDQSLKDEGLLEMAKNWKIVGVDLISDVTCDAPYEWVDKTGSGWEFSDNQSSETFHVVVYDFGVKHNILRRLASYGCKITVVPASWPASDVLNLKPDGVLFSNGPGDPAAVPYAGKTXQEIVGKGPVFGICLGXINLIGQAPGGKXTFKKKFWSSPKETHPVFGTKGPGTW

SEQ ID NO: 88413 - protein, 576 aa, Debaryomyces hansenii CBS767
MSSLLTNKYFKDYYNNPSPTAIGTMIAILEIGALISSFVAGKVGDHIGRRRTIRYGSFIFIIGGLIQTSSINIINLGAGRFISGVAIGFLTTIIPCYQSEISPPDDRGFYACLEFTGNIIGYSTSIWVDYGFSFIENDYSWRTPLAIQCVMGGLLFIGSFVIVETPRWLLDHDHDIEGMIVISDLYGDGDVEDELSKTEYRNIKENILIARVEGGERSYRYMLTKYKKRLSVACFSQMFAQLNGINMVSYYAPMIFELAGWVGRQAILMTGINSIVYVLSTIPPWYLVDGWGRKPLLLSGAVVMGIPLLVISYSLFLDNIYTPNIVVVSVIIFNAAFGASWGPIPWMMNEVLPNSIRSKGAAMSTATNWLFNFIVGEMTPILLDTIKWRTYLISAVSCALSFLCVHFLFPETKGLSLEDMGSVFDDNSSIFSFHSGASSGNNASTTTINNYGAADRDSGIEVRRTSISVETPNHANIVNEAFRQSPASIARNSKAKPELDGLITGNPPPVPPDLSVLDSNVPPQEIEPPSFDVIFKYKVRQLEKPNIFQKAFRAISGDSTFKPPQIDEERTLLSNN

SEQ ID NO: 88414 - protein, 209 aa, Listeria innocua Clip11262
MTKKPIVVGVTGGSGSGKTSVTKAICDHFSGHSILMIAQDVYYHDQADISFEERLKVNYDHPLAFDTDLLISHIAALRRYETIEKPIYDYEKYTRKQEVEIQEPREVIILEGILILEDKRLRDLMDIKVYVDTDDDIRFIRRLLRDMKERGRTMDSVIDQYLSVVKPMHNEFIEPTKKFADIIIPEGGENHVAIDLMTTKIESILQKHV

SEQ ID NO: 88415 - protein, 205 aa, Magnetococcus sp. MC-1
MSFPSAFYRWRPHPWHGLDVGPKDLFPEVVHAYIEITPFDMVKYEVDKTSGYLRVDRPHRSSSQPPALYGFVPRTYCGGRVKALSPNSTKGDGDPLDICVISERPINKTEVILNARVLGGMQMIDGGEADDKIIAVLANDNVWGGLKDITEVPKVLTERLHHYFSTYKMVPGHENEITVDLTYGREHALKVIKAACDDYIDMYGG

SEQ ID NO: 88416 - protein, 184 aa, Methanosarcina barkeri str. Fusaro
MEYTITVENVVASTTLAEDFDLQKIEARLEKAEYNKAKFPGLVYRTENPKAAFLIFTSGKVVCTGAKTVDNAKMAIINLASTLKSIGCEKINPEPDVHIQNIVATADLETNLNLNTIVIAFGMENVEYEPEVFPGLVYRLEDPRVVVLIFSSGKLVITGGKSPEDCEEGLRVIKKEFDNLGLLY

SEQ ID NO: 88417 - protein, 267 aa, Dehalococcoides sp. BAV1
MNIAFIGGGNMGEAILGALIQKNICPPQNITVSEIKAERRTYLETSYGIKTTASNPDAIKSAEVVLLAIKPQNLPELSAELKGKLADKQLVISIIAGATLSKLSGGLAHKAVVRVMPNTPAMIGMGMSVWTALPSVSPAQKDQAKAILSAMGKEIYTGKETMLDAATAISGSGPAYFFLFMEGLEKAALEMGFTPEEASILVSQTAAGSAIYAGKSGFALTQLRKNVTSPGGTTAEAIKAFEEAGLEATIIKAAKAAFNRSVELGKG

SEQ ID NO: 88418 - protein, 577 aa, Magnetococcus sp. MC-1
MHDGILLELLIIFALSVSVVYLCHRLGIAPIIGFLLTGAVAGPFGLTLIDSIEQVELLAEIGVMLLLFTIGMELSLTKLVEMQRAVFVGGGLQVGLTVAVGALLAVALGFPLNQSLFFGFLLAHSSTAIVLKTLQSRGEVGSAHGGAAVGVLIFQDLIVVPMLLLVPLLAGKAENPMLEMGLFSLKFVGIGFALWFGARRLIPAMLNAIVRLRDPELFLLFIIAIGLGIAWLTAAAGLSLALGAFLAGLIISESEYGHQAFASVLPFRDVFTSLFFISVGMLMDVGFLWNHLGLILTLTLLAILCKALLTSGAVLSAGIGFAAAAGAGLTLAQIGEFAFVLARSGVDEGLLSQQAYQTFLAVSVLTMSMTPLLAGRAGRWGRKLAHMPLFRRLALGAEAANPTKDTLHNHLIIIGFGENGHTMAQLARYHGIDHLILETNPETVRREKLAGAHIQFGDASRASILKHAGIDHAKALLITVPDAAATRHILHTARHLRADLPIIARTSFKNEVEALETLGATHVVAMQLEASVVLCQHTLRHLEIPQEQILLDLDDIRHHRLPGATHPPEAPQPPAHG

SEQ ID NO: 88419 - protein, 397 aa, Gibberella zeae PH-1
MTSTPKTSFMRAVQWEGELRHMSVNIIPRPKLIDPEDAVVRITTSAICGSDLHIYHGLFGTDEKFGVGHEAVGIVEEVGPAVDFLKPGDRVLVTGFSEDGNLLPKAALVPTDLDMVGVGFGSSFHSEGGLQAEYVRMPWADSSLAKIPHGLDDKEWLPLTDIFPTGWTALTRSGFQPGDTVAVFGAGGVGLMCAYSAIIRGASLVYVIDHIPARLALAASIGAQPINFTRGGKASEQILALRPAGVNRAIDCVGQFCLNENLKPQPDFILREAVKITTNGGGIGIAGVYQAGGPEGYKPEINFAIPELWFKSLQVGSGLVDIEGNIRALVDLVKNGRARPGFVFSNEYSLEEAPLAYRRFEQHQETKVMLKGSRKLEDDSSLDMIIGRNGVSDANGA

SEQ ID NO: 88420 - protein, 222 aa, Oryza sativa Japonica Group
ATPFSIRESTGSEPPISRLRRRPTGVQNPNPNPSEEEGGGGGRRGEMVYYALYWWADLDNLTNLQPRYGCDDPTYPYYFKLRCENCGEVSAKATCVSLGEVVDLPNGRSTANLVQKCKLCGRDASIVMIPGQGTPLTMEQSQKGDRTCLMVFDCRGCEPIDFAFGNGWKAESLEGTSFDIDCSEGEFADYDEKGECPVGVGKLRSEFRVVKKQESRGKTKYV

SEQ ID NO: 88421 - protein, 284 aa, Wolinella succinogenes DSM 1740
MQKRSKIVSILLDSLPHIKLFSGSTMVIKYGGAAQINPTLKEQFAIDIVLLYMLGIKPVIVHGGGKKITDLLGKLGIESKFVEGHRITCIDSMKIVEMVLSGDINKEITSFLNHHGVKAVGISGKDSSLLRAEPKDGGRFGYTGEVKEVKAEIIYNLLEKGFVPVIAPVAEGEEAGHPGYNINADTAASEIAKAIKARKVIFLTDTQGVLDGEGSLMESLTLSEVEENKRSGVINGGMIPKVDACVECVKGGVEKAHIIDGRVEHSLLLELFTSEGIGTEILRD

SEQ ID NO: 88422 - protein, 434 aa, Lactobacillus acidophilus NCFM
MKRQISFGQALATVVGSVIGAGVFFKIGTITAQTGSSSMTLLVWVLAGIISIASGLTISEIAASLKINGAIKYLDYTYGRVWGFLFGWAQMIVYFPAQIGALSSIFGVQFVSLFGIEAKYSNLIAVILVLFLLSINLIGTKFSSKMQSVITILKIIPIILIIVLGLFNQNKVSAPIFPVTVGSSKDLIGSLSQGLLSALFAFEGWIVVTNLANEVKNPENDLSRAIISGLSIVTLIYVLINYTFLTVLPINQLVNNDNAAFEASMKLFGQFGGKLITIGILISVYGAANAFMLTGMRTPYILAQDRLLPFSNKIGKANIHTGVPVTGALIVDAIAIIMIILGNFTVLTDMLVFVMWTFNTMLSIAVVILRKREPELRRPFKVPWYPIIPIISVLGGLFIVISTIINQFLLSLIGIGLTLIGLPIYYHMQKKNQN

SEQ ID NO: 88423 - protein, 199 aa, Streptococcus pyogenes MGAS315
MAEEQVLNTHNASILLSAANKSHYPQDDLPEIALAGRSNVGKSSFINTILGRKNLARTSSKPGKTQLLNFFNIDDKLRFVDVPGYGYAKVSKSERAKWGKMIEEYLTSRDNLRAVVSLVDLRHAPSKEDIQMYDFLKYYDIPVIVVATKADKIPHGKWNKHESVVKKALNFDKSDTFIVFSSVERIGIDDSWDAILEQV

SEQ ID NO: 88424 - protein, 551 aa, Bradyrhizobium sp. BTAi1
MYAYDDIDRTLVNERVAEFRDQVKRRLSGELTEDEFKILRLQNGVYLQLHAYMYRIAIPYGTLSSEQLRRLAHVARRYDRGYGHFTTRQNIQFNWIKLAELPDAMADLAEVGIQSMQTSGNNMRNVTSDQWAGVAPGEVEDPRIWAELLRQFTTLHPEFSFLPRKFKIAITASAHDRAAIKIHDIGLRLLKNEQGETGFEVLVGGGLGRSPFIAKTIKPFVHGHDILSYVEAILRVYNQYGRRDNIYKARIKILVHELGIETFAAEVEEEWQQIRDGVLKLDDGIVEDIRSRFFYPAYETLPHMPDELRQAAHDPKFEAWRKNSVVAHKVQGYAIVTVSLKPIGKPPGDATADQMDALADIADKYSFGEIRVGHEQNLALPHVRKRDLPAVWKALDAIGLAIPNVNLVSDIIACPGLDYCSLANARSIPIAQEITRRFANHDTANLIGRLHINISGCINACGHHHVGHIGILGVEKNNEEFYQITIGGRADEGAVLGTLIGPAVPYAEVADVVEDIVEAYLALRASPEELFVDTVARLGVEPFRERVYATR

SEQ ID NO: 88425 - protein, 270 aa, Actinidia deliciosa
MAKNDSYSEFLAIAIDAAKEAGEVIRKGFYQTKHVEHKGQVDLVTETDKACEDLIFNHLKLHFPDHKFIGEETTAACGITELTDEPTWIVDPLDGTTNFVHGYPFVCVSIGLTIGKVPTVGVVYNPIMNELFTGIHGQGAFLNGNPIKVSSQSELVKSLLSTEVGTKRDKLTVDATTNRIKSLLFKVRSLRMSGSCALNLCGIACGRLDVFYELGFGGPWDVAGGAVIVKEAGGVLFDPSGKEFDISAQRIAASNPLLKDAFIEALRESE

SEQ ID NO: 88426 - protein, 393 aa, Glycine max
KKENNFEDKVKRERKEERVRGGNGCKVGDDNGSLMLMWEDGFCRGRVSDCLEEIDGEDPIRKSFSKMSIQLYNYGEGLMGKVTSDKCHKWVFKEPTECEPNISNYWQSSFDALPPEWIDQFESGIQTIAVIQAGHGLLQLGSCKIIPEDLHFVLRMRHTFESLGYQSGFYLSQLFSSTRNTSSSTSLSSKPSSIPTRPPPPLLNWGQRPLGSSASMLPSPTFQHAARMGFPQAKDETHMFLMPHASEHARMGDIMGEHENDIKWPNGLSIFNALTGRSDDAKLLFNQESLGGKPSDDHNHHHHHHHSLNPNNPTSSVQNANSVANPNEFLSLDSHTEGGGARKLDKFKRCFTLPARMTSSSSSTSMDHHQQAGVEYRNSGGSMYQDVMETFLE

SEQ ID NO: 88427 - protein, 270 aa, Malus x domestica
MAENDSLAQFLSSAVDAAKKAGQIIRKGFYETKHVEHKSQVDLVTETDKACEDLIFNDLKQLYPTHKFIGEETTAANGVTELTDDHTWIVDPLDGTTNFVHGFPFVCVSIGLTIGKIPTVGVVYNPIIDELFTGIRGGGAFLNGNPIKVSSKNELVKSLLATEVGVKRDNLTVDATTGRINRLLFKVRSIRMSGSCALNLCGIACGRIDLFYELGFGGPWDVAGGAVIVTEAGGCVYDPSGKEFGITSQRVAASNPLLKDAFVEVLRDSE

SEQ ID NO: 88428 - protein, 157 aa, Haemophilus influenzae Rd KW20
MKVLEGSVAAPNAKVAVVIARFNSFINESLLEGAIDALKRIGQVKDENITIVRTPGAYELPLVARRLAESKKFDAIVALGTVIRGGTAHFEYVAGEASSGLGKVAMDAEIPVAFGVLTTENIEQAIERAGTKAGNKGAEAALTALEMVNLIQQIDAA

SEQ ID NO: 88429 - protein, 275 aa, Lactobacillus acidophilus NCFM
MITIKSIRELKGMQASGHLLATMFEGLRDVIKPGISTWEIEEFCQDFVKSRGGRLSEQGFEGYKYGTCISVNDEIAHQTPRKDRILKEGDIVKVDVTCNLNGYESDSCTTYPVGKISEADKKLIEVTKKAMYLGIDQAVLGNRIGDIGAAIQHYVEVENHYGDVRELIGHGIQPSIHEDPEVPHWGKAGHGLRLREGMTITCEPMVEAGGDWHIDQRTVDDPNDDWVYYATPDGSNAAQFEHTFAITKDGPKILTLQRPYDGLEKYIPHFDEMDD

SEQ ID NO: 88430 - protein, 472 aa, Zea mays
  misc_feature (348)..(348): Xaa can be any naturally occurring amino acid
MAAGGGAPWAERARVVGTQIRNRFRVAPVDHRSLWLRADGRVATEAVRRWSDRVRALLQRGRSADRNSTSTDTSPEAVAKPSSSVFEILQKESSGILAKKRTLDYSVLLVPFSLNSEDVQVYGVEKLHQALHGRPKGKALLTVSNHVAAMDDPFVIASLLPPSVMLEAQKLRWTLCATDRCFTNPVLSTFFRSVKVLPVSRGDGIYQKGMDMALSKLNSGGWVHIFPEGSRSRDGGKTIAPAKRGVGRLVMDADSLPVVIPFVHTGMQDIMPVGKRIPRAGKRVIVVVGDPINFDDLLIDNCGDTQDIPRGILYDKVTQRIGQRLQELKVEVDRLAAEQEPELPKPQXGDDGYRLWQQVDWEGFGIGSSMLPSEPSAAAQVPSREAEPEPHVEVEQSVSPAPSAATSYNVAVPHWFQRHADPSELMGFASRGLIKHGKFLEEGYREFQQSATTLHTFWVSRANNAAHRWSTA

SEQ ID NO: 88431 - protein, 500 aa, Arabidopsis thaliana
MATIWFLPLLFLSCLLLAALRLKKRRQHQRKPPSPPGFPIIGNLHQLGELPHQSLWSLSKKYGPVMLLKFGSIPTVVVSSSETAKQALKIHDLNCCSRPSLAGPRALSYNYLDIVFSPFNDYWKELRRMCVQELFSPKQVHLIQPIREEEVKKLMNSFSESAAQKTPVNLSEKLASLTVGVICKAAFGVSFQGTVLNSDNFDKLIHDAFLFLGSFSASDYFPNVGWIIDWLTGLQGQRERSVRGLDAFYEQMFDLHKQGNKEGVEDFVDLLLKLEKEETVLGYGKLTRNHIKAVLMNVLLGGIGTSAITMTWAMTELMRNPRVMKKVQSEIRNQIGGKSMICLDDIDQLHYLKMVINETWRLHPPAPLLVPREVMSEFEINGYTIPAKTRLYVNVWGIGRDPDTWKDPEEFLPERFVNSNIDAKGQNFELLPFGSGRRMCPAMYMGTTMVEFGLANLLYHFDWKLPEGMVVEDIDMEESPGLNASKKNELVLVPRKYLNL

SEQ ID NO: 88432 - protein, 753 aa, Zea mays
MESSDAIVRKVLDAMHLMEVRLTEKITGRCDIVERRMDARCDELHCRFTARGYTIQQEVDAVIYDESSDHDGYGAAPFDINGSGEKSIFDDGPSFDEEHCTFSADNAHFNDVLRAHLFDSFLPTTTTVKETLRASFMREEDKRPKVPHDHGCSQGGAEAGRPGGAAAPQHRGARVPGGRREGACSGRHFQPRLSVPQVPHQRDRDGHKALLRRPPVRRGRIRPRLLRLHGPHPYRHQGAPARRALAKRIWRNTTTYDYYHQIFVLDREPPNGKSDEPLRVNNLFQHIKGMLSGKRAAVAEKLGLTDSQSASTLIDAQVVFDEMQQSDTSVGIAHDAFNTFFSEIGVNEHVTWIIFIAVSFTASAVWARAARRLDGVVVADNRKLRQASVDGRKMHCYELLTDEALESWRTRSSGQHPRKEYLESPRADLRCMAEPTIASIRNAQAPLFTTMYELEYEREEDVMFSFNTIFYENGQQSDVYNFHVVPIVSDTINGIIGTIITYGQSGASKTYSMDEPSILHHNEQKTGLVQRVVDELFVCLGSSASTWIMKLPMVEIYLQKVRNLLDLSKDNPQIKESKIQGIYISGAIEIFIFNSSDVLENLFPGIDNSAVGKTHMNLASSRNNCLCIFSVQYESTSDERVPSGTIILIDLDGSEKVGTTGAEGRGLDKAKTINIVIDSLSFVSVTIFQLEGIVLGLIASAVRFSDLGAVSSGQGNFSVFVWDPGDRAVMLLASGVVLVLQELPHFRWRAAEA

SEQ ID NO: 88433 - protein, 527 aa, Arabidopsis thaliana
MHSSHLLLEEPIRMTSILEPSKSSFFPALTKIVGTLGPKSRSVEVIAGCLKAGMSVARFDFSWCDADYHQETLENLKIAVKSTKKLCAVMLDTVGPELQVINKTEKAISLKADGLVTLTPSQDQEASSEVLPINFDGLAKAVKKGDTIFVGQYLFTGSETTSVWLEVEEVKGDDVICISRNAATLGGPLFTLHVSQVHIDMPTLTEKDKEVISTWGVQNKIDFLSLSYCRHAEDVRQARELLNSCGDLSQTQIFAKIENEEGLTHFDEILQEADGIILSRGNLGIDLPPEKVFLFQKAALYKCNMAGKPAVLTRVVDSMTDNLRPTRAEATDVANAVLDGSDAILLGAETLRGLYPVETISTVGRICCEAEKVFNQDLFFKKTVKYVGEPMTHLESIASSAVRAAIKVKASVIICFTSSGRAARLIAKYRPTMPVLSVVIPRLTTNQLKWSFSGAFEARQSLIVRGLFPMLADPRHPAESTSATNESVLKVALDHGEQAGVIKSHDRVVVCQKVGDASVVKIIELED

SEQ ID NO: 88434 - protein, 577 aa, Arabidopsis thaliana
  misc_feature (528)..(528): Xaa can be any naturally occurring amino acid
MEGSKLLPCVHKSPVPTSHQLYINYEILGLTKLKKHKYTQNKMSSSDSSSAESRLATAKTVLTTAASVAATAMLARSLVQDYLPDEVHHYISYGFRSIFGYFSSQMTIIIEEFEGFAHNEVFEAAEAYLATKISPSNKRIKVSKHEKENNYNVTVERDEEVVDTYNGVKFQWILHCRHVESKHFHNPRDLNSTLRSEVRSFELNFHKKFKDVALESYLPFMVKRATLMKQEKKTLKIFTLSPENMYGNYSDAWTSVTLDHPSTFKTLAMDSDVKTSVMEDLDKFVKRRDFYKRVGKAWKRGYLLYGPPGTGKSSLIAAMANHLNFDIYDLELTAVNNNSELRRLLIATANRSILIVEDIDCSLELKDRTSDEPPRESDDIEDPRYKKVTLSGLLNFIDGLWSSCGDERIIIFTTNYKEKLDAALLRPGRMDMHIHMSYCTPSTFKALALNYLEIKEHRLFSKIEEGIEATEVTPAEVAEQLMRNDSVDKVLEGLIEFLKVKKIENEQDKAKTEKQELENKKKTKEGTXDSVVKKEVDEQLVRNDRVDKVLEGLVELLKAKKIEDDQDKAKHEEVEQH

SEQ ID NO: 88435 - protein, 448 aa, Methanosarcina mazei Go1
MTEISSMVISHKKAKVEEMESAWHGDLDGLLRNLYKHEYVYECVVLKTCNRVEIYVVSPKSSSVLFSFAKEMGASTHIIDFYGHDESLEHLLRLAGGLESMIVGEDQILGQIKDLYAYSKKAGTTGKILETAFEKAIQVGKRIRNETRINKGSVSIGSAAVDLAEDIFGGLTGKNVLVIGAGEIGVLVAKALAEKDIEAIYIANRTYKKAEEIAYELGGHAVRLDDIRDYLPGADVVISGTGAPHYILTREIVEEAIKCRERKLLLIDIANPRDIEESVVELENVELCNIDNLRVISERTLRMRKEEAKKAEAIIQEEIRLLNLQYKRQKADRLISELYKQVYDVRLRERQKAVNRLSSYHTIGDIETEVLDDLTRSIVNKILGEPTKVLRQAAELGNEEFLDVVSRVFCLDKEKVRFEKIKQAKFDQIKPGCTKEQAEVKEEYAVKD

SEQ ID NO: 88436 - protein, 662 aa, Arabidopsis thaliana
MPMPNLPKELVEEILSFVPATYLKRLSATCKPWNRLIHNDKRFARKHYDNAAKEFLVFMMRKNFRIIRRGVNLHGADPSAEVKGELTLPDPYFKNSADEFHIDRVFHCDGLLLCTSKLERRMVVWNPLTGETKWIQTHEEGDNFFLGYSQEDKNISCKKSYKIMGFYRSGSKVWEYDFNSDSWRVLNGILPNWYFDKSYKCVSLKGNTYMLAGAVTDMGFDLSLQSYDFSTEKFAPVSLPVPSQARSLNGANRLSVVRGEKLALLYRRDKRSKAEIWVTNKIDDTTEGAVSWTKVLELDLSRELHALFTSNFLVDEEKKVFICCVSWKEDEDENKSNKVYIVGEDNIVKEIDSGEDATSGCEPTILSLTRGILRPKLIGFVVLLADKRLRSTCKGWNRLFKDDKRFARKHIEKAAKQFQPLTLTKNYRICPINVNLHGTTPSLEVKNEDSEIYEFSSDSWRVIDDIIKPPHYMEYFRKCLSLKGNTYWLGIDRRRRPPDLRITLIKFDFGTEKFGYVPLPPPCQVHGFEASRLSAVGDEKLSLLLVGDSTSNTELWVTSKIGEANVVSWSKVLSLYPKPNVGFWHGLSFLLDEEKKVLLCCKSKGWMKEEDEDNVYIVGEDTKFILLNFGVQTIGGYSPIIVNYVPSLGQIELAGSKRKRDY

SEQ ID NO: 88437 - protein, 442 aa, Triticum aestivum
  misc_feature (170)..(170): Xaa can be any naturally occurring amino acid
MGQKDSKPSYNSADYGNSSNGYNSRYANTPSSYSPRYASSAGNNVQQPEAQARLQRKYSRIGDDYRSVSQVTEALAQAGLESSNLIVGIDFTKSNEWTGKISYNRRCLHDIGNTPNPYEQAISIIGRTLSAFDEDNLIPCFGFGDASTHDQEVFSFYPENQPCNGFEEAXLERYREIVPTLRLAGPTSFAPIIETAIGIADSTGGQYHVLLIIADGQVTRSVDTQSGQLSPQERDTIDAIVKASHFPLSIVLVGVGDGPWDMMHKFDDNIPARSFDNFQFVNFTEIMSKSIAADRKEAEFALSALMEIPTQYKATLDLQLLGRRQGIPPRVPLPPPTRTPYSRSTSFDQQSGVYSRSSSFGQQTSGFQQSDSFKQRQHGATRRPDSYSSEKSSESTLSCAICMDKSKDLAFGCGHQTCYDCGKNLVRCPMCQQHITTRIRLY

SEQ ID NO: 88438 - protein, 802 aa, Methanosarcina acetivorans C2A
MPGDKNKYIRWFEETTIEDVPLVGGKNASLGEMYRELTSKGVRIPNGFSVTSEAYWHMLKAGGILEKLKKTMEGLDTSNVSDLAKRGKAARDLILGAGLPDDLWEEIKASYDRLCEQYGEDTDVAVRSSATAEDLPTASFAGQQETYLNIRGYPGLRDACIRCFASLFTDRAISYRVTNNFDHFKVALSIGIMKMVRSDLASSGVIFTLDTETGFRDVVFITGAYGLGENVVQGQVNPDEFYVFKPTFREGHKPIIQKKLGSKEIKMIYGRGDSKVLTRNVEVPEAERLRFCINDEEVLKLAGYAIDIEEHYSNKYGESRPMDIEWAKDGITGELFIVQARPETVQSQRAKDVLETYVLEKKSEVLAKGRSVGDKIASGKAHVIPDVSDLPSFRPGEILIADTTTPDWEPVMKTAAAIVTNKGGRTCHAAIVSRELGIPAVVGAGNATEVLETGREITVSCAEGEDGFVYAGLLPFHKDTMSLKDLKRPGTEIMMNLGNPESAFAYSMIPNDGIGLARLEFIITSYIKVHPMALVHPEKVKAQGEIQEIEGLTRGYEKKEDYFVDQLARGVGMITAAFYPKPVVVRMSDFKTNEYASLVGGSYFEMDENNPMIGFRGASRYFDERYREGFALECRAMKKVRDEMGLTNLILMIPFCRTVEEAEKVIAEMEKNDLRRGENGLQVYVMCEIPNNVLLVDEFSEFFDGFSIGSNDLTQLTLGVDRDSELLAAEFDERDPGVMKIMSMAVQGAKRNKRHSGICGQAPSDFPEIAEFLVKEGINSISLNPDSVMKITLKVLETEKEL

SEQ ID NO: 88439 - protein, 219 aa, Oryza sativa Japonica Group
MSASAAPTHIRFSSAAPPSAAALRRPRRRCATPVRCSLAAAPGLRAPPELIDSILSKVKGTDRGVLLPKDGHQEVADVALQLAKYCIDDPVKSPLIFGEWEVVYCSVPTSPGGLYRTPLGRLIFKTDEMAQVVQAPDVVKNKVSFSVFGFDGAVSLKGKLNVLDGKWIQVIFEPPEVKVGSLGFQYGGESEVKLEITYVDEKIRLGKGSRGSLFVFMRR

SEQ ID NO: 88440 - protein, 296 aa, Magnetococcus sp. MC-1
MLTWLADKFKRGQEASDRLVNAVRLDNIAKVEMILAEGSDVNTLDSRHKTPLCHAVERGYLGICALLLAYGADPNIKNSHGETPLHLAAMANRIEIATALLDRMTTPDVVDKDGRTPLHFAADNGQPEICKLLIKKGANVNIADVEGETPLFFANRMVAELLVQSGADIHWRNRSGETVLHLTSKDLAEYLLGLGSDVNVRDNKMWTPLHFANSELAALLIQHGADLNATDRYGWTPLHFAANRGDEEKTLLLIKAGAEINAEDRYGYTPMTVAYNTNYNNLARLIGMHGGVSQVS

SEQ ID NO: 88441 - protein, 477 aa, Gibberella zeae PH-1
MEHGTQADGGIQTDENTPIAPSLRRSNRLASKPPQQIKAIVAMSEPRRNPKRKACEPANEVNQRINSDELLNEALAPLSQEDIEEWEGWIELESEPAFFTIILRDLGVQNVKAQEIFTIDQDSLSHLPQPVYGLIFLFQYLPGMEETNEEQDASDVWFANQTTNNACATVAMLNIVMNAEGIELGDKLQAFKESTKNLSTALRGHQISKNRFIRTIHNSFTRRMDHLNADLFLENESSEAKSSANKRRSAPKGGKRAPPRKKKTDSDYGFHFIAYVPAGGYVWELDGLQYKPYRLDPVPSSSKWTSVAAPQIEARMLQYEESQLSFNLLALCQSPLAAYSRTIARAAASLQFVCTNTNLPEFEMLIRGEKLPLDVDDESQLSEFNITKSDITNAQIPYAIQYKLKRPGFDTQTAYELYQELIIDLKAAMGEFHAEMTAISDDEQRVKGRKKDYGPALHKWMTKLAQKGVLEEVIKTT

SEQ ID NO: 88442 - protein, 465 aa, Dehalococcoides sp. CBDB1
MAKAGLNRIDMPKQAVAKRIQNFSEVATGYTPSDAHIEAARCLQCKKRYCVEGCPVNIDIPEFILALREGDMPEAARILKKTNSLPGVCGRVCPQETQCEQACILNKKEVPIAIGRLERFVADWEREHSAEVNLPKSLKPKSGKKAAVVGAGPAGLTASAELARLGHDVTLFESLHTAGGVLMYGIPEFRLPKDIVQGEVEYVKSLGVKIELNAVAGRLFSLDDLFKQGFQAVFLATGAGLPLFLNVQGENLNGVYSANEFLTRINLMKAHSFPEYDTPVKKGKKVAVIGGGNVAMDAARCALRLGAEEVSIIYRRSEVELPARKEEVENAREEGIKFHFLTSPVRFLANEQGKVRAMDCQKMELGEPDASGRRRPIPVDGSEFEMDIDLAIIALGTRPNPLVMQSAPDLQVNPNGTVAAGISGQTSHKAVWAGGDIVTGSDTVISAMGAAKRSALVMDEYLRSL

SEQ ID NO: 88443 - protein, 662 aa, Arabidopsis thaliana
MEKVEVPPIHNHPLLPFTRFSYKACKGCGYVGYIYGGYHCNELGCESVFHKECADPLPEINHYSHPDHPLKLLINVEPLASCSQCPSSFENGYLCSICDFKLDFRCATRLPLEFILEESTVHEHPIQLSDGTRDGFVQLCKTCKWGVFDAVHYKCNKCDLRFHVECTKLFPQASHVLHPQHPLKLLRCEEAPDYADNKCLLCGNKFDGRIHHCDVCNFTICGGCMENPPPLSVVSPTTHEHQLYLLSKPLGFTCNACGTQADQSPYFCLQCNFMIHWECIDLPRVININRHDHRISYTRRLGHGQNTCGVCRKKVDGFYGGYSCSKCSNYVVHSRCATDEDVWDMIELEGTPEEPEEDAPFEVIDDNTIKHFSHDHNLVINKDGRILHESTLCKACVFQICSDAFYSCENCDFILHQKCANLPRKKRHVCDNLPFTLVTNDTSDETSCDLCWQSFTGFRYECLTRMVTLDVRCGSIREPLVHQSHQHPLYFSKRSSKSCTECGKNMDLDIGSFSCDECDYSLDFKCALLPQKVKWHRYDDHPLYLSCGESSVDGEYWCEACETKVNSKKWFYTCNDCGVILHISCVVGDFSYYMPGSKIGWEEDLVVSNTSMCRPFCYVCNSQCKLPSIVKVVSKADVVLYICSLNCYYNFNRSNNYSSSDW

SEQ ID NO: 88444 - protein, 93 aa, Glycine max
MAFLLKNNSISSHLRSSSQKMEGGALAQPRRGFHVELGSREKDLLAENDALRRFKSHKKGVRQLKRIGDVITAVVVAGCCYEIYARATMKKEA

SEQ ID NO: 88445 - protein, 84 aa, Dioscorea tenuipes
INCTENRSVLHIALRAARDKVIKSDGKNVVPDVWHVLDKIKEFSERIRSGSWVGATGKALTDVVAVGIGGSFLGPLFVHTALQT

SEQ ID NO: 88446 - protein, 721 aa, Oryza sativa Indica Group
MKLRLRSMDQRGGAGGAAETHRVQLPDTATLSDVKAFLATKLSAAQPVPAESVRLTLNRSEELLTPDPSATLPALGLASGDLLYFTLSPLPSPSPPPQPQPQAQPLPRNPNPDVPSIAGAADPTKSPVESGSSSSMPQALCTNPGLPVASDPHHPPPDVVMAEAFAVIKSKSSLVVGATKREMENVGGADGTVICRLVVALHAALLDAGFLYANPVGSCLQLPQSGSFVPVSMKYTLPELVEALPAVEEGMVAVLNYSLMGNFMMVYGHVPGATSGVRRLCLELPELAPLLYLDSDEVSTAEEREIHELWRVLKDEMCLPLMISLCQLNNLSLPPCLMALPGDVKAKVLEFVPGVDLARVQCTCKELRDLAADDNLWKKKCEMEFNTQDTCGCMMCKCIYSDQRKDIVLADKYTCGNYMQKPVSQPGRWLIILVYHSLLCQYITIGLSLLWYHLVDLVQDAPAAGIHFDCIIPLPINPYQLPPSAGACCSTTQASASAKDGGNMYSPPCSAAASSQGHCFAVGANQLASLDLAMDFDEPILFPVHNASLQEGIQFYNPTGVSKGEDKRKDEASAGPRPRMQQGSNEINNSFESVMVWCALTCVNMLLLTKQITGKAMMLDEIINYVQSLQRQVEFLSMKLSTISPELNSDLDLQDILCSQDARSAFLGCSPQLSNAHPNLYRAAQQCLSPPGLYGSVCVPNPADVHLARAGHLASFPQVYI

SEQ ID NO: 88447 - protein, 270 aa, Oryza sativa
  misc_feature (41)..(41): Xaa can be any naturally occurring amino acid
MSSAAGEPSSSSAAAAAISCSSSNDDEKPPPSLEGKELRRXEEEEPAAAARPEKLTEGSSRAAEAEEEEEVVEDEEDDDEEDEGKVAEAIDLGPRVSIKEQLEMDKEDESLRRWKEQLLGSVDLNSVGESLEPDVRITSLCILSPGRPDVLLPLPVEPSNSKEPWFTLKEGSTYRLKFTFSVSSNIVSGLRYTNTVWKAGIRVDKTKEMLGTFSPQLEPYTYVTPEETTPSGVFARGSYSAKTKFVDDDRKCYLEINYTFDIRRDWPCKS

SEQ ID NO: 88448 - protein, 300 aa, Lactobacillus acidophilus NCFM
MKVRKAIIPAAGLGTRFLPATKALPKEMLPIVDKPTIQFIVEEAKKSGIEDILIIIGKNKRPIEDHFDANPELEQDLKEKGKDELLELTQGITNLGVNLYYTRQPHPAGLGDAIYRARSFVGDEPFVVMLGDDLMDDKVPLTKQLIDRYNKTHASTIAVMPVPHEEVSKYGVIEPENEILPGLINVKSFVEKPDVDKAPSDYAIIGRYLLMPEIFEILANQKPGRGGEIQLTDAIDTMNKTQRVFAHVFKGERHDVGNKEGYLETSIEYGLKHPEIKDQLREYIQRLGKKFEAEDKRKNK

SEQ ID NO: 88449 - protein, 298 aa, Acidithiobacillus ferrooxidans
MAEVRKAVFPVAGLGTRFLPATKASAKEMMPIVDKPLIQYAVEEAIAAGCDQLIFISGRGKRAIEDHFDVSYELEIELEKRGKADLLKQVQGILPSHVSTIFLRQPYPLGLGHAVLMARPVVGDEPFAVLLADDLMLSESPVLAQMVEQYRRYQTGILGVEEIPREHSTRYGVVDARPWDDRIYQVSGIVEKPKPEDAPSNLGVVGRYILPARIFHFLEQTQQGAGGEIQLTDAIAHLLNERQVLAYLFSGQRFDCGDKLGYLKATIAFGKLHPEVGADFTRYMDSICEPQASAETLS

SEQ ID NO: 88450 - protein, 729 aa, Physcomitrella patens subsp. patens
MAALAAATTVVGQAVTLKGLSTSASSSSSLLKSDASEFFCAQKLNLSKGYHSSLRLRSNGKSRIAASAVPDSSAEYPAEKPPTPLLDTINYPMHMKNLTVRELKQLANEVRAETIHTVSKTGGHLGSSLGVVELTVALHHVFNCPEDKFLWDVGHQTYPHKILTGRRGKMHTLRQTDGLSGFVKRAESEYDAFGAGHSSTSISAGLGMAVGRDLKGKKNNVIAVIGDGAMTAGQAYEAMNNAGYLDCNMIVILNDNKQVSLPTATLDGPAPPVGALSSALSRLQSSRPLRELREVAKGVTKQLGGPAHVLASKVDEYARGMISGSGSTLFEELGLYYIGPVDGHNMDDLVTILREVKNTSTTGPVLIHLVTEKGRGYPYAERAADKYHGVVKFDPATGKQNKVKAPTQAYTTYFAEALIAEAEVDKDVVGIHAAMGGGTGMNIFAKRFPERCFDVGIAEQHAVTFAAGLACEGLKPFCSIYSSFLQRGYDQVVHDVDLQKLPVRFAMDRAGLVGADGPTHCGAFDVTYMACLPNMVVMAPADEAELFHMVATAAAIDDRPSCFRYPRGNGIGVQLPAKNKGIPIEVGRGRILLEGTEVALLGYGTMVQNCLAAHVLLADLGVSATVADARFCKPLDRDLIRQLAKNHQVLITVEEGSIGGFGSHVVQFMALDGLLDGKLKWRPLVLPDRYIEHGAPKDQYAEAGLTAGHIAATALNVLGKTREALQVMT

SEQ ID NO: 88451 - protein, 185 aa, Aspergillus nidulans FGSC A4
MGGSVSKIMGKIFGTKEMRILMLGLDAAGKTTILYKLKLTNQDVTTIPTVGFNVESVTYKNVKFNVWDVGGQDKIRPLWRHYYSGTQGLIFVVDSSDTARMDEARSELHKIINDREMKDALLLVFANKQDVPGHLSPDEVISALKLHSLKDKTWYVAPSVATEGTGIFEGLAWLSNNVKVQQPQK

SEQ ID NO: 88452 - protein, 268 aa, Xanthobacter autotrophicus Py2
MNIDGKRILITGGSSGIGLALAHALLAKGARVAITGRRAKMVADAVTELKAGDSEVHGVVADIATPEGRATTLEGALQKLGGLDILVNNAGGVRAGRLENTPEAELQAMIDIDLVAPIMLTRAALPVLREGGDAVIVNISSGIALVGAPFYATYAAVKAGLANFGEALRRELKGEGIHVMTVYPGGTDTPMMKSNRAGPDLGFSREPASAVADAIVAGIEARAFEVIRGGETRAQMIALNRENPAAVDERFLGLKRALEEAVKDHSAL

SEQ ID NO: 88453 - protein, 502 aa, Arabidopsis thaliana
MVLSHAVSESDVSVHSTFASRYVRTSLPRFKMPENSIPKEAAYQIINDELMLDGNPRLNLASFVTTWMEPECDKLIMSSINKNYVDMDEYPVTTELQNRCVNMIAHLFNAPLEEAETAVGVGTVGSSEAIMLAGLAFKRKWQNKRKAEGKPVDKPNIVTGANVQVCWEKFARYFEVELKEVKLSEGYYVMDPQQAVDMVDENTICVADILGSTLNGEFEDVKLLNDLLVEKNKETGWDTPIHVDAASGGFIAPFLYPELEWDFRLPLVKSINVSGHKYGLVYAGIGWVIWRNKEDLPEELIFHINYLGADQPTFTLNFSKGSSQVIAQYYQLIRLGHEGYRNVMENCRENMIVLREGLEKTERFNIVSKDEGVPLVAFSLKDSSCHTEFEISDMLRRYGWIVPAYTMPPNAQHITVLRVVIREDFSRTLAERLVIDIEKVMRELDELPSRVIHKISLGQEKSESNSDNLMVTVKKSDIDKQRDIITGWKKFVADRKKTSGIC

SEQ ID NO: 88454 - protein, 46 aa, Glycine max
  misc_feature (31)..(31): Xaa can be any naturally occurring amino acid
GMTLVNTVNIMREAHGNGLSVVIFCHQPDVXDHCMQLKGNGLLIPI

SEQ ID NO: 88455 - protein, 231 aa, Solanum habrochaites
MAAAEMERTMSFDAAEKLKAADGGGGEVDDELEEGEIVEESNDTASYLGKEITVKHPLEHSWTFWFDNSTTKSRQTAWGSSLRNLYTFSTVEDFWGAYNNIHHPSKLIMGADFHCFKHKIEPQWEDPVCANGGTWKMSFSKGKSDTSWLYTLLAMIGHQFDHGDEICGAVVSVRAKGEKIALWTKNAANETAQVSIGKQWKQFLDYSDSVGFIFHDDAKRLDRSAKNRYTV

SEQ ID NO: 88456 - protein, 231 aa, Solanum habrochaites
MAAAEMERTMSFDAAEKLKAADGGGGEVDDELEEGEIVEESNDTASYFGKEITVKHPLEHSWTFWFDKSTTKSRQTDWGSSLRNLYTFSTVEDFWGAYNNIHHPSKLIIGADFHCFKHKIEPQWEDPVCANGGTWKMSFSKGKSDTSWLYTLLAMIGHQFDHGDEICGAVVSVRAKGEKIALWTKNAANETAQVSIGKQWKQFLDYSDSVGFIFHDDAKRLDRSAKNRYTV

SEQ ID NO: 88457 - protein, 571 aa, Methanosarcina mazei Go1
MTLSPEDIKIIEKYALQNAVKYGKAPQPKAVMGKVMGECPQLRADPSGVSAALENIVSEIAKGNPEAWEARLSEIAPELIEALSVKKEPDKGLKPLEGAETGKVVMRFAPNPNGPATLGSSRGMVVNSEYVKVYKGKFILRFDDTDPDIKRPMLEAYDWYMDDFKWLGVVPDQVVRASDRFPIYYDYARKLIEMGKAYVCFCKGEDFKRLKDSKKACPHRDTDPEENLMHWEKMLAGEYEDQQAVLRIKTDIEHKDPALRDWGAFRIRKMSHPRPEIGNKYIVWPLLDFAGAIEDHELGMTHIIRGKDLIDSEKRQTYIYKYFGWTYPKTTHWGRVKIHEFGKFSTSTLRKAIESGEYSGWDDPRLPTIRAIRRRGIRAEALKKFMIEMGVGMTDVSISMESLYAENRKIVDPVANRYFFVWNPVELEIEGMKPVVAKVPRHPTDHARGMREISIENKVLVCAEDIEKLNVGSVLRLKDLCNVEITSLSPLRVKRSETSLEDLKKAKGKIIHWVPVDGIPVKVCGPEGDIEGTGERGIETELDNIVQFERFGFCRIDAVDGENVVAYFAHK

SEQ ID NO: 88458 - protein, 268 aa, Thermoanaerobacter tengcongensis MB4
MAIAFITGATDGIGREVAKRLAFHGYDVIIHGRNELKLEKVADEIRDLTGKSVFKIKADFSSLKDLKKLVKEIKDNFSKVDLLLNNAATFEKERKVTEEGFERTFMVNYLAPFYLTISLINEGVDIKYVLNVSSMAHASSIEFEDLQLEKGYDGYKAYSLSKLYITLFTYYLAEMLKGKIYVNCLHPGVINTKLLMENWGAIGASIEEGAKNVIDAIKYIEAHNVTGVYFDNGKPSKSKPITYDREVQRKLWEKTLKLLKINERDLKF

SEQ ID NO: 88459 - protein, 504 aa, Bartonella henselae str. Houston-1
METATHYDLFIIGGGINGCGLARDAAGRGFKVGLAEMNDLASGTSSASTKLIHGGLRYLEYYEFRLVREALKEREIIWRMAPHIVRPLRFLLPYHKKLRPAWMLRFGLFIYDYLGNWNQKLWRSKTVNFSKSFCSILKEEYHKGFEYSDARVDDARLVIANARDAEKWGAVIKVRTEVLSLKSEEKKWVVILRDKLSGKESCVTASYVANMTGPWINHILSNVLDCKENPPVRLVRGSHILVPKLYAHDRAYIFQNGDGRILFSIPYQEEFTLLGTTDCGYQGDPADVHITDTEIDYICTAASEYFVQPVLRESIVWTYSGVRPLYDDGASKAQEITRDYVLKEMGTESTPRILNLYGGKITTYRKLAEDAMKFVEKALGKKGKPWTINSTLPGGDFPHNKLDTIENKIALLVPDLDAFTYRRLARSYGCEALMIFANGKADKGKNFGHGLYEVEVKWLMEKEWAKTCEDVLWRRSKLGLLFNKKEINALTAYMQKIQDNEQNS

SEQ ID NO: 88460 - protein, 326 aa, Bartonella henselae str. Houston-1
MIFYSFPSSIKFAIAPMLGWTDRHCRFFYRLLTKKALLYTEMIVADAVIHGVREQLLALNHKEHPIALQLGGSDPQKLAEAARIAEDFGYDEINLNVGCPSNRVQSGAFGACLMLYPDIVASAVEAIKKVVTLSVTVKCRVGVDDQDEELALDLLADKVWNAGCDALWVHARKAWLKGLSPKENRDIPPLNYNRVYKLKRKYHNKFIGINGGIKSIYEIKEHLILCDAAMVGRQVYHDPTLLKYIDSEIYGEQQNNLSDSDLIEAMCDYAAQHIASGGLLSHVTRHMIGLFHGRNGARRWRQILSNNARGRDAGIHVLKEAFSALI

SEQ ID NO: 88461 - protein, 310 aa, Pasteurella multocida subsp. multocida str. Pm70
MKKIILDCDPGHDDAIAILLAHGNPEIDLLAITTVVGNQTLEKVSRNALAVAEIANILNVPIAKGCVRPLVREVEVAPSIHGESGMDGPVLPEPTLSLDSRHAVDLIIELVMTHPPKTITLVPTGGLTNIAMAVRKEPRIVERVKEIVLMGGGYHTGNWSAVAEFNIKIDPEAAHIVFNEKWSLTMVGLDLTHQALATEDVIKNIEKIQTKPAKFVLELLAFFRKMYKQAQNFDYPPVHDPCAVAYVIDPTVCTTKVVPINIELTGTHTLGMTVADFRYPIPENCHTQVAMQLDKAKFWGLIYDALQRIG

SEQ ID NO: 88462 - protein, 411 aa, Mycoplasma mycoides subsp. mycoides SC str. PG1
MNQPLSFLLRPKTTKDIIGQTEILKPKGLINKMILNNYCTSLIFYGPSGVGKTSFAISLANDLKIDYEIFNASYDKKEKLTNIIQTALKQKRFILIIDEIHRLNKDKQDILLEYMEKGNIFVFSTTTENPFFVINPALRSRSLLIELKPVNKEELISYAKKVINQYQLKINISDEALDFLAQISVGDIRTFLNYLELIDRLYSNEFIDIKEIKTIITVSKNPTAQNSDDFHDLKSALQKSIRGSDVDAALYYFSRLIETGDYESLMRRMIIIGYEDIGLANPAISSRVVQACSAFRQIGFPEGIIPLGLAIVEMSLSLKSNSAYLATNSALDFVRNGNIYSVPKHLKDNHYKSAIKLGIGIDYKYPHDYENDWVEQQYLPDEIKNKKFYNHKNNQYESKVYELYNRMKNKK

SEQ ID NO: 88463 - protein, 256 aa, Brassica napus
ISKFISQINNNIDALMLHPPQIVKMGDKAELSATIKWPKIKAKPNLSISYLKNLDLFTVENCLTSDESKGFVKIAESLGFTHQGSRGPAYGEAFRDNHRISVNDPVLADTLWRSGLSNLFTDIKIRRKVAVGLNPNIRFYRYSAGQHFGRHIDESVDLEDGKRTYYTLLIYLSGSNNAKSKSKSSSSSKTNDSSSAEPLVGGETVFYGSRNSIVAEVAPMEGMALFHIHGDKCMLHEGRNVSKGVKYVFRSDVVFA

SEQ ID NO: 88464 - protein, 536 aa, Colwellia psychrerythraea 34H
MLSLSHFNRQTIKGDIFGALTSTIVALPFALAFGVTSGAGASAGIYCAILTGLFASLFGGTNQQISGPNTGLTVAMVAILTSFVAQSPDNGIAAAFTVVSLAGLFQMLFGIFKLGKYFILVSYPVISGFTSGIGVLIILSQLEPLFGHSLPELQLSLSTLTSTNTLLGLACLVILFLWPQRFSRIVPASIIAVTGATIFFVFSGAEMPVVGAISSELPSFNMPIWDNVLASEMIKSALLIATLSTLDSLMTSLTVDSITNELHDSDQELVGQGIGNIVAGLFGALPGGGATMRTVTNLRAGGTTPLSGILHAIFILAIVLWAGEYTAYIPVAVLAAILTHVGISIIDWNFLKRLHQVPLFSAGLMLSTLVMSVAFDLVTAVLVGVFLANLVTIRRLSEIQLDNIKLCTAKEAEHLSAPERELLASMDDSVLLLNISGPIGFGVARGLKQSVSESDQNKTLLIDLTDARFVGITSTIAIEEIIVSYRNQGRDILLSSVCERVKADFDKLKLLDKISAEHVFSTRLEALTYLSEQAKS

SEQ ID NO: 88465 - protein, 500 aa, Atriplex hortensis
MAFPIPARQLFIDGEWREPLLKNRIPIINPSTEEIIGDIPAATAEDVEVAVVAARKAFKRNKGRDWAATSGAHRAKYLRAIAAKITEKKDHFVKLETLDSGKPRDEAVLDIDDVATCFEYFAGQAEALDAKQKAPVTLPMERFKSHVLRQPIGVVGLISPWNYPLLMATWKIAPALAAGCTAVLKPSELASVTCLEFGEVCNEVGLPPGVLNILTGLGPDAGAPIVSHPDIDKVAFTGSSATGSKIMASAAQLVKPVTLELGGKSPVIMFEDIDIETAVEWTLFGVFWTNGQICSATSRLLVHESIAAEFVDRMVKWTKNIKISDPFEEGCRLGPVISKGQYDKIMKFISTAKSEGATILCGGSRPEHLKKGYYIEPTIITDITTSMQIWKEEVFGPVICVKTFKTEDEAIELANDTEYGLAGAVFSKDLERCERVTKALEVGAVWVNCSQPCFVHAPWGGVKRSGFGRELGEWGIENYLNIKQVTSDISDEPWGWYKSP

SEQ ID NO: 88466 - protein, 266 aa, Brassica napus
MAMAAPRKLRGHKATATCCIASRDRPGLVVTSGEDGCVCWFDLRCKDVQFTIDVGTEPVSSLCFKTGNEDILYASHGNEIKSFDVPMLSAGSWKPLESYSYNKGEVNQVVCNGRSSFLASADDSGDVKIIDVGQKCLYKTLRAGHTSICSSVQFIPWRPWEVITGGLDAKLVLWDFSKGRSQKIIDFSSDNSGQCLNPAFVHSIAVPEMDMVDKLDKICAVARGDGIVDLINIESELSRKGASKGSSRNNVSKRVCLDYSVGGHKS

SEQ ID NO: 88467 - protein, 266 aa, Picea sitchensis
MAIGSYDRQALEYVNGRPQYPPQLFSFIAKHSPHRRLAWDVGTGSGQAALALSEMFERVIATDVSEQQISYAPRRPNITYAVTARAMSLQELESTVGEEGSVDLVTVAQALHWLDLDTFYGHVKHVLRKPGGVFAAWCYREPVVNPSVDCVFEEVFRASVAFWDPPRKMVDEGYATVCFPFRSVVQEGSEEGASTTAPIKFWAKKEMGLEPYLNYMRSWHAYQKAKATGVDLLDEQTVARFKDAWAESENDVKTVSFPVFLRIGVV

SEQ ID NO: 88468 - protein, 350 aa, Oryza sativa Indica Group
MAFRRTLARGIWAGKNANAAAACPAAAAPKPPAPRPLPAVDDCPTLAYLRPRPGTIRYTTASVPLPAHCFPALPVGDQLFNRLRLDGLVPPTTAVTRPPEEEGVGVTVEEARKVARAAEMEVARARLRSNAQSVVSGSEFAALCVDIAGGAEGGRRLARALDDSGVVIVLGDAVFLRPDMIAKAIGSMIPATAHATRAAASVVEVRKKREEEEELRAMEEEKAGIDAAAAAQVRRELWCGLGLLAAQTLGFMRLTFWELSWDVMEPVCFYVTSLYFMSGYAFFMRTSTEPSFEGFYRSRLASRQRRLMRARSFDVARYEALKEQVGGGARYGVAARDAIVLRQQHVTHVH

SEQ ID NO: 88469 - protein, 258 aa, Triticum aestivum
MGSAASPPRALDAATQEDLKRVSAHRAVDMVESGMTLGLGTGSTAAHALDRLGDLLRTGALRAVAGVPTSLKTEAHAARVGIPMLALADAAEIHLSIDGADEVDPDLNLVKGRGGSLLREKMIEGAGARFVVIVDESKLVPRLGCTGAVPVEVVPFGSAYTLGLIRKVFDKLPGFHARLRTVKSKASDRQEELFLTDNGNHIVEMFFEDGIHGNLRDISDSLLRITGVVEHGMFLGMATKVIVAKKDGTVAVLSKKVA

SEQ ID NO: 88470 - protein, 173 aa, Listeria innocua Clip11262
MEIKDLQDYVAIVNDWPKKGIVFKDITPLMNDGEAYRFATDKIVEYAKELKIDIIVGPEARGFIIGCPVAYALGIGFAPVRKPGKLPRETIEMEYDLEYGTNKLSMHSDAIKPGQRVLITDDLLATGGTIEATIKLVEELGGIVAGCAFLIELKELEGHKKLNGYDRLILMKL

SEQ ID NO: 88471 - protein, 577 aa, Lactobacillus acidophilus NCFM
MTKTLKGIAASDGIAIAPAYLLVEPDLSFSKSSVDDIDAEVARYNDAIKESTAEVEKIRDIAKKSLGEEESQVFEAHLMILNDPEFTGAIENEIKDSKINAEAALDETAQKFIAIFEGMTDNPYMQERAADVRDVSKRIMAHLLGKELPNPASIDHEVIVVAHDLTPSDTAQLNKKYVKGFITDVGGRTAHSAIMARSLELPAVVGTDSITKDVKNGDMLIDDGLDGVAIISPSEEQIADYKKKGEDFLKQKAEWKKLKDEPSVTADGKQFIIAANIGTPNDMPGVHENGAEAIGLYRTEFLYMDSSDFPTEDDQFEAYKKVIEGMNGKQVVIRTMDIGGDKHLDYWDLPEEMNPFLGVRAIRLSLMNEEIFRTQLRALLRASAYGKLGIMFPMVGTLAELRKAKAILNDEKQKLVEKGVKIGDNLQVGMMIEVPAAAVLADQFAKEVDFFSIGTNDLIQYTMAADRGNDNVSYLYQPYNPSVLRLIKHTIDAAHENGIWCGMCGEAAGDNTMFPILLSMGLDEYSMSATSILRIRSLMKKLDTKDLKELANEACFVSETAEENEKLVNDLMKKINK

SEQ ID NO: 88472 - protein, 175 aa, Escherichia coli
SLLNVPAGKDLPEDIYVVIEIPANADPIKYEIDKESGALFVNRFMSTAMFYPCNYGYINHTLSLDGDPVDVLVPTPYPLQPGSVIRCRPVGVLKMTDEAGEDAKLVAVPHSKLSKEYDHIKDVNDLPELLKAQIAHFFEHYKDLEKGKWVKVEGWENAEAAKAEIVASFERAKNK

SEQ ID NO: 88473 - protein, 190 aa, Wolinella succinogenes DSM 1740
MVLMIDNYDSFTYNIVQYCLELGADLRVIRNDEMSVEAIKALSPQKIILSPGPSTPNEAGVTLEVIEKLKGIVPILGVCLGHQAIGQAFGGEVVRAAHMMHGKTSTIKIVVPTPIFEGLPEEFTATRYHSLIVKKENLPDILEPTAYSTDDGEIMALQVRGYPIYGVQFHPESIMSHYGHEIFKNFLERG

SEQ ID NO: 88474 - protein, 399 aa, Oryza sativa
EFTYPQWSEFRVETTAEPCILSRQAPMASYTPATDVAAGDEEEAACLQAFELMCAFTVPMTLKAAIELGLLDALVTAADDDDGRALTADELAARLPDALDKAEAASSVDRMLRLLASCNVVKCSTEAGPAGEPLRRRYSPAPVCRWFTAGGNSHHGSLAPSVLFGIDEDYLSTWHQLAAAVGGGGAVAFERAHGAPMFEYMGTNRRLNTLFNQAMAQQSMIVINKLLDRFHGFDGVGVLVDVGGGTGGTLEMIMSRHKHITGVNFDLPHVISQAPSLAGVKHVAGNMFESIPNGDAIFLKSILHLQNDEECIKILKNCHQALSDNGKLIAVEIVLPAIPEPVPTAQYPFQMDMIMLNNCRGGKERTELEFTKLAMDSSFSGTLRTTYIFANYWALEFNK

SEQ ID NO: 88475 - protein, 201 aa, Xylella fastidiosa Ann-1
MKCSSNNIHSTPCTVHRRIYPQKRDFIQNINNRIDIFHRILSSDLTMNVTFDLTPPSPSQREALIATLNAEERRILLQHGTEAPFCNRLLDNNQLGTYTCRLCGLPLFHSNAKFKSGTGWPSFFEPYTHTHIRKQHDTSHGMIRTEILCARCNSHLGHLFPDGPPPTYERYCLNSVSLTFIPTGTLLPDQLHRGDNTTYRT

SEQ ID NO: 88476 - protein, 175 aa, Escherichia coli
SLLNVPAGKDLPEDIYVVIEIPANADPIKYEIDKESGALFVDRFMSTAMFYPCNYGYINHTLSLNGDPVDVLVPTPYPLQPGSVIRCRPVGVLKMTDEAGEDAKLVAVPHSKLSKEYDHIKDVNDLPELLKAQIAHFFEHYKDLEKGKWVKVEGWENAEAAKAEIVASFERAKNK

SEQ ID NO: 88477 - protein, 175 aa, Escherichia coli
SLLNVPAGKDLPEDIYVVIEIPANADPIKYEIDKESGALFVDRFMSTAMFYPCNYGYINHTLSLDGDPVNVLVPTPYPLQPGSVTRCRPVGVLKMTDEAGEDAKLVAVPHSKLSKEYDHIKDVNDLPELLKAQIAHFFEHYKDLEKGKWVKVEGWENAEAAKAEIVASFERAKNK

SEQ ID NO: 88478 - protein, 62 aa, Methanosarcina mazei Go1
MIPVRCFSCGKVISNYWDEYKRRVTDGEDAAAVLDDLGITRYCCRRMFLSHVELIDVLSPYQ

SEQ ID NO: 88479 - protein, 275 aa, Oryza sativa
  misc_feature (47)..(47): Xaa can be any naturally occurring amino acid
MGSFASPLDAAPAPPTAKPSPPPAPAPANGLVTQEELKRVAAHRAVXMVEPGMTLGLGTGSTAAHALDRLGDLLRSGELAAVAGVPTSLKTEAHAARVGIPMLPLGEAGGIDLSIDGADEVDPELNLVKGRGGSLLREKMIEGSGGRFVVIVDESKLVPRLGCTGAVPVEVVPFGCDHTLGLVRKVFDGLPGFSARLRTVASKDGEGKEEMFVTDNGNYIVEMFFEDGIRGDLNEISDRLLRITGVVEHGMFLGMATSVVVAKKDGTVALLHKKK

SEQ ID NO: 88480 - protein, 355 aa, Phytophthora infestans
MGLCASQMNDNDRQAMAKSREIEAKNEEAHRVEQEKVKLLLLGAGESGKSTVFKQMKILFGAALTEDEKRHCTPIIYNNVVTSMKMLIEQCAEMKLKGDVVCVQDFEDIRTLSDEAEVNLVIGQKIKNLWSDPGIVATWNRRAEFQIIESVKYYFNDLDRIMRDDYAATQQDMLYARVRTSGIVEERYQIDGATFVMYDVGGQRNERKKWIHCFEDVTAVIFVAALSEYDQSLYEDASTNRMIEAITLFDEIINNKFFLNSAMILFLNKKDLFQDKIKKVDPKTVEVFKDFPGGIGDYELGVQYFLGKFMEMNRQPEKEIYHHVTCATDSQNVQVVFNACKDIILKQNIKGSGFM

SEQ ID NO: 88481 - protein, 292 aa, Pseudomonas aeruginosa UCBPP-PA14
MAGRTIRNRQNHAENPVIVRPAACRTAAKGICMRNSPAEALAAACTPTASVRCVWQQLQAEARRAPQEDSVLGPLIDRSILCRSSFWQALSSLLSAKLSIQTVSMDIWLECFADAHGPEAEEAAKDDLAATLLRDPAAENLLVPFLCYKGFHALQCHRVAHQLWNARRRTLARLLQSRVSEVFGVDIHPAVPVGRRVFIDHATGIVIGETASIGNDVSILQKVTLGGTGKEYGDRHPKIRDRAFIAAGATILGNIEIGFASTVGAGSVVLEPVPPYSTVVGVPARILCTNGL

SEQ ID NO: 88482 - protein, 355 aa, Phytophthora palmivora
MGLCASQMSDSDRQAMAKSREIEAKNEEAHRVEHEKVKLLLLGAGESGKSTVFKHMKILYGASLTEEEKRHCTPIIYNNVVTSMKMLIEQCTEMKLKGEVVCAQDFEDIRTLSDEAEVNPVVGQKIKNLWTDPGIVATWNRRAEFQIIESVKYNSNDLDRIMRDDYAATQQDMLYARVRTSGIVEERYQIDGATFVMYDVGGQRNERKKWIHCFEDVTAVIFVAALSEYDQSLYEDASTNRMIEAITLFDEIINNKFFLNSAMILFLNKKDLFQDKIKKVDPKTVDVFKDFPGGIGDYELGVQYFLGKFMEMNRQPEKEIYHHVTCATDSQNVQVVFNACKDITLKQNIKGSGFM

SEQ ID NO: 88483 - protein, 321 aa, Bartonella henselae str. Houston-1
MTQNTFFSLFPHQHLLGIKDLSVQDLTILLDRANANVPFLKKSDKKQSILHGRTQINLFFEASTRTQSSFELAGKRLGADVMSMAIGNSSVKKGETLVDTATTLNAMKPDILVIRHSCAGAAALLAQKVDCCVINAGDGAHEHPTQALLDALTIQRTKGRIEGLTVAICGDILHSRVARSNILSLNALGACVRVIAPSTLLPASIADMSVEVYNTMKEGLKGADVIMMLRLQQERMTGSFIPSIREYFHYFGLHKENLAYAKSDCIILHPGPINRGVEIASDIADGPQSMIHTQVEMGIAVRMAVMEALLDSRLKASGEKK

SEQ ID NO: 88484 - protein, 482 aa, Pelargonium x hortorum
MENKSKQLLSKIATNDGHGENSPYFDGWKAYDRDPFHPSQNPNGVIQMGLAENQLSSDLIEDWVRSNPEASICTLEGVGKFKDVANFQDYHGLLEFRHAVAKFMSRGRGGKVTFDPDRVVMSGGPTGANELIVFCLANPGDAFLLPSPYYPANDRDLQWRTGAQIIPVHCNSSNGFKITREALERSYAQAQESNINVKGVLLTNPSNPLGTILDRDTLKSIVSFVTDNNIHLVIDEIYAATVFAAPEFVSVSEILQEMDDTTCNPDLIHIVYSLSKDLGMPGFRVGIVYSFNDDVVSCARKMSSFGLVSTQTQHLLAAMLSDDVFVERFLAESRSLGRRHGVFTKGLEELGIGCLKSNAGLYFWMDLRKLLEEETFEAEMVLWKVIINEVKLNVSPGSSFHCVEPGWFRVCFANMDDETVHVALKRIRAFVRKKEVGPVKRKRFMDNLNLRLSFSSLRYDESVMLSPHIMVSPHSPLVRART

SEQ ID NO: 88485 - protein, 275 aa, Oryza sativa Japonica Group
MGSTRLLVLLAAASLLLATAVPAARAQEETDHEEEFTYISGDEKGPEHWGKLKPEWAQCGAGEMQSPIDLSHERVKLVRDLGYLDDSYRAAEASIVNRGHDIMVRFDGDAGSVVINGTAYYLRQLHWHSPTEHSVDGRRYDMELHMVHESAEKKAAVIGLLYEVGRPDRFLQKMEPYLKMIADKEDREEKVGMIDPRGARGRASVYYRYMGSLTTPPCTQGVVWTIVKRVRTVSRYQLDLLREAVHDEMENNARPLQAVNNRDISIFRPYPHKRY

SEQ ID NO: 88486 - protein, 474 aa, Magnetococcus sp. MC-1
MSVARTGKVVQVVGPVVDVRFEGELPNILNALHMVRNGERLVLEVATHMGEGTVRAIAMDSTDGVVRGMEVTDTGDTIRVPVGRQTLGRILNVVGEPQDEKGPVETTETLPIHRPAPAFAQQATSAEILETGIKVIDLLAPYAKGGKVGLFGGAGVGKTVLIMELINNVAQEHGGYSVFAGVGERTREGNDLYHEMAESGVIDPNSWENSKAALIYGQMNEPPGARARVALTGLTVAEYFRDLGGQDVLFFVDNIFRFTQAGAEVSALLGRIPSAVGYQPTLGTDMGALQERITTTKTGSITSVQAVYVPADDLTDPAPATTFSHLDATTVLNRAISEMGIYPAVDPLDSTSRVLDPKVVGEEHYHTAREVQRILQTYKSLQDIIAILGMDELSEEDKLVVNRARKIQRFLSQPFHVAEVFTGTKGVYVPVKKTVQGFKELCEGKYDNVPEAAFYMVSDIDAALAKAEKLKAAS

SEQ ID NO: 88487 - protein, 324 aa, Methanosarcina mazei Go1
MMLMTLVDEIKNRSSHVDAAIDELLPVTRPEELYKASRYLVDAGGKRLRPAVLILAAEAVGSNLRSVLPAAVAVELVHNFTLIHDDIMDRDDIRRGMPAVHVKWGEAGAILAGDTLYSKAFEILSKVENEPVRVLKCMDVLSKTCTEICEGQWLDMDFETRKKVTESEYLEMVEKKTSVLYAAAAKIGALLGGASDEVAEALSEYGRLIGIGFQMYDDVLDMTAPEEVLGKVRGSDLMEGKYTLIVINAFEKGVKLDIFGKGEATLEETEAAVRTLTECGSLDYVKNLAISYIEEGKEKLDVLRDCPEKTLLLQIADYMISREY

SEQ ID NO: 88488 - protein, 619 aa, Colwellia psychrerythraea 34H
MKNNFITNIHNRLFSSAHSQKNLRDMVVKLTCCFLSFVATNSVATTPVQQVSKAELPRLWQLVDYHDISHPVIGRKGMVVSQKRIASEVGADILRQGGNAVDAAVAVGFALSVVLPRAGNLAGGGFMLVHLGDEKKTIAIDYRETAPALAYKDVFLDKYGYPIVNKSLKTLSASGVPGTVAGLHYALENYGSMSWSEVIKPAEKLARAGIVVDDDMARFFYKEQMFLSANSETCRVFLKENCQPYLAGEVWVQTDLADSLAYLREQGKSGFYQGDIAKKIVAAMQQGNGLITAKDLADYRVNEVAPIRGTFQGFEILTMPPPSSGGVHLIQMLNMFETLNLENIQQGSAALIHLQTEIFKRAYADRSSFLGDPAFVNVPSEGLTSKAYAKELSKNIKRNKITPSSDIKAGEPSKYESPDTTHFSVMDAEGNVVSSTYTLNHNYGSGITIPGTGILLNNTMDDFSVKPGSPNSYGLIGGTANAIEAKKRPLSSMTPTIVLKDGEPYLATGTPGGSKIITSVFQQLVNVLYFEMNIAEATNAPRFHHQWQPEVLSVERNIPADTVDILKAKGYNIKVSSSLGSLQAIMKHNGVFLGAADPRRAGAAAIAVDVIEQSVKLAK

SEQ ID NO: 88489 - protein, 220 aa, Thermus thermophilus HB27
MFSEIAPRYDLLNRLLSFGADLRWRRRAVDLALEKAPKRILDLATGTGDLALMLKERAPGAEVVGADFAPPMLAIARRKAEARGLEVRFLEADALALPFPDGAFDAVTIAFGFRNFADYEKALGELYRVLAPGGRLVVLEFPPPPKGAFGLVYRVYFQRVLPFLGGLISGNFGAYRYLPESVEAFPAPEALKAMMAAAGFSVRYELLTFGVAAIHVGDRP

SEQ ID NO: 88490 - protein, 123 aa, Arabidopsis thaliana
  misc_feature (17)..(17): Xaa can be any naturally occurring amino acid
  misc_feature (39)..(39): Xaa can be any naturally occurring amino acid
  misc_feature (68)..(68): Xaa can be any naturally occurring amino acid
  misc_feature (86)..(86): Xaa can be any naturally occurring amino acid
  misc_feature (101)..(101): Xaa can be any naturally occurring amino acid
TSRALATLDGPFTPPKXSPSFPFTRIANNYITFITSNVXRVSFMNVLPPILKNKSDTLSYLPYLTFFXFSKEVDYLFPNKWIPCIXFIFDHLFFFLEHLNXPLYYNLTYFTIYKSYHCSNAPS

SEQ ID NO: 88491 - protein, 425 aa, Arabidopsis thaliana
MKPSSPISLTSSSIARKARFSPYLFTLLAFILFVSVLYGEDFMCIFGQLEPNFVLPPSRTPEKNKKSEKLAFAIGKTEESCDVFSGKWVRDEVSRPLYEEWECPYIQPQLTCQEHGRPDKDYQFWRWQPNHCDLPSFNASLMLETLRGKRMMYVGDSLNRGMFVSMICLLHRLIPEDQKSIKTNGSLTVFTAKEYNATIEFYWAPFLLESNSDDAIVHRISDRVVRKGSINKHGRHWKGVDIIIFNTYLWWMTGLKMNILQGSFDDKEKNIVEVSTEDAYRMGMKSMLRWVKNNMDRKKTRVFFTSMSPTHAKGIDWGGEPGQNCYNQTTLIEDPSYWGSDCRKSIMKVIGEVFGRSKTPITLLNITQMSNYRKDAHTSIYKKQWSPLTAEQLENPTSYADCVHWCLPGLQDTWNELLFAKLFYT

SEQ ID NO: 88492 - protein, 269 aa, Zea mays
MAGADDLKVLGLWTSPFVIRVRIVLNLKGLAYEYVEDDLSNKSALLLSSNPVHKTVPVLLHAGRPVNESQIILQYIDEVWAGTGPAVLPRDPYERAAARFWAAYIDDKVKSAWLGMLFECRDEGERAEAVARAGEALGTLEGALRGKPFFGGDGVGFVDAVLGGYLGWFGAVGRIIGRRLIDPAKTPLLAAWEDRFRAADVAKGVVPDDVDKMLAFLETLLANYYSKKTTRWQCWVSACGTFYIEEGAGGAHPQAAGEMGGTLAPTLSL

SEQ ID NO: 88493 - protein, 282 aa, Listeria innocua Clip11262
MKIAYLGPAASFTHAAAAKAFPKEEMVAKSTIPDCIMAIEKEDVDVAVVPIENTIEGSVNITLDYLFHFSSVPVVAEIVLPIAQHLMVHPAHKATWKSVQKVMSHPQALAQCHTFLQAELYGVEREVTPSTAYAAKWVSNNPTELVAAIAPRMAASEYGLEIVQENAQDLELNQTRFFVLSRKPVSILLPKEEEKTSISVILPNNMPGALHKVLSTFAWRDIDLSKIESRPLKTSLGEYFFLIDVLSEGKETLVTNALDEIRLLGGKANKLGTYHVHRLQTT

SEQ ID NO: 88494 - protein, 388 aa, Lactobacillus sakei subsp. sakei 23K
MAYLLPLAFIILLTKLFSHLFARLNLPTVIGELAVGVLFGPACFNLIQSNDFITSFAQLGVIFLMFMAGIEGDLSQLLKYWKPSLIVATLGVILPTLGAFFICVTLFHFTVSTAIFIGLILSATSVSISIQVFKEMDYLNTEEGMIILGAAVADDIICVILLGIFSSIMQPASGQSLNLVNLILPKLLFFILAFVLGKWFVPLILNLAKRLTASENITSIAITLCLLFASLATYLGMSDVLGAYFVGLAISQTDYKNVLTEKIETIGYSVFIPVFFVSIGLNIRLAHLQDNLSFIVLTIIIAIIGKQLGGWLGTRICGLSSSAGHIVGAGMVSRGEMALVVAQAAINAHLIDDSHYTAMIIVTVVTTLIAPLLLKIFIMHQAQKMSTN

SEQ ID NO: 88495 - protein, 79 aa, Zea mays
LGQSKKADDMSRVAGLDNQGIVVLQRQIMKEQDEGLEKLEETVLSTKHIALAVNEELTLHTRLIDDLDVCACFYLLSPS

SEQ ID NO: 88496 - protein, 123 aa, Brassica oleracea var. botrytis
GSVVLILFCPAFSINTLSSTESLRISSNRTLVSPGNNFELGFFRTNSSSRWYLGIWYKKLLDRTYVWVANRDNPLSNAIGTLKISGNNLVLLGHTNKSVWSTNLTRGNERLRWWQTFSLMETS

SEQ ID NO: 88497 - protein, 323 aa, Lactobacillus sakei subsp. sakei 23K
MSEQYFDPKLKIFALNSNKPLAEKIAAEVGVPLGKSSVKRFSDGEIQINIEESIRGDEIFLIQSTSAPVNDNLMEILIMIDALRRASAKTINVVLPYYGYARQDRKARSREPITAKLVANMLTMAGADRILALDLHAVQIQGFFDIPVDHLMGAPLLADYFLSNDLAENAVVVSPDHGGVTRARKLADFLKTPIAIIDKRRPRPNVSEVMNIIGNVNGKRAIIIDDMIDTAGTITLAAQALKDAGATEVFACCTHPVLSGPAIQRIEDSVIKQMIVTDSIDLPKEKLIDKMVQVSVGPLIGDAIKRIHENKPVSPLFENRFKR

SEQ ID NO: 88498 - protein, 240 aa, Zea mays
  misc_feature (148)..(148): Xaa can be any naturally occurring amino acid
MQARVVVFPVKGRAWCFALPRASAAAPAADGALPRPTLRDLWRGISSGSRTAPEKAEAVVDFVADKMNRAWVGFGSAPEGSMKSRIHSFGLKLLSRVRPSEVLLKSVTKDVSALEIVHPASINSRLVRRRLRHIAVRGASVHKKFLYXPLPNIPFFWVLFRAYSHWRALQGSERLELLVSDCSDKWKVLEEKINSVKDGKPSENAGNSPWKLRPSEKLDRFLEGRNLDEGLDCDTILSIC

SEQ ID NO: 88499 - protein, 122 aa, Glycine max
  misc_feature (99)..(99): Xaa can be any naturally occurring amino acid
VLANADTPEDALAARNNGAEGIGLCRTEHMFFASDERIKAVRQMIMAPTVELRQQALDRLLSYQRSDFEGIFRAMDGLSVTIRLLDPPLHEFLAEGNVXEIVRELCSETGANQEDALARIEK

SEQ ID NO: 88500 - protein, 227 aa, Ralstonia solanacearum GMI1000
MARTAAMPMPMPQITHIVLVRHGETDWNRERRLQGQLDVPLNAQGREQAAQLGRALAREPFDAIYASDLSRARETAQALAGEVGKAVRDDTGLRERCYGGFEGLTYAEVAERHPAEFEAWQSRVPEFAPPGGGETLAGFHARAVDAALRLIRRHPGERIALVSHGGVLDCLYRHANAMTLTEPRQHALRNASINRLSSDGHQLTVLQWGDVAHLDLLVLDEVDRRVP

SEQ ID NO: 88501 - protein, 923 aa, Sesbania rostrata
MMELPDIWILRLAVACALCLYIFLRSASASEEFESIACCADSNYTDPLTTLNYTTDYSWFSDKRSCRQIPEAGLNNRSNENVRLFDIDEGKRCYNLPTIKNKVYLIRGTFPFDSTNSSFYVSIGITQLGAVRSSRLQGLEVEGVFRATKDYIDFCLVKGEVNPFISQLELRPLPEEYLHDLPTSVLKLISRNNLGGSKDDIRFPADRSDRIWKATSSPSSAFPLSFNVSNVDLQANVTPPLQVLQTAITHPERLEFIHNGLETEDYGYRVFLYFLEINRTLKAGQRVFDIYVNNEIKKEKFDVLDGGSNYGYTVLNVSANGSLNVTLVKASESEFGPLLNAYEILQVRSWVEETNQTDVEVIQKMREELLLQNQENKALESWTGDPCILFPWKGIACDGSNGSTVITKLDLSLSNLKGPIPSSVTEMTNLKILNLSHNSFDGYIPSFPLSSLLISIDLSYNGLRGTLPESITSPLHLKSLYFGCNQHMSEEDPANLNSSLINTDYGRCKSKEHKFGQGIVIGAITCGSLLVTLAVGILFVCRYRQKLLPWEGFGGKNYPMATNVIFSLPSKDDFFIKSVSIQTFTLEYIEVATERYKTLIGEGGFGSVYRGTLNDGQEVAVKVRSATSTQGTREFDNELNLLSAIQHENLVPLLGYCNENDQQILVYPFMSNGSLQDRLYGEPAKRKVLDWPTRLSIALGAARGLAYLHTFPGRPVIHRDVKSSNILLDHSMCAKVADFGFSKYAPQEGDSNVSLEVRGTAGYLDPEYYKTQQLSEKSDVFSFGVVLLEIVSGREPLNIQRPRNEWSLVEWAKPYIRASKVEEIVDPGIKGGYHAEAMWRVVEVALQCLEPFSAYRPCMVDIVRELEDALIIENNASEYMKSIDSLGGSNRYSIVIEKRVLPSTTSTAESTITAQSLSHPQPR

SEQ ID NO: 88502 - protein, 435 aa, Pelargonium x hortorum
MGLAENQLSSDLIEDWVRSNPEASICTLEGVGKFKDVANFQDYHGLLEFRHAVAKFMSRGRGGKVTFDPDRVVMSGGPTGANELIVFCLANPGDAFLLPSPYYPANDRDLQWRTGAQIIPVHCNSSNGFKITREALERSYAQAQESNINVKGVLLTNPSNPLGTILDRDTLKSIVSFVTDNNIHLVIDEIYAATVFAAPEFVSVSEILQEMDDTTCNPDLIHIVYSLSKDLGMPGFRVGIVYSFNDDVVSCARKMSSFGLVSTQTQHLLAAMLSDDVFVERFLAESRSLGRRHGVFTKGLEELGIGCLKSNAGLYFWMDLRKLLEEETFEAEMVLWKVIINEVKLNVSPGSSFHCVEPGWFRVCFANMDDETVHVALKRIRAFVRKKEVGPVKRKRFMDNLNLRLSFSSLRYDESVMLSPHIMVSPHSPLVRART

SEQ ID NO: 88503 - protein, 1476 aa, Neurospora crassa
MASTTQIKTPQEAVARIAYLASDVVVSVQPSLAAESDFSATLKSLASSRTQSLVAKAADAVTEIIPVRHNNDPLLSVFTPIRSGRLVSVTTTSEVLLPSIAHLYKLAQLPVVLHVALGPKSLPDYTAITSIRNSGWTFLQSNSLQEAQDLALTAHALAVQSGKGVIHFFDPSSSASEQPIAAEDLSLVQEILNLDNVRRFQSASISGSSIYANDGRVAVVSEQSEPVASQTVLDARQVEAATATATDSLAPAQDGSDDAFEYSGPSNAENALFVFGSGSPLFAQAIAQAQSDDSFAKAGVLTARLYRPWLGAKLLEAIPKSVKRVAVLEQVSRKTTKWGPLLIDVLTSVKSGPGGVQTIVGHQLGYISQETVVQALRGIFQNLTSEKPVQNLEVGEREAPKEASEYGLEKPKLETAYTKILDQLFGERAYIANSIEKDNAGISNTISATPEYGFGALLARKERKQKFVSEVKEAASNGQFSSDAPKQALAKWVANAEDSKKVEEVASEAVSKLSEDGSDLSKSLLEYKQFFRKQSLWLVGSDAWSYDLGNSGVHHVLASGENVNLLIIDSTPYSERAAADANRRKKDIGLYAMNFGNAYVASTAVYSSYTQVLQAMDEADKFNGPSVVLAYLPYFGEHDSALTVLQETKKAVDIGYWPLYRWNPENEKKGEPSFSLDSERIKKELKEFLDRDNHLTQLMKKEPSFGAVLSEDFGTEIRAQQKRKAKDAYNQLLEGLFGAPLTILYASDNGNAISLSKRLGNRGRARGLKTTVMSMEDYPVEDLATEENIVFITSTAGQGEFPQNGLSFWHAVKDNTSLDLANVRYSVFGLGDSHYWPRKEDKIYYNKPAKDLDRVLANFGAKPLAPIGLGDDQDPDGFQTGYSEWEPKLWEALGVANVDGLPEEPAPRTNEDIKIESNYLRGTIVQGLNDTSTLAISPDDCQLTKFHGTYMQDDRDIRDERKAQGLEPAYSFMIRCRLPGGVSTAKQWVQMDDIANELGNETMKLTTRQTFQFHGVVKSKLKPAMQAINRALMTTIAACGDVNRNVMCSPLPAHSKYHRAVHACAKRISDHLLPNTTAYHEIWLTDDDGAKTQVGGNAVQDFEPLYGPTYLPRKFKVSIAIPPHNDVDVYAHDIGLIAIKNEDGSLAGFNLLAGGGMGATHNNKKTYPQTGRMLGFVTAADVHLACEKVMLVQRDNGDRKNRKHARLKYTIDDMGVDVFKAKVEEYWGQKFEEPRAFHFDSNVDTFGWTKDETGLNHFTMFIENGRIEDTAEFQMKTGLREIAKVHKGEFRLTPNQHLILSNVADEDKPELEKLLAQYKLDNLHHSGLRLSSSACVAFPTCGLAMAESERYLPVLITKLEGVLEEVGLKQDSIVMRMTGCPNGCARPWLAEVAFVGKAYGAYNMYLGGGYHGQRLNKLYRSSIKEEEILTIMKGLLRRYAKEREEGERFGDWTIRAGIIKATTDGRNFHEGVSEIF

SEQ ID NO: 88504 - protein, 884 aa, Methanosarcina mazei Go1
MSKFVYFFGKDVTDGKSSMKDLLGGKGANLAEMANLGVPVPPGFTISTEVCVLYLKEGKYPEEVLRQVEEAIDKLEKLNGKKLGDPEDPLLVSVRSGARVSMPGMMDTVLNLGLTDKSVIGLANKVNDERFAYDCYRRFIAMFGDVVLGVEFRKFDSLIDDKKKELGVKSDTDLDSKALQELAERFKEVIKLEKGFEFPQDPKVQLQMAINAVFDSWNNQRAITYRKLNAIDDSWGTAVNVQTMVYGNRGNTSGTGVAFTRNPSTGEKKFFGEYLINAQGEDVVAGIRTPDYIDTLGNKIPEAYAQLVDICQKLEAHFKDMQDIEFTIQEGKLYMLQTRTGKRTAAAAVKIATEMVAEGLINKETAVKRVNAEHIDLLLHPRIDPKAKLEVIAKGLPASPGAAVGKVVFTAEDAEEMAENGEKTILVRTETSPEDIGGMAAAQGVLTVRGGMTSHAAVVGRGMGKPCVVGCGEISIDMKNALFMVNGFTIKEHDYITIDGSVGSVIIGKVDLIDAEINEDLKKLLIWADKIRTLGVRTNADNPADAALARELGAEGIGLCRTEHMFFGEDRIPAVREMIMAEDEKSRKKALKKLLPMQKEDFLGIFRSMEGLPVTIRLLDPPLHEFLPDKEELDTKLRELETSGDCGKIDGVKKVIQRVVSLKELNPMLGHRGCRLGITYPEIYNMQVRAIMEAACELTAEGMEVVPEIMIPLVGIVKELSLSREEVCKTAEAVMAEKGMKIDYKVGTMIELPRAAIVADQIAKEADFFSFGTNDLTQTTFGFSRDDVSKFVPIYQKAGILEHDPFAVLDQEGVGEIMKIGISKGRSVKPKLKMGICGEHGGEPKSIAFAHEIGIDYVSCSPYRVPIARLVAAQSTMEMRDAKK

SEQ ID NO: 88505 - protein, 367 aa, Arabidopsis thaliana
MSRRSLTLLKNLARNANGSGIQTRSVTYMPRPGDGAPRAVTLIPGDGIGPLVTNAVEQVMEAMHAPIFFEKYDVHGEMSRVPPEVMESIRKNKVCLKGGLKTPVGGGVSSLNVQLRKELDLFASLVNCFNLPGLPTRHENVDIVVIRENTEGEYAGLEHEVVPGVVESLKVITNFCSERIAKYAFEYAYLNNRKKVTAVHKANIMKLADGLFLESCREVAKKYPSITYNEIIVDNCCMQLVAKPEQFDVMVTPNLYGNLVANTAAGIAGGTGVMPGGNVGADHAVFEQGASAGNVGKDKIVLENKANPVALLLSSAMMLRHLQFPSFADRLETAVKKVIAEGKFRTKDLGGTSTTQEVVDAVIAKLD

SEQ ID NO: 88506 - protein, 352 aa, Samanea saman
MASNGAREPLLPQSPDPAPPKTNGQVSRRRYLRCRSAPLANVDPPEKTDIGSIHRFDSILGKLHPSFRTVALYLIGYLGIGAVIFYLVRHQITGKKTEGVLDAIYFTIVTMTTVGYGDLVPNSDLTKLLACAFVFTGMALVGLILSKAADYLVEKQEALIIKALHGNHEVGPTKILQEAEVNRKWYKFFVVFVLLVALIIMGTIFLVAVEKLDVIDAFYCVCCTITTLGYGDKSFSSEGGRVFAVFWILTGTICLAQLFLCIAEMNTEKRRKEITEMVLKRRITIADLEAADIDHDGTVGVAEFIIYKLKEMGKISQEDIALIMQQFEELDVDQSGTLSPSDLTLAQAPWPS

SEQ ID NO: 88507 - protein, 122 aa, Triticum aestivum
MAGTTTTTGGGGGAAQGGRRALGLLASAAKRKDGFVQLLLMSGILMMSLRSLSQKHRVRDLANDAAELSLEQEHISHRMRELQDELDREAGADPSGAFASHLRRIFAAHPPTPAAAPATDDH

SEQ ID NO: 88508 - protein, 343 aa, Oceanobacter sp. RED65
MTDLNSNKAAVLGGGSFGTAVANILAANGFQVDLWMRNEKTIEDIKQERENKQYLPGVKLHDNIQATGDLESAIKDSQVLFYAVPSKSFRELVERTQGLVVPEQMLISTTKGIEPEGFNLMSDILKGTFPSNPIGVISGPNLAKEIGQGQPAATVIGSKDKRVRDFIQKSLSCNFFRVYANADMYGVELGGALKNIYAVITGMAAALGFGENTKATLITRSLAEMSRFAVSQGANPMTFLGLAGVGDLVATCVSPLSRNYRVGYAVGKGETLEQAVEALGEVAEGVNTVRYIYHEANEQGIYMPLASALYAVLFEGAEVSQLANSLMTGEYNTDVEFSLPRGA

SEQ ID NO: 88509 - protein, 148 aa, Spinacia oleracea
MEQTFIMIKPDGVQRGLVGEIISRFEKKGFSLKALKFVNVDRPFAEKHYADLSAKPFFNGLVEYIVSGPVVAMVWEGKGVVATGRKLIGATNPLASEPGTIRGDFAIDIGRNVIHGSDAVDSATKEIALWFPDGVVHWQSSLHSWIYE

SEQ ID NO: 88510 - protein, 490 aa, Clostridium perfringens str. 13
MDNKNFQSKTGFNLENTYLTLPNIFFSEQNPKGSKNPKLIKFNTSLAEELGLNEEVLNSDFGLNIFAGNETFPGIVPIAQAYAGHQFGHFTMLGDGRALLLGEHVTKDCKRYDVQLKGSGRTIYSRGGDGKAALAPMLREYIISEGMHGLGIPTTRSLAVVSTGEEVLRERFEQGAILTRIASSHIRVGTFAYAAQWGTLEDLKSLADYTIKRHFPNIADNENKYILFLEEVINRQAELIVKWQSVGFIHGVMNTDNMVISGETIDYGPCAFMDTYDTNTVFSSIDYAGRYAYGNQPNMALWNLARFSEALLPLLNPNLDEAVNIAKKSISNFSKLYKKYWFNKMRTKLGLFTEKENDELLIEGLLSTMQKYEADFTNTFVSLTLNKFEDEKVFSSDEFKTWYALWQNRLKEENRPQEEVRNLMMNNNPYIIPRNHLVEEALKNAEKGDFTFMDNLLEALKNPYSYSKDLEKYTKLPEKSDTPYVTYCGT

SEQ ID NO: 88511 - protein, 171 aa, Corynebacterium efficiens
MRQNRRFLRCQVTEQIIPRVGIASDAHQIEAGKPCWIACLLFDGVDGCEGHSDGDVVAHAIVDALLSASGLGDLGSFVGVGRPEYDGVSGTQLLIEVRELLITRGFTIGNVAAQLVGQTPKFGPRREEAQQVISDILGAPCFLSATTTDHMGFTGRGEGRAALATAVVWTG

SEQ ID NO: 88512 - protein, 492 aa, Oryza sativa Indica Group
MVLSKAVSESDMSVHSTFASRYVRASLPRYRMPENSIPKEAAYQIINDELMLDGNPRLNLASFVTTWMEPECDKLIMAAINKNYVDMDEYPVTTELQNRCVNMIAHLFHAPLGEDETAVGVGTVGSSEAIMLAGLAFKRRWQNKRKAEGKPFDKPNIITGANVQVCWEKFARYFEVELKEVKLRDGYYVMDPEKAVDMVDENTICVAAILGSTLNGEFEDVKLLNDLLDKKNKETGWETPIHVDAASGGFIAPFLYPELEWDFRLPWVKSINVSGHKYGLVYAGIGWCIWRNKEDLPEELIFHINYLGADQPTFTLNFSKGSSQVIAQYYQLIRHGFEGYRNIMENCHENAMVLKEGLVKTGRFDIVSKDEGVPLVAFSLKDRSRHDEFEISDMLRRFGWIVPAYTMPPDAQHVTVLRVVIREEFSRTLAERLVLDIEKVMYQLDALPSRLMPPVPPAPLLVVAKKSELETQRSVTEAWKKFVLAKRTNGVC

SEQ ID NO: 88513 - protein, 637 aa, Desulfococcus oleovorans Hxd3
METGLFYNPALTLALALALGMIAQALAHQLRMPGIVLLLAAGVALGPDGAELIHPQALGPALTILTGFAVAVILFEGGMNLKFNRLRRAKRSIRQLVLFGGLVTVIGGAVAARFILDWPWKNAILFGTLVMVTGPTVINPLLKRLKVKRSVATVLEAEGVLIDALGAVVAIVALEAALSPSHGSPMVWIWHVVSRLGFGAISGGVAAGLLVLLYRVRTLVPEGSENVFTLSIVLALFQLSNTIVPESGIAAVTVAGIIVGNTRMQGIKRLVEFKEELTVLLIGMLFVLLAADVRLAQVTQLGWPGLGVVLALMFLVRPAAVFTGTAFSELAWKERLFVAWIGPRGIVAAAVASFFAAAFADRGLSGGYELRALVFLVIAVTVVFAGLTGGLMAGMLGLRRPSQMGWVILGANDVARNVAKLFKENGQEVVCIDANTDHCNAAEADCTRVIYGNGLQTRNLLRAEIDTRRGALALTANDEVNVLFTEKVKQEARGITLYAALKTDSSFTPKMLHQADVALAFGATADIDTWTRRFKAHHVFLQRWRLDTSGEAAAETHISGDYTGKGMMIAASLREETLFPVGDTTRFKMGDEIMVFVFEPELSAVEKFLSDTGWTRLESRDKAEVSASVCYLEPEKK

SEQ ID NO: 88514 - protein, 323 aa, Gibberella zeae PH-1
MPKPVISVLGSLNIDLVSYVPHHPLPGETITSSQFNVFPGGKGANQAVACAKLSRTSDFKDASVDVVMIGAIGADAYGTTLLDSLKSYDVGTDSIIVNRDGGAGSQSGIAMIIVDEPTGQNRIILSPGANNSLQPSQFQTIPGPAPALLIMQLEIPLETVIQAFQAAKATGTPVLLNPAPAQALPTEIYKGLAHLILNETEAALLSDKDELEFENISVVEQAASDFLARGVHNVVITLGGKGAYFANDTGAKGLIPAQKVKVVDTTAAGDTFIGSYAVEVALAGQRAKTFDIEKAVRSGIRASSHTVARRGAQVSIPWKDELE

SEQ ID NO: 88515 - protein, 102 aa, Oryza sativa Japonica Group
MAAAGGGGAGAAGGGKVSFKIILTSDPKLPFKVFSVPEAAPFTAVLKFAAEEFKVPPQTSAIITNDGVGINPQQSAGNVFLKHGSELRLIPRDRVGALAAPF

SEQ ID NO: 88516 - protein, 319 aa, Xylella fastidiosa Ann-1
MTIYNTILDTIGHTPVVKLNRIAPAHVDLYIKVESFNPSGSVKDRLALAIIIDAEQQGLLKPGDTIVEATSGNTGVALAMIAAARSYTFVATMVETFSIERRKLMRAYGAKVILTPAAERGSGMVRKAKELAEQHGWFLASQFSNPANPAYHRNTTAAEILRDFAGRRLDHFVSGWGTGGTLTGVGEVLKIARPDIKITASEPASAALLQGKEWQPHKIQGWTPDFVPEVLNRSVPHHILSVTDDDAITVARRLAAEEGVFSGISGGASVATALQIAQQAEQGAVILAMLPDTGERYFSTPLFADINEHSDDAWLASLG

SEQ ID NO: 88517 - protein, 646 aa, Medicago truncatula
MEETEEREENVEPEPNNPENENEEECNAVVVVEEIQGLIESVVQFGEYRRTQRKESHNLARRFKHMLPLMEDLRDLCHPAPRKGVVWLKNLRDALFFARELLKLCSQGSKIHLAWEGEMVMIKFQKVYEKLSQAFDGVPCDELGISDEVKEQLELMHVQLRRARRRTDTQDIELAMDMMVVFSDEDDRNADSAIIERLAKKLELRSVEDLEVETVAVGNLVRERKGKQSESTKKIIDLLNRFKRTAGMEETDVVFDDDHAMPNKMLGRSTSLVIPHEFLCPITLEIMSDPVIIASGQTYERESIEKWFKSNHKTCPKTRQPLEHLQLAPNCALRNLIAEWCENNNFKLPKICSSCQETTPTENQEEIPCLVESLSSINLEHQRKAVERIRLLSKENSENRILVAENGGIPPLVQILSYPDSKIKEHAVTALLNLSIDEANKKLISKEGAIPAIIEVLENGSIVAKENSAAALFSLSMIDENKEVVGMSNGIPALVNLLQNGTVRGKKDAATALFSLSLTHANKERAIKAGIVTALLQLLKDKNLGMIDEALSILLLLVLTPEGRHEVGQLSFIETLVEFTREGTPKNKECAASVLLELCSSNSSFTLAALQFGVYEHLIEIKESGTNRAQRKANAILDLIKRSEQI

SEQ ID NO: 88518 - protein, 301 aa, Oryza sativa Indica Group
MSNPELLSEKKASLVETLKNKLQALAEQHVDVLESLAPVVRKRVDVLIEIQSQHDELEAKFLEEKSALEAKYHKLYGPLYSKRSEIVSGVLEVEGETEEREEKGVPDFWLKAMKNNEILAEEIHESDEEALKYLKDIKWCRIDDLKGFKFEFFFDTNPFFKNQVLTKTYHMIDEDDEPILEKAIGTEIEWHPGNCLTQEVLTKESLESTKPITKTEEYESFFNFFSPPQVPEDDAKIDENTVEELQNQMERDYDIASTLRDKIIPHAVSWFTGEAVQDEDYGASWVDDEEDDDDEYSDEEA

SEQ ID NO: 88519 - protein, 186 aa, Lactobacillus acidophilus NCFM
MNLPNKLTVFRIFLIPVFMLIIIFGGNAHTTVGNFTVVWSWVIAAIVFAVASATDWFDGHIARSRNLVTNFGKFADPLADKMLTMTAFIFLVELKLAPAWVVAIIVCRELAVTGLRLILAENKGQVLAAKMPGKIKTTCQMLSIIFLLIGNFWYIGTILLYLALIFTIYSGYDYFHKSWGVFKGSM

SEQ ID NO: 88520 - protein, 488 aa, Xylella fastidiosa Ann-1
MSERQRRTRILATLGPATDPPGVLDALFKAGVNVVRLNFSHGDVSDQARRVAEVRAAAAHVGVEIGILADLPGPKIRIGRFTGGKVRLVAGARFDLLADSNASLGDATQVGVSYLGLPQDVAAGDVLLLDDGLMQLQVVQVQGARIVTTVLNDGVLSDRKGLNKQGGGLSLGALTDRDRELIRIVARMGIDFIAVSFCRHAEEMHEARRIARECGCDAALVSKIERAEAIVNLAEIVAASDVVMVARGDLGVEIGDAQLPGLQKKIIKEALLQNKVVITATQMLQSMVESPMPTRAEVLDVANAVIDGTDAVMLSAETATGDYPVKAVEAMARICLGAEHQFEFDTDYEMAQRNLQRADHAIAMATMFLSEHICLGGVVALTESGTTPRFLSRFRSHVPIYAFTRHEDVRRRMVLMRGVFPMRFDSRGLTPREAARATIRLLVECGCMSPGDRVVFTSGEHMETLGATNTLRLLEVGADGCVSGLWEL

SEQ ID NO: 88521 - protein, 593 aa, Neisseria meningitidis
MALVELKVPDIGGHENVDIIAVEVNVGDTIAVDDTLITLETDKATMDIPAEVAGVVKEVKVKVGDKISEGGLIVVVEAEGAATAPKAEAPATPAQEAPKAAAPAPQAAQFGGSADAEYDVVLGGGPGGYSAAFAAADEGLKVAIVERYKTLGGVCLNVGCIPSKALLHNAAVIDEVRHLAANGIKYPEPELDIDMLRAYKNGVVSRLTGGLAGMAKRRKVDVIQGDGQFLDPHHLEVSLTAGDAYEQAAPTGEKKIVAFKNCIIAAGSRVTKLPFIPEDPRIIDSSGALALKEVPGKLLIIGAGIIGLEMGTVYSTLGSRLDVVEMMDGLMQGADRDLVKVWQKQNEYRFDNIMVNTKTVAVEPKEDGVYVTFEGANAPKEPQRYDAVLVAAGRAPNGKLISAEKAGVAVTDRGFIEVDKQMRTNVPHIYAIVDIVGQPMLAHKAVHEGHVAAENCAGHKAYFDARVIPGVAYTSPEVAWVGETELSAKASGRKITKANFPWAASGRAIANGCDNGFTKLIFDAETGRIIGGGIVGPNGGDMIGEVCLAIEMGCDAADIGKTIHPHPTLGESIGMAAEVALGTCTDLPPQKKK

SEQ ID NO: 88522 - protein, 489 aa, Xylella fastidiosa Ann-1
MVPQARCMMSFACVGLGGEDRRGIARDAGIFWCVVRGITGIGGVSDACLPVLAGVGTAWRCSQAVAVIGGRLVGWTLGVYLLPDEPGQWPFVSIKEIEMSIVRMTDLALSGKRVLIRQDLNVPIDQGRITSEQRIIASLPTIRVALERGAAVMVTSHLGRPKEGVWSEEDSLAPVAKRLSQLLGIEVPLRRDWVDGVQVAPGQLVLLENCRMNVGEAQNDEALARKYAALCDVFVMDAFGTAHRAQASTHGVICCAAIAAGGPLLMAELDALSRGLKHPVKPLLAIVGGSKVSTKLELLSNLVNNVEQLITGGGIANTFLAAAGYSIGKSLYEADLIETAREIIIVAKARGAEIPLPTDVVVAKQFLPGVTATVKTVDAIVADDLILDIGPQTARHYAALIETAATVVWNGPVGVFEFDAFSKGTEVLARAVAASSAFSIAGGGDTLAAIDKYGVADQISYISTGGGAFLEFLEGKTLPAVAALQARSG

SEQ ID NO: 88523 - protein, 288 aa, Rhodopseudomonas palustris CGA009
MDVTNRIERALTEALNQADMAGCPPRLAAAMRSAVFPRGARVRPRLCHSVALACGEDNPGITEAAGAALELMHCASLIHDDLPCFDGADLRRGRPSVHKAFGEPLAVLAGDAMIVLAFQTIARAEGQADRLLKLTQIIGGAVGVPFGIVAGQAWECETEINLAHYHRSKTGALFVAATAMGAASAGSDPEPWRMVGEKIGEAYQVADDLRDAAADVEEIGKPVGQDVAHDRPSAVREMGIDGAIYHLKSLVRGAVEAMPECTNGNELRSLIMSEATRLVPAKLAATAA

SEQ ID NO: 88524 - protein, 583 aa, Thermoanaerobacter tengcongensis MB4
MRRTKIVCTIGPASEDYNILRKLIEKGMNVARLNFSHGDFEEHGARIDNIKKIREELGLPVAILLDTKGPEIRTGKFKNGGVELKEGQTFTLTTRDVIGDETVVSVSYKGLPQDVSRGTQILIDDGLISLRVVDVKGEDIICVVENSGFLGDHKGVNVPGVKLNLPALTQKDIEDIEFGIKKGIDMIAASFVRKAADVLAIRRLLEDNKADHIQIIAKIENREGVENIDEIIRVSDGIMVARGDLGVEIPLEEIPIVQKMIIKKCNEAGKPVITATQMLDSMMRNPRPTRAEVTDVANAILDGTDAIMLSGETAQGKYPVEAFETMARIAEKTEVYVQYRDIVGVGTERNVSITNAISHATCTTARDIGASAIITCTKSGYTARMVSRYRPSSPIIATTPSEQVARKLSIVWGVYPLVTKEVSTTDEMIDVAIESALKAGLIRNGDIVVISAGIPVAMTGTTNMLKVHIVGDVILRGIGIGSKSTTGTVCIIHDIGKDRDKFREGDIIVTTKTERDFMPLIEKASAIITEEGGLTSHAAIVGLNLGIPVIVGCEGATSKLQDGMTVTVDTTRGLVYKGIVNIK

SEQ ID NO: 88525 - protein, 373 aa, Rhodopseudomonas palustris CGA009
MVSLSLRDRLLGWRDSILSNPRFQRFAAVFPLMRPVARRRAVAMFDLVAGFVYSQILLACVQLRLFDIVAERPATAEDLAAQLSLPVDSLRVLLDGAVALRLLQMRSGHRYGLGQLGAELRGNPGVLALVAHHAMLYRDLADPVALLRAPRGGGELAAYWAYVRGERPGELPADAIASYTALMAASQPMIAREVLHVYSFRDHRCLLDVGGGDGSFLSAVAAQAPQLRCMLFDLPAVAEKAAARFEANGLKGRATAVGGSFTTDPLPEGADIVSLVRVIHDHDDEVVEALLRAVHKALPDNGKLLIAEPIAGLPGTAAISDAYFAFYLYAMGSGKARSFPRLQAMLENAGFSQVTLHPVPMPLVASVITASKR

SEQ ID NO: 88526 - protein, 594 aa, Xylella fastidiosa Ann-1
MSFSKHFGKLMLATCLSLSAAPAFSYSISHGKVVDDKGNQIQLRGVNWFGFETGDHVVNGLWARNWKEFITQLQGMGFNAIRLPFCPANLNSNTSPSSIDYSRNPDLQGLSSLQILDKVVKELSDRRMYVLLDHHRPDCSAISELWHTDSYSEKQWIDDLRFVAHRYANVPGVIGLDVKNEPHGRATWGTGDFQTDWNTAVEHAAAAILEAAPKWVIGIEGIGENPICSSTIGHFWGENLEPMDCTPLKVPADHLLLMPHVYGPDVYVQPYFNSPDFPNNMAAIWDKHFGHFAKAGYAMAIGEFGGKYGEGDPRDIAWQNAFVDYLISIGVTDAFYWAANQNSGDTGGMVGNDWTTPRDDKVKLLNKLWNAGGGASGGSGSGAGGGSGGGAGAGSGSGAGGGSGGGAGAGSGSGAGGGSGSGAGAGSGSGAGGGSGSGAGGGSGGGAGAGSGSGAGGGSGSGAGVGSGSGAGGGSGSGAGAGSGSGAGGGSGSGAGAGSGSGAGGGSDPTKSKISVNTIVDSDWHTGYCERIQVTNTSDSPNTWTVTIPIKGKIQTLWSARWSVKDNALTAFGMDWNKTLDPKGRTEFGFCSNY

SEQ ID NO: 88527 - protein, 143 aa, Triticum aestivum
NKFVQKSRLVPVRNSRDIVDPRVRSSIVEAKSEHNEFAQKKRELEMQEKKYHEELKMEIEGTTFSNLSNKKADSAADVADEDEKAAIEQAEKDADDIAKSVVSRRKRALMEAMKISNDRKKTPVDLLKQRKKAAESSASAKRR

SEQ ID NO: 88528 - protein, 318 aa, Arabidopsis thaliana
  misc_feature (286)..(286): Xaa can be any naturally occurring amino acid
MAGGGNRRDEGSITIQSTNLFAALDTRKKKKKSDKAGKSKGSSKSREPEKEPEPQVYWAPTPLKVKSWADIDDEDDDDDYYATTAPPQSGWSTSLPSHTDSKDVHVEESESEEDILDEGDDDVEEEQEQETEVQVHPEPEVKKAPEVPAPPKEAERQLSKKERKKKELAELEALLADFGVAPKENNGLEESQEAGQEKKEDVNGEGEKKENAAGGESKASKKKKKKDKQKEVKESQEQQANNNADAVDEAAGSEPTEEESPIDVKERIKKLASMKKKKSGKEVDAXAKAAAEEAAARRKKLAAAKKKEKNHYNQQPVR

SEQ ID NO: 88529 - protein, 100 aa, Brassica napus
  misc_feature (9)..(9): Xaa can be any naturally occurring amino acid
  misc_feature (24)..(24): Xaa can be any naturally occurring amino acid
  misc_feature (34)..(34): Xaa can be any naturally occurring amino acid
  misc_feature (41)..(41): Xaa can be any naturally occurring amino acid
  misc_feature (43)..(43): Xaa can be any naturally occurring amino acid
  misc_feature (49)..(51): Xaa can be any naturally occurring amino acid
  misc_feature (53)..(58): Xaa can be any naturally occurring amino acid
MEDEEGIGXILARATELRLKIADXIDTSSTDVSXPREGKKXEXAGNQEXXXDXXXXXXVFEEFFFSPPPRGGGPGGGEKKKTGGGGGGGGGGGGGPAPPP

SEQ ID NO: 88530 - protein, 230 aa, Thermus thermophilus HB27
MSVYRFEDKTPAVHPTAFIAPGAYVVGAVEVGEGASIWFGAVVRGDLERVVVGPGTNVQDGAVLHADPGFPCLLGPEVTVGHRAVVHGAVVEEGALVGMGAVVLNGARIGKNAVVGAGAVVPPGMEVPEGRLALGVPARVVRPIDPPGNAPRYRALAERYRKALFPVAPPRRYRLTLRGQDALNPFSEVHLRLKRTRREALEVLRRAAQGFPLDPEEALPLLAEGLLAPE

SEQ ID NO: 88531 - protein, 547 aa, Clostridium perfringens str. 13
MAYKALYREWRPQTFNDVVGQEHITTTLKNQIINERTAHAYLFCGTRGTGKTSTAKVMAKALNCLDLKDGEPCNQCEMCKKINEGLAIDITELDAASNNGVDKIRDIIDDVQYPPQEARFKVYIMDEVHMLSIGAVNAFLKTLEEPPKNVVFILATTDPQKLPITILSRCQRFDFKRISRKDITGRLRKIVTEQGIFCDDKSLDLVARVSDGAMRDSLSILDQAISIGDGKVDYDELVSMLGLVTNDNLFKIVDSIIKRDIESAMEIIEELVLTGKDMTLFIKDLIVHYRNLLMIKVTSNPEEVLDTAEENIEKLKVQGSKLKVEEIMRCIRIVQECDEEAKLSKQARVYLELAVIKMCKIEYDTSKEVMLARINKLEQAIRSGNIQVNTNLEEVKSQVSNEASNNKTLNNKQQNAIKSSNNYEVVNENSTLTPEYLRKVWKDILETFKSRGKYMVYIALAKGISKVSCNKGVVEFRYTYEYRHNKERLEKHDFSKIVNDIFSEVLKEPVRVVYSVEQGTEEEKAEEADLEARLSGIMGDGLEIVEE

SEQ ID NO: 88532 - protein, 138 aa, Brassica napus
QEIREVTSSDERTTDVNGFAKSISEEALNKMHYLHAALSETLRLYPIVPLNMRCAENDDILADGHRVKRGDNVYYMAYAMGRMTYIWGQDAEEFKPERWLKDGVFQPESPFKFISFHGGPRICLGKDFAYRQMKIVSM

SEQ ID NO: 88533 - protein, 122 aa, Lactobacillus sakei subsp. sakei 23K
MALDVNAIVDQLKESSILELNDLVKAIEEEFGVSAAAPVAAAGAAGADAAAEKDSFTVELSEIGQEKVKVIKAVREITGLGLKDAKGLVDNAPSALKEDVSKDEAEEMKAKLEEVGAVVNLK

SEQ ID NO: 88534 - protein, 295 aa, Arabidopsis thaliana
MAELQPVDGQQTNGGVVTIPASTSAEATAIAAAGSKRLRRPSVRLGEIGGDQYQQQHHHHAAAAAYDSQGRKSKWTPTTTSGNRKDTSKSSRTRTLTNLSSGYENIGTLDDEREGNVDSFGVGSWRVKKRVGSSAAAKRVRSNWVSKVGDGDEKISGGEELEGGFRDFSREDSESPIKEESLDRDGGGFYGRRRYESNNSSGNREFESNMDGGGKEGVKIWLQELGLGRYWPMFEIHEVDEEVLPLLTLEDLKDMGINAVGSRRKMFCAIQKLVKAMAECKLAMSETMKAFFLTL

SEQ ID NO: 88535 - protein, 161 aa, Zea mays
MAQRDKKEEPTELRAPEITLCANNCGFPGNPATQNLCQSCFSASRSPSSPTSSSSSLASAASQPRPAALVVDAAAVEALAAPAAAGQGQATEAAARASASRCSSCRKRVGLTGFRCRCGELFCGAHRYSDRHGCSYDYRGAARDAIARENPVVRAAKVVRF

SEQ ID NO: 88536 - protein, 502 aa, Pseudomonas aeruginosa UCBPP-PA14
MAKAIPQLIDGEWRGSRSRELIEVTDPATQDVLALAPKATADEIEQAIASAQRAFETWREVPAPERARLMLRYQHLLKEHHDELGELLARETGKNLADAKGDVWRGIEVVEHAANVASLMMGETVENVAREIDTASWIQPLGVCAGITPFNFPAMIPLWMFPLAIACGNTFVLKPSEQDPLTPNRLAELFLEAGAPKGVLQVIHGGREQVDALLTHPDIRAISFVGSVAVGQHVYRTGTAHLKRVQAFAGAKNHMVILPDANKAQVLGNLVGASCGAAGQRCMAISAAVFVGAAREWIPELAERMAALRPGHWQDPDAAYGPLISPQARQRVLRLIAEGKAEGAECLLDGSQCQVEGYPNGNWLGPTLFRAVTPKMGLYREEIFGPVLACLEVDTLEEAIALVNANPYGNGTSLFTRSGGAARRYQHAVQVGQVGINVPIPVPLPFFSFTGWKGSFYGDLHAYGKQAVRFYTETKTVTSRWFDDEPTTDESSAGPNMTIHLK

SEQ ID NO: 88537 - protein, 635 aa, Streptococcus pyogenes MGAS315
MIILQGNKLERSFSGDVLFQNISLQVDERDRIALVGPNGAGKSTLLKLLVGEETPTSGEVNTKKDLTLSYLAQNSRFESDKTIYEEMLKVFEALRQDEKRLRQMEMDMATVSGQDLTRLMMDYDLLAERFRQQGGFTYEAEIKAILNGFKFDESMWQMTIAELSGGQNTRLALAKMLLEKPELLVLDEPTNHLDIETIAWLENYLANYQGALIIVSHDRYFLDKVATVTLDLTPHGLDRYVGNYSRFMTLKAEKLVAEEKQFDKQQKEIAKLEDFVQKNIVRASTTKRAQARRKQLEKIERLDKPTSARKSAHMTFQADKPSGNVVLTVEKAAIGYNQHVLSEPINLDVHKLDAIAIVGPNGIGKSTLIKSVIGQIPFIKGEVKYGANVEIGYYDQTQSHLTSSNTVLEELWQDFSTTPEVDIRNRLGAFLFSGDDVKKSVAMLSGGEKARLLLAKLSMENNNFLVLDEPTNHLDIDSKEVLENALIDFDGTLLFVSHDRYFINRLATKVLEITENGSTLYLGDYDYYLEKKAELEELARLAAGETVEETKEASATDYQLQKANQKERRRLTRRYEEIEARLETIEERIGAIQEDMHASNDTAQLIAWQKEWDQLDQEQEALMEEWETIAEQIES

SEQ ID NO: 88538 - protein, 407 aa, Zymomonas mobilis subsp. mobilis ZM4
MTAYAENITERPSHSEKKSVFSNLKSQPADALLELIALCREDTRENKIDVGVGVFCDDQGHTPVMRAVKAAEIQLIHEQNTKSYLGSAGDIEFFLRLIPVVFGNDFKDHERLSGLQTPGGTGALRLAFDLIHAGNPNADIHYGNPTWVNHLQIIANTGLNSISHPFYNREKRQIDFDAVLDDLKQVKRGDVILLHGCCHNPTGCDFTFDQWKALSEVISQKGLLPVIDLAYQGLGDGLEEDVAGLRWLSQQVDEMIVTYSCDKNFGLYRERTGAIFVLSQNAESRKIVQSNLIASTRTHWYMPPDHGAAAVRIILENEALYDSWQTELNAMQQRISGNRQSLAKADSYFAPLLQQKGMFSILPLSPEQIKKLRIENAIYMAPSGRINVAGLTPTTIDPFVKAIQKVI

SEQ ID NO: 88539 - protein, 469 aa, Streptococcus pyogenes MGAS315
MAFEIIMPKLGVDMQEGEIIEWKKQEGDTVNEGDILLEIMSDKTNMELEAEDSGVLLKIVRPAGDTVPVTEVIGYIGAEGESVDTIASSEKTTEIPVPASADAGPAVAPKENVASPAPQVAATAIPQGNGGKVRATPAARKAAAEMGIDLGQVPGTGPKGRVHKEDVENFKGAQPKASPLARKIAADKGIDLATVSGTGFNGKVMKEDIMAILEAAKPAEAKAPAAKEEKVVDLPEGVEHKPMSAMRKAISKGMTNSYLTAPTFTLNYDIDMTEMIALRKKLIDPIMAKTGLKVSFTDLIGMAVVKTLMKPEHEYMNASLINDANDIELHRFVNLGIAVGLDDGLIVPVIHGADKMSLSDFVLASKDVIKKAQTGKLKAAEMSGSTFSITNLGMFGTKTFNPIINQPNSAILGVGATIPTPTVVDGEIVARPIMAMCLTIDHRLVDGMNGAKFMVDLKKLMENPFELLI

SEQ ID NO: 88540 - protein, 520 aa, Phlebia tremellosa
  misc_feature (337)..(337): Xaa can be any naturally occurring amino acid
MFSFARSTALVVAGLFVGAIAAIGPVTDFHIVNAAIAPDGISRQAVLAEGTFPGPLITGNKGDNFQINVIDELTNATMLKSTTIHWHGFFQHGTNWADGPAFVNQCPIATGNSFLYNFNAPDQAGTFWYHSHLSTQYCDGLRGPFVVYDPNDPYADLYDVDDDSTVITLADWYHTAARLGGPFPNADTTLINGLGRCGEPGAPVSDLAVINVEAGKRYRMRLVSISCDSWFNFTIDGHDMTIIEVDGVNHETLTVDQIQIFAAQRYSFILEANQPVDNYWIRANPGTGITQGFEGGINSAILRYAGADEVEPTTALVASTSPLAEGDLHPLDNPAAXGQPFPGGVDYALNLNLTFDGPTLKFLINGVSFVPPTVPVLLQILSGAQTAQDLLPTGSVYSLPSNATIELSLPAGPAGGPHPFHLHGHTFSVVQGAGQTVPNYVNPVRRDVVSIGAVPDNVTIRFETNNPGPWFLHCHIDWHLDAGFAVVFAEDIPDIASVSPVPTDWSNLCPIYDALDPSDQ

SEQ ID NO: 88541 - protein, 333 aa, Zymomonas mobilis subsp. mobilis ZM4
MAILITGIAGFIGSFAAKSLLERGEEIVGIDNLNDYYDPELKKKRLAELKKLKNGKLHFSPIDFSDGALLNNTLEKFDFDRIIHLGAQAGVRYSLINPQIYGDSNLIGHLNILELARHRKVRHMVYASSSSVYGNRSTLPFKVDSQPDYPASLYAATKRAGEMLSESYAYLYRIPLTGLRFFTVYGIWGRPDMAMWIFTKKILQKQPIMLFNNGKMQRDFTYIDDAVSGLIAALDNPPQDNNKIKSGGSLNPHNLYNIGNHHPENLKYLVELLEEACGCHAIKELRPMQAGDVSTTYADIETSKRDLGFYPKITLDIGVGRFVEWFRHYITHS

SEQ ID NO: 88542 - protein, 444 aa, uncultured Acidobacteria bacterium
MKSRPAGAGPVAVEAPPVTVQTSQRMVVREVLDNGLRLITETMPHVRSVTIGVWLMRGSRHESDERSGIAHFVEHMLFKGTDTRSAEDIAQAIDSIGGQLDAFTAKEYASYYIKVLDEHLPLAVDLLSDIVLRPAFSAEEIEREKKVILEEIKMVEDTPDDLVHELFTQHFWEGHPLGRPILGSKETVESFTATSLLDYFHGAYVARNMIISAAGNLEHAHVRELVERAFGAVPSEGEPFSAEAPRVVPQVITRTKELEQSHICLGTNSYPQNHDDRYVSYIMNTVLGGSMSSRLFQNVREKRGLAYAVFSGLSAYRDAGNITIYAGCSNQAVGEVIDLCVEELRGMKRAPVPDSELRRAKDHLKGSLMLSLENTASRMSHLARQEIYFDRHFGLDETLAGVERVTDADVQRVAQDLFSDGSLAATVLGPSVPALDRARIDLGA

SEQ ID NO: 88543 - protein, 435 aa, Burkholderia pseudomallei K96243
MKAAGDPLRLLARRAHPRRIQGPIIEAPLPEVAIGELCAIRAAAGSDTTIGRAQVVGFGRDTAILSTLGSTAGLSRQVALVPTGERMTIDVSPALLGAVVDATGGIVETFGAPPPAGAAPGRRAIDAAPPDYAARRPIERRLATGVRAIDGLLACGVGQRFGIFAAAGCGKTSLMNMMIEHAAADVYVVALIGERGREVSEFVERMRRSGSRDRTVVVYATSDRSSVDRCNAALVATTIAEYFRDLGCDVMLFLDSMTRYARALRDLALATGEAPARRGYPASVFEQLPRLLERPGRTRAGSITAFYTVLLENEEEPDPIGDEIRSIVDGHVYLSRQLGAKGHFPAIDVLRSASRLFDEIADAPHRALAKRFRQHLARIDEMQVFLDLGEYRRGENPENDDALDRRPALDAFLQQAVDEASAFGDTLERLSEAAS

SEQ ID NO: 88544 - protein, 387 aa, Saccharomyces cerevisiae YJM789
MSAPTPLAEASQIPTIPALSPLTAKQSKGNFFSSNPISSFVVDTYKQLHSHRQSLELVNPGTVENLNKEVSRDVFLSQYFFTGLRADLNKAFSMNPAFQTSHTFSIGSQALPKYAFSALFANDNLFAQGNIDNDLSVSGRLNYGWDKKNISKVNLQISDGQPTMCQLEQDYQASDFSVNVKTLNPSFSEKGEFTGVAVASFLQSVTPQLALGLETLYSRTDGSAPGDAGVSYLTRYVSKKQDWIFSGQLQANGALIASLWRKVAPNVEAGIETTLQAGMVPITDPLMGTPIGIQPTVEGSTTIGAKYEYRQSVYRGTLDSNGKVACFLERKVLPTLSVLFCGEIDHFKNDTKIGCGLQFETAGNQELLMLQQGLDADGNPLQALPQL

SEQ ID NO: 88545 - protein, 385 aa, Arabidopsis thaliana
MVSDQDLAKGVETLLRQSDPSSLTSLSSIVQQLEAKLGLDLTEKTTFIRDQINILLRAHQNPSASVASASSVQQSHPPPPPSSHQQQNLHSGVNVPPMAKGHFTLSHPSQFSVSSQSQQYPSHFALQPPYHSYDLNFRQPYPVYMPPQQHQHQQQSPRQQQSSVMLSHGGNASLSVNQAPKESAPAGTKRKGGPGGLNKVCRVSPELEVVVGEPALPRTEIVRQLWAYIRKNNLQDPSNKRKIICDDALRVVFETDCTDMFKMNKLLAKHILPLDPSKDSGQAKKAKTEVETKTETTEPVSSTAISSTVTLSEPLGKFFGTGETEMADEEIIRRVWEYIKLNNLEDPVNPMAIQCDEKLRDLLGCESISAVGINEMLRRHMYKQS

SEQ ID NO: 88546 - protein, 348 aa, Triticum aestivum
  misc_feature (199)..(199): Xaa can be any naturally occurring amino acid
MLRSTHPLSPSSGGSGGSSPAPASSSGEAMVGGAPSGAKLLQILNVRVVGTGERVVVLSHGFGTDQSAWSRVLPYLIREHRVVLYDLVCAGSVNPDHFDFRRYNNLDAYVDDLLAILDALRIPRCAFVGHSVSAMIGILASIRRPDLFAKLVLIGSIDRSSSRFLNDSDYHGGFELEEIQQVFQAMSANYEAWAKGYAXPLAVGADVPAAVQEFSRTLFNMRPDISLHVCQSVFKTDLRAAPRAAQAPCVVVQTTRDVSVPANVAAYLRAHLGGRTTIEPLPTEGHLPHLSAPSLLAQVLRRALARFLHLRKKRERRNYCGSFAGFTDPRVRTGVYPVFLLCIFTASA

SEQ ID NO: 88547 - protein, 304 aa, Gibberella zeae PH-1
MINSMASKRNSRAFVDDHAHPTEGQQTPNNTQFRSRQGSRSASKEDMKQEVEEVISSMNRSQSATTVAMEPSLSTQSSDSDSRSSSISRGGRVQSSEHVASLDGRPFNFGIVIPGVYRSSFPKSHDFDYIKGLGLKTIVSLVKKDDLDHDLETFITSEGIRQVVFNMKGTKKEAIPLDTMKGILNVVLDQSNYPLLIHCNHGKHRTGCVVGVVRKITGWDVARVVAEYNTYAEPKAREVDVTYLQGFDVSSLVLSNTLQREICSRRNRLQSRTFFRAIVFSTCVMLVWFMSGVRMTSVTPSGPL

SEQ ID NO: 88548 - protein, 282 aa, Vibrio vulnificus YJ016
MRPIMLVDRLFTRYQRQIALTEFGESGQANLLQAHVLIIGCGGLGNAAALYLAAAGVGHLVLVDDDVVEESNLQRQIAFRQQHLASPKVDALAEQLKQLNAELRVRTISQRLDEERLNLEVMLADIVLDCTDNFPSRQLINQACLNQRTPLVSASAIGWKGQFIAFDFSSYHSIQSQQDTSSAASSVNPPCYHCLFPFAENAMQTKCSDAGVIGPVVGLMGNYQAIATIQKLATGAFQTTCHQLHLFDGLKLSWQHLAVVKDPSCRVCQIQKQESSNEHHSN

SEQ ID NO: 88549 - protein, 373 aa, Colwellia psychrerythraea 34H
MTFKSFNPPQRILMGPGPSDVSARVLSALARPTIGHLDPLFISMMDEVKTLLQYAFQTKNEFTIALSAPGSAGMEACFVNLVEAGDKVIVCRNGVFGDRMIQNVTRIGAEAVVVDSPWGRAVETHKVKAALHDHPDAKFLAFVHAETSTGALSDAKALCKMAQEHDCLTIVDAVTSLGGVELKVDEWGIDAIYSGTQKCMSCVPGISPLSFSPKAVAVVQNRKTQIQSWFLDQTLVMGYWSGEGKRSYHHTAPVNSLYALHEALVMLHDEGLENSWARHKEQHEVLAKGLKELGIEFIVPEEERLPQLNAIYIPDGADDAKIRDYLLEHYNLEIGAGLGAFAGKAWRIGLMGHAAKSENVALCLSALKDALHQ

SEQ ID NO: 88550 - protein, 456 aa, Bordetella bronchiseptica RB50
MTTLSSAQQQDIQYQLHSYTNAVKHRDVGPRIITHGEGVYVFDDQGNRYLEGMAGLWSVAVGFGEQRLVEAAARQFQELPYYHTFTHKSHPSVIALAERLIGYTDGRMAQAFFTNSGSEANDTVVKLVWYYNNALGRRDKKKIIARQRGYHGVTVASASLTGLPGNHKDFDLPLPQIRHTACPHYYRYGLPGETEEDFATRMAGELEAMILREGPDTVAAFIGEPVMGAGGVIVPPRTYWQKIQAVCRKYDILVIADEVITGFGRLGQRFGSQVFDIEPDIMVLSKQITSSYQPLGAVLLNARVADVVAEHSGRLGTFGHGYTASGHPVATAVALENLRLIDERGLIEHAAEMGALLHLELQALSSHPLVGEVRGVGLIAGVELVADKATRQPFDPLGKAGGYAYERAHDHGLIVRGIQDTVAFCPPLIITAEQVRDMVARFARTLDDVAAHVAQG

SEQ ID NO: 88551 - protein, 494 aa, Zea mays
MAENNVVATYYYPTAAPAAMEVCGAELGQGKPDKCFDDDGRPKRNGTMWTASAHIITAVIGSGVLSLGWAIAQLGWVAGPVVMLLFSLVTYYTSSLLADCYRSGDPSTGKRNYTYMDAVNANLSGIKVQICGFLQYANIVGVAIGYTIAASISMLAIRRANCFHQKGHGNPCKISSTPYMIIFGVAEIFFSQIPDFDQISWLSILAAVMSFTYSSIGLGLGVVQVIANRGVQGSLTGITIGVVTPMDKVWRSLQAFGDVAFAYSYSLILIEIQDTIRAPPPSESTVMKRATVVSVAVTTLFYMLCGCMGYAAFGDGAPGNLLTGFGFYEPFWLLDVANAAIVVHLVGAYQVYCQPLFAFVEKWAAQRWPDSAYITGEVEVPLPLPASRRRCCKVNLFRATWRTAFVVATTVVSMLLPFFNDVVGFLGALGFWPLTVYFPVEMYVVQKKVPRWSSRWVCLQMLSLGCLVISIAAAAGSIAGIASDLKVYRPFKSY

SEQ ID NO: 88552 - protein, 539 aa, Bradyrhizobium japonicum USDA 110
MQGSATGLAYRGRTASIGFAHGPLVRVGADTNGERVAGNLAEEALALRAAIDAASGQIADLAGIAGGEAAQILEFQVALLEDEDFIQAIFASIGDGDPADVAWRSALDAQIADYNSAADEYLKARSSDLADLRDRVINILRGDGGPALEIPSGAVVCADDLPPSRFLEIDWSGGGGLALLRGSPTSHVAMLARARGIPMVVQLGAIPDVRANALLDGEGATLELDPSAEQVRLFEKRRESHRKSRASARAILRRPTASWRGERIKLFINIQRVDDLEHPDAQYADGIGLMRTEFLLTERGSLPDEETQFQAYDAVLRWADQRPVTIRTFDAGGDKPVAGFTLDGEANPFLGVRGLRLCLARPEIFAIQLRALARAAVRGNLKVMFPMVTSAAELEAGRKLFADVVQRLQADGIAAMLPELGIMVEVPAAALAITSFKTSFFSIGSNDLAQYVLACDRSNGALAPLMDPLHPAVLELIARTAEHGRRAAISVSLCGDMASDPRCLPALLNCGLRELSVNASALAQIKQTIDRLSSGGGLD

SEQ ID NO: 88553 - protein, 248 aa, Magnetococcus sp. MC-1
MRDTTTHFGFTNVPTSEKVKKVRDVFDSVAPKYDLMNDLMSMGVHRLWKRHAISKLNLQPGDHALDLAGGTGDLALLMQKRMTRSGRVTICDINYSMLDQGRHRLTDEGWLCGMEWVQANAEELPYPSNCFDVVTIGFGIRNVTNIPQALSEMFRVLKPGGKLMVLEFSKIAIPALRPLYDLYSFKLLPEIGHIVTKDRDSYQYLVESIRMFPDQESFKAMIEAAGFFNVRYENLSAGISAIHLGYKV

SEQ ID NO: 88554 - protein, 317 aa, Chenopodium rubrum
MEKYEKLEKVGEGTYGKVYKAKEKTTGQLVALKKTRLEMDEEGVPPTALREVSLLQMLSQSLYVVRLLLCVEHVDKKNTTTGISKPILYLVFEYLDTDLKKFIDSHRKGSNPRPLPPCQIQSFLFQLLKGVSHCHSHGVLHRDLKPQNLLVDKDKGILKIADLGLGRAFTVPMKSYTHEIVTLWYRAPEVLLGSTHYSTGVDIWSVGCIFAEMVRRQALFPGDSEFQQLLHIFRLLGTPTDEQWPGVTSLRTGMCIRNGSLRILLVQFHRWDLMVLISYLKCSNMIQLKGSRPRQLWIIPSLIILISLNSKNAIVSY

SEQ ID NO: 88555 - protein, 435 aa, Listeria innocua Clip11262
MFILTMGLNHHTAPIDIREKLVFKETEEEMALVTLLQEKSILENVIISTCNRTEIVAVVDQIHTGRYYLKRFMANWFQMDMEKIEPYLFFHEEAEAVNHLYKVTAGLDSLVLGETQILGQVKHAFEIAKQTGTTGTLLNKLFREVVTFAKKVHHHTKINENAVSVSYAAVEVAKKLYGSLDNKKIVLIGAGEMSELALQNLAGSGIADITIINRTKSNAEILAHQFQAKVGAYENMSDHLLEADIVLVSTSAEEPIIKQVAMQELMEQKASSMLVIDIGLPRNVEHDCSYIPNFHLYDIDDLAGVVSANSLERQRIVQELENTIETEVRSFFEWEKQLGVVPVIRALREKALDMQEVTMTSLENKLPGLTEREYIQIGKHMKSIINQMLKQPISELKEMSVEENADTSIEHFKRIFGLTETDVAIIEKEQAETRS

SEQ ID NO: 88556 - protein, 194 aa, Listeria innocua Clip11262
MDVNNVELVISAVRPEQYPETDLPEYALAGRSNVGKSSFINTMIRRKSMARISQKPGKTQTLNFYKIEEALFFVDVPGYGFAKVSKTEREKWGVMIETYITSREQLRGVIQIVDLRHKPTEDDRMMYEFLKYYDIPVIVVATKADKIPRSKWQKNAKIVRETLDFDPDDKFVLFSSETKMGKDEAWQFIKEGME

SEQ ID NO: 88557 - protein, 358 aa, Clostridium perfringens str. 13
MHKKLFIPGPVEVREEVLEKMATPMIGHRSKEASQLQRRISDNLRKLFFTNNEILLSTTSGSGLMEGAIRSCTLKKAAVFSVGAFGDRWYEMGISNNVPVDKFEVPWGKSINIDLIDSVLKTGQYDLITVTHNETSTGVMNDLEAISKVIRKYPEVIFCVDAVSSAGGSKIEVDKLNIDICITSSQKALGLPPGIAICTFSERARERSEKVKFRGTYLDLLALYKYIKKKDYQYPSTPSISHMYALDYQLDYILNVEGLENRFNRHIEMSKIVREWAEKYFEIYPENGYYSNTLTTIKNNKNIDIGALNKELGKRGFQISNGYGKLKDKTFRIAHMADCQVKDIKELLSNINEILELE

SEQ ID NO: 88558 - protein, 272 aa, Colwellia psychrerythraea 34H
MSDYSLRFGGISRLYGEHGANVLQQANFCVIGIGGVGSWVAEALARNGIGKITLIDLDDICTTNINRQIHALTDTVGQSKVDVMAERIKQINPECQVNIIEDFVTVENLSSLITKDFDYVIDAIDSVDIKTRLIAYCRGSKLPIITIGGAGGQVDPSKIEITDLSKTYQDPLLAKVKNQLRREFNFPRADLKTAGKRKFSIDAVYSTEQLRYPADGKQGEVCLAKPDKSNGEQGATRLDCQSGFGATTHVTATFAFFAVGRAIDKLLIKHQK

SEQ ID NO: 88559 - protein, 654 aa, Oryza sativa Indica Group
MASAAVIPSSAPGAAAAGAAAVESAGWVVDERDGFISWLRGEFAAANAIIDLLLLHLRSVGEPGEFEHVAAAVQQRRHHWAPVIHMQQFFPVGDVAYALQQAGWRRRAPPHHQQQGPGASPSPPPPPPRGRPSFSASHSHHRHGGHHHRSDSVRGGGTGATAGSDKDGREVHNKEEKGMKEAENVVEAKSSQLESLVSHEGEKTPRPQAVAEGSSKVVPTPVEYTVNDIIDGKTVNAVEGLKVYEGLVNENEKNKILSLLNETKASFRRGGLEAGQTVIIGKRPMKGHGREIIQLGIPIVEGPPEDDYPRETKVEAVPGLLHDLFDRLCQKEIIPTKPDYCVIDYYNEDQMIFFPRGIILTLTNPLLDCDMVFGRVISGERGDHRGPLKLSLSTGSLLVLHGKSADVAKRAIPAACKQRILLSFGKSLSRKQVPSESVSRFTTPLTPPPMPWGPPRPANMVRHSSSPKHFGYAPNSGVLPAPAIGAHHIPPSDGMQPLFVAPAPVAAAAMPFPSPVPLPNSTTAWMAEAAPRSAPQRLPVPGTGVFLPPGSGHALPHQMMTASQSPAEPISSTDSSAYVHNKSTSTMGEMANGDVSPKSSPAKQSDAVEQKPECNGSSNGGSSLVDKKSAVSKEQQNGGMKKVGSNKVQPNAAK

SEQ ID NO: 88560 - protein, 449 aa, Pseudomonas syringae pv. syringae B728a
MRRKERHLKVTVFGTGYVGLTLAACLAEVGHTVCCMDVDSKRIDALREGICPIFEPGLGELLRNGLDCKRLSFTTDEVHASRFAELVFIAVGTPAQADGKADLSQVLAVLRCVIRHAESAPIIVNKSTSPVGTVDRLLAEIAASARCDDGFEVISNPEFFKEGCAVSDCLRPDRIIVGGASPRALEQMRELYQPFSRNREKFVVMDARSAELSKYAANCLLATKISFINEIANLAEQVGADIEQVRLGIGSDPRIGYDFIYPGCGFGGSCFPKDLQALIGTASEHGVETALLNAVEQVNRRQKHRLFENIHTHYHGDLRGKVFAVWGLAFKPNTDDIREATSHTLLKALWAAGARVQAHDPQAIEAVRHHYGERNDLQLVQCKQDALEGADALVVVTEWQDYRVLDLDALGETLGDRVVFDGRNLFDPLQLREAGFTYYGIGRGQATPA

SEQ ID NO: 88561 - protein, 253 aa, Clostridium perfringens str. 13
MLQHSLSRTELLIGKDALDKLAKSKVMVFGVGGVGSFTVEALARAGVGNLILVDDDTVCLTNLNRQIHATYKTISKNKVEVMKERVLSVNRNCNVETIQVFVTPDNLEEIIPDDVDYVVDAIDTVSAKIALAVYCEQKGIKLMSSMGTGNKLNPAEFKVADIYNTKVCPLAKVMRYELRKRGVKKLKVVYSEEMPRKPKVEDVVTCKTGCVCTGGTKKCSAKRQIPGSVSFVPPVAGMIIASEVVKDLIKEYI

SEQ ID NO: 88562 - protein, 366 aa, Triticum aestivum
SSPAPHSSPPSRRRRRRRRRDPLGSSPPVPAAGIDLATIFKQIKLLFRTGFDEAELKGYMPVIHANVFQTIKILYDGAKELAQLETESSKHVISPDNQEIGEKLSEIGGRLDYPLLNKELVQDVRKLWEDSAIQETYSCGSVLQVPDCAHYFMENLDRLAEPDYIPTKEDVLHARVRTNGVVEIQFSPLGESKRGGEVYRLYDVGGQRNERRKWIHLFEGVDAVIFCAAISEYDQLLFEDETQNRMMETKELFDWVLKQRCFEKTSFMLFLNKFDIFERKIQKVPLTVCEWFKDYEPIAPGKQDVEHAYEFVKKKFEEVYFQSSKPDRVDRVFKIYGTTALDQKLVKKTFKLIDESMRRSREGTGT

SEQ ID NO: 88563 - protein, 222 aa, Coffea canephora
SRFSEYPFGLRTIVSTKATEKSFGVEVQDEKQTIQQTKQSLYDALQGINRGIFGVSSEKKAEITRLIELLESQNPSPEPTMNIEKMGGTWKLVYSTITILGSKRTKLGLRDFISLGDFFQDIDQMEGKAVNVIEFSAKGLNLFRGQLKVEATFKIASKSRVDIRYENFTITPEQLMNLFEKNYDFFFSIFNPEGWLNITYPFDENLRIGRDDKGNIFVLERS

SEQ ID NO: 88564 - protein, 390 aa, Wolinella succinogenes DSM 1740
MQEPKMSVYLDNNATTLVDPKVKELMDPYFCQMYGNPNSLHRFGTETHPAIKKALDDLYEGINAADEDDVIITSCATESNNWVIKGVYFDILRHGVKNHIVTTDVEHPAVRATCAFLETLGVEVTYLPINDQGTISAEQVREAITEKTALVSVMWANNETGMIFPIQEIGEICRERGILFHTDAVQAIGKIPVDVQKAKIDLLSFSAHKFHGPKGMGALYIRKGVELTPLFHGGEHMSGRRSGTLNVAGIVGMGEAMRLAVQYLDFEKSNVRRLRDRLENALLELPDVFVVGSRENRVPNTVLISVKGVEGEAMLWDLNKAGIAASTGSACASEDLEANPVMIAIGADKELAHTAIRLSLSRFTTEAEIDYTIEVFKKSAERLRSISSSY

SEQ ID NO: 88565 - protein, 434 aa, Wolinella succinogenes DSM 1740
MPLYALREKLGKKSLSPTFGTVVKVSSGAIVVVGLRPSVGDIVRIIQGENHHESMGMVTVVESESFTVSPFSFIEGSKVGDRVYLNNRGLQIPVGAGLLGRVVDPLGRPIDGAGEILGTEYAPIIKPPIAAMKRGMIDEVFSVGVKSIDGLLTCGKGQKLGIFAGSGVGKSTLMGMIVKGASAPIKVIALIGERGREVPEFIEKNLGGNLENTVLVVATSDDSPLMRKYGAFSAMSVAEYFKARGEDVLFMMDSVTRFAMAQREIGLALGEPPTSKGYPPSVLTLLPQLMERAGKEEGHGSITAFFTVLVEGDDMGDPIADQSRSILDGHIVLSRELTDFGIYPPINILNSASRLMNDVSTKDHVLAARKFRRLYSLLKENEVLIRIGAYQKGNDRELDEAIEKKERMEGYLKQNFDENWEFEKSVSELVTLMG

SEQ ID NO: 88566 - protein, 420 aa, Listeria innocua Clip11262
MSQKIQVENGVLKTPNNPVIPFIEGDGTGPDIWAAAKRVLDAAVKKAYNGEKEIAWKEVLAGEKAFKQTGEWLPQETLDTIDEYLIAIKGPLTTPIGGGIRSLNVALRQELDLYVCLRPVRYFKGVPSPVKRPEDTDMVIFRENTEDIYAGIEFKEGSAESKKLIDFLKSEFGVDKIRFPETSGIGIKPISKEGTERLVRSAIEYAIKEGRKSLTLVHKGNIMKFTEGAFKNWGYDLCEREYGDKVFTWNEYDRIKEAEGTEAADAKQKEELAAGKILVKDSIADIFLQQILTRPAEFDVVATMNLNGDYISDALAAQVGGIGIAPGANINYLTGHAIFEATHGTAPKYAGLDKVNPSSVILSGTLLLEHIGWGEAAALINHSMEKTIAAKTVTYDFARLMDGATEVKCSEFADELIKNF

SEQ ID NO: 88567 - protein, 517 aa, Zea mays
MAAIASASPRTLIPPRPRHHGAAPSPSTSDVSSLRLLRAHPRHVRRSRGVSISMPVARSRSFVFSPRAVADSKSSQTCLDPDASTSVLGIILGGGAGTRLYPLTKKRAKPAVPLGANYRLIDIPVSNCLNSNISKIYVLTQFNSASLNRHLSRAYGSNIGGYKNEGFVEVLAAQQSPDNPNWFQGTADAVRQYLWLFEEHNVMEFLILAGDHLYRMDYEKFIQAHRETNADITVAALPMDEKRATAFGLMKIDEEGRIIEFAEKPKGEQLKAMMVDTTILGLDDVRAKEMPYIASMGIYVFSKDVMLQLLREQFPEANDFGSEVIPGATSIGKRVQAYLYDGYWEDIGTIAAFYNANLGITKKPIPDFSFYDRFAPIYTQPRHLPPSKVLDADVTDSVIGEGCVIKNCKINHSVVGLRSCISEGAIIEDSLLMGADYYETEADKKLLAEKGGIPIGIGKNSCIRRAIIDKNARIGDNVKILNADNVQEAAMETDGYFIKGGIVTVIKDALLPSGTVI

SEQ ID NO: 88568 - protein, 195 aa, Wolinella succinogenes DSM 1740
MNYIPYVIEKTGRGERSYDIYSRLLKDRIIMLSGEINDGVASSIVSQMLFLEAEDPEKDIYLYINSPGGVITSGMSIYDTMNYVKPDICTICIGQAASMGAFLLSCGTKGKRFSLPNSRIMIHQPLGGAQGQATDIEIQAKEILRLKSILNGILASNTGQPLEKIAKDTDRDFFMSAQESKEYGLIDNVLEKSFK

SEQ ID NO: 88569 - protein, 573 aa, Burkholderia sp. 383
MTTLNRFKSSAVVLATVAGIGFLPNAPVYAKGPQPAVLTSSAVAVADKYSADAAERIFKEGGNAIDAAVAIAFTLAVTYPEAGNIGGGGFMTIYKDGKPYFIDYRERAPLAATKDMYLDKDGNVVKGMSLYGPRAVGVPGTVAGMWEAQKRFGKLKWKQVLAPAIHYARDGFVVDEQLAQRGVDASKEFGGKTNFDKYFSGLKAGVNFKQPDLADVLTRIANDGAEGFYKGKTAELIAASMKTGDGNGLITTEDLAQYRAVWRQPVQAKWNGYDVITAPPPSSGGIGLVQLLKMKADLKQDFEGVKLNSPQYIHLVAEIEKRVFADRAQYLGDPDFYKVPIAQLTDDAYIAKRAGEVNPKEPSDTKSVQPGLGTTMPEKAETTHFSVVDKWGNAVSNTYTINGYFGSGVIADGTGIVLNDEMDDFSAKPGVANMFGVVGSDANAIEPKKRPLSSMSPTIMTRDGKVSLVIGTPGGSRIFTSIFQVINNIYDFKMPLKEAVGAMRFHHQLLPPNTIFWEPYHPIEGELAKQIEARGYTLKGQDFSGDIQVIKIDGKTPEAMADPRGRGVTRIIH

SEQ ID NO: 88570 - protein, 428 aa, Salmonella enterica subsp. enterica serovar Paratyphi A str.
MKLYNLKDHNEQVSFAQAVTQGLGKQQGLFFPHDLPEFSLTEIDEMLNQDFVSRSAKILSAFIGDEIPQQILEERVRAAFAFPAPVAQIESDVGCLELFHGPTLAFKDFGGRFMAQMLTHISGDKPVTILTATSGDTGAAVAHAFYGLENVRVVILYPRGKISPLQEKLFCTLGGNIETVAIDGDFDACQALVKQAFDDEELKTALGLNSANSINISRLLAQICYYFEAVAQLPQGARNPLVISVPSGNFGDLTAGLLAKSLGLPVKRFIAATNINNTVPRFLHDGKWAPKATQATLSNAMDVSQPNNWPRVEELFRRKIWRLTELGYAAVDDSTTQQTMRELKAKGYISEPHAAVAYRALRDQLNPGEYGLFLGTAHPAKFKESVESILGETLALPEALAERADLPLLSHHLPADFAALRKLMMTRQ

SEQ ID NO: 88571 - protein, 309 aa, Photobacterium profundum SS9
MTPITRVAIIGECMVELKKNDGSIEQSFGGDTLNTAVYLSRLTQQHGISTSYVTGLGRDPFSKEMLAAWREEGINTDMVYLSDDKLPGMYAIETTEDGERSFYYWRNDSAAKYWLRERAILTLAKELCQHQMVYLSGISLAILSEDCRQSLINLLALCCKDGLKIAFDNNYRPTLWESAEQAQTFYKQILAITDIAFLTFDDEQMLYGDDNEQQTIERTQALGVQEIVIKRGGDDCYVVTPGSLECVAPHPVGNIIDTTAAGDSFSAGYLAKRITGGTPHASALAGHLLAGNVIQHRGAIISRDDMPNI

SEQ ID NO: 88572 - protein, 424 aa, Burkholderia sp. 383
MPSHVDSPAAHHAGSLTIFQGAALYIGAVLGTGVIALPALAAEVAGPASLLAWAALVVLSGPLAATFAALGARYPDAGGVSTYARRAFGPKAAAIVGWCFYFAVPAGAPAAAMFGGAYVAAVTGGGHTTIIVTAAALIATVSAANAFGVTVSGRMQLVLSALLVTLLLAAVLASAPHARTANLHPFAPHGWLAVGQAAALLVWSFAGWEAITHLAAEFRRPAHDMPRSAGIAVVVVGFLYLSVAAASVTVLGPTAGGSGAPLAELIAGGIGGHAQVLAAVAALLLTLGTMNAYFAGAAKLGAALGRDGALPAWLAQGSQVGGVPRRSLGVIALLAVVALAATTLSDVGPKPLVLVTSGCFVMVYGLGAAAALKLLPRGGIAYRCAWISLVAVAGLFLTTGWYILCPLLLAGGALLYLQVAGPRQ

SEQ ID NO: 88573 - protein, 533 aa, Wolinella succinogenes DSM 1740
MLQTINLGMQYATKKLFESVTVKLDKGKRYGLIGANGAGKSTFLKILSGEIEHTSGDIIIENGLRLGVLKQDQYAFEHLSIFDAVLVGNKRLYDAIKEKERLYSEGDLSDDKVNERLGELEMICAEEDPTYEYDVIIEKILEDLGFPSSSHQEPMSTLTGGDKFKVLLAQVLFPKPDILFLDEPTNNLDIHTIGWLEENLKRHEGTMVIISHDRHFINAVCTHILDLDFQTLREFTGNYDDWYIAANLISKQQEADRNKKLKEKEELESFIRRFSANASKAKQATSRQKQLEKLNIESLKVSSRRDPSIMFKPRREIGNEALEVEKISKSYGDHQVFAELSLKILPGDKIALIGPNGIGKTTFCKIIMEELKPDTGAIKWGATVESGYFPQNAAETIEGEETLYEWLRSFDKRADSGEIRNCLGRMLFSGEEQEKSVSALSGGEKHRMILSKLMLEGGNFLVLDEPTNHLDLEAIIAMGEALYNFKGNVICVTHDRELIDAFANRIIEMREGGEVIDFRGTYEEYMESQGKSY

SEQ ID NO: 88574 - protein, 448 aa, Candidatus Pelagibacter ubique HTCC1002
MSSENRTSVPNSLNEHWMPFTSNKDFKANPRLITEAKGVYLKTHHGKTQIDASSGLFCNPLGHGRREITEAVTKQLETLDYAQPFQQGFGGSFELATKISKHTPGDLNKMFFTICGSTAVETAIKIAVAYHRAKGHAERFRFVGRERGYHGMNIGCISVGGMVNNVKTFASVLMPGVQHIRHTHLPEHKFVSGQPETGDYLANDLETICQNFGGENIAACIVEPIAGSTGTLVPPKGYLQKLREICDKHGILLIFDEVITGWGRTGSKFAADEFGVTPDIMTMAKATTNGVVPMGVVACNDYIYDAVMDASPTGAVELFHGYTYSGIPVAVAAALAVQEIFEKDDIFNRAKNLSPYFQKGLFSLQDLESVDNIRGYGMMGGIDMKLNTKPGKAGYECFKACYEAGVNFKATGDCLIIAPQFICEEKHIDEIIEKLRTGITNYQKNQKN

SEQ ID NO: 88575 - protein, 210 aa, Zymomonas mobilis subsp. mobilis ZM4
MSHDHADIVNALIPMVVEQSNRGERSFDIYSRLLRERIIFVTGQVEDHMASVICAQLLFLEAENPKKDIFLYINSPGGVVTAGLAIHDTMQYIRPKVGTLCIGQAASMGSFLLAAGEPGMRVATTNSRIMIHQPSGGAQGMAADIEIQAREILRMRKRLNALYAKYTNQPIEEIEKAMDRDNFLEADEAKAFGLIDKVFDKRPVASEEKE

SEQ ID NO: 88576 - protein, 207 aa, Debaryomyces hansenii CBS767
MASNNPEALQDDELIPESVEGYHVGEKKTIEEYTKLDAEDESLAKWKASLGLSDNSNAYPVKAGDKRKVVIVEMSLQFPNQPELQPIVIDLEDAQGNTIAGKEIKFSIKEKSVYQFVIKFRVQHEIITGLKYLHLIKKTGIRVDKLEEPLGSYAPNTKEKPYYEKVFSEVEAPSGMLARGGYSATTKFVDDDKNVHLSFPWSFQITK

SEQ ID NO: 88577 - protein, 855 aa, Cryptococcus neoformans var. neoformans B-3501A
MADDIRSWITKVLIDHDIRYGANFKVPVKCKHYCQLLKFYTYRDDRNPRAQIEGSIGDRTHCVKVVFDPEETDKFEQPDPDTGYKHSLTSQLRSIFQIKEFHIHIAPPSPLAGTKIPIVTFFVTKWDVVSGNHDEPVYWLDTCKIGEGNNDGKVRDVLKKWWSGESNSESSQNRSSQNILSQGNIPDMSISAARPRGNKDVAHYYRTTVALGDIVSIEEAKASRVGEWDAQSALAWLERNQDTVLNTHAQYRNYPSNNAETIKSLQHSQGKTVREPSDHGYPPESQPIEGISRNSRSPHLSNRRSPPGSSQSHHISSSSLLHASPTKCQFSKEKITDPLNFPSSPATNMSPGNTDEELLSPYEREERRKRSRKSKAIREDGNKELEQSSPSPSQLSQLSWLSPPSPTMATPRKSGAELSRSDRPVPELSPSGNATISNARDKWKRPRESLNSKGQSRIVVWDEDEDSDEEPMVKNGLKRKIILSSSEPSPQVIEIQDSSGDEENFAQTSSSLTTKRNAMLRTREATRPIKTPSNSNVLNGISADRRTCKDGDEKEENGRGKGGNALGGEEKTMVEEKEEKEEKEEKEETGIEEEEDEEEEQEEEEEDEEEEEKIEEDEEEEEEKEEEEGKIEEEEKEKEIEEEEEKIEEEEEEEEIEEEEEEEEEEEEEEEEEEEEEVEEEEEEEEEVEEMEEEEELKDDREIEGKKEEEEQQTGEKKEGIQVKLGEKRTEGGVRGRTMKKTEISIKEENDDVDGNRVQRRLENERLARMDVLRMEKEMDEAQTPPVLEGGNEILRRKRKHRAEDPTSNQHVPKFGGFKLDMTLREGGLDEACVLQMLEWAREKRQEIAKRAKKP

SEQ ID NO: 88578 - protein, 557 aa, Oryza sativa Japonica Group
MRNLLLLPLLVAVAATVPLAAALSADGVALLAFKTAVTDDPSGALSSWSDADDDPCRWAGVTCANTSSSGPRVVGVAVAGKNLSGYVPSVLGSLALLRRLNLHGNRLSGTVPPALANATSLHSLFLYGNSLTGGLPPELCDLPRLQNLDLSDNSLTGSLPPELRRCKQLQRLMLSGNGFSGEIPAGVWPEMVSLQLLDLSDNSLTGAIPPELGKLAALAGTLNLSRNHLSGGVPPELGHLPATVTLDLRFNNLSGEIPQSGSLASQGPTAFLNNPGLCGFPLQVPCRAAPPSSSTPPPPSAAGSISGAGGPRQPVKTSLIVLISVADAAGVALIGVIVVYIYWKLRDRRGDGCGGDGDDDEERKRGLFPFPCMRADDSSDDGSDAGDDVKRNNTTTTTTASGGGGGGEEGQLVAIDKGFKMELDELLRSSAYVLGKGGKGIVYKVVVGNGTTPVAVRRLGGGAAAAERYKEFAAEAGAIGRVRHPNVVRLRAYYWSADEKLVVTDFVNNGNLATALRGEHTPSPSPSPSQFVNLFGKRETYFLKKWSKLWLDYNKLW

SEQ ID NO: 88579 - protein, 902 aa, Arabidopsis thaliana
MEKYFHGVLCVFIITVAFIHVVQAQDPNGFITLDCGLLPDGSPYTNPSTGLTFTSDSSFIESGKNGRVSKDSERNFEKAFVTLRYFPDGERNCYNLNVTQGTNYLIRAAFLYGNYDGLNTVPNFDLFIGPNKVTTVNFNATGGGVFVEIIHMSRSTPLDICLVKTGTTTPMISTLELRPLRSDTYISAIGSSLLLYFRGYLNDSGVVLRYPDDVNDRRWFPFSYKEWKIVTTTLNVNTSNGFDLPQGAMASAATRVNDNGTWEFPWSLEDSTTRFHIYLHFAELQTLLANETREFNVLLNGKVYYGPYSPKMLSIDTMSPQPDSTLTCKGGSCLLQLVKTTKSTLPPLINAIELFTVVEFPQSETNQDEVIAIKKIQLTYGLSRINWQGDPCVPEQFLWAGLKCSNINSSTPPTITFLNLSSSGLTGIISPSIQNLTHLQELDLSNNDLTGDVPEFLADIKSLLIICLLVLYISFLYLNRNLSGNNFSGQLPQKLIDKKRLKLNVEGNPKLLCTKGPCGNKPGEGGHPKKSIIVPVVSSVALIAILIAALVLFLVLRKKNPSRSKENGRTSRSSEPPRITKKKKFTYVEVTEMTNNFRSVLGKGGFGMVYHGYVNGREQVAVKVLSHASKHGHKQFKAEVELLLRVHHKNLVSLVGYCEKGKELALVYEYMANGDLKEFFSGKRGDDVLRWETRLQIAVEAAQGLEYLHKGCRPPIVHRDVKTANILLDEHFQAKLADFGLSRSFLNEGESHVSTVVAGTIGYLDPEYYRTNWLTEKSDVYSFGVVLLEIITNQRVIERTREKPHIAEWVNLMITKGDIRKIVDPNLKGDYHSDSVWKFVELAMTCVNDSSATRPTMTQVVTELTECVTLENSRGGKSQNMGSTSSSEVTMTFDTEVNPVAR

SEQ ID NO: 88580 - protein, 364 aa, Oryza sativa Japonica Group
MGAKKHTLQVLPWLLLFAQHTAASACDCANTTDGADRQGAMKLKLIAIASILAAGAAGVLVPVIGRSMAALRPDGDIFFAVKAFAAGVILATGMVHILPAAFDALTSPCLKRGGGDRNPFPFAGLVSMSAAVSTMVVDSLAAGYYHRSQFRKARPVDNINVHKHAGDERAEHAQHINAHTHGGHTHSHGDIVVCGSPEEGSVAESIRHKVVSQVLELGILVHSVIIGVSLGASVRPSTIRPLVGALSFHQFFEGVGLGGCIVQANFKVRATVIMAIFFSLTAPVGIVLGIAISSSYNVHSSTAFVVEGVFNSASAGILIYMSLVDLLATDFNNPKLQINTKLQLMAYLALFLGAGLMSMLAIWA

SEQ ID NO: 88581 - protein, 182 aa, Zea mays
MEVKEVCVQDMLVDLEKGKCLLPIEDNSGMKVNSIVGHASTMRPSSWDDLVALKDDKSHHICCFSSHRQDSSVKSGEPMKAEGEIKVGILDKSTVDKENKKWYKKPPRPPRLQTTSPLDPADQKLISALSELAVLKKARIERMKALKKMKNSKPASSIGNLVALIITVILCFFILWQGLLMK

SEQ ID NO: 88582 - protein, 506 aa, Crambe hispanica subsp. abyssinica
MTSINVKLLYHYVITNLFNLCFFPLTAIVAGKASRLTIDDLHHLYYSYLQHNVITIAPLFAFTVFGSILYIVTRPKPVYLVEYSCYLPPTQCRSSISKVMDIFYQVRKADPFRNGTCDDSSWLDFLRKIQERSGLGDETHGPEGLLQVPPRKTFAAAREETEQVIVGALKNLFENTKVNPKDIGILVVNSSMFNPTPSLSAMVVNTFKLRSNVRSFNLGGMGCSAGVIAIDLAKDLLHVHKNTYALVVSTENITYNIYAGDNRSMMVSNCLFRVGGAAILLSNKPRDRRRSKYELVHTVRTHTGADDKSFRCVQQGDDENGKTGVSLSKDITEVAGRTVKKNIATLGPLILPLSEKLLFFVTFMAKKLFKDKVKHYYVPDFKLAIDHFCIHAGGRAVIDVLEKNLGLAPIDVEASRSTLHRFGNTSSSSIWYELAYIEAKGRMKKGNKVWQIALGSGFKCNSAVWVALSNVKASTNSPWEHCIDRYPVKIDSDSAKSETRAQNGRS

SEQ ID NO: 88583 - protein, 211 aa, Vibrio vulnificus YJ016
MFFILKGEFLLLFSHDITIHQALLGGKMSSIRSYKGIHPQIGERVYIDSTSVIVGDIRIGDDSSIWPLVAARGDVNHIHIGARTNIQDGSVLHVTHKNAENPHGYPLLIGNDVTIGHKVMLHGCDIHDRVLVGMGAIVLDAVVVESDVMIGAGSLVPPGKRLESGYLYVGSPVKQARPLSEKERAFLLKSADNYVQNKNDYLTEVKDLHER

SEQ ID NO: 88584 - protein, 498 aa, Arabidopsis thaliana
GTLLILKPKGTRVGCDLPPSPPSLPIIGHLHHLLSSLTHKSLQKLSSKYGPFLHLRIFSVPIILVSSASVAYEIFKAHDVNVSSRGAAAIDESLLFGSSSFIYAPYGDYWKFMKKIFATKLLRPQVLENSRGVRAEELKRFYRRILDKARKNENIEISKESAMLMNNILCRMSMGRSFSEENGEAERVRGLVGESYALVKKIFFAATLRRLLEKLRIPLFRKEIMGVSDRFDELLERIIVEHKDKLEKEHQVMDMMDVLLAAYRDKNAEYKITRNHIKSFFVDLFVGGTDTSVQTTQWTMAEIINNPNILQTLRKEIDSVVGKSRLIHETDIPNLPYLQAVVKEGLRLHPPGPLLIRTFQERCEMKGFYIPEKTTLVINAYAVMRDPDSWEDPDEFKPERFLSYSRSGQEDEKEQTLKYLSFGGGRRGCPGVNLGYIFVGTAIGMMVQCFDWKIEGDKVNMEETYGGMNLTMVNPLKCTPVPRTQPFSFTSNLEILSS

SEQ ID NO: 88585 - protein, 210 aa, Magnetospirillum magnetotacticum MS-1
MEITLEHGDALEAMDQSVRYIRLVKAVAHKHGMQATFMAKPFDHLAGTGMHMHVSLADAEGRNLFASEDPAGTPLLRTAIGGMLASLLDSLLLFCPYANSYRRFQANSYAPLAPTWGVDNRTVSLRVPGGPANTRHIEHRICGADANPYLAAAAILAGIHRGIKEDIDPGEPVEGNGYAQAKELLPTDWLTSLTALENSVWARDALGQEF

SEQ ID NO: 88586 - protein, 331 aa, Pseudomonas syringae pv. syringae B728a
MTVLVTGAAGFIGFHVAKRLCELGVEVVGIDNLNDYYSVELKQSRLALLQRLPGFTFHRLDITDAEGLSALFAQNGFEQVIHLAAQAGVRYSLEQPNVYAQSNLVGFINVLEACRQYRPAHLIYASSSSVYGANTRMPFQVEDAVDRPLSLYAATKRANELTAYSYCHLYGLRATGLRFFTVYGPWGRPDMALFKFTKAMLAGQPVDIYNHGEMARDFTYIDDIVESILRLRLLPPDAVGSEPPHQLFNIGRGQPVKLLEFVDCLEAALGLRAERRYLPLQAGDVLQTWADVSALSQWIDFQPQVSVDTGVRAFVDWYREHYQARICEPLQ

SEQ ID NO: 88587 - protein, 440 aa, Clostridium perfringens str. 13
MGKPKLKKEIGLFTATALVVGNMMGSGIFMLPASLASVSGPGSTIMAWLLTGLGSLVLALTFANLGSKIPKTGGTYEYSRLAYGNFMGFMTAWLYWNGSWIGNATIFIVITTYLGEVITSLTNSPIIGFLFCSSILWICTYINIRGTKLAGRVASVITVFKVLLFIFFIVVGLIYFDPSNLTPMFPDGKGVSTIPVAASLTLWAFMGLETASVAGGEIKDPEKNVKRSTILGMLISTVLYILISVVAMGAMSQSELASSTAPISDIIVKVLNLKSLNFLNIAIAISILGTAMGWLLSTARVGYAAGEDGIFPSVFAKVHPKYNTPHVALIIGSIFINIIFLMNFTKGLAGAYSFIVVLATLSYLPIYAISTIAEIILMVKEEKKPTFKKHLGLIIRCLIGFAFAIWAIYASGAEIVMYGFILILLGVPIYGYMSIKKHFR

SEQ ID NO: 88588 - protein, 433 aa, Vitis vinifera
  misc_feature (69)..(69): Xaa can be any naturally occurring amino acid
  misc_feature (105)..(105): Xaa can be any naturally occurring amino acid
  misc_feature (182)..(182): Xaa can be any naturally occurring amino acid
  misc_feature (412)..(412): Xaa can be any naturally occurring amino acid
MQNCSSSVAPVVKGDLFCELQCPKNDLEKKQMDKIPYASAVGSIMYAQVCIRPDIAYMVGMLGRYQSNXGIDHWKAVKKVLRHLQGTKDYMLTYRRTKYVACYEXTCHAIWLRNFVSRFHVIDSIMRPLRIYCDNSVAVRFSKNNKTLEGSKHIDIKYLVVREKVQNGVVSIEHIKNTLMLXDPLTKGFGTFPTLLCADGCCVTDRRMGVSGYPMEIQALFFMALRCAVHLLREDDGKEFSMRIEKRLQALTYHMRSYFWLDFQQLNNIYRYKTEEYSHTAVNKFNVMPNSIPDWVFDFMPMKGGYSVANVSPTRMDFRWFVLGNCVAILSSLATYNQSMAILDLIEDRWEELVGKMPLKLSYPALDIHGWSIETGSDPKNTRWSSQNGGSWPGLLWLLTAACIKTGWPEIXRKAIELAEHAADVQGRLARIL

SEQ ID NO: 88589 - protein, 181 aa, Azoarcus sp. BH72
MSIYALRERKPRFGEGCWVAHNATVIGRVEAGRNVNIWYNAVIRGDNDPIVIGDNTNIQDGSILHNDDGIPLTIGSDVTIGHMVMLHGCTVGDGTLIGINAVVLNNAVIGKHCIIGANALIPEGKVIPDRSLVVGSPGRVIRELSDDEIAGITRNAAHYVANARQYEEELEPLDAAAVLGR

SEQ ID NO: 88590 - protein, 269 aa, Thermus thermophilus HB27
MIVVKVGGAEGINYEAVAKDAASLWKEGVKLLLVHGGSAETNKVAEALGHPPRFLTHPGGQVSRLTDRKTLEIFEMVYCGLVNKRLVELLQKEGANAIGLSGLDGRLFVGRRKTAVKYVENGKVKVHRGDYTGTVEEVNKALLDLLLQAGYLPVLTPPALSYENEAINTDGDQIAALLATLYGAEALVYLSNVPGLLARYPDEASLVREIPVERIEDPEYLALAQGRMKRKVMGAVEAVRGGVKRVVFADARVENPIRRALSGEGTVVR

SEQ ID NO: 88591 - protein, 773 aa, Oryza sativa Indica Group
MALLARRARKAVMAKAPAPLLQKRGGGAAAELAIPAHFRCPISLDLMRDPVTAPTGITYDREGIEAWLDTGRAVCPVTHAPLRHEDLVPNHAIRRVIQDWCVANRSRGVERIPTPKIPVTPVQASELLFDVAESAARRGAAGRAAGAVARVRALARDSERNRRCFVSVGTGRVLAAAFESLAAAGEAGVLEDVLAALVCMMPLDEEAARVLASSSSMGSLVAIAKHGSLAGRLNAVLAIKEAVSRDGAFVDLADDKVDKVVDALVVIIKAPICPQATKAAMVATYHLASSDERVAARVASTGLVPTLIEALVDADKSVSEKALAVLDAMLASEEGRASARGHALAMPALVKKMFRVSDVATELAVSAMWRLGCKASSGDEEAAATGCLVEALRVGAFQKLLLLLQVGCRDATKEKATELLKMLNKHKGLGEGREGKGREGRKVRADMSAAPIPREWVGLQQFPAATQTKLHELLGKLKEENVSTLTILVMGKGGVGKSSTVNSIVGERVATVSAFQSEGLRPMMCSRTRAGFTLNIIDTPGLIEGGYINEQAVEIIKRFLLGKTIDVLLYVDRLDAYRMDTLDDQVIRAVTNSFGKAIWRRTLVVLTHAQLSPPDGLDYNDFFTKRSESLLRYIRAGAGVSKRELGDFPLPIALVENSGRCKTNENGEKVLPDGTPWIPNLMKEITTVVSNGSKSIHVDQKLIDGPNPNNRWKMFIPLILMVEYFLVVKGIRRAIHADISNGKLDDWEQRYRDLVGSKDPVDQKGSSSGNRKA

SEQ ID NO: 88592 - protein, 585 aa, Listeria innocua Clip11262
MKKTKIVCTIGPASESVDTLVQLIEAGMNVARLNFSHGDFEEHGARIVNIREASKKTGKQVAILLDTKGPEIRTNDMVGGKLEFQTGDVVRVSMTPVEGTKEKFSVTYGELYDDVEIGSSILLDDGLIGLEVIEKDEANRELVTKVLNPGVLKNKKGVNVPNVSINLPGITEKDAADIRFGLEQGIDFIAASFVRRATDVLEITKILEEHNATHVQIIPKIENQEGVDNIDEILQVSQGLMVARGDLGVEIPAEEVPIVQKELIRKCNKLGKPVITATQMLDSMQRNPRPTRAEASDVANAIFDGTDAIMLSGETAAGDYPVEAVKMMAKIAVRTEEVLVAQDKFALKLHENTDMTEAIGQAVGHTAKNLNVQTIVAATQSGHTARMISKYRPKSHIVAVTFNEHVYRGLALSWGVYPRLATPVSNTDEMFDLAVKESLASGVAKQGDLIIITAGVPVTESGTTNVMKIQLIGEKVVKGQGIGSKSVIGKAVVAKSNAEALQKAEEGGILIVKTTDKEILPAFEKSAAVVVEEGGLTSHAAVVGINLGIPVIVGAKDATSLVKDGEIITVDSRQGVVYNGKTATH

SEQ ID NO: 88593 - protein, 134 aa, Oryza sativa Indica Group
MSRSLGIPVKLLHEAAGHVVTVELKTGEVYRGAMVECEDNWNCQLDNITFTAKDGKVSQLEHVFIRGSRVRFMIIPDMLKNAPMFKRLEARIRGKGSAIGVGRGRAVAMRARAAAGRGGGPVGRGGAPPACAWP

SEQ ID NO: 88594 - protein, 1359 aa, Candida glabrata CBS 138
MESAITGAVNSLSRHSSSDKEDDKPVPESVDHDTFKIPTSLPTLSTTDEGDEKVNTNRDGTNNEHGSEQTNIQLEESSEKIDGMQDLPSLADVQADSNPFEFDFSPRDDQISADVMPLAPHNSTHLENSVENNNNIHEQSDSVGSSQNSEPAHIYENNEHVAEDLQINSATNTDNKTENTRNSIQETTEESNSDNHGNNEITLSINITNNKQNSDSAQTVNDSIFPKDIDQNEKLEQPDNDNTKNAIEGVPRVLEDKVTDASGMDRSSDDKRDGNDNFKPNPIENEHDATEKSFFTVNAEHTKGSSLRRDSNSNNDKDNTAITGDTLKKWKNTDQVNDNEEANNSTDFGFPDLDKSNVSFDSLPNEKEDKHQENVSEMLTGQDGHKDNSLENIGRKELTNEVSSPSKLKSTDQIASPSSNDDISQLEIMNNKNTDDGKKLDHIPEIRAEDSTKNEDKNNTTNINAKTEDDDKKLDLPDALDHDQLVTLLELDDKHSNIFEDSEMLDEEEELEQLESEIPNTKHNSASMETDKVKAFNDIPVNTQDLQENNADNENPQLNKTVAADNHIKVEPSQPGGIIKREESVDSTKDKTQQPVTKTPPLSPINEEDISPNQHVPGIKSDQQNLQKSSSANQTSGSSTTQPNKESATDTPASIINEKNSLLYPKRQNSLTPMVFQPHQIKELIQRPPNADQGNVGSNTTSDTTASQPTIFAYARLDFESFTFYVQTLHAIIGRRSENDYSHKVDVNLGPSKSISRRHAQIFYNFGTGRFELSIIGKNGAFVDDTFVERGNTVPLKNKTKIQIGQIPFQFILPEPDILPTPKKNETKKTQEKAKAKEPMKPDPKKVIKQDVTSANKQAETKPKPKQAAAPKPKKVVKSPKKVYTPEEIPPEYREKPSLSYSAMLTVCIRKFSKEKGMSLSEIYAGIRELYPYFKYCPDGWQSSVRHNLSLNKSFRKISKEGKGWLWGLDEEFIAERDKLKQQQNSAAASRANTPVNKVAKTETTAPKKPSPKPTTSTNAKVTKKQNISQTLAANRATSPKNQATDDHQRTMKYLQEQLVILTKDRKGLSKQVIANILTQALAMTINQVTQAAKNKGISGNPLTALMDKNPQHLNLILAAAVNAATAKITNGEVKQLVNLPSINQNKPATQQVRPTKQENKKPPAKQTTTQKASKPPTPQAKAKSGSSFDPTSLSKFFQPKQAARTISAVPTADVKSIPAKRTIGGSVVNKKVTENESSSSSGSSSSEDDSSSDDSSSSGSDDSDSDSSSGSDDSSSGESDSDDSDSSSDDSNDESSSEDENDEDDAAENERKKLKTQESVIESLLQHDNDGAFDLDEAVAQLDDDAVGELDDVHSLEF

SEQ ID NO: 88595 - protein, 304 aa, Kluyveromyces lactis NRRL Y-1140
MVAPSQFKQLEKVGNGTYATVYKGLNKTTGVYVALKEVKLDSEEGTPSTAIREISLMKELKHDNIVRLFDVIHTENKLTLVFEFMDNDLKKFMDNRNKGNSHKGLEMDLVKYFQWQLLQGVAFCHENRILHRDLKPQNLLINNRGQLKLGDFGLARAFGIPVNTFSSEVVTLWYRAPDVLMGSRNYCTSIDIWSCGCILAEMIMGKPLFPGSNDEEQLKLIFDTMGTPVEQTWPQVTQLAKYNPLLPPHMPRDLKQLLQNNTEEVLDDNVVDLLHGLLQLNPDARLSAKDALNHPWFAEYNHAN

SEQ ID NO: 88596 - protein, 511 aa, Zea mays
MYKNQLQELAQRSCFNLPSYTCLREGPDHAPRFKAAVNFNGEQFESPGFFTTLRQAEHAAAEVALAALARRGPSYSLAARILDETGVYKNLLQEVAQRVGAPLPLYTTERSGLGHLPVFTCTVELAGITFTGDPAKNKKQAEKNAASAAWSALKQLVREEVNSSNEPENIDEQEQIRIARALLNYRLKEKMAMANYPHVSPFPKKFPMQQERKPCFGQSSQSSHSKILPLFRPKPNSRPKSPASTDGVSKTPGRTPVDSLDQSARSRFPAAEAAPYVPVGHYRRIPCHNMAPSVTIRTAVPVFSAPPLPPPPARLQQLPPLMSHPPPIRMASPVRMRPAPASPMFASSSPVQVPKPVMPVQLKDVQDHSRKEAVPPVIPVQVKDAQCRPRKSSMSPVIPVPVKDAQRRPAAIPVQMKDVQTQAPKEPLAAPISVKTDTPAQVKEASAGATSEAPSSATGNDAAVECSASSESGLARQSGAADGDTLVLMRKLSMRPEAQAAAATTMRLETN

SEQ ID NO: 88597 - protein, 335 aa, Desulfococcus oleovorans Hxd3
MNILVTGAAGFIGFHLAKRLCEDGHTVVGVDNINDYYDPGLKNARLALLHPFSNFSFFQIDIADRPFMAKLFTSHKFDCVVHLAAQAGVRYSLEHPETYIDSNLVGFGNILEGCRHAKVKHLVYASSSSVYGLNTTMPFSVFHNVDHPVSLYAATKKANELMAHTYSHLYGLPATGLRFFTVYGPWGRPDMAYFLFTRAILEGTPIKVYNQGNMKRDFTYIDDIVEGVVRVMDRVPAPDPEWSPEAPCPATSRAPYRLYNIGNNQPVSLMGFIEAIEKALGKKAEKTFLPMQPGDVPATWADIDSLRQATGFSPATSLENGIAKFVAWYLDYYGT

SEQ ID NO: 88598 - protein, 227 aa, Lactobacillus sakei subsp. sakei 23K
MDKNAMKKMAAERSVDYVEDNMILGLGTGSTVVYMVEALAKRVKAENLHLTCVCTSIRTAEQATSLGIPVKALNEVDHIDLTIDGADEVDDNFQGIKGGGAAHLFEKLVATTSTRNIWIVDEEKVVDTIGRFPLPVEVIPFGSQQVFNKFVKEGLNPEFRTTEDGQRVLTDSKNEVIDLHLEKITHPHLLATWLSEQVGVVEHGLFLDLVNEVVVGSPEGVKILKAR

SEQ ID NO: 88599 - protein, 416 aa, Wolinella succinogenes DSM 1740
MGNSLPAYHEQTLQNGLKVVAIPLHNGTGVITTDIFYKVGSRNETMGKSGIAHMLEHLNFKSTKNLKAGEFDEIVKRFGGMTNASTGFDYTHYYIKSSELNLEKSLELFGELMEHLSLQDEEFQPERNVVAEERLWRTDNNPMGYLYFRLFNSAYVYHPYHWTPIGFMEDIKNWSIEDIHAFHKTYYQPQNAIIIVAGDIEPERVFQAAKERFERIENCCEIPKVHTLEPKQDGARRVIVKKESEVEMLALAYKIPPFTHEDQVALSAISEILSSGKSSRLQRNLIDKKRLANQVYAYSMDLVDEGVFLFMGIANEGVSGEALEKELLKQIEKIKEGKIKESEIEKIKINVKADFIFQLESSSSVASLFGSYLARGDLSPLLEFEEKFSTLTKEKIIEVANRYFQPDNSTTLILKK

SEQ ID NO: 88600 - protein, 171 aa, Escherichia coli
IGVYKDETGKTPVLTSVKKAEQYLLENETTKNYLGIDGIPEFGRCTQELLFGKGSALINDKRARTAQTPGGTGALRVAADFLVKNTSVKRVWVSNPSWPNHKSVFNSAGLEVREYAYYDAENHTLDFDALINSLNEAQAGDVVLFHGCCHNPTGIDPTLEQWQTLAQLSVE

SEQ ID NO: 88601 - protein, 510 aa, Hyoscyamus niger
MYIEDTSEIFTIFFTHILLPLLSFFIIRCVISSRKKLPLPPGPFPWPIIGHLFYLGNKPHVSLAKLANVHGPHLMSIRLGGRLVIVASSPMATAEVLKTHDRLLSGRFVSHPMRVEGSYIRNLATETLEECDENWKKVRSMYQIVLFSHKAVESQVNIREKKVMELVKFVASKEGELVNIKGIAFVTILNILSNSTISNDLVDFEGKGIGEGMREWIRNYTKLEGVPQLADLFPILDGCTWDFQGTYKKLKDTFERISDVWRDIINKKRMEISNKYYEGEDFADALIRNGFEDKQINALLMELYSAGTETTITTVEWTLVELLKNPEAMKRLRNEIKKELTTIDDREIMIVKDSNLPNLPYLEACMKETLRLHPPAPLLFPHRAVQTCEVMGYRIPQDTQIIVNVWKMARDSEYWNDDPWSFKPDRFLDSSTDYKGHDFEFIPFGSGRRICAGQSLALRMLPMIVGSLVHNFELILPNNMNPMEMNMDDIIDVTMAKKDPLFIIPKIRNS

SEQ ID NO: 88602 - protein, 180 aa, Wolinella succinogenes DSM 1740
MRLAPNLLTLSRIVFSFLLLVVILYGGILFPPPIHPTWINYTACVLFLIASITDFFDGFIAREHQITSTFGEVFDPLADKMLMLAGFVGLLVWERANPWAVFLILSREFFITGLRVVAASQGMNVAASSLGKWKTGLQITAVAFLLMDYFPGEILLWLATLITLYSGYDYTKAYMESSKA

SEQ ID NO: 88603 - protein, 195 aa, Tetraselmis suecica
AGGIAQMREHDPIVRERTDIALDSVGNTSAASGKGFDIASASLTALALFAAYVTFTGIDGINIFKAPVLAMLFMGGMVPVVFSALAMNAVGKAAMEMVYEVRRQFKEIPGIMEGTGKPEYDKCVAISTTASLKEMMLPGLLTIGFPLAIAFLPLAFGMETKAIAEMLGGYMAGVTVSGVLWAIFQSNSGGAWDNA

SEQ ID NO: 88604 - protein, 225 aa, Zea mays
MEAVCGSVWVTSSLPRSPKSTLSLFRSTHQHLTAFPSQSHLFLYHPPPYANAKTLRARTSSKPAIFLPHLIASLEQVDQTYIMVKPDGVQRGLVGEIISRFEKKGFKLTGLKLFQCSKELAEEHYKDLKQKSFFPKLIDYITSGPVVCMAWEGVGVVASARKLIGATDPLQAEPGTIRGDLAVQTGRNVVHGSDSPENGKREIALWFKEGEVCEWTPVQAPWLRE

SEQ ID NO: 88605 - protein, 223 aa, Wolinella succinogenes DSM 1740
MNLAQNLDQAIKRIEQARIAYSRHHIVKIVAVSKYSSSDAIQTLYECGQRAFGENRVQDLAQKSELLGDLPLEWHFIGTLQSNKINALLSLKPALMHSLHSLELAKELHKRLESRNQTLPALLQINSAKEESKSGVEPQKAVETYHKILEEFPQIKLQGVMTIGAHVEDRAIIQKSFETTQVIFEQLKPHGAEILSMGMSGDFELAIACGSNLVRLGSTLFKA

SEQ ID NO: 88606 - protein, 194 aa, Isochrysis galbana
AGGIAEMSDQEPIVIERTDILDSVGNTTAATGKGFAIASAALTSLALFAAYVTFTGIDGINIFKAPVLAMLFVGGMVPVVFSALAMNAVGKAAMEMVQEVRRQFKAIPGIMEGTGKPEYDKCVAISTQASLKQMMLPGLLTIGFPLIIAFAPLAFGMDRLAIAEMLGGYMAGVTVSGVLMGILQSQSGGAWDNA

SEQ ID NO: 88607 - protein, 742 aa, Saccharomyces cerevisiae YJM789
MGSSINYPGFVTKSAHLADTSTDASISCEEATSSQEAKKNFFQRDYNMMKKAPAPTKSKLSLALQTSKSSSSANGTVQEDTSSKTEDFSTKSIKKKPDSGVESHVSIQSDSGPQSDSDLDSDSSISSCDERNEESLKDYRPGGYHPAFKGEPYKDARYILVRKLGWGHFSTVWLAKDMVNNTHVAMKIVRSDKVYTEAAEDEIKLLQRVNDADNTKEDSMGANHILKLLDHFNHKGPNGVHVVMVFEVLGENLLALIKKYEHRGIPLIYVKQISKQLLLGLDYMHRRCGIIHTDIKPENVLMEIGDVEGIVQMVEALDKQKREAKRLQRHVSRSSDITANDSSDEKWAECQTSMPCGSSSNSKSRSIEKDLSKRCFRRPRRHTIITGSQPLPSPISSSNFFEMRAHFCGSSHNSFSSVSGNRNIPSSINNNSINNGIGIKNSNNSFLNSVPHSVTRMFINEDSNDNNNNDNSKNKNNNNNNSNNNNNEDIMNTPLHEEQLADSLSTFDISNISQSSDTNGPYISNTMDSNSNVSTDINSPENLIQIKIADLGNACWYDEHYTNSIQTREYRSPEVLLGAPWGCGADIWSTACLIFELITGDFLFEPDEGHSYTKDDDHIAQIIELLGELPSYLLRNGKYTRTFFNSRGLLRNISKLKFWPLKDVLTEKYKFSKDEAKEISDFLSPMLQLDPRKRADAGGLVNHPWLKDTLGMEEIRVPDRELYGSGSDIPGWFEEVRDHKRH

SEQ ID NO: 88608 - protein, 493 aa, Candidatus Pelagibacter ubique HTCC1002
MTIDYKKISKNLKFEGRAFINGKYVDAIDGEKFENINPATGETLCSVAKCNHKDVDLAVKVSRKAFNSGVWSRTSPEFRKDVLLKFAELLRQTGEENSVLECVDTGKLIGDCINEVANDAPMHFQWYGELIDKVFGKVGPTEPSLTSLIVKEPIGVVAGVVPWNFPLMMAVWKMAPALAAGCSVIIKPAEDTPLTAIRVAQIAKEAGIPDGVLNIVPGFGDVGEALGRHNDVDAVSFTGSTEVGGLFMKYSGESNLKTIGLEMGGKSPFIVLEDAKITDDLIDNAINSAFWNGGQNCSANMRQIIHSKVKDEFLDKVSKKVKALKAGDPLDPESNMGSMISKKHLATVDGYIQKGIDEGAKLLFGGVSSSDQKGFFAKPTLFDDLKENMTIAQEEIFGPVLGVLTINSDEEALKIASNSKYGLHASVFTQDIDRAFHMAKSLPCGTVSVNTFSEGDIKTPFGGYRQSGSLSRDQGTEALDQYLQTKTIWISHS

SEQ ID NO: 88609 - protein, 374 aa, Photobacterium profundum SS9
MKMKSLYIHGQATDVSSGETFITSNPATGEPLAEIGQASAQDVDRAIASAQAGFKVWSAMSGIERGRILMRAVAILRERNDELAELEVKDTGKPIQEAIEVDIVTGTDVIEYYAGLAAAIQGQQQDLGHGQFFYTRREPLGVCAGIGAWNYPIQIAMWKSAPALAAGNAMVFKPSEETPLSVLKLAEIFTEAGVPDGVFNVVQGDYRVGQMLSRHPDIAKISFTGESGTGKKVMADAAGTLKDITMELGGKSPLIVFDDAKLDNAVSAAMLANFYTQGEVCTNGTRVFVHDAIYDDFIEQLAHRTNKLVIGDPADMSTQIGALISGEHLEKVLGFIQAGKESGARLICGGERENWQRTRQGVLCSTDHFCRLYR

SEQ ID NO: 88610 - protein, 705 aa, Populus trichocarpa
MAEPKTKYDRQLRIWGEQGQAALEKATICLLNCGPTGSETLKNLVLGGVGSITVIDGSKVELGDLGNNFMVDESCVGQSKAKCVCTFLQELNDAVKAKFIEEYPEALIGSNPSFFSQFTLVVATQLAEDSMIKLDKICREANVLLIFARSYGLTGFVRISVKEHAVIESKPDHFLDDLRLNNPWPELKRFAETIDLNVTDPVAHKHTPYVVILVKIAEEWTKAHGGALPSTRDEKKEFKELLKAGMVAMDEDNYKEAIEASFKVFAPRGINSGLLQIIHDSCSEVESNSSDFWVMVAALKKIYQAKAEADFLAIQQRVKSILKRMGRDPDSISKEMIKSFCKNARKLKICRYRPIEDEFNNPAVTELQKYLTDEEYREMDGDISRLKTTVVGLLSDLGCNGATVTEDLINEMCRFGASELHAVAAFIGGIASQEVIKVSIIGTVECFAGTGKQKGREEIYKMKGLENISQMEGIDDEDDLGMEPIALSSPPPAQQFGHASNRDNDTEKRTQGLHNKVAMKLARFMDTIRQNLVAVQRFVEDLWLRQYGCAGDPDITRAYQVWPGNNVFFFHGRLICGPDPRGLLLTTVSIILSSWVFAMYSEDDLPHDSGLITAFSLMLTVTVSPSHSIKLAVINIYRQGSNLFYFILLGIQVLVNLFLVSTIDPGIIPRNDGSSIEETAGTSDGTRRKRVTINGVELKLKYCRI

SEQ ID NO: 88611 - protein, 210 aa, Phaeodactylum tricornutum
AGGIAEMMGLIPNSVEHTNDALDAVGNTTKTVTKGYTIGSAGLAALVLSAAYKEDNVCFIDKSPQSSMLYGIGAAMFPIVNPYVVIDLLVGGPMPIMLDGICLMTVGRPAQAVLEEIRPQYRERPGITTYHKKPFYGRAVDIASMSAIKEMIVPSILPVLSPSVLFIVIRGTAGPIGAPATVGAILLGVTVTGVFVAISMSNGGGAWDNA

SEQ ID NO: 88612 - protein, 192 aa, Candidatus Pelagibacter ubique HTCC1002
MNDFLQSIIDRDPAAKSKLSLILTYPGVKAVFFHRIANFFQLAKFHLVARIISQLSRFFTGIEIHPGAKIGKNLFIDHGMGVVIGETSEIGNNVTIYHMATLGGIAPSINSNEQRQVKRHPTLGDCVVVGSGAQILGPVIIGANAKIGANAVVTKDVPENAVMVGIPAKNVGTATEEFKPYAVEEVDKDTSN

SEQ ID NO: 88613 - protein, 540 aa, Ralstonia solanacearum GMI1000
MSFSELGLSDKLVRAVAELGYAEPTPIQRQAIPAILKGGDLLAGAQTGTGKTAGFTLPLLHRLSAVQPNKVQTPHGMRYPIRALVLTPTRELAAQVEESVRAYGKYLPLKSMVMFGGVGINPQIDALKRGVDIVVATPGRLLDHVGQRTIDLSHIELLVLDEADRMLDMGFIHDIRKILNILPPKRQNLLFSATFSDDIRALADRLLDQPALIEVARRNTTAETVEQRIYPVDRERKRELLAKLVSDNDWHQVLVFTRTKHGANRLAEQLTRDGIPALAIHGNKSQSARTRALSEFKAGTLRVLVATDIAARGIDIDQLPHVVNFDLPNVPEDYVHRIGRTGRAGAQGEAISLVCVDEHGLLRDIERLIKRELPRTVLAGFEPDPTIAPEPIPNGRNSARAPRQGGGRSQPPRQAAGNAAPREPRAPREPRRESGASGQGQGQGQGQGRNGGGRQRQAQGQRDGQAAPKPRGGQGSGNGNGQSHARGQRQGNGQGNGQGGQRRASNTQAAQPTKVAQPAPKQPFNGLFAKAAALLGGRKA

SEQ ID NO: 88614 - protein, 242 aa, Arabidopsis thaliana
MAGEDSREAQRGDEYEESSPLLKVNENDGKICSKRDAKAAPLVPPPAAEEYGWTADGLPVSHGSVIGEPIRRNQWNSGLFTCLGRNDEFCSSDLEVCLLGSVAPCVLYGTNAERLGSAPGTFSNHCLTYLGLYFIGNSLFGWNCLAPWFSYSSRSAIRRKFNLEGSFEAMNRSCGCCGGCIEDEMQREHLETTCDFVTHVLCHTCALCQEGRELRRKVLHPGFNAQSTVVVMPPIEQTMGRK

SEQ ID NO: 88615 - protein, 408 aa, Zea mays
PRVRRAKNVSDCGHSYGREIWVCVINQLGSTIHDISCVIIYIIWLLKSRYVFCRLVLMPLAVFVFLAHKYWKARITIDAVEKFLRMQQMLVPMRYAYTNIIAITSHFREKLGQGGYGSVYKGVLQPGEVHVAVKMLGNSARGGDEFISEVATIGKIHHVNIVRLIGFCSEENSRALIYEFMPRGSLDKYIFSSEKSFSWDKLNEIALGIARGLNYLHHGCDMQIVHFDIKPHNILLDSNFVPKVADFGLAKLFPRGDSFVPLSAMRGTIGYIAPEMVSRSFGVISSKSDVYSFGMLLLEMTGGRRNADPHAGSSSQAYYPSFVYRQLSQGDANMISEGVDMHELEKKLCIIGLWCIQMKPQDRPTMSEVVEMLEAGVDGIQLPPRPYFCDEEGDSSYSTISELDTIEE

SEQ ID NO: 88616 - protein, 352 aa, Bacillus cereus ATCC 10987
  misc_feature (224)..(224): Xaa can be any naturally occurring amino acid
MTIDRICTIGPASNNKETLAQLISNGMKIVRLNLSHGTHESHKDIIRLVKSLDDSIKILGDVQGPKIRLGEVKGEQITLQAGDSFILHTQPVTGSSTEASVDYEGIANDVKVGSRILMNDGEVELIVGKVGKDKIETKVKAGGNISSHKGVNLPGAIVRLPAITEKDKQDIQFLLEEGVDFIACSFVRKPSHIKEIRDFIQQYKETSPNLIAKIETMEAIKNFXDICKEADGIMIARGDLGVELPFQFVPLLQKMMIQECNRTNTYVITATQMLQSMVEHSIPTRAEVTDVFQAVLDGTNAVMLSAESASGEHPIESVKTLRLVSEFAEHVKKDGPFVMKDVLELLHKSLNA

SEQ ID NO: 88617 - protein, 267 aa, Humulus lupulus
MADANMGAGGGQFPDFPSVLTHGGQYVQFDIFGNFFEITTKYRPPIMPIGRGAYGIVCSVLNTELNEMVAVKKIANAFDIYMDAKRTLREIKLLRHLDHENVIGLRDVIPPPLRREFSDVYIATELMDTDLHQIIRSNQGLSEDHCQYFMYQLLRGLKYIHSANVLHRDLKPSNLLLNANCDLKICDFGLARPNIENENMTEYVVTRWYRAPELLLNSSDYTAAIDVWSVGCIFMELMNRKPLFAGKDHVHQIRLLTELLGTPTESN

SEQ ID NO: 88618 - protein, 64 aa, Physcomitrella patens subsp. patens
MAYAHPVFALVDERLSTEGTGLGLGVSNPKLTWILVGVTALVWAVYFTYSSTLPEGDDDSGLSL

SEQ ID NO: 88619 - protein, 393 aa, Clostridium perfringens str. 13
MEGRLVSKKEIVAMILAGGQGSRLGVLTKNLAKPAVPFGGKYRIIDFPLSNCSNSGIYTVGVLTQYKPLKLNEHIGIGDTWDLDRRDGGVSILPPYQKEKGGDWYKGTANAIYQNIEFIERYDPEYVLILSGDHIYKMDYDKMLEMHKQKEADATIAVINVPMHEASRFGIMNTNEDLSIYEFEEKPEHPKSTNASMGIYIFNWKILKKFLEEDELDQSSSNDFGKNIIPKMLNSGKKLIAYPFNGYWKDVGTIESLWEANMDLLKYEDELSLYDSEWKIYSANPVRPAQFIGKDAEIKSSLTVEGCIVHGKVENSVLFQGVYVGKGAIVKDAVIMPNTKIEDNVLIEKAIIGSEAIVCKGCKIGDGNKISVIASKEVVIGSKEVIEECAMVK

SEQ ID NO: 88620 - protein, 368 aa, Clostridium perfringens str. 13
MNNCIGIINLDENESKIGELAKNRPLAAVPIAGRYRIIDFILSNMTNAGIESLGILSKNKSRSLVDHLTNGRPWDLHRKRDGLRVFNFGERDPYYDDITNLYENLEFLTKSRREYVIMSPSYMICNIDLKEALEYHKKNDNDITVIYKKVKDADSNFIDCDVLNFDECGFIKSIGKNLGREEESNISLEMYILRTDLLIEIIYECIRRGSHRKFKSYLKEFLDEIKVGGFEFKGYLSCVNSLKSYYKANMDLLEEKVYKELFIDNNPIYTKSRDEGPTHYTKNSEVTNSIIANGSYIEGKVENSIIGRRVYVGPEAVIKNCIIMQETVIGENAHLDKIITDKAAVIRDDEKIVGLEYCPMVLSKPNII

SEQ ID NO: 88621 - protein, 429 aa, Azoarcus sp. BH72
MSAIVDVIAREILDSRGNPTVEADVLLESGVMGRAAVPSGASTGSREAIELRDGDAARFLGKGVLRAVENVNTEISEAIIGLDAEEQAFIDRTLIDLDGTENKSRLGANATLAVSMAVARAAAEEAGLPLYRYFGGSGPMAMPVPMMNVINGGEHANNSLDIQECMIMPVSMGSFREALRCGAEIFHHLKKITDKKGYPTTVGDEGGFAPNVSGTEEALNLIQEAIAAAGYEPGRDVLLALDCAASEFYKDGKYELKGEGLSLTSEGFTDYLATLADKFPIVSIEDGMAEGDWAGWKHLTDRLGRKIQLVGDDLFVTNTKILEQGIDQGVANSILIKINQIGTLSETFAAVEMAKRAGYTAVISHRSGETEDSTIADIAVGLNAMQIKTGSLSRSDRIAKYNQLLRIEEDLGNTVVYPGKRAFYNLRSR

SEQ ID NO: 88622 - protein, 518 aa, Magnetococcus sp. MC-1
MQTHRPKPMTLVILDGWGLRDTQENNAIANASTPHMDDWLANRPHAQVRTSGRDVGLPDGQMGNSEVGHLNLGAGRVVYQEFTRVSCAIEDGSFMHNQVLLDAIRAANEAGGAVHLYGLLSPGGVHSHQDQILAAVQCAKQNGASEIYIHALLDGRDTPPQSAMEYMTRFEEGLQKLGAGRVATVCGRYFTMDRDKRWERVERGYRLMALGEGTPFDSACEAIQAAYDAQQTDEFVEPAVMVEQGQPIGMINDGDTLICMNFRADRVREISHVFTDTTFEPFVRDGLPKLSAYVCLTQYDVSLQNVQIAYPPVALTNILGQVMAQHGLTQLRAAETEKYAHVTYFFNGGQEQPGEGEDRLLVASPKVATYDMQPAMSAAELTDRVIEKIQSTPYDLVVVNYANPDMVGHTGVYEAAVQAIETVDTQLGRLTDAIVQMGGEVLITADHGNADQMVDEQGTAHTAHTLNPAPLIYLGRDAQLHDGRLSDVAPTLLALMGLPQPLEMDGVSLVQFTQPAVA

SEQ ID NO: 88623 - protein, 475 aa, Ustilago maydis 521
MGKKDKSTKAAAPAVNAKKASKKDKKAAPAANVVEPKANGVDKKAKYNNKKGKKEATKKEPTPEPEPESESESESESSDDSSDSDNDKSKSSSDSSSDSDSSDSSDDEQVETKAAPAAKTNGKPAAAPVAEASSSSDSSDDSSDSDSSSESDSDSDSSDSSDDDEDEKPAAAADSKKRKAEDEAPSAKKVKTEDGTAAAAAAAPAELAEGETNQIWVGQLSWNVDNDWLKSEMEVFGEVTSARVQLDRTSGKSRGFGYVDFATAAAAKKAFDEGQGKEVDGRAIRIDLSTPKGDVTENRAKKFNDQRSAPSSTLFIGNLSFDVSEDDVWNAFSEHGEVSGVRLPKDPDSGRPKGFGYVEFAAQESAQAAIDAMTGQELAGRPLRLDFSTPRDRDGGAGGRGGGRGGGFGGGRGGGRGGGFGGGRGGGRGGGRGGRGGSDGSFRGMPRGGGWGARGGSARTGGAADFSGKKMTFDD

SEQ ID NO: 88624 - protein, 442 aa, Colwellia psychrerythraea 34H
MKEDKLQLTKSLSLFGLVLFGLAYMTPMIVFGTYGVLYEESGGNVASSYLFALIAMLFTAGSYALMAHKYPSAGSSYTYVTKVFGDRIGFLVGWTILLDYLFLPMVIWLIGGIYLEAMAPGIPEWFWILSFIVVTSVLNLIGVNVAKKVNLVLMLLQIVVIVAFCALAVMYINASGGVIAAPSTDSFTGGNFSLIFSGAAIACYSFLGFDAVSTMAEETENPKKNVPKAIMLVTLIGGIIFVASSYILNSAFPDISVFAAESAAADIAKQVGGVIFSSIFVATLIIAQFTSGVSAQASASRLMYVMGRDGVLPKGIFGKLHATFKTPYMTILMVGFIGLLALKMDVATSTSFINFGAFIAFIFVNMSAFSEFFKLEKNERTLGATLIHIVFPSIGTIAVMKLLISLDSNAVMLGCIWLAIGLCYLAYLITKGQKLKMDIKES

SEQ ID NO: 88625 - protein, 898 aa, Arabidopsis thaliana
MEGIHKLIFLALIWIFLITNIVDAQDQQGFISLDCGMPRNESSYTDESTGLNFSSDADFISSGKSGTIKTEDSDSGVKYIKPYKQLRYFPEGARNCYNLTVMQGTHYLIRAVFVYGNYDLKQRPKFDLYLGPNFWTTINLQDPSGGFYYRIWLQDGTVEEVIHMPKSNNLDICLVKTGTTTPFISSLELRPLRDDTYTTTTGSLKLISRWYFRKPFPTLESIIRHPDDVHDRLWDVYHADEEWTDINTTTPVNTTVNAFDLPQAIISKASIPQVASDTWSTTWSIQNPDDDVHVYLHFAEIQALKPSDTREFSILWNKNTIIRDYYSPLEFMADTVPIRTSSKCGDDGFCSLDLTRTKSSTLPPYCNAMEVFGLLQLLQTETDENDVTTLKNIQATYRIQKTNWQGDPCVPIQFIWTGLNCSNMFPSIPPRITSIDFSNFGLNGTITSDIQYLNQLQKLDLSNNNLTGKVPEFLAKMKLLTFINLSGNNLSGSIPQSLLNMEKNGLITLLYNGNNLCLDPSCESETGPGNNKKKLLVPILASAASVGIIIAVLLLVNILLLRKKKPSKASRSSMVANKRSYTYEEVAVITNNFERPLGEGGFGVVYHGNVNDNEQVAVKVLSESSAQGYKQFKAEVDLLLRVHHINLVTLVGYCDEGQHLVLIYEYMSNGNLKQHLSGENSRSPLSWENRLRIAAETAQGLEYLHIGCKPPMIHRDIKSMNILLDNNFQAKLGDFGLSRSFPVGSETHVSTNVAGSPGYLDPEYYRTNWLTEKSDVFSFGVVLLEIITSQPVIDQTREKSHIGEWVGFKLTNGDIKNIVDPSMNGDYDSSSLWKALELAMSCVSPSSSGRPNMSQVANELQECLLTENSRKGGRHDVDSKSSLEQSTSFGPEHIPDAR

SEQ ID NO: 88626 - protein, 459 aa, Pseudomonas syringae pv. syringae B728a
MSSGRIVQIIGAVIDVEFPRDSVPSIYNALEVQSAAGTTLEVQQQLGDGVVRTIAMGSTEGLKRGLEVTDSGAAISVPVGKATLGRIMDVLGNPIDEAGPIATEERWGIHRPAPSFAEQAGGNDLLETGIKVIDLVCPFAKGGKVGLFGGAGVGKTVNMMELIRNIAIEHSGYSVFAGVGERTREGNDFYHEMKDSNVLDKVALVYGQMNEPPGNRLRVALTGLTMAEKFRDEGNDVLLFVDNIYRYTLAGTEVSALLGRMPSAVGYQPTLAEEMGTLQERITSTKNGSITSIQAVYVPADDLTDPSPATTFAHLDATVVLSRDIASLGIYPAVDPLDSTSRQLDPNVIGQEHYDTARGVQYVLQRYKELKDIIAILGMDELSETDKQLVNRARKIQRFLSQPFFVAEVFTGASGKYVSLKDTIAGFKGILNGDYDHLPEQAFYMVGGIEEAIEKAKKL

SEQ ID NO: 88627 - protein, 141 aa, Arabidopsis thaliana
  misc_feature (126)..(126): Xaa can be any naturally occurring amino acid
GAHARERRRETQEGAGLPLFLSSAAAVTSPAQATMGAPFTGLKASAALPVTRKTNKDITSIERNGGRVSCMKVWPPIGKKKGETLCYLPDLNDVQLAKEADYLVRNKWSACVECELKHRVVYRERXYTPRYYDGRDWTMWK

SEQ ID NO: 88628 - protein, 279 aa, delta proteobacterium MLMS-1
MAPLANQSGNVYMSTPADQPRLAEETPTTANPWPPCRNACPVHADVRTYVDHIAREEFTKALAVIRRRLPLAAICGRICDHPCEANCRRRDVDQAVAIRELKRFVAEYPENDDVPVTAGPGDRQQVAIIGAGPAGLSAALELARRGFRPTIFEKEKVAGGIPGVAIPTYRLPRQALKRDIDWILAHGIKLQSGVEVGVDTTINKLKKQGFAAVIIAVGMSQSRILPLPGTDAPGIHGALDFLRARRRRPRVGTGPGSAGDWRRQRGLRHRPHRRPAGLR

SEQ ID NO: 88629 - protein, 450 aa, delta proteobacterium MLMS-1
MPPASTVLWTSCGPAAAGRELELGREVLVIGGGNVACDTARTAVRLGCDKVRMICLESEEEMPALPEEITESRDEGIEIITRRGPLEVVLEDGKISGLRHRLVTRVFDEEGRFAPEFDDHDLAITPCQSIIFAIGQAVEPGFIKGSKLTMDERGRLVHDPETRQTSVPWVFAAGEAVSPPGTVVRACADGRRVAQGVEQFLQGETIQLARETPAVIDRLQPERAAKVSKVERAEPEIRPAARRQRDFQPFIGTLPHQQTVTEARRCLECGNGATVQNDYCVKCLNCVRLCPYDAPRIDRTARVPAEHCLACGLCYGACPTGAIRLQNNSPEQLAASSQRLLAELDGKQPRTIAYICDRPATKIGPWREQTGATEAAAIHLPNAGLLEAGQLLQTLEAGAERILVILPATDDEYHKGTGHRLRRRIQRLQADLLALGLDPNRIQLWPEASE

SEQ ID NO: 88630 - protein, 600 aa, Dehalococcoides sp. BAV1
MAKTKKPVEKLEPAEETKKDGKVVSTKRTKGSEFFWTQSRCTGCNRCASVCPVDAIKLERDKMPTKRVGTSPCTRACPAGLDIPRYVRFVADGNAPAATAVMREKIPFPSVCGYVCFHPCELECQRQKFDEPIAIRALKRYAAENDDGSWKNNLKIAPPTGKKVAIIGSGPTGLTSAYFLTLLGHEATIFESMEYAGGKMFYSIPEHQLPKEILNKEIKTITDLGVTIHTSCQVQSVQTLFKQGYDSVLLSTGVLGVDEGLLLPCDETAKSDLIKGSDFLKGIKSTTKETLGDKVIVIGGGSEAYNSAFAAKNLGVSEVNLVCSRHTGSKEASPEEVDRAIDAGVTVQPSLDFVKLVKLNDKIEGVELFRIRSYGYDKENKLHYEIINDTRRLISADTIITTVAQNDKPGSDYLSVVQPGVFAAGDGISGARSVIEAMAAGRSVAGLIDKYLGGEGNLDETLAPPEKTIKPLGEPKSQNRSQVELNLVKQAGGDKVEIEKTLSPNAAKKEAQRCLRCDIVHQVHDYSLDTSSCTYCGRCVDACYWDAITNGYGYEAAAKKRKAEAAALEEKNSVYNYAIRILPIAIGLMILAAAIAKLST

SEQ ID NO: 88631 - protein, 399 aa, Methanothermobacter thermautotrophicus str. Delta H
MITMIQIAVTGKPNVGKSSFFNAATLSEAEVASYPFTTIDANHAVAYASCRCPCRELGVECNPRNSRCINGVRLIPVELIDVAGLVPGAHEGRGLGNKFLDDLRQARAFLHVIDASGSTDEEGRPVEAGSHDPLEDVEFLEEEITMWLYGILERNWERLLRKAASEKLDMNRIIHEQLSGTGITPEDIIEASRKVDADVYSWGKDELLQFLDELLRIAKPMLIVANKADLPSAGENIERLKDAYPHVVPASAEAELALRRAAEAGLISYTPGGSEFEIIDESKLTDKQRAALEYIRENVLEVYGSTGVQEAINRAVFDLLDMIVVFPVEDEHRFTDQKGNVLPDAILVPRGSSPRDLAYLIHTEIGDSFLHAVDARKGMRVASDHELEDGDIISIICSR

SEQ ID NO: 88632 - protein, 410 aa, Arabidopsis thaliana
MGSLGTMLRYPDDIYPLLKMKRAIEKAEKQIPPEPHWGFCYSMLHKVSRSFSLVIQQLNTELRNAVCVFYLVLRALDTVEDDTSIPTDEKVPILIAFHRHIYDTDWHYSCGTKEYKILMDQFHHVSAAFLELEKGYQEAIEEITRRMGAGMAKFICQEVETVDDYDEYCHYVAGLVGLGLSKLFLAAGSEVLTPDWEAISNSMGLFLQKTNIIRDYLEDINEIPKSRMFWPREIWGKYADKLEDLKYEENTNKSVQCLNEMVTNALMHIEDCLKYMVSLRDPSIFRFCAIPQIMAIGTLALCYNNEQVFRGVVKLRRGLTAKVIDRTKTMADVYGAFYDFSCMLKTKVDKNDPNASKTLNRLEAVQKLCRDAGVLQNRKSYVNDKGQPNSVFIIMVVILLAIVFAYLRAN

SEQ ID NO: 88633 - protein, 190 aa, Kluyveromyces lactis NRRL Y-1140
MAIQSVMIINKSGGLVYNHNFIEPKGTMNSNDYLILAGTLHSVFAIASQLTPKAVQISNKSSQKTETQVPYIPGIGVSTENKMAPLQLGSFMGPDYFQEPFTNWNKSGLRHMITDEFSMFLFQSLTGIKFVLISTNNFRNNTSVSIAENILRKIYCIYSDYVMKDPFYSLDMPIRSELFDSNLKNLIESL

SEQ ID NO: 88634 - protein, 357 aa, Aspergillus nidulans FGSC A4
MSEAGYQRQLLLLPRLLQEELDRGLFNPFPTYQFTGSVRPVYPLSPRRPVPKIITHPDWAETGIPRREMRLSRSKWDLLDAKGQQAMRKVCRLAREVLDITAAAVKPGVTTDYLDEICHNACIERGSYPSPLNYNHFPKSICTSVNEVVCHGIPDQRVLLDGDILNLDVSLYHGGYHADLNETYYVGDKAKADPDAVKLIETTRQALDMAIEIVKPGVPIREFGRIIEKHAASRGLAVIKTWGGHGINSEFHPPPWIPHYAKNKAVGTCKPGMTFTIEPILTLGANREKYWPDDWTNVTMDGKRTAQFETGVEVLTARQENSPGGPIPIPEVVNGVADGVANGDANRDANGAAINES

SEQ ID NO: 88635 - protein, 703 aa, Desulfococcus oleovorans Hxd3
MINAIFPFMAWLRGYNLDKFKVDGISGLTVALVLIPQSMAYAQLAGMPSYYGLYASFLPPLVAALFGSSRQLATGPVAVVSLMTSASLEPLATAGSEGYIAYAIMLALMVGIFQFSLGVLRLGLVVNFLSHPVVNGFTNAAAIIIASSQFSKLFGVDVDKAAHHYETIIRVVEAAIHYTHWPTFFMGALAFAIMVILKRINPRIPNVLVAVAVTTIMAWAMGFEHNTTVTLDAIQAPEVHETATAYNGCIDQIRAIVEERTAAMKHLDEAKTAHDAMSVMAAEHDLRVANYKIDQLKEEAHLYRDELRSKLFVADASGSVFYLNDPAAQNLSGRTWRIKLRAAALNPDSITMSGGGAVVGVVPKGLPAMSIPKIDMKIMLHLFPYAAIISLLGFMEAISIAKAMAAKTGQRLDPNQELIGQGLANMIGAAGKSYPVSGSFSRSAVNLQAGAVTGLSSAFTSLAVVIVLLFFTPLLYHLPQAVLAAVIMMAVIGLVNVSGFIHAWKAQWYDGAISIISFICTLAFAPHLDRGIMVGVALSLGVFLYKSMRPTVASLSRKEDDAFRAAMVHGLQKCKYIDLVRFDGPLFFANASYLEDKINDRMMQRKDLRHIVIAANAINDIDASGEETLSLLIDNVRSAGVKISFSGVNESVMRVLERTHLLARIGPENIYPTMEKAVCAIHADAHQNADEPDCPLMTVCRIA

SEQ ID NO: 88636 - protein, 460 aa, Kurthia sp. 538-KA26
MNSHDLEKWDKEYVWHPFTQMKTYRESKPLIIERGEGSYLFDIEGNRYLDGYASLWVNVHGHNEPELNNALIEQVEKVAHSTLLGSANVPSILLAKKLAEITPGHLSKVFYSDTGSAAVEISLKVAYQYWKNIDPVKYQHKNKFVSLNEAYHGDTVGAVSVGGMDLFHRIFKPLLFERIPTPSPYTYRMAKHGDQEAVKNYCIDELEKLLQDQAEEIAGLIIEPLVQGAAGIITHPPGFLKAVEQLCKKYNILLICDEVAVGFGRTGTLFACEQEDVVPDIMCIGKGITGGYMPLAATIMNEQIFNSFLGEPDEHKTFYHGHTYTGNQLACALALKNIELIERRDLVKDIQKKSKQLSEKLQSLYELPIVGDIRQRGLMIGIEIVKDRQTKEPFTIQENIVSSIIQNARENGLIIRELGPVITMMPILSMSEKELNTMVETVYRSIQDVSVHNGLIPAAN

SEQ ID NO: 88637 - protein, 573 aa, Triticum aestivum
  misc_feature (396)..(396): Xaa can be any naturally occurring amino acid
  misc_feature (434)..(434): Xaa can be any naturally occurring amino acid
  misc_feature (455)..(455): Xaa can be any naturally occurring amino acid
MAGGGVEDVYGEDRATEEQLITPWSFSVASGHQLLRDPRHNKGLAFSEAERDAHYLRGLLPPAIVSQEHQEKKIMHNLRSYTVPLHRYVAMMDLQERNERLFYKLLIDNVEELLPVVYTPVVGEACQKYGSIYRRPQGLYISLKDKGKVLEVLKNWPERSIQVIVVTDGERILGLGDLGCQGMGIPVGKLSLYTALGGVRPSACLPITIDVGTNNETLLNDEYYIGLRQRRATGEEYHELLQEFMNAVKQNYGEKVLVQFEDFANHNAFDLLAKYSKSHLVFNDDIQGTASVVLAGLLAALRMIGGGLVDQTYLFLGAGEAGTGIAELIALEMSKHTELPVDDCRKKIWLVDSKGLLVESRKESLQHFKKPFAHEHEELKTLLEAVQSIKPTVLIXGTSGVGKTFTQEVIEAMASFNEKPVIFSLSNPTSHSEXCTAEEAYTWSKGTAVFASGSXPFDPVEYEGKTFVPGQSNNAYVFPGFGLGVVISGAIRVHDDMLLAASEALAEEATQENFDKGLIFPPFTNIRKISASIAAKVAAKAYDLGLASRLPRPDDLVKYAESCMYTPLYRSYR

SEQ ID NO: 88638 - protein, 477 aa, Vitis vinifera
MQRFVVGRVSQEKHFLQWRRNLSQLVQNKAPLQENDLLLPKMPPFDYSPPPYNGPSAADILQKRKQYLSPSIFCFYNQPVNIVDGKMQYLFDEKGRRYLDAFGGIATVNCGHCHPDVVDVIVKQINRLQHSTVLYLNHAIADFAEALASKMPGDLKVVFFTNSGTEANELAMMMARLYTGCNDIISLRNAYHGNAAGTMGATAQRVWKFNVVQTGVHHALNPDPYRGMFGSDGEKYARDVQDLIDFGTSGHVAGFISEAIQGVGGIVELAPGYLPAVYSSVKKAGGLFIADEVQSGFARTGSHFWGFESQGVVPDIVTMAKGIGNGIPLGAVVTTPEIAEVLTRRNYFNTFGGNPVCTTAGHAVLKVIEKEKLQENAYVVGSYLKERLLSLKDKYEIIGDVRGRGLMLGVEFVTDRKLKTPANVEILHIMDQMKEMGVLVGKGGFYGNVFRITPPLCFTKEDADFFVDVMDYAMSKM

SEQ ID NO: 88639 - protein, 774 aa, Populus trichocarpa
MTGHLTRRHGSAAPPSFCLVTSSVANSSCHQQQQRRNRKRNNSFWGRQRRESESIQGEEKNRDWASLHREEEGPFLTPGLGTTAVLSLHRDLRPPPSSTAIPPPSTLPTPAEPEREKRNRTEPRERKPGEEKNHSGKKKNHRSSLEPAEPSANHHRSFLHPDLEPPSTKKEEETLLTEGTKNRGRKQHSEAEERRRKTAASATVCHHRCPSRRPDHRHRRQPGPTIRKRDQTLDFDQTNKTMQLTLEKKRKDLKTLLHNDTKVTRQATGDARMTHNKTCMLPLDRNLHICRAEAAAAADGQPLFGEETDKPKFLGIELATFKKIIPLGLMFFCILFNYTILRDTKDVLVVTAKEAFADKLLNVLGPRFLGPLAIMRIWTFCLFYVMAELWGSVVVSVLFWGFANQITTVDEAKRFYPLFGLGANVALIFSGRTVKYFSNLRKNLGPGVDGWAVSLKGMMSIVVLMGLAICLCYWWVNTFVPLPTRSLKKKEKPKMSTMESLKFLVSSRYIRDLATLVVAYGISINLVEVTWKSKLKAQFPSPNEYSAFMGDFSTATGIATFSMMLLSQFIFDKYGWGVAAKITPTVLLLTGVGFFSLILFGGPLAPTLTQFGMTPLLAAVYVGAMQNIFSKSAKYSLFDPCKEMAYIPLDEDTKVKGKAAIDVVCNPLGKSGGALIQQFMILTFGSLANSTPYLGGILLVIVFAWLGAAKSLDTQFTALRQEEELEKEMERAAVKIPVVSQEGGNGALSSGTALNPTTGDPSSSSSEPSSPRNI

SEQ ID NO: 88640 - protein, 289 aa, Candidatus Pelagibacter ubique HTCC1002
MQNISFIGIGLMGFPMAKNLLKSGFNLRAYNRSQDKADRLKEFGAEISTSIKDVVTNSDVIITMLTDDAAVEKVMGSDEFISNIKEGATVIDMSSVNPVITKKYFKILKEKNINYLDAPVSGGTIGAEEASLAIMVGGDEETFKQCYDLLKILGNPTLVGPVSSGQISKLANQIIVGVTIGAVAEAVTLCEKSGTNPNKMIEALSGGWADSKILQTHGKRMINKDFTPKGKTTTQLKDMTNIINAGKAAETHLPISSLVKEMYKDLVADGQGNTDHSSLYKAIEKINKK

SEQ ID NO: 88641 - protein, 299 aa, Oryza sativa Japonica Group
MAVESPFRADVLRGKAALVTGGGSGIGFEIAAQLARHGAHVAIMGRRREVLDKAVAALRSHGLRAVGFEGDVRKQEDAARVVAATVQHFGKLDILVNGAAGNFLASPEDLTPKGFRTVVDIDTVGTYTMCYEALKYLKKGGPGKGPSTGGVIINISATLHYTAAWYQIHVSAAKAGVDSITRSLALEWGTDYDIRVNGIAPGPIEGTPGMRKLAPEEMAKGSREIMPLFKLGEKWDIAMAALYLASDAGKYVNGTTVVVDGGLWLSRPRHIPKEEVKELSKVVEKKVRASGVGVPSSKL

SEQ ID NO: 88642 - protein, 265 aa, Fusobacterium nucleatum subsp. vincentii ATCC 49256
MTTLDGQEFFAGDYNTKFTIQSISKIISLMLAILDNGEEYVFSKVGMEPSGDPFNSIRKLETSSRKKPYNPMINAGAIAVASMIKGKDDREKFLRLLDFAKLITEDDTLDLNYKIYIGESDTGFRNYSMAYFLKGEGIIEGNVNEALTVYFKQCSIEGTAKTISTLGKFLANDGVLSNGERILTTRMAKIIKTLMVTCGMYDSSGEFAVRVGIPSKSGVGGGICSVVPGKMGIGVYGPSLDKKGNSLAGGYLLADLSEKLSLNIF

SEQ ID NO: 88643 - protein, 432 aa, Oryza sativa Japonica Group
MNGASSGGGGGAGAGGDGPLVYQRWKGNNDMYGVLGSEKDKKHEYLALVFVLQGRFIFGPDARSLYVTMFLIIAPASIFCLFVAKELMNNFSYGLGLPVMISAVVFTAYDLSLLLLTSGRDPGIIPRNAHPPEPEGLDGNAEVGSNQTPPMRLPRVKDVVVNGITVKTKYCDTCMLYRPPRCSHCSICNNCVERFDHHCPWVGQCIGLRNYRFFYMFVFSTTLLCLYVFGFCWVYIVKIRNSEQITIWKAMAKTPASIALLVYTFIAVWFVGGLSVFHLYLMSTNQTTYENFRYRYDQRANPYNRGVMENIKDIFFSAIPASKNNFRARVPVPQEQGLRPRPTNGFMSPNMGRAVGDIEMGRKPVAWDEPRMAADIGDLGAGLGNLLEDKDGRFRSASPDLSRDALAIGGLDDQGSSVMNPGRTSWGVEAGR

SEQ ID NO: 88644 - protein, 630 aa, Zea mays
  misc_feature (218)..(218): Xaa can be any naturally occurring amino acid
MAAASTATAASHSASFPAASLRHDARRPSCVAPAAAAATTAAETGLTAVPAPPPTPMLRVVPESLQRDSGCLVAGFRERGAGAADGEGFGDAVGEGGGPGAMEYLTSVLSSKVYDVAIESPLQLATKLSDRLGVNLWIKREDLQPVFSFKLRGAYNMMAKLSREQLERGVICSSAGNHAQGVALSAQRLGCDAVIVMPVTTPEIKWKSVERLGATVVXLEGDSYDEAQSYAKLRCQQEGRTFVPPFDHPDVITGQGTIGMEIVRQLQGPLHAIFVPVGGGGLIAGIAAYVKRVRPEVKIIGVEPSDANAMALSLCHGKRVMLEHVGGFADGVAVKAVGEETFRLCRELVDGIVMVSRDAICASIKDMFEEKRSILEPAGALALAGAEAYCKYYNLKGETVVAITSGANMNFDRLRLVTELADVGRKREAVLATFLPERQGSFKKFTELVCHMSLRCSSVRLSFPPHGWRLLGSHHCRRRRLWHARGASSALGASIDITATHSTLVVTLATTKAVVAAVGNRERVATLAWEHERTTVDAIASQLAKRYALDDHILADTVPHLLLSWHRMDNMVLLWILSTLTVELEDVVRERRAPLTRHGLPLRHSSLKSKRLALSTSMPPFGSSPKGTSS

SEQ ID NO: 88645 - protein, 516 aa, Oryza sativa Japonica Group
MVIARGLLRSNASSSSSQAINLLKYVTSTGSLQGHTQNLCDASTRHFSSVPSPQYNSTEENGFKGHGMLAPFTAGWQSTDVHPLVIERSEGSYVYDIDGKKYLDSLAGLWCTALGGSEPRLVKAATEQLHKLPFYHSFWNRTTKPSLDLAKELLSMFTAREMGKVFFTNSGSEANDSQVKLVWYYNNALGRPDKKKFIARSKSYHGSTLISASLSGLPALHQKFDLPAPFVLHTDCPHYWRFHLPGETEEEFATRLANNLEELILKEGPETIAAFIAEPVMGAGGVIPPPKTYFEKVQAIVKKYDILFIADEVITAFGRLGTMFGSDMYNIKPDLVSMAKALSSAYVPIGAIMVSPEISDVIHSQSNKLGSFAHGFTYSGHPVACAVAIEALKIYQERNIPDHVKQISPRFQEGVKAFAGSPIVGEIRGVGLILGTEFADNKSPNDPFPAEWGVGAIFGAECQKRGMLVRVAGDNIMMSPPLIMTPDEVEELVSIYGDALKATEERVAELKSKKNN

SEQ ID NO: 88646 - protein, 512 aa, Pseudomonas syringae pv. phaseolicola 1448A
MNQPARITPTTPSPAPGLTELFEAQKAAARSQGVPSYAQRIADLNAILRVVSDNQDRLLEAVSADFGNRSFAETRLGELMPVINGIKHIRSHLKAWMRPSRRKVGIVFKPATAKVIYQPLGVVGILAPWNYPLTLTLVPLIEALAAGNRVMIKPSELTPRTSELLRQLLGETFSAEQVTVVTGDALLASQFSELPFDHLVFTGSTHVGRHVMAAAARNLTPVTLELGGKSPVVICDDYSIKKAARMLAIGKLFNAGQTCVAPDYILVPREHVNSFAGEWLAAAKKLYPTLEGNPDYTSIISQRHHDRLVSMANQALSKGAKAWQHGASVSTLERKIAPMALTDVPLDADLMQEEIFGPLLPILAYDSLDEAIAFINDRPAPLALYCFSNDQTSVNQVLNRTQSGGVTINGTMLHATQDDLPFGGVGQSGTGAYHGYEGFVRLSHARGVLKLSRFNMSDKVSAPLWTADTPCNPLHARQIDACRATASGDRTSPRLDMPACPAFRTANDNHCL

SEQ ID NO: 88647 - protein, 247 aa, Saccharomyces cerevisiae
ARTFFVGGNFKLNGSKQSIKEIVERLNTASIPENVEVVICPPATYLDYSVSLVKKPQVTVGAQNAYLKASGAFTGENSVDQIKDVGAKWVILGQSERRSYFHEDDKFIADKTKFALGQGVGVILCIGETLEEKKAGKTLDVVERQLNAVLEEVKDWTNVVVAYEPVWAIGTGLAATPEDAQDIHASIRKFLASKLGDKAASELRILYGGSANGSNAVTFKDKADVDGFLVGGASLKPEFVDIINSRN

SEQ ID NO: 88648 - protein, 411 aa, Arabidopsis thaliana
  misc_feature (128)..(128): Xaa can be any naturally occurring amino acid
MGSKRKEEKMDYMYGPGRHHLFVPGPVNIPEPVIRAMNRNNEDYRSPAIPALTKTLLEDVKKIFKTTSGTPFLFPTTGTGAWESALTNTLSPGDRIVSFLIGQFSLLWIDQQKRLNFNVDVVESDWGXQGANLQVLASKLSQDENHTIKAICIVHNETATGVTNDISAVRTLLDHYKHPALLLVDGVSSICALDFRMDEWGVDVALTGSQKALSLPTGLGIVCASPKALEATKTSKSLKVFFDWNDYLKFYKLGTYWPYTPSIQLLYGLRAALDLIFEEGLENIIARHARLGKATRLAVEAWGLKNCTQKEEWISNTVTAVMVPPHIDGSEIVRRAWQRYNLSLGLGLNKVAGKVFRIGHLGNVNELQLLGCLAGVEMILKDVGYPVVMGSGVAAASTYLQHHIPLIPSRI

SEQ ID NO: 88649 - protein, 207 aa, Clostridium perfringens str. 13
MKIYFTRHGETLWNLEHRFQGWKDSELTENGVKRAELLGKKFNDIKIDKIFTSPIKRAKRTAYLIKGDKDIEVEEVEGLKEISFGKWEGMTTEEIKSHDEYVNELDNLFNKPFSYKSFEGENIKDFTERLFKTVDDIVKNNEDKDILIVTHGMCVRYLIGYFKNEFEESKIIDYPIFHQASYNEVEWNGENFEVITLNNIDHYEYDK

SEQ ID NO: 88650 - protein, 570 aa, Oryza sativa Indica Group
MELFYELLLTAAASLLVAFLLARLLASAATASDPRRRAPDHAAVIAEEEAVVVEEERIIEVDEVEVKSARARECVVSEGWVEVGRASSVEGKLECLPEEEEAPAKAARELVLDAVLEEREEEGQVGEERCDLAAAVAEVVGVKPHELGVEAAPGEVSDVTLEEGKVQDVGVEQHDLVAEAAPREALDTGLEKQGVPIIEAVEIKRQDDLGAEVAPSDVPEVEFEQQGVRIIEAIDVNQHHRVALAAPAEVVDAGLEERVQAIEAGSSGLTSETVPEEVLDELSEKQEEQVIEEKEHQLAAATAPVAIPGVALAETEELKEEQSSEKAVNVHEEVQSKDEAKCKLHLVDQQEGSASKVELVGRNTDNVEISHGSSSGDKMIAELTEEELTLQGVPADETQTDMEFGEWEGIERTEIEKRFGVAAAFASSDAGMAALSKLDSDVQLQLQGLLKVAIDGPCYDSTQPLTLRPSSRAKWAAWQKLGNMYPETAMERYMNLLSEAIPGWMGDNISGTKEHEAGDDAVGSVLTMTSNTINQHDSQGNEDNTGMYEGHLTSSPNPEKGIGADHNACI

SEQ ID NO: 88651 - protein, 296 aa, Lactobacillus plantarum WCFS1
MNKQLLTEFESKWRPQINQYLDEQLQACSDQSTLTDAMRYSVLAGGKRLRPLLTLAILDTFDITTTAANLRASVAVELMHTYSLIHDDLPAMDNDQLRRGEPTNHVKFGEDVAILAGDALQPLTFEWIADSGLPASIVANQTLALAQATGPRGMVAGQVADVLGAGQHLALPALQQLHREKTGALIHYAVQAGLIQAQVQPTVQELLLQYADAYGLAFQIYDDILDVTSTPAQLGKATHKDADEHKNTYPGLLGLAGARTALEQAVTAAQTALVKASAASQRGMGLLAAFLTYFTD

SEQ ID NO: 88652 - protein, 162 aa, Mycobacterium smegmatis str. MC2 155
MEFDVVIEIPKGSRNKYEVDHETGRVKLDRYLYTPMGYPTDYGFFENTLGEDGDPLDALVLLTESVFPGCVVEARPVAMFKMTDEAGGDDKLLCVPAGDPRWDHIQDVGDISQFELDAIKHFFVHYKDLEPGKFVKTADWEGRAEAEAELQRSVERFKSSGH

SEQ ID NO: 88653 - protein, 711 aa, Dechloromonas aromatica RCB
MFSGKCMAVHRLDNDVAHLVFDRQESVINKLDRATLEEIEIAVKLVAADTSLRGLLVSSAKDNFIVGADIKEFGELFGRDEAALDAHMRWANQIFCAFEDLPIPSVVAINGMALGGGLEFALGATLRVMAENAQIGLPEVTLGIFPGYGGTVRLGRLAGAQVAVDWVASGKPRRAAEALVAGVVDAVSPAEQLQEQALSLLGRAMAGEIDVAAIRRKKQGAIPGHHDAVFADALTRQAKALAVHLPAAAMAIASMARGAGKGRDLALDEERHALLKVVKTQAAGAMIQGFHNQQALKKLFGRHRANARRVRSAAVLGAGIMGGGIAFTSALKGVPVRLKDISRQQLDLGMAEAKKQIGRQIKSGRVSEAKGQQVLTSIQPQLDYAGFSDCDLVVEAIIENLKVKHAVLSELEQAVAPDTVIASNTSSLRIDEIAMPLQRPENFVGMHFFNPVPVMALVEVIKGSRTSDVAVSTAVDYAVTMGKTPIVVQDCPGFLVNRILTPYVRAFLDLVADGVDFVRIDRVMEVFGWPMGPAYLMDVVGIDTGCHVFDVISAGYPAVMPIQENNALAVMVANQRYGQKNGIGFYRYENDPTGKPKKTVAEDSYPLLKPIQLSPPREVSDEEIVERMMLSSILEAARALEDGVVATAGELDVAMLLGIGYPQYLGGPLKYADWLGLPKVVALGEKHGHLGPQYRVTDKIRSMAASGAQFY

SEQ ID NO: 88654 - protein, 316 aa, Listeria innocua Clip11262
MTMYVKSNTTGKDMLSLLEWNKEELIDIIKLAVAMKTNPAHYSHILSGKILGMIFDKPSTRTRVSFEAGILQLGGQAIVMSSKELQIGRGEPIKDTAHVMSEYIDAIMIRTFSHEKVEELAYHAEIPIINGLTDLHHPCQALADLMTIYEWKDQLEGVKLAYIGDGNNVCHSLLLAGAMVGLDIRLAMPKGYEVDETILATAENLAKESGAKIFVTEDPKHAVTDADFIYTDVWTSMGQEEENAKRLADFGEKYQVNAELASIAKPDYHFLHCLPAHREEEVTAEIIDGNHSVIYQQAGNRLHAQKALLAAILEAK

SEQ ID NO: 88655 - protein, 183 aa, Zea mays
  misc_feature (35)..(35): Xaa can be any naturally occurring amino acid
  misc_feature (106)..(106): Xaa can be any naturally occurring amino acid
  misc_feature (147)..(147): Xaa can be any naturally occurring amino acid
  misc_feature (161)..(161): Xaa can be any naturally occurring amino acid
  misc_feature (171)..(171): Xaa can be any naturally occurring amino acid
MGRRWTTTTIERTLTEAHLKANKEIVRADLNVPLXRAQNITCDTRIRSSFPTVKFLLDKGALVILDMSPGLSVGRSRPLTPRMLLFHICLNSLIVVSSMLSDDCIXVTSCYIGCRFDDSRLLLLENVVFYNEEENNEPEDADRVASXADLYVHDAFGTGRXAHASSEGVTXISTLSAAGFLMQ

SEQ ID NO: 88656 - protein, 384 aa, Listeria innocua Clip11262
MKHVFPTYNRFPVDIVKGNGTVVKDATGKTYLDFTSGIAVCNLGHCPENVTEAIQSQLANIWHTSNLYECALQDSVAELITDGTDKLVFFCNSGTEANEAALKLARKYTGKEKIITFEKSFHGRTFGSMSATGQAKIHQGFGRLVPGFTYVPYNDIESFKTELDENTAAVMLEVIQGEGGVIPGNAAWLMEVQMLCKKAGALLIIDEVQTGLGRTGTLFGFQQTFLDPDIFTLAKGLGNGLPIGAMVGKEHLSSAFGPGSHGSTFGGNKLALAAAKEILLTMKQTGFLEEVNAKAAYFRNLLEEHFEQLENVVAIRGEGFLIGIELGSSAAPVVTELRDKGLLILTAGPNILRILPPLTVSYAEIDQAISILKSVLEKQLIGSE

SEQ ID NO: 88657 - protein, 250 aa, Listeria innocua Clip11262
MKNTIVIKLGGVASDNLTDDFFQQIIKWQAEKKKIVLVHGGGHYITKMMKALDIPVETKKGLRVTNKQALEVTKMVLIGQVQPAITTAFQKRNISVIGLNAGDTGLLEADQINDSDLGFVGKITKVKTALIEQLLAENIITVIAPLGINSAHDWLNVNADTAACEVASALNAEALYLLTDVPGVKNGAKIIDEIATDEINKLQTTDIIKGGMIPKLASAAFAAENGVGQVIITNSLENPGTKIKSKVAIR

SEQ ID NO: 88658 - protein, 387 aa, Corynebacterium efficiens YS-314
MRSQSSCHPGDNTGPGVKLGHVLPSDVESEHLNMTTPHHPTPVRAWGVTAFAQPLESLTITRRELRADDVSIDIEYAGICHSDIHTATGDWGEREYPLVPGHEIVGRVSAVGDAVTKHRVGDRVGVGCFVNSCGHCEPCRAGEHSYCDTGAVLTYGSEDRYADGEYTQGGYSQAIVVKEDFVVRVPESLDPAAATPLLCAGITTYSPLKHHGAGPGKKVGIIGLGGIGHVAVKIAVAMGAEVVVFSHSTSKREDALKFGATEHVSTADPTFAETWGGQFDLILNTVSVNLDTATYLSLLCFDGALVALGLPNDPMEVPTRMLTSKRRTLTGSLVGGIPETQEMLDFCAEHNITAEIELIDATSINEAYERTINSDVRYRFVIDAATF

SEQ ID NO: 88659 - protein, 275 aa, Xanthobacter autotrophicus Py2
MNYVEAANAPLRKTGHIKLYGPEGFAGMRKAGQLTAQALDAVADMVAPGVTTDAIDRLIYEFAMDHGAYPATLMYRGYRFSVCTSVNHVVCHGMPNARPLREGDIVNVDVTLVLDGWYGDSSRMYPVGAIPRRAERLLEVTYDAMMLGIAAIRPGGHVGDIGAAIQDFVEPQHMSVVRDFCGHGVGQVFHDEPNIVHVGRRGEGPKLVPGMIFTVEPMINLGRPHVKVLSDGWTAVTRDRSLSAQFEHAVGVTETGVEIFTLSPKGYHQPPYISA

SEQ ID NO: 88660 - protein, 262 aa, Xanthobacter autotrophicus Py2
MIRTPLITVMVQAVRKAGRALARDFGEVEQLQVSMKGPGDFVSAADRKSEETLHAELLRVRPTYSFLMEESGAVEGADTSNVWVVDPLDGTTNFLHGIPIFSISLALVRNGVPVAGVIFNPVMDELYVAEAGQGAYLNDRRLRVAGRKKLADSVVCCGLPHMGRGDHAKFNRELEKVQGQVSGLRRTGSAAIDLAWVASGRFDAFWERDLSAWDMAAGIVMVREAGGIVTDLSDGDKMLDKGSVIAGNEIIRSDLMRLLKSA

SEQ ID NO: 88661 - protein, 388 aa, Ralstonia solanacearum GMI1000
MNIHEYQGKEILRKYNVPVPRGIPAFSVEEALKAAETLGGPVWVVKAQIHAGGRGKGGGVKVAKSMDEVKTYASNILGMTLVTHQTGPEGKKVNRLLIEEGADIKKELYVSLVVDRVSQKVALMASSEGGMDIEEVAAHTPEKIHTLIVDPQIGLQDAEADDIARKIGVPDASVPQARQALQGLYKAFWETDASLAEINPLILTGDGKVIALDAKFNFDSNALFRHPEIVAYRDLDEEDANEIEASKFDLAYISLDGNIGCLVNGAGLAMATMDTIKLFGGEPANFLDVGGGATTEKVTEAFKLMLKNPGLKAILVNIFGGIMRCDVIAEGVIAASKAVSLSVPLVVRMKGTNEDLGKKMLADSGLPIIAADTMEEAAQKVVAAAAGK

SEQ ID NO: 88662 - protein, 427 aa, Vitis vinifera
MQRRRMMIKWARDTVRRRFMSTSAAAIDWWDHVGHAPKDPIMSVTEAFLSDTSPNKINLGVGAYRDDDGRPVVLQCVRDGEVKIAGTEFLESVSASVSSKLVEESVKLIYGKEADFIKEGRFAGVQALSGTGACRLFAEFQRRFYPQSRIYLPIPTWSNHHNIWRDAQVPGRTFHYYHPDSKGLHFAALMDDIKNAPDRSFFLLHPCAHNPTGVDPTEEQWREISNLFKVKNHFPFFDMAYQGFASGDLDKDAKAIRIFLEDGHLIGCAQSFAKNMGLYGHRVGCLSVLCVDAKQAVAIKSQLQHITRAMYSSPPVHGILLVSTILSDPHLKELWKKELKVMANRIHRMRSTLHESLKKLGSPLNWDHMTNQVGMFCFSGLSPDQVNRLVKEFHIYMTYDGRISMAGVTTSNVSYLANAIHEVTKFG

SEQ ID NO: 88663 - protein, 678 aa, Coprinopsis cinerea okayama7#130
MTGFSSLPLASEEGDAGQNARKFTGVAHIVGPRWAHLPTLTVGLLGVQVFWSVEMSYASPYLLSLGLSKSSMAIVFLAGPLSGLIMQPLIGVLADNSTSRFGRRRPYMMLGTVLCMAGMLLLGFTRPVASIFTTLGSSANDTLTIWLAVLAIYFIDFAINAESAVQAMDRALLVDTLPTSKQAPGNAWAAKMLGVGAVVGFFVGKLELTKAFPYLGRTQLEVLSVIVSFFLFTTHSITALFVKERVLLKSTQVEGKTKKQNAFIREVKDIWSNVLTLPWVIRQICFIQFCAWIAWFPVLFYSSIYVGDFHKHASPVPTTAEGRAALDADATRMGSRALFYSSLIALVCNFALPLFILKSNPRNGLPEAQGRYSRFAIPAVLKFHLASLWAFSHLIFALCMFATFFTHSLAGATALIAITGFSWAVTQWAPFALLAEAILTEPGPATADDGGSIQLEDARTRNHDERTAFLVGNDSDGEDDDDVRKAEENRRMLLGNPSAHVSTLDVDRSGSRSTDNEYEIVNGSDAYDSPRTSTRHDREDDGLDTSDANPSGGLSAKAGIILGIHNVFIVIPQFLVTGLSSIIFALFDEKPAVPPHSGAAPAPVLNGTDVLNAVKNVSSALADTVRGRDNLYHLLPRAEDAVPTAKANSVVYVFRLGGVAATFAFVLCWRLAREMRHR

SEQ ID NO: 88664 - protein, 170 aa, Triticum aestivum
  misc_feature (157)..(157): Xaa can be any naturally occurring amino acid
AYLGDLQNKFVQKSRLVPVRNSRDIVDPRVRDAIREEMKDIEIVYRPLTEMYEAAADADVVFTSTASESLLFTKEHAEALPPISLAMGGVRLFVDISVPRNVGACLSEVEHARVYNVDDLKEVAEATKEDRVRKAMEAQAIITQELKRFEVWRDSLXETVPPIRKVEVGH

SEQ ID NO: 88665 - protein, 209 aa, Fusobacterium nucleatum subsp. vincentii ATCC 49256
MAKLEAFIKAKEKLSKVLLKTSLIHSPIFSKEAGNEVYIKPENLQKTGSFKIRGAYNKITNLSDEEKKKGVIASSAGNHAQGVAYGAKESGIKAVIVMPKSTPLIKVESTKQYGAEVVLHGDVYDDAFKKAKELEEKEGYIFVHPFDDEDVIHGQGTIALEILEELPETDIILVPIGGGGLISGIACAAKILQPEIKIVGVEPDELSYP

SEQ ID NO: 88666 - protein, 160 aa, Rhizobium leguminosarum bv. viciae 3841
MRIGLFAVGRLKSGPEKDLAARYFDRFAKAGPAVGLELTRVAEVAESRASNAETRKREEAAMLLKSLADGSILILLDERGKALDSEAFANLLGSYRDQGKRELTIAIGGADGLDPSLYDRADATLCLGKMTWPHQLVRTLIAEQLYRAVTILSGHPYHRV

SEQ ID NO: 88667 - protein, 80 aa, Prosthecochloris aestuarii DSM 271
MNVEEIKDKVFDIIVSKMGVNKDQIKTESKFADDLGADSLDTVELIMELENEFDVQIPDEDAEKISNVQQAIDYIVNAKK

SEQ ID NO: 88668 - protein, 303 aa, Bordetella bronchiseptica RB50
MKQSHLACADWLRERAQHVEHVLDELLPGADIAPSRLHEAMRYAVLGGGKRVRAALVYAAGQACPVNGSTLAVGASMDRAAAAVELIHAYSLVHDDLPCMDDDTLRRGRPTVHVQFDEATAMLAGDALQPLAFELLAGMPIAPALVVQAAQVLARAAGSQGMAGGQAIDLHSVGRMLTRDELQTMHSMKTGAMLACSVTLGGIVAGASSTARQALDSYAQAIGLAFQVVDDILDVTADTASLGKTAGKDAADNKPTYVSLLGLDQARALAQELRQAAHQALAPLGESGARLGQLADFIVLRDR

SEQ ID NO: 88669 - protein, 252 aa, Bordetella parapertussis 12822
MGRLSGRNALITGAAVGIGAAMARRFCAEGASVLLGDIDAERGQALAAELAATGARARFARLDVTDEDSVRQALELAEAEHGPLHILVNNAGGSSLNDRSVVEFALEEFWRAINIDLLGTVLCCRHAIPRIAAAGGGAVVNMGSIAALRGLKGRDAYTAAKGGVHALTRSMAVEFAEQRVRCNAIAPGAVLSERMARFIDEDPRVAAAVSRHLLGLPEPDEIAAMAVFLASEESRHVTGSIFQIDGGRAAAA

SEQ ID NO: 88670 - protein, 354 aa, Lactococcus lactis subsp. cremoris
MTSPLITKAEVNSVFQGRSLLAEKDFTPAEINYLVDFGLHLKALKQQNIPHHYLEGKNIALLFAKTSTRTRAAFTTAAIDLGAHPEYLGANDIQLGIKESTEDTARVLGSMFDAIERRGFSQKEVEDLAKYSGVPVWNGLTDDWHPTQMIADFMTVKENFGYLKGLTLVYVGDGRNNMANSLIVTGSMLGVNVHIVAPDSLHPSKEVMDIANKFAEKSGAKPLATSNIEEGVKGANIIYSDVWVSMGESNWEERVKLLTPYRITMDMLKMTGNADNGKLIFMHCLPAFHDTETEYGKEIKEKYGLTEMEVTDAVFRSKYARQFEEAENRMHSIKAIMAATLGNLFIPAVPEDFK

SEQ ID NO: 88671 - protein, 788 aa, Azoarcus sp. BH72
MTRYVIPFTELRMTDVDQVGGKNASLGEMISQLPSSVRVPGGFATTAAAYREFLAHGGLADRINAALDTLDVDDVDALVKTGAQIRQWIVDTPFPAALEADIKAAYEKITAEGEGSFAVRSSATAEDLPDASFAGQQETFLNIHGYENILHAMKEVFASLYNDRAIAYRVHKNFAHAEVALSAGVQRMVRSDTGASGVMFTIDTESGFSDVVFITASYGLGETVVQGAVNPDEFYVHKPTLALNKPAVIRRNLGSKLIKMVFADKAVAGKSVRTVDVPEADRNRFSLTDEDVLELARYAVIIEKHYGRPMDIEWGKDGEDGKLYILQARPETVKSQSNGLVMEKYRLKQYGKALTHGRAIGQKIGAGTVRVVKDASEMNRVQAGDILVTDMTDPNWEPVMKRASAIVTNRGGRTCHAAIIARELGIPAIVGCGNATEVLEEGDSVTVSCAEGDTGYVYRGKLEFEVITTDMGNLPEIPVKIMMNVGNPELAFEFAQIPNGGVGLARLEFVINNMIGIHPKAILELSQVPASLRDEITRRSRGYATPKQFFIEKLAEGVATIAAAFYPKPVIVRMSDFKSNEYRKLLGGEIYEPEEENPMLGFRGASRYIAHSFRDCFELECAAMKKVRNELGLTNVQIMIPFVRNVEEAAGVVDLLAEHGLKRGVNDLKLIMMCEIPSNALLADKFLEHFDGFSIGSNDLTQLTLGLDRDSGLVAHAFDERDPAVKLLLSMAISTANRLGKYVGICGQGPSDHADFAEWLMDEGIQTISLNPDTVVDTWLKLASHGKQ

SEQ ID NO: 88672 - protein, 425 aa, Desulfococcus oleovorans Hxd3
MNFEAFGFNPQVAAGIKEAGYAVPTPIQVQAIAPVMENRDVMGMAQTGTGKTAAFVLPILHRLMKGQKGGIRALILAPTRELAEQTHQAIGVLGRKTGLKSATVYGGVGITPQIQKLKKVDIVVACPGRLLDHIGRRTANLSKLEVLVIDEADQLFDMGFFPDIKKILTHLPKQRQTLLFSATMPAEIRKLAADILQNPATVQVGNEAPADTVSHALYPVAQHLKTAFLLDLLKQTQARSVLVFTRTKHRAKNLDQKLAGAGFRSTSLQGNLSQVKRQAALDGFRKGTFQILVATDIAARGIDVTRVSHVINYDVPSTPEAYIHRIGRTGRATCTGEAFTFITGEDRNMVRAINRLLGSEIEQRTLESFNYKAAAPAFTGSAPARTDSAHRPARKKPARQSSPRPKTFEKSGSHGKKPARRHTFL

SEQ ID NO: 88673 - protein, 346 aa, Bacillus licheniformis ATCC 14580
MDGNMKALIKKPGEPGASFELVPIPKIDKHEVLIKVKAASICGTDVHIYNWDEWAKSRVKPPYVFGHEFSGEVVQVGENVTTVKEGEYVSAETHIVCGKCLPCLTGKEHVCKKTLILGVDTDGCFAEYVKMPAANIWKNPAGMPEDLASIQEPLGNAVHTVLTGMTAGVKVAVVGCGPIGLMAVAVAKASGAAQVIAIDKNEYRLDLALQMGATDIISVEKEDPLKNVSALTNGEGADLVCEMSGHPTAIRQSLKMAANGGRVHVLSLPEHPVCIDMTNDIVFKGLTVQGITGRKMFETWRQVSGLLQSGTIQIKPVITHRFPMEEFEKGFELMRKGQCGKVVLIP

SEQ ID NO: 88674 - protein, 364 aa, Candida glabrata CBS 138
MSKQWADGKDGVFRRQVSSFRETISNSHPVFKPAKGRYWLYVCLACPWAHRTLIARALKGLTSAIGVSVVHWHLDEKGWRFLQGDAQELLAGKAYEIAGGIEGANSDVSTRVGDIKNDSERLFVDGSVEPHHHFERLSELYLKSNPDYKDRFTVPVLWDTETQTIVNNESSEIIRILNSDAFDQFRDSDAEVPDLVPKELEAEIDEVNKWTYDNINNGVYKAGFSENGSNYEDEVTNVFTHLDKVESLLADKYKKLEKELGDKAKILSKYFIVGNQITETDIRLYTTIVRFDPVYVQHFKCNFTSIREGYPYIHLWLQNLYWNYPAFGKTTDFNHIKLHYTRSHPRINPLGLTPLGPKPDIRPL

SEQ ID NO: 88675 - protein, 187 aa, Pseudomonas putida KT2440
MPIINSQVKPFNATAYHKGEFVQVSEADLKGKWSVVFFYPADFTFVCPTELGDLADNYAEFQKLGVEIYGVSTDTHFTHKAWHDTSDTIGKIEYPLIGDPTHVISRNFDVLIEEAGLADRGTFVINPEGQIKIVELNDGGVGRDAAELLRKVKAAQYVAAHPGEVCPAKWKEGEATLAPSLDLVGKI

SEQ ID NO: 88676 - protein, 284 aa, Hordeum vulgare
MAKEVSEEPEHAAPARKDYSDPPPAPLFDMGELRMWSFYRALIAEFVATLLFLYITVATVIGYKVQSAADPCAGVGVLGIAWAFGGMIFVLVYCTAGISGGHINPAVTFGLLLARKVSLLRAVMYIVAQCAGGIVGAGIVKGIMKDAYQANGGGANMVASGFSRGTALGAEIVGTFVLVYTVFSATDPKRSARDSHVPVLAPLPIGFAVFMVHLATIPITGTGINPARSLGAAVIYNKKAAWDNHWIFWVGPFVGALAAAAYHQYILRAAAIKALGSFRSSRSN

SEQ ID NO: 88677 - protein, 417 aa, Hevea brasiliensis
MAKKAVLIGINYPGTKAELKGCINDVKRMYRCLVDRYGFSEEDITVLIDIDESYIQPTGKNIRRVLTDLVRSAEPGDLLFVHYSGHGTRLPAETGEDDDTGFDECIVPCDMNLITDDDFREFVDQVPHGCRITVVSDSCHSGGLIDEAKEQIGESTKRKEEESESGFGFKSFLKQTIQDAFESRGVHLPSDLHHHHGHRDEEDFDNRVVEEDYGDSGYVKSKSLPLSTLIEILKQKTGKDDIDVGKLRPTLFDMFGDDASPKVKKFMKVILNKLRHGDGESGGGGFLGMVGSLAQEFLKHKLDENDESYVKPALETEVDSKQEVYAGKTKRSLPDGGILISGCQTDQTSADASPSGKSSEAYGALSNAIQTIIAETDGAVTNQELVLKARKMLKKQGFTQKPGLYCSDDHVEASFVC

SEQ ID NO: 88678 - protein, 384 aa, Kluyveromyces lactis NRRL Y-1140
MTSATAGKPIECVAAVAYEAGKPLTVEKIIVDAPKAHEVRVQVTHTAVCHTDAYTLSGVDPEGAFPSILGHEGAGIVESVGDGVTNVKVGDHVVLLYTAECGKCKFCKSNKTNLCGSVRATQGKGVMPDGTTRFHNLKGEPLLHFMGCSTFSQYTVVADVSLVTIDPSAPLSSVCLLGCGVTTGYGAAVKTANVQEGDTVAVFGAGTVGLSVVQGAKSRGASKIIVVDVNDQKKQWSMDFGATGFVNPLKDLKEGETIVSKLIDMTDGGLDFTFDCTGNVKVMRDALEACHKGWGQSIIIGVAAAGEEISTRPFQLITGRVWKGSAFGGIKGRSEMGQLVTSYQKGDLKVDDFITHKRPFTEINNAFEDLHHGDCLRTVLDLAN

SEQ ID NO: 88679 - protein, 391 aa, Halobacterium sp. NRC-1
MRDGRDPAGMPSERAAAVTPFAAMDVLERAADRADVIHMEVGEPDFAPPAAATEAAVDALRAGDDDYTTSRGRRSLRDAISGYYAAEYGVSVPAERIVVTPGSSPALLTVLLATVDPGSAVVLSDPHYACYPNFVRLADGVVRTVGLAPDAGFQPAVSDYDAAIGDDTAAMLLNSPGNPTGAVIDGESLSALVALADRTDTAVVSDEIYHGLAFDAAAHSVLEYTDDAFVIDGVSKRYGMTGWRLGWVVCPRRYVDTINAIAQNTLICAPSFVQAGAEAAIRHGTDWLDGVRADYRTRRDILCAAAERWGFDPGYTPAGAYYMLLDVSRLGAAPAVADALLETAGVAVTPGPDFGANATEYVRASFAVSTDAVREAVARIDAVLASATTLT

SEQ ID NO: 88680 - protein, 508 aa, Corynebacterium efficiens YS-314
MSDPHGFQKYTRAEPAHRPVPLRLMDFHEVYEAAPAGQIEEQAARCMDCGVPFCHQGCPLGNIIPEWNNLVREGRWKEAYDRLHATNNFPEFTGRLCPAPCEGACVLDINDDAVTIKNVELEIVERAFAEGWVEPVRASLDTGLTVAVVGSGPAGLAAAQQLTRAGHRVTVFERSDRLGGLMRYGVPDYKMENRWIDRRLDQMRAEGTVFRVGVSPKAAELALFDAVVLATGTPVARELGIPGAELAGVHPAMDYLTAQNRANEGDGPVPAEFDARGRRVVIIGGGDTGTDCFGTALRQGAASVTQFDIRPRGPVLRAEETPWPMYPNQFRTATAHEEGSYVLRGDESVAEIEALGLGTRAVGEPLGERRFAVNTVALHGDDRGRVTGLTGCQIKVVGGRREPVEGTEFPFDADLVLVALGFTGAEQGGLAHELGVGFDTRGRMIRDAGYRSPTNSRVYIAGDNGRGQSLIVWAIAEGRACAAAVDADLMGETALPVAVTPQDMPMAV

SEQ ID NO: 88681 - protein, 383 aa, Moorella thermoacetica ATCC 39073
MAIYLDNAATTFPKPPAVWQAMEHFMKNIGASAGRGGYRRALAAEEIVFQCRRLLGKLFNINDATRIVFTANATEAINLALKGWLNPGDHVITTAMEHNAVWRCLKTLEKERGISITVVPCREDGELLLPELDAAFRKETRLLACTHASNVTGTVMPVQAITAAAHRHEVPVLLDTAQTAGVYPIDVQELDIDFLAFTGHKGLLGPMGTGGLYIRPGFDLRPLKEGGTGSVSRLEYMPEGLPDRFEAGTLNVVGIAGLKAAVEYVLNQGISRIRSHEEVLTARMLAGLEELPAVTVYGPRETAPKVGVVSFNIKELAPEEVAYALDEGHEIMVRVGLHCAPLAHKTISTLERGTVRASVSYFNTTEEIDAFLTAVREIVELTS

SEQ ID NO: 88682 - protein, 674 aa, Lactobacillus plantarum WCFS1
MTPNYTLSGRYRIVRSLGEGGMANVYLAHDLILDRDVAVKLLRLDLRDDPKTIKRFQREALATTELVHPHIVSLYDIGEENGMQYLVMEYVKGMDLKNYIKENFPLPLQQVIDIMEQILSAVATAHAHNIIHRDLKPQNILIDEQGNAKITDFGIAVALSEHTMTQTNTILGSVHYLSPEQARGSMATKQSDIYSLGIILYEMLTGSVPFKGETAVSIALKHFQNAMPSVREFDADIPQALENVVLQATTKDPRERYATVEDMAADLLTVLASNRAGEKRFVPQDVGNDETKIMPSADIQAAIAANQDGKTQVVAHKSKQPTLQRPAETTESQTDADEEPLPTRSWSKRHPLRRRLLFWGGIILLLVVAVIVGLELSRPQMTTVPKVTGLSQRAATKVLKKHHLTVGTVQHAKSNQVAKNQVIKSTPSVKTRVQERARINLVISNGAKVMSFGNYVNDNYHDVRQTLKSAGFKVKETYSTSSVAAGQIISQDVVAGSRVMPTDTTVTFTVSAGSRYVELKDLTGESKSDILDYAEANDLNVNFKQGYSSEQKAGYSYDQDPDGGGNVRTGSTITVTMSRGSDNNVTTPQNFYVKLTVPYKALSATTAQANDVKIYLYDDTHMIETVYRDIAIMRSTKISLPFQLTGNTKGHYRIVRNGVTIMEKKNITSKSATK

SEQ ID NO: 88683 - protein, 248 aa, Legionella pneumophila subsp. pneumophila str. Philadelphia 1
MSMDKMIAIVTGGTGGIGSAISQRLADSYQVVACYYKDGRHEEAKKWQDEQRQLGYDIDIVYGDIAQYSDCEKITSLVMERYGRIDVLVNNAGITKDCSLRKMTPQQWQQVLDANLTSVFNMTRNVVPVMLERGYGRIVSISSINGRKGQFGQCNYASTKAALFGFTKSLALEVASKGITVNTVSPGYIETPMLAALKEDVLNSIISSIPVGRLGYPKEIADAVAFLASPDSGFITGANLDVNGGQYM

SEQ ID NO: 88684 - protein, 267 aa, Sinorhizobium americanum
HLLRFDSIHGRFPADVKVDGDAIIINNGKPIKVTAIRNPAELPHKDLGVDIAMECTGIFTARDKAAAHLEAGAKRVIVSAPADGADLTVVYGVNHDKLTKDHLVISNASCTTNCLAPVAKVLNDAIGIDHGMMTTIHSYTNDQPSLDQMHKDLYRARAAALSMIPTSTGAAKAVGLVLPELKGKLDGFAMRVPTPNVSVVDLKFVAKRDTTKEEINAAIKAAADGPLKGILGYTLAPNVSIDFNHDPHSSVFHMDQTKVMEGKFVSI

SEQ ID NO: 88685 - protein, 541 aa, Burkholderia sp. 383
MPGQGNAHPSVPLSRSAHPDAGHGKFKKQLSLTDLTFIGLGAIFGSGWLFAASHVSTIAGPAGIFSWLLGGFAVLLLGIVYCELGAALPRAGGVVRYPVFSHGPLLGYLMGFITLIAFSSLIAIEVVAARQYAAAWFPGLTVEGSSDPTTLGWLVQAALLCFFFYLNYSSVKTFAKANNIISIFKFIVPLAVIAVLFTFFKPANLTVHGFAPFGMPGIEMAVSAGGIIFAYLGLTPIVSVASEVRNPQRTIPIALILSILLSTLIYVLLQLAFIGSIPTAMLAAGWHDVSKAFSLPYRDIALALGVGWLAVMVVADAMISPSGCGNIYMNATPRVVYGWAKTGTFFKVFTRVDEASGIPRAGLWLTFGLAIFWTLPFPSWEALINIVSAALVLSYAVAPVSVAALRRTAPDLPRPFRASAFGITGPASFVIAALIVYWSGWSTVSWLLGLQIVMFVIYLACRRWVPTAHLSLTEQVRSSAWLIAFYAAMIVLSYLGGFGGTGQLAHPYDTVVVAAVALVIYYWGANTGVRADKLQLDDDED

SEQ ID NO: 88686 - protein, 360 aa, Cryptococcus neoformans var. neoformans B-3501A
MLPHLILSLASIFALPAVFAATTCNGHSELCSRLYSNVTFIGAHDSYAVGSSVADDQDKDVTSQLNDGIRTLQIQAHNASDGIHLCHSSCSLLDGGLMSDYLSTVASWVNDNPNDVITIVIVNSDNLPPTSFSPVFESAGLSSKVYTPASQPTQLSDWPSLSDMIDAGTTVVAFMDYEADTSSVPYLLDEFAAMWEDAYGVTTQEFGCAVNRSSGDTSSQPFLINHFLDSTYSFSSIQVFVPNKDKLNETNAETGTGSIGYHVNNCRQLWGRNPNHILLDFYDSNGNSPFNVAASLNGVSAPTNTVTAGTASATSSGTAAVVSTQSLSGSVTSIEGIAKGITLGFGVMLGVGMGVGRVFL

SEQ ID NO: 88687 - protein, 352 aa, Schizophyllum commune
MGGCASKPVDLEAKARSDDIDKMIEEDGKRLKKECKILLLGSGESGKSTIVKQMKIIHQDGFSQDELIAFRPSSTANVLDSAKAILSHEKLNVECEDFKNRPLQDKILDYQLDETNLPFPRHLPNHKPFWKDPAVTRIIDEQTSHFYLMDSATYFFTEVLRIGEPNYIPTETDVLRARAKTTSITETRFTMGPLSIHMFDVGGQRSERKKWIHCFESVTSIIFCTALSEYDQSLLEEKNQNRMAESLVLFESIINSRWFLRTSIIIFLNKIDVFKLKVHKVPLERYFPEYTGGKDPNKAAKFILWKFMQANRAGLSVYPHLTQATDTSNIRLVFAAVKETILQNALKDSGIL

SEQ ID NO: 88688 - protein, 267 aa, Ensifer adhaerens
HLLRYDSIHGRFPAEVKVEGDTITINGGKPIKVTAIKDPATLPHKELGIDIAMECTGIFTARDKAAAHLTAGAKRVIVSAPADGADLTVVYGVNHDQLTKDHLVISNASCTTNCLVPVVKVLNDTIGISHGFMTTIHSYTNDQPSLDQMHKDLYRARAAALSMIPTSTGAAKAVGLVLPELKGKLDGTSIRVPTPNVSVVDFKFVAKRNTSVEEITNAIKAASNGALKGVLGYTEEPLVSRDFNHDSHSSIFAIDQTKVVEGNFVRI

SEQ ID NO: 88689 - protein, 352 aa, Suillus bovinus
MGNCVSAQDREEKARSDAIDRQIEEDSRKFRKECKILLLGSGESGKSTIVKQMKIIHQNGFNENELMTFRPTIYRNTLDSAQAIVLQMRNMNVECATPANRTFAERIVEYRVENTPDFVFSADIAQAIHELWQDPIIPKVMDCSSQFYLMDSAGYFFTEVLRIGTPDYIPTENDVLRARAKTTGITETRFNMGQLSIHMFDVGGQRSERKKWIHCFESVTSIIFCTALSEYDQVLLEEKNQNRMQESLILFESASTPAGLRTSIILFLNKIDVFKNKLPKVPIEKYFPEYTGGADINKAAKYILWKFMQANRARLSVYPHLTQATDTTNIRLVFAAVKETILQNALKDSGIL

SEQ ID NO: 88690 - protein, 165 aa, Triticum aestivum
MEVQAGTHGDTATSKFTLPVDSEHKAKSIRLFSFANPHMRTFHLSWISFFTCFVSTFAAAPLVPIIRDNLNLAKADIGNAGVASVSGSIFSRLAMGAVCDLLGPRYGCAFLVMLSAPTVFCMAVIDDASGYIAVRFLIGFSLATFVSCQYWMSTMFNSKIIGTVN

SEQ ID NO: 88691 - protein, 336 aa, Moorella thermoacetica ATCC 39073
MLKHVVTLIPGDGTGPELIAAARRVLEASGAELEWEVMAAGEGAQEKYGSVLPEETLASIRKNGVALKGPITTPVGTGFRSVNVALRKELDLYANVRPFRNLPNVPSRYQGVDLVIYRENTEDLYAGVEHMVGEDAAESIKIITRKGSERIARAAFEYARRQGRKRVTAGHKANIMKFSDGLFLRTFYDVARDYPEITADDRIVDNLSMQLVQKPEQYDVLVLPNLYGDILSDLCAGLVGGLGVAPGANIGEKAAVFEPIHGSAPKYAGQNKVNPLATILSGVMMLEHLGEKEAAARIQRAILAVLAEGKYLTYDLGGSAGTSDMADAIVRRLEVE

SEQ ID NO: 88692 - protein, 172 aa, Triticum aestivum
QWLGLIVKQLWAYIRRNDLQDPNNKRKIICNDELRLVFETDCTDMFKMNKLLAKHIKPLEPTKDSNRDMKKLKPVEDVPVPLAEDVATNQLPVNVSDALASFFGTGEREMSQSEVVKRVWDHIKSNNLEDPSNPTMILCDSKLKDLFGCESVTAPAVSELLSDHLFKQPNKI

SEQ ID NO: 88693 - protein, 366 aa, Saccharomyces cerevisiae YJM789
MSEKSASNNKAEFKRQSSPFREIISADHPIYKPAKGRYWLYVALPCPWAQRTLITRALKGLAPIIGCSVAHWHLDDKGWRFLEEGDGKTNERHWFDIAGGISSVNLNTSTPVANIPNNAHRLLVDGTDEPHYGYKRLSDFYFKTKPDYKGRFTVPVLWDLETCTIVNNESSDIIRIMNSAAFDEFVGEEYRQVRLVPRSLEAQITEFNSWVYDKINNGVYKAGFAECAEVYEREVTSLFQYLDKLENLLDKKYTDLEAEYGKNNKDKILDRYFAIGDTLTEADVRLYPTIVRFDVVYHQHFKCNLATIRDDYSRIHTWLKNIYWRHEAFQRTTDFTHIKLGYTRSQPRVNPIGITPLGPKPDIRPP

SEQ ID NO: 88694 - protein, 181 aa, Pseudomonas syringae pv. maculicola
MSYTDIPAGNAIPDDFFTVIEIPANHSPIKYEVDKPSGQIFVDRFLSTPMFYPANYGFIPNTLSDDGDPLDVLVICPYPVSPGVVIRSRPVGVMYMTDEAGADAKVIAVPHEKLSSMYSNVKECSDLPALLLAQIQHFFENYKALEPGKWVKMGRWGSADEAREDIRKSVAAYNLKKEACK

SEQ ID NO: 88695 - protein, 93 aa, Cicer arietinum
RCQNGKPPRCHHCSICQRCVLKMDHHCIWVVNCVGARNYKYFLLFLLYTFLETTLDCLALIPSFIRFFGGTKYRHPLTPGGFAAIFLASNCVA

SEQ ID NO: 88696 - protein, 138 aa, Azoarcus sp. BH72
MKRKIEKPDAEWRQALTPEQYHVTREKGTERAFTGKYWNTWTKGTYNCACCGAPLFDAAHKFDAGCGWPSFWTAAEPENVETAEDFSHFMHRTEVLCHQCGAHLGHVFEDGPQPTGLRYCINSASIEHVPEADSDTGA

SEQ ID NO: 88697 - protein, 382 aa, Zea mays
MENSAAAAAERPRLTRAAAKRSAVVTAVAVAAKRKRVALSQLPTLPNAVLGAHDDDDDKPVRKQRLLPAAKPKPKPKAAPAPAAPAAADDTDDDIQLCKPYASDIYSYLRSMESQAKRRLAVDYIAAVQIDVTPNMRGILIDWLVEVAEEYKLVSDTLYLTVSYIDRFLSAKVLNRQKLQLLGVSAMLIASKYEEISPPNVEDFCYITDNTYTKQEVVKMESDILNVLKFEVGSPTAKTFLRMFIRSAQEDNKKYPSLQLEFLGSYLSELSLLDYGLIRSLPSLVAASAVFVARLTLDPHTHPWSKKVQTLTGYKPSELKDCVAAIHNLQLNRTCQSMVAIREKYRQHRCTNCGKIFEQFKGVSALLPPVEIPASYFNTLKE

SEQ ID NO: 88698 - protein, 233 aa, Triticum aestivum
  misc_feature (30)..(30): Xaa can be any naturally occurring amino acid
MGGKVLLMSAVLVGLVSLSSCRSLGELHEXRRPHYGGSPTPTHGSGGGYNPTLTPTPTYGTTPTPSYGTTPTPTYGITPTPTYGTTPTPSYGTTPTPSYGTTPSTPSAPSHDVPASPKKHGFIGSCDYWKNHPDAIVAAIGSLGNIGKTFGAACSMIGGKKLGNMHDALSNTRTDGIGALIREGAAAYLNSIVNKKFPFTTQQVKDCIVVAVTSDGAASAQAGVFKKANEFHY

SEQ ID NO: 88699 - protein, 105 aa, Zea mays
MGDWFPRGRPGKSKETPIPVAPIRCSSHQKRSRRREEGDREQPEPEAERMKTFDPWPVFFRREWKRNWPFLTGFAITGFIITKMTANFTEEDLKNSKFVQEHKKR

SEQ ID NO: 88700 - protein, 454 aa, Cicer arietinum
TDELRTVLETNLPKVKEGKKPKFSLGVAESKLGSQIHDVTKIPCQCNEFVGELLRGVRQHFVDSVGDLKPGDLIKAQLGLSHSYSRAKVKFNVNRVDNMVIQAIFLLDTLDKDINSFSMRVREWYSWHFPELVKIVNDNYLYCKVAKFIEDKSKLSEDKLEGLTDQVGDEDKAKEIIEAAKASMGQDLSPVDLINVHMFAQRVMDLSDYRRRLYDYLTTKMNDIAPNLASLIGEVVGARLISHAGSLTNLAKCPSSTLQILCAEKALFRAFKTRRNTPKYGLIFHSSFIGRASAKNKGRMARYLANKCSIASRIDCFSENGSTIFGEKLREQVEERLDFYDKGVAPRKNIDVMKSAIEIADNKDTEMETEEASAKKSKKKKQKATDEDDMAVDNAAEVTNGDATEDHKSEKKKKKKEKRKVDLEVETQDPSVDEGANGDSSKKKKKKSKRMDVD

SEQ ID NO: 88701 - protein, 290 aa, Hordeum vulgare
MAKDEVMETGGGGDFAAKDYTDPPPAPLVDAAELASWSLYRAVIAEFIATLLFLYITVATVIGYKHQTDPAVNSAADAACGGVGVLGIAWAFGGMIFVLVYCTAGISGGHINPAVTFGLFLARKVSLVRALLYMVAQCLGAMCGVGLVKAFQSAYFVRYGGGANTLAAGYSKGTGLAAEIIGTFVLVYTVFSATDPKRSARDSHVPVLAPLPIGFAVFMVHLATIPITGTGINPARSLGAAVIYNKDKAWDDQWIFWVGPMIGAAIAAFYHQYILRAGAIKALGSFRSNA

SEQ ID NO: 88702 - protein, 217 aa, Lactobacillus plantarum WCFS1
MIKVAPSILSADFANLQRDVQMAENAGADALHIDVMDGQFVPNLSFGMSTVADLRPVTSLMLDCHLMIMDPERFVGQFAKAGADLIGVHVESTRHIYHALQLIKDAGVKAEVVVNPGTPLSMISELLPLVDQVLIMTVNPGFGGQHFLDQMVAKIAALNELKQQHGYRFEIEVDGGINDQTVKACYDAGATVAVAGSYVYDSADPAQRIQDLKVATN

SEQ ID NO: 88703 - protein, 720 aa, Magnaporthe grisea 70-15
MAPDRGSDDANLRSRSRSARPTSPLMSDPVAAADHHSTANNDTEVDGHSFTVRGVVVGILIGIVLCFSNMYFGLQTGWISVMTMPASLLGYGFFRTLSRHLKYPFTPVENVLVQTVAASVGIVPLGAGFVGVIPAMNYLLTEDEMGPVRLGVWDSIVWSLGLCYFGCVFAMLLRRQVIIRERLRFPSGFSTAVLIGVLHGRTTKAETSGDGNTAAEGGFASLAGQPKLPPIGSEANEDTTAGAQPSSSNEWKANVRLLLICFCISGVATVSTYFVPVLRNLPVFGSAAAAWLWTLNPSLAYVGQGIIMGPATTLHMLLGAVIGWGVLSPLAKAKGWAPGRVDDWETGSKGWIVWTSLTIMLADAIVSLGFVVAMAVWPYLKEMSWRNPVGSGMALLRGQGTRGGYMTVNSSERHDGAQGDGDNEHDGNRGYSAAMNNSDTDRDAPEDQVVRTRTVWMGLPLSMLLCVASIRYVFGSDLVPLYAIFAAVIVAMPLSVIAVRAMGVTDLNPVSGISKLAQLFFALVVPRSNKAGILINLVAGAVSESGALQAGDLMQDLKTGHLLGAAPKAQFYGQVIGATVGAVVSALVYKLYTRYPPRGWSGSSRGGLVTSGKGLPPMAAEWAGGAAVLFAVFTAVKMVGPRGAKWQAYIPGGLAVAVGMYNVPSFTLARTIGGVLSWWWRSVMGREDTPLIITASGFILGEGFLSIANLLMESFGVPHL

SEQ ID NO: 88704 - protein, 143 aa, Oryza sativa Japonica Group
MALAAIYSLFIINKSGGLIYYKDYGSAGRTDTNDSLRLASLWHSMHAISQQLSPTPGCEGIDLLQAHNFDLHCFQSLTGTKFFAVCETGAQNIETLLKVIYELYTDFVLKNPFYEMEMPIRCELFDLNLAQVIQKDRVTLLGR

SEQ ID NO: 88705 - protein, 160 aa, Zea mays
FFVVCGGKMNIERLAKLVELVGKQRLVLGLSCRKKDGRYSFVTDRGPKFSDVFVDEPALEYLAAFADEFLVPGVDVGGKRLGVDGGLVELLGPPSPIPVTFAGGGSTMDGLGGVKKAGQSRVDVTVGGALDIFGGGFPSKDVVLWPQKQSMVGPVSRNMW

SEQ ID NO: 88706 - protein, 248 aa, Thermus thermophilus HB27
MSEALLVKVGGSLRGAEALLDELAAYPGPLVLVHGGGPEIGAWLGRLGYESRFVGGLRVTPPEQLEVVEMALYLTGKRLAEGLSRRGRKALALSGRDALCLKGRALPELGRVGEVVEVEVGLLQDLLAKGYTPLLAPIALDAEGPLNVNADTAAGAVAGALGWPAVFLTDVEGVYRDPKDPRTRFPRLTPKEVEALKGEGVIQGGMIPKVEAALSALRAGAPWAAIAKGERGVLEAVLRGEAGTRFTL

SEQ ID NO: 88707 - protein, 393 aa, Ustilago maydis 521
MSANYWASTQCNNWLLDRPQLELARKEDLRYATRLECAALGVFFSNLLSLICKRLNLRQRVTASANVFFRRFFAKNSYSALDPFLVCATCVYVAAKVEESPIHIKSAVAEATRSFTEHGFRGMPTDHSSLAEMEFYLLEEMEFDMVLFHSYRSLIVMFEDYGSGSAVGSGNSIHERSAGAAGSGSGSGGSGMMIGLGIEAAAFGVTKGLASVEEGDAASAIAEEDKVQLNEFNDEVLLMCWFILNDTYKTDIPLMYPPYMVALASIWLGLSLHPPSFDKITASLHTMQTRRDEHHLSIQRILDNPASTPAELASAKREPSPPSQDALTFFASLNVSLPLLAEIVQEMVSAYSVQHQVQRLVSDGPGIVKLLERMRESRRVALIKDRDQTRTHA

SEQ ID NO: 88708 - protein, 81 aa, Lactobacillus plantarum WCFS1
MTKEEIFDKIADIIADRFEVDKATITNEMNLQTDLDADSIDFVEFVLELEDTFGSEISDEDAEKLSTVGEVVDYVAAHQAK

SEQ ID NO: 88709 - protein, 362 aa, Pseudomonas putida KT2440
MNAALKTFAPSALALLLILPSSASAKEAETQQKLANVVILATGGTIAGAGASAANSATYQAAKLGVDKLIAGVPELADIANVRGEQVMQIASESISNDDLLKLGKRVAELAESKDVDGIVITHGTDTLEETAFFLNLVEKTDKPIVVVGSMRPGTAMSADGMLNLYNAVAVASDKQSRGKGVLVTMNDEIQSGRDVSKAVNIKTEAFKSAWGPMGMVVEGKSYWFRLPAKRHTVNSEFDIKQISSLPQVDIAYGYGNVTDTAYKALAQNGAKALIHAGTGNGSVSSRVVPALQELRKNGVQIIRSSHVNQGGFVLRNAEQPDDKNDWVVAHDLNPQKARILAMVAMTKTQDSKELQRIFWEY

SEQ ID NO: 88710 - protein, 267 aa, Sinorhizobium xinjiangense
HLLRFDSIHGRFPADVKVEGDTIVINNGKPIKVTAVRNPAELPHKDLGVDIAMECTGIFTARDKAAAHLEAGAKRVIVSAPADGADLTVVYGVNHDKLTKDHLVISNASCTTNCLAPVAKVLNDAIGIDHGMMTTIHSYTNDQPSLDQMHKDLYRARAAALSMIPTSTGAAKAVGLVLPELKGKLDGFAMRVPTPNVSVVDLKFVAKRDTSKEEINAAIKAAADGPLKGILGYTLAPNVSIDFNHDPHSSVFHMDQTKVMEGKFVSI

SEQ ID NO: 88711 - protein, 419 aa, Ralstonia solanacearum GMI1000
MASGKIAAFRDFSAAAMPNVLRLTDLISEGKLAGKRVFIRADLNVPQDDAGNITEDTRIRASVPAIRAALDAGAAVMVTSHLGRPTEGEFKPEDSLAPVAVRLSELLGCEVKLVQNWVDGVDVAPGQVVLLENCRVNKGEKKNSDELAQKMAKLCDVYVNDAFGTAHRAEATTHGIAKFAPIACAGPLLGAELDALGKALGQPARPLVAIVAGSKVSTKLTILKSLADKVDNLIVGGGIANTFMLAAGLKIGKSLAEADLVGDAKAIIDLMAARGASVPIPVDVVCAKEFSATAAATVKDVKDVADDDMILDIGPKTAAQLADQLKASGTIVWNGPVGVFEFDQFGNGTKVLAEAIAASSGFSIAGGGDTLAAIAKYGIADRVGYISTGGGAFLEFLEGKTLPAVEILEQRAQRQEALA

SEQ ID NO: 88712 - protein, 178 aa, Legionella pneumophila subsp. pneumophila str. Philadelphia 1
MNYSIRKFEDKYPELGERVYIDPQSTVIGNVTLGDDVSVWPMAVIRGDVNYIQIGHSCSIQDGAVLHVTHDGPYTPGGRPLILGQGITVGHKALLHACTINDYCLIGMGSIILDSAHIQKHVMIAAGSIVPPGKILQSGYLYLGSPVQAVRKLTAKEIEQIEYSAGHYIRLKNKYLTY

SEQ ID NO: 88713 - protein, 479 aa, Ralstonia solanacearum GMI1000
MTRATKIVATLGPSSNTLEILTRMIAAGVDVVRLNFSHGTAQDHVARAELVRETARAVGREVGIMADLQGPKIRVGKFESGKITLSPGERFTLDARCELGNQERVGLDYKELPRDVGPGDLLLLNDGLIVLQVERVVGEEIETVVKVGGDLSNNKGINRQGGGLSAPALTAKDMEDIKTAMALGADYIAVSFPKNATDMEMARQLAAVAGAPHSHKTKMIAKIERAEAIRPGVLEEILAASDGIMVARGDLAVEVGNAAVPALQKRMIKLAREANKLAITATQMMESMIVNPVPTRAEVSDVANAVLDGTDAVMLSAETAAGRYPVETIEAMAAICVEAEKSQPVHLDTDFLDQTFSRIDQSIAMGALFTAYHLQVKAIAALTDSGATALWMSRHGINVPIYAITPNVASQRKMALYRNVQPLPLAISLDRDEALRQAEELLVARGVVQRGDFIVLTVGEPMGQAGGTNTLKIVRVGMH

SEQ ID NO: 88714 - protein, 454 aa, Legionella pneumophila subsp. pneumophila str. Philadelphia 1
MTMKTKHFDLIVLGGGSGGIASAVRAAQYGAKVAVIEQNHLGGTCVNLGCVPKKIMYNASSIAETLHKSPDYGFFLENNAKLDWKRLVNKRNAYIERLRENYEKRFSQHKITLIQGKGIFHDQSSITIDHTIYQAEHIIIATGSEPALPAINGIKHAIDSDGFFSLTKLPAKVAVIGSGYIGVELAGILNSLGSETHLLMRGTRPLSRFDHMIGDTLMEIMQKQGICIHQNHKAQAIHLHSDGRKSILCQSGSIIENIDVIISAVGRKPRTGNLNLDKINVNMDDKGLILVDAFQNTSVKGIYAIGDVTNAPALTPVAIAAGRRLADRIFGNQPDACLNYDNICSVVFSHPPSGSVGLTEHEAIEKYGKNKIKIYQTRFIPMYDALSIDKTPTAMKLVTLGKKEKIIGLHVVGYSADEMLQGFGVAIKMGACKKDFDNTIAIHPTSAEEFVTMV

SEQ ID NO: 88715 - protein, 267 aa, Ensifer adhaerens
HLLRYDSIHGRFPAEVKVEGDTITVGGRKPIKVTAIKDPATLPHKELGVDIAMECTGIFTARDKAAAHLTAGAKRVIVSAPADGADLTVVYGVNHDQLTKDHLVISNASCTTNCLVPVVKVLNDAIGINHGFMTTIHSYTNDQPSLDQMHKDLYRARAAALSMIPTSTGAAKAVGLVLPELKGKLDGTSIRVPTPNVSVVDFKFVAKRNTSVEEITNAIKAASNGALKGVLGYTEEPLVSRDFNHDSHSSIFAIDQTKVVEGNFVRI

SEQ ID NO: 88716 - protein, 518 aa, Oryza sativa Japonica Group
MVEAAAGRRSGANRRRPSGGGERRRQQQQHQRLVAVAVAARVVMVAPAATPAPAAGGGGGCVEDILGCLLGVLRALGVTWAAAARPQRQQPRLAAQTPRGPAPGADGRRAAAELRGIPGRIAGNGACAVASLYTLQGKKGVNQDAMIVWENFCSREDTIFCGVFDGHGPNGHLVAKRVRDLLPIKLGADLGTDEGRQTSTSSIKSNGDETGSPGNMGRDAEQNGEYPEIFTALRTSFLRAFNVMDRDLKLHKSIDCFFSGTTAVAVLKQGRNLIIGNLGDSRAILGTRDKDNQLMAVQLTVDLKPNIPSEAQRIRQRRGRIFALPEEPEVARVWLPKYNSPGLAMARAFGDFCLKDYGLISMPEVSYHRITEKDEFVVLATDGVWDVLSNTEVVSIVNRATSRASAARLLVESAHRAWRARFPTSKIDDCAVVCLFLDTDELSETSSSMARDMTNAVEVSSGQHSNTIQLSTGVSSDVVTAVLTDGDDLSAVDAVAKLVTLTDLPNNASGATQSITTK

SEQ ID NO: 88717 - protein, 267 aa, Ensifer adhaerens
HLLRYDSIHGRFPAEVKVEGDTITVGGGKPIKVTAIKDPATLPHKELGVDIAMECTGIFTARDKAAAHLTAGAKRVIVSAPADGADLTVVYGVNHDQLTKDHLVISNASCTTNCLVPVVKVLNDAVGIDHGFMTTIHSYTNDQPSLDQMHKDLYRARAAALSMIPTSTGAAKAVGLVLPELKGKLDGTSIRVPTPNVSVVDFKFVAKRNTSVEEITNAIKAAANGALKGVLGYTEEPLVSRDFNHDSHSSIFAIDQTKVIEGNFVRI

SEQ ID NO: 88718 - protein, 237 aa, Brassica napus
MSVFDDSFVIVEDDASESVPVSASLDDSIDDVFAAPSSDYAAYSNGDGPILPPPSEMESDEGTALREWRRQNANQLEEKEKREKELRNQVIEEANQFKEDFHKKRELACENNKAANREKEKLYVETQEKFYAEASKNYWKAIAELVPKEVPTIEKRRGKKEQDPKKPTISVIQGPKPGKPTDLSRMRQILLKLKQNPPAHLKLAPQPPPEAAAATTTAATPPKNVPETKPTEAVTAA

SEQ ID NO: 88719 - protein, 251 aa, Populus trichocarpa
MAANFWTSSHYKQLFDQEEVDVVHPLDKEKGITLEDFKIIKTQMAIYIGILAQQVKVRQRVVATAVAYMRRVYTRKSMSEYDPRLAAPTCLYLASKAEESTIQARVLSFYIKKLYSDDKYRYEIKEILEMEMKILEALNFYLVVFHPYRSLPQFLQDAGINDINMTQLTWGLVNDTYKMDLILVHPPHIIALACIYIASVYREKDSTAWFEELRVDLNVVKNISMEMLYFYESHRLITEERITAAFNKLKP

SEQ ID NO: 88720 - protein, 370 aa, Rhizobium leguminosarum bv. viciae 3841
MTARNLFLLPGDGIGPEAMGEVRKIIAYMNEAMNAGFVTDEGLVGGCAYDAHGAAISEADMQKALAADAVLFGAVGGPKWDSVPYEVRPEAGLLRLRKDLQLFANLRPAICYPALAAASSLKPELVEGLDILIIRELTGGVYFGEPKEIIDLGNGQKRGIDTQVYDTYEIERIAGVAFEMARTRQNRVCSMEKRNVMKSGVLWNQVVTETHKAKYSDVQLEHMLADAGGMQLVRQPKQFDVIVTDNLFGDMLSDVAAMLTGSLGMLPSASLGAPDGKTGKRKALYEPVHGSAPDIAGKGIANPIAMIASFAMCLRYSFNLVKEADDLEKAIANVLDKGIRTGDIMADGARQVGTVEMGDAILAEFKTLSA

SEQ ID NO: 88721 - protein, 165 aa, Triticum aestivum
MNGAGASQQQQQQQQRLRQQQQQQQQALLMQQALQQQQYQSGVLAAAAAAAMTQMEPVSNGNLPPGFDPSTCRSVYVGNVHPNVTESLLIEVFQGSGPVERCKLIRKEKSSFGFVDYYDRRSAALAIMTLHGRHIYGQAIKVNWAYASTQGEDTSGPFHIFGWGI

SEQ ID NO: 88722 - protein, 480 aa, Oryza sativa Japonica Group
MSRIHRNPTLLAPTPSPSSIPPLLEPSRSSPPPPMAATIVSVKARQIFDSRGNPTVEVDVCCSDGTFARAAVPSGASTGVYEALELRDGGSDYLGKGVSKAVDNVNSVIAPALIGKDPTSQAELDNFMVQQLDGTKNEWGWCKQKLGANAILAVSLAICKAGAIIKKIPLYQHIANLAGNKQLVLPVPAFNVINGGSHAGNKLAMQEFMILPTGAASFKEAMKMGVEVYHNLKSVIKKKYGQDATNVGDEGGFAPNIQENKEGLELLKTAIEKAGYTGKVVIGMDVAASEFYNDKDKTYDLNFKEENNDGSQKISGDSLKNVYKSFVSEYPIVSIEDPFDQDDWEHYAKMTAEIGEQVQIVGDDLLVTNPTRVAKAIQEKSCNALLLKVNQIGSVTESIEAVKMSKRAGWGVMTSHRSGETEDTFIADLAVGLATGQIKTGAPCRSERLAKYNQLLRIEEELGAAAVYAGAKFRAPVEPY

SEQ ID NO: 88723 - protein, 190 aa, Physcomitrella patens subsp. patens
MNGATVQPSYKEAGPVRYHPMHDCLSLILRLLTLGATIAAIVAMLKSTQTVPTLLGPHTARWKDFPAFEWFVIGNSIVLVYAALGTLAACLSLFTRRGPLSYTKTAWLTFLCDFICSCALISAGSTALGVAWIGKHGQHSAFWNAVCPTVDRFCDYVQGALIATLCGFIFQALSTVIAASALHNLATHRH

SEQ ID NO: 88724 - protein, 658 aa, Vitis rupestris
MGPHSTDEVPEAKEDIRSLSSSHRHTTNLPYMHKVGVPPKQNLFKEFKTTVKETFFADDPLRSFKDQSKSRKFILGIQAIFPILEWGRSYNLTKFRGDLIAGLTIASLCIPQDIGYAKLASLEPQYGLYSSFVPPLIYAFMGSSRDIAIGPVAVVSLLLGSLLRAEIDPTENPAEYLRLAFTATFFAGITQATLGIFRLGFLIDFLSHAAIVGFMGGAAFTIALQQLKGFLGIKNFTKETDIISVMHSVWGSVHHGWNWQTIVIGATFLGFLLFAKYIGKKNKKFFWVPAIAPLISVVLSTFFVYITRADKKGVQIVKHIDKGINPSSASQIYFSGVYLLKGFKIGVVAGMIALTEAVAIGRTFASMKDYQLDGNKEMVALGAISIVGSMTSLLMWQQVPLSSAVNYMAGCRTAVSNIVMSCVVFLTLEFITPLFKYTPNAILASIIISAVIGLIDYDAAILIWKIDKFDFVACMGAFFGVVFKSVEIGLLIAVAISFAKILLQVTRPRTAILGKLPRTTVYRNIQQYPEATKIPGLLIVRIDSAIYFSNSNYVKERILRWLTDEEEHLKEANLPRVQFLIVEMSPVTDIDTSGIHALEELHRSLLKRDVKLVLANPGQVVVDKLHASKFADDIGEDKIFLTVGDAVVTCSPKLAEEV

SEQ ID NO: 88725 - protein, 420 aa, Yersinia pseudotuberculosis IP 32953
MSFETISVIGLGYIGLPTAAAFASRKKKVIGVDVNAHAVETINRGAIHIVEPDLDKVVKIAVEGGYLQAATKPQAADAFLIAVPTPFKGDHEPDMIFVESAAKSIAPVLKKGDLVILESTSPVGATEQMAQWLAEARPDLSFPQQAGEAADINIAYCPERVLPGQVMVELIQNDRVIGGMTPKCSARASALYKIFLEGECVVTNSRTAEMCKLTENSFRDVNIAFANELSLICDEQGINVWELIRLANRHPRVNILQPGPGVGGHCIAVDPWFIVSQNPQLARLIHTARLVNDGKPLWVVDRVKAAVADCLAASDKRASEVKIACFGLAFKPDIDDLRESPAVGVARLIAEWHVGETLVVEPNVEQLPKSLMGLVTLKDTATALQQADVLVMLVDHKQFKAIKPEDIKQQWIVDTKGVWR

SEQ ID NO: 88726 - protein, 279 aa, Vitis vinifera
  misc_feature (37)..(37): Xaa can be any naturally occurring amino acid
  misc_feature (39)..(39): Xaa can be any naturally occurring amino acid
  misc_feature (277)..(277): Xaa can be any naturally occurring amino acid
  misc_feature (279)..(279): Xaa can be any naturally occurring amino acid
MAAPSSSSFCFIILAFALLHVPAFAFTTEELEEVPFXYXGQMGPANWGKLHPQFQECVVGKSQSPVDIITNKTELNPNLKPLSRNYRPGKSTLVNNGFNVGVRFDEDVGVLLVDGKNYSLKQMHWHSPSEHRIDGLQYPAELHLVHRTDDGNIAVVGILYQYGDADPLLSKLKNKLDELAKDVCASNEQSQVSLGTMDTKLIRRNTRRYYRYMGSLTTPPCSEKVAWHILGKIRDISKDQVAALKAPLNSDCKDNSRPLQPLNGRRIQLYDETPDGXDX

SEQ ID NO: 88727 - protein, 529 aa, Thermus thermophilus HB27
MSALYRRFRPLTFQEVVGQEHVKEPLLKAIREGRLAQAYLFSGPRGVGKTTTARLLAMAVGCQGEDPPCGVCPHCQAVQRGAHPDVVEIDAASNNSVEDVRELRERIHLAPLSAPRKVFILDEAHMLSKSAFNALLKTLEEPPPHVLFVFATTEPERMPPTILSRTQHFRFRRLTEEEIAFKLRRILEAVGREAEEEALLLLARLADGALRDAESLLERFLLLEGPLTRKEVERALGLPPREALAEIAASLARGKTAEALGLARRLYGEGYAPRSLVSGLLEVFREGLYAAFGLAGTPLPAPPQALIAAMTALDEAMERLARRSDALSLEVALLEAGRALAAEALPQPTGAPPPEVGPKPESPPAPEPPRPEEAPDLRERWRAFLEALRPTLRAFVREARPEVREGQLCLAFPEDKAFHYRKASEQKARLLPLAQAHFGVEEVVLVLEGEKKSLSPRPRPAPPPEAPAPPGPPEEEVEAEEAAEEAPEEALRRVVRLLGGRVLWVRRPRTREAPEEEPLSQDEIGGTGI

SEQ ID NO: 88728 - protein, 66 aa, Halobacterium sp. NRC-1
MMVPVRCFSCGTVVGEHWEAFKARAETHDGDEDPADVLDDLGVDRHCCRRMLIAHQDLVDVVSPYQ

SEQ ID NO: 88729 - protein, 396 aa, Odontella sinensis
MKLSLGIVALMAASASAFAPTAFMPANTLRAAAPASPSALNMALKEGEKPIVIGVAADSGCGKSTFMRRLTSIFGGEGVGPLGGGFDNGGWETNSLVSDLTTVLCLDDYHLNDRNGRKVTQRTALDPLENNFDLMYEQIAALKNGESIEKPIYNHVNGTLDTPETIVPTPIVIIEGLHPMYDERVRDLLDFSLYLDISDEVKLNWKIQRDMEERGHSLESILASIEARKPDFDAYIAPQKEFADLTIEVLPTQLDEEDKKTLRVRCIQKEGVSDFSPCYLFDEGSTIAWTPAPSKLSSSGPGLTMAYGTEDYYGKPAQVVEMDGTFDNIQELVYVESQLSNTSTKFYGELTQAMLKLADAPGSNNGTGLMQTLAAFAIRELYEKKAAAAKLAVIEA

SEQ ID NO: 88730 - protein, 489 aa, Bacillus licheniformis ATCC 14580
MEHINMEQFILLAALLLIIGVLTTKFSTRLGVPALVLFLIVGMIMGSDGLGIIYFNNPELAQLIGIIALVVILFEGGLQTKWSSVKAVAVPSLSLATIGVLLTTCVVAVAAKLIFNVSWMEGFLFGAIVGSTDAAAIFAVLKGQNIRDRLSSTLEAESGTNDPMAMFLTLSLIQLLTADHSSYFMLVISFFWQMGMGLLLGYLLGRFASFAINKINLDSSGLYPIFALAFALLTYSLTDVIGASGLLAVYIAALVIGNQDLTYRHSIFRFNEGFAWMMQILMFIILGLLVFPAQFLSFDIIFKGFLLSLILIFIARPVAVFLSTIKMGFNFNEKIFLSWAGLKGAVPIVLATFPMTMGLENSQLIFNVVFFVVLTSALIQGSTISVFAEKLKLNGPQKVEAPHSLELVSIGKANAEIIEFEVDDQAAITRQMLKDISFPKDALINAIIRNGDLVTPHGETKIKPGDILYILVSKKQKKELKKFLNREFD

SEQ ID NO: 88731 - protein, 311 aa, Azoarcus sp. BH72
MSSPRHYLQFSDFTAAEYDHVFQRTRWIKEKFKQYEPYHPLFDRTLVMIFEKASTRTRLSFEAGMQQLGGSAIYLNTRDSQLGRGEPVEDAAQVISRMSDLVMIRTFEQDIIERFAAYSRVPVINGLTNEYHPCQILADIYTFIEHRGSIKGKTVAWVGDSNNMCNTWLQAAEVLDFKVRVSTPPGYEVEPTDAGLRGTAHFAQFSDPLEACRGADLVTTDVWTSMGFEAENEARMKAFADWCVDAEMMSVAAPDALFMHCLPAHRGEEVTAEVIDGPQSVVWDEAENRLHVQKALMEYLVLGRVGDEESN

SEQ ID NO: 88732 - protein, 353 aa, Mesorhizobium loti MAFF303099
MLKLARAGPIVVTGTAGFIGFHVASRLLRRGLAVIGVDNFTPYYDVGLKEARFAQLCAEPGFTPMQMDLADQALVKALFSDFQPSHFVHLAAQAGVRYSLADPHAYVQSNIVAFLNVLEGCRHAGVSHLVYASSSSVYGANRSIPFSEHHGASHPVSFYAATKSANECMAHSYSHLFGLPVTGLRFFTVYGPWGRPDMAVYTFTHAIAEGRTIEIANAGRVWRDFTYIDDIVEGVVRVLAAPPRPDPDWDSRAAAPATSSAPYRIYNIGNDRPEEINRLIAIIETALGRRAVRVNVPLPPGDVLKTRADVSDLRGAVGFAPATALEDGVQRFVEWYRDFHASPAGRERAFTQA

SEQ ID NO: 88733 - protein, 680 aa, Oryza sativa
  misc_feature (83)..(83): Xaa can be any naturally occurring amino acid
MGYLSCRADSSVATCRSITAISPLPLSRRSGVGGRRRALPAAAREGDGGEASSAAATIERFAYHELEAATSHFADAALLGRGXSTGLVYKAVLASGRAVAVKRPSPRRPEVDNEIRILSSVRGPRLVNLLGFSDSGAGAGADQQQQQHRPRLLVVEYMPNGTLYELLHSNPRPPGWPRRVRLALQTARALRALHDADPPVIHRDVKSANVLLDANLDARLGDFGLALRVPKRLPGDAAANAAATPAPAGTLGYLDPAYVTPESLSTKTDVFSFGILLLEIMSGRKAIDVQHSPPSVVEWAVPLLRKGKVASLFDPRVAPPRDPVTRRDLAALAASCVRSCRERRPSMADIVDRLVVLSKAVSGKMWNGLAVVGNPCAVVDVQKTIAKRAAAAAAGDRAASQRELTSALAFDDDEKKEEEDAPNAGALEEDEVPLVGAKKAPRPLKNGKMFSEPGARERRNLLELMARIDGVAGQRFGITRARTVRAASESIEKDAAVLLLRRNQTVKVLGSEALSKADIFSSLDAKIKHELGKEQQEEAGKIKHELVKEQQEKAGNIKQELVKEQQEKAGNIKQESGEEQEKAGKTKHDAGKGHVEKAVGINLEAGKEQEKVEKNQEKEMKIQEKLGEIFDKAMKSEEKTGQNPGIEKKIQDTAEKKQEHDARVVQDKVEKIQDEAKKIQ

SEQ ID NO: 88734 - protein, 396 aa, Azoarcus sp. BH72
MSHVMNTYARLPVAFERGEGVWLYDDAGKRYLDALSGIAVSTLGHNHPRLVRAIAEQAAAVLHTSNLYRIPLQEKLADRLGAISGMDEVFFCNSGCEANEAAIKLARFYGHKRGVAQPTIIVMENAFHGRTLATLSATGNRKAQAGFEPLVSGFIRVPYRDIQAIRQVAEHNQDVVAVMLEMIQGEGGINLAEAGFQRELRELCDARGWLLICDEVQCGVGRTGKWFGWQHADVRPDVVTLAKGLGSGVPIGACLTSGAAAGLFGPGNHGSTFGGNPLACAAALTTLEVIEESGLMAQAEAVGETICSGLREALAGCEGVVEIRGRGLMIGVELDRPCGALVTKALENGLLINVTAERVVRLLPALVFTAADAQALVGALAPLIRDFLSQQGKGTA

SEQ ID NO: 88735 - protein, 398 aa, Halobacterium sp. NRC-1 [sequence omitted]

SEQ ID NO: 88736 - protein, 302 aa, Pseudomonas putida KT2440
MNAKVVVVGSLNMDLVVRAQRLPRAGETLPGDSFFTVPGGKGANQAVAVARLGGSVAMIGNVGDDDYGRQLHRALYVEGIDCQGVSTCPAMSSGVALITVDAASQNCIVIIPGANGLLTPQSVRRFDALLQAAEVIICQLEVPASTVAWTLARGHELGKQVILNPAPATGPLPADWFAHIDYLTPNESEAEALTGVVVTDQDSARRAGERLLQLGAGKVIITLGAQGALLVTAQGHQHYPAPHVQPLDTTAAGDTFIGGFAAGLVRGLEEGEAIAFGQRAAALSVTRAGAQPSIPYLAELTP

SEQ ID NO: 88737 - protein, 586 aa, Erythrobacter sp. SD-21
MASGELASPALSDALVILGAAGLVIPVFTRFRITPVIGFILIGILVGPYGLGQLVFERPWLEHITISDPEALDLFAEFGIILLLFAIGLELSFKRLWQLRRLVFGLGAAELLIGGICLAIVLSMMGQYWIGALALGFALAFSSTAIVLPISGSTSPVGRAALSMLLFEDIMIVPIVFILGAMAPNAASEGWEGLLTTMWQGAAVIAVMMIAGRYALPRLFAQAARTKSPELFLAAAMLVVIGSSLATAAVGLSPIVGALIAGLLIAETEYHTEVESIMEPFKGLALGIFLITVGMSIDLATIAEHFGMIATAVVGVLVFKALLTGVLLRLMGARRSTAAETGILMASPSETTLIVLTAASSALLIQPGTAQFWQIVTAIGLTITPLLARLGRVVARRVEPAPELPPEDEGERKVIIVGIGRVGRLVAQMLKAHEKAYVAIDSDADLIEYAKREGYRATFGNAARGDALHHLGIEDALAVVLTMDEPVLAERLVRKLRSEYPDLLIVARARDIAHAAELYRAGASHAVPEALEATLQLSEAVLVDIGVAMGPVIASIHEKRDEFREQIEEEGALGYKPKLRSSTANG

SEQ ID NO: 88738 - protein, 495 aa, Mycobacterium smegmatis str. MC2 155
MSTIDQRAEKHSRQGGAADVLAAQRRSFLDDGPPDIALRRNRIDRLLAMVLDNAEDFVTATASDYGTRSRSAAFFAEILGMISVIEHTRSNLPRWMRSTRLMRAARLAGLRAEVVPSPVGVVGVIGPWNFPVQLTVLPAAAAFAAGNRVMIKMSEVTPRTAEAMADLAPRYFDQRELAVITGGPELAAEFSALPFDHLFFTGSPAIGAVVGRAAAANLVPVTLELGGKNPVVVAPGADITRAATRIAQARMVNGGQVCVCPDYVFVPDRHVDEFVEVARGTLRRMFPTITDNPDYCSSVNRSNFDRVVGLIADARARGARVESIVPVGEVLPDPVTRKIPPTIIRDVDDRMRINDEEVFGPVLAVRGYSSLASTIDYINSRPSPLVAYWFGPDDADFRHFVDHTRSGGVARNDFAAHMIPSSAPFGGVGRSGMGAYHGKAGFDAFSHHRTVVGTDLPFSITGRAALPFTGSMRVSADLALWRARSRTKNRLRKFR

SEQ ID NO: 88739 - protein, 347 aa, Halobacterium sp. NRC-1
MSQEARERAVLAAVRERRQQVNDAIDDDLPVAEPERLYEASRYILEAGGKRLRPAVLLLTAEALADTSDTPPYREFPDCIGGHVDVMSAAVSIEVIQSFTLIHDDIMDDDDLRRGSPAVHREYDTETAILAGDTLYSKAFEIMLETGAPPERGLRAMRTLAETCTHICEGQAMDIDFETRGDVVTDEYLEMVELKTAVLYAAAATLPGLLLSADEETVEALYNYGLRVGQAFQIQDDVLDLTVPSAELGKQRGSDLVEDKTTIITLHAAEHGVDVDGLLDAEDPADVTEAAVQAAVQALQDAGSIQYASDLAEDLVEEGKAHLEVLPENEARHRLEQIADYLIERGY

SEQ ID NO: 88740 - protein, 384 aa, Phaseolus lunatus
MGLVCSKRRRFRDADAEENAQDAEIERRIELETTAEKHIQKLLLLGAGESGKSTIFKQIKLLFQTGFDDAELKSYIPVIHANVYQTIKVLHDGSKELAQNDADPSKYVISNENQDIGEKLSEIGGRLDYPCLTKELAQEIETLWEDAAIQETYARANELQVPDCTHYFMENLERLSDANYVPTKEDVLYARVRTTGVVEIQFSPVGENKRSGEVYRLFDVGGQRNERRKWIHLFEGVTAVIFCAAISEYDQTLYEDENKNRMMETKELFEWVLKQPCFEKTSFMLFLNKFDIFEKKILKVPLNVCEWFKEYQPVSTGKQEIEHAYEFVKKKFEELYFQSIAPDHVDRVFKIYRTTALDQKLVKKTFKLVDETLRRRNLFEAGLL

SEQ ID NO: 88741 - protein, 384 aa, Phaseolus lunatus
MGLLCSRNRRYNDADAEENAQTAEIERRIELETKAEKHIQKLLLLGAGESGKSTIFKQIKLLFQTGFDEAELKSYLPVIHANVYQTIKLLHDGSKEFAQNDADFSKYVISDVNKEIGEKLSEIGGRLDYPHLTKELAQEIENLWKDPAIQETYARGSELQIPDCTDYFMENLQRLSDANYVPTKEDVLYARVRTTGVVEIQFSPVGENKKSGEVYRLFDVGGQRNERRKWIHLFEGVSAVIFCAAISEYDQTLFEDENRNRMMETKELFEWVLKQPCFEKTSFMLFLNKFDIFEKKILKVPLNVCEWFKDYQPVSTGKQEIEHAYEFVKKKFEESYFQSTAPDRVDRVFKIYRTTALDQKVVKKTFKLVDETLRRRNLFEAGLL

SEQ ID NO: 88742 - protein, 484 aa, Monilinia fructicola
GTIIAAGVAAFVVLAVVLNVLNQVLFANPNEPPVVFHWLPIIGSTITYGIDPYRFFFDCRAKYGDVFTFILLGKKTTVYLGRKGNDFILNGKHKDLNAEEIYTVLTTPVFGKDVVYDCPNAKLMEQKKFMKIGLSTEAFRSYVPIIQMEVENFMKRSSAFKGQKGTANIPPAMAEITIYTASHTLQGKEVRDRFDTSFASLYHDLDMGFSPINFMLHWAPLPHNRARDHAQRTVASTYMDIIQKRRAQATEAEFKSDIMWQLMRSSYKDGTPVPDKEIANMMIALLMAGQHSSSSSISWIMLRLAARPDIMEELYQEQIEVLGADLPDLKYEDLSKLTLHQNILKETLRLHTPIHSIMRKVTTPMPVSGTKYVIPTSHTLMASPGCTSRDAEYFPEPLEWDPHRWDIGSGRVIGNDQDEEFQDYGYGMISKGASSPYLPFGAGRHRCIGEQFANVQLITIMATVVRLFKFKNPDGSKDVIGTDY

SEQ ID NO: 88743 - protein, 354 aa, Burkholderia sp. 383
MLLLNPGPVTLTERVRRSLLQPDLCHRESEFFDLQDEARARLVAAYELDPAEWTAVLMTGSGTAAVESMIAALVPKDGKLLVIENGVYGERITQIATQYGIAHEVLKHEWMQAPDLVQIGAKLDAGGYSHVAVIHHETTTGRLNDLGAIAEVCRSRGVKMLVDGVSSFGAEAIDFAGGDIDAVAATANKCLHGVPGAAFVIVRRSALAKAASRTYYLDLGRLAKLQDQRNTPFTPSVHAYYALVEALREFDEAGGWRARHAHYKALADQAQAGLAARGMPLVLAEGESSVVLRAYRLPKGVTYETLHDGLKARGFVIYAGQGGLSKELFRISTMGAIQAADVDRLLEGFTALTR

SEQ ID NO: 88744 - protein, 207 aa, Vitis vinifera
MQSVSQEAYEIYSERAKVILIETSKQLKAQADKASQDLNELAKVIGEDGKEYLSLAAENSPVPLKDVVETFTSPSDDLDKISKVRDFYLGIPYGVALSVGGLLSFMLTGSIPAVRFGVILGGALLALSISSLRAWKKGESLALALKGQTAIAGIIFLREICLLSQKPSFSTRLATIISGAMVAFYLYRIMLDGDLIKGSNGEDGKEN

SEQ ID NO: 88745 - protein, 624 aa, Vitis vinifera
MREKLGLLVCVWFVLWGSCVGRFVVEKNSLRVTSPESLKDVYECAIGNFGVPQYGGTMVGTVVYPKANQKACKSFEDVEISFKSKPGGLPTFLLADRGDCFFTLKAWNAQNAGAAAILVADDKIEPLITMDTPEEENAHADYLQNITIPSALISKSFGDSIKNALSKGDMVNINLDWRESLPHPDERVEYEFWTNSNDECGPKCESQIEFVKNFKGAAQIFERKGYTQFTPHYITWYCPDAFILSKQCKSQCINHGRYCAPDPEQDFSRGYDGKDVVVQNLRQACFFKVANESGKPWLWWDYVTDFAIRCPMKDKKYSKECADQVILSLGVDVKKIDQCIGDPEADVDNPVLKAEQDAQIGKGSRGDVTILPTLVINNRQYRGKLDKGAVLKAICAGFQETTEPTICLSDEVETNECLENNGGCWQDKAANITACKDTFRGRVCECPIVQGVKFTGDGYTNCEASGALRCEINNGGCWKDTKDGSTYSACVDDNSKGCQCPQGFKGDGVKTCEDVNECKDKVACNCPECKCKNTWGSYECSCSGNLLYMREHDACISKHVKTEVSWSFIWVIILGLAAAGVGGYALYKYRIRRYMDSEIRAIMAQYMPLDNQGEIPNHVPHGDI

SEQ ID NO: 88746 - protein, 202 aa, Arabidopsis thaliana
  misc_feature (17)..(17): Xaa can be any naturally occurring amino acid
  misc_feature (78)..(78): Xaa can be any naturally occurring amino acid
  misc_feature (108)..(108): Xaa can be any naturally occurring amino acid
  misc_feature (114)..(114): Xaa can be any naturally occurring amino acid
  misc_feature (131)..(131): Xaa can be any naturally occurring amino acid
MASSMLSSAAVVTSPAXQATMVAPFTGLKSSAAFPVTRKTNKDITSIASNGGRVSCMKVWPPIGKKKFETLSYLPDLXDVELAKEVDYLLRNKWIPCVEFELEHGFVXTREHGXNTPGYYDGRYLGKFWKXLPICFGCTRLPLQVVERKFERMPRKEYPRATLSLGIIGFTTPRQVQCITFLALQSPPSFTRSLNFFLKHFL

SEQ ID NO: 88747 - protein, 423 aa, Oryza sativa Japonica Group
MAAAVAASSSSSSSSCAAVGVATASHPHRHRQARFVVSPPAPASPAALLWRRPRRVAPTTFCSAPSLGRVGWPRREGAAWLLSFRAGPVSSPSSAAAGDPSQALSALLPLVVAATAVAALGNPATFSWVSKEYYAPALGGIMLSIGIKLSIDDFALAFKRPVPLTIGYMAQYIVKPLMGVLIARAFGMPSAFFAGFVLTCCVSGAQLSSYASFLSKGDVALSILLTSCSTISSVVVTPVLTGLLIGSVVPVDGIAMAKSILQVVLVPVTLGLLLNTYAKAVVNVIQPVMPFVAMLCTSLCIGSPLAINRSKILSSEGFLLLLPIVTFHIAAFIVGYWISKLPMLRQEEPVCRTISVCTGMQSSTLAGLLATQFLGSSQAVPAACSVVIMAIFGLTLASYWGNGLRIRDIGSRFVPQASAGVSS

SEQ ID NO: 88748 - protein, 486 aa, Zea mays
MAGSSAEQLLSRIAAGDGHGENSSYFDGWKAYDMNPFDLRHNRDGVIQMGLAENQLSLDLIEQWSVDHPEASICTAQGAPQFRRIANFQDYHGLPEFREAMAKFMGQVRGGKVTFDPDRVVMCGGATGAQDTLAFCLADPGDAYLVPTPYYPAFDRDCCWRSGVKLLPIECHSSNNFTLTREALVSAYDGARRQGVRVRGILITNPSNPLGTTMDRGTLAMLAAFATERRVHLICDEIYAGSVFAKPGFVSIAEVIERGDAPGCNRDLVHIAYSLSKDFGLPGFRVGIVYSYNDDVVACARKMSSFGLVSSQTQHFLAMMLADAEFMARFLAESARRLAARHDRFVAGLREVGIACLPGNAGLFSWMDLRGMLRERTHDAELELWRVIVHRVKLNVSPGTSFHCNEPGWFRVCYANMDDDTMEVALDRIRRFVRQHQHSKAKAERWAATRPLRLSLPRRGATTASHLAISSPLALLSPQSPMVHAS

SEQ ID NO: 88749 - protein, 434 aa, Zea mays
MAPPMRKPYMREHSCLIFPPPRGRRPLAVIKFLGGAFIGAVPEVTYGYLLELLALEGFVVVCVPYNVTFDHEAAAREVFQSFHACYDALLASGLPEAGLSALDIAELPLYSVGHSNGALLQLLVGSYFSERIPEANAIVSFNNRPASEAVPYFEQCVFSILGLSGLQLLTPGIADEVFQDWWKAAEARVCKEKKKGFNSLVALSSWRIWKHRNACVFDGVPPSVSKVIQDIKEEARIWCLAGAAGMIGPLFRQLMPMMEASPVYSMARNASGYAWKALFDLAGGLLREYDQEATVSLSKFIDQLPSVMNQVSEGVSEFKPTPPENREFCKNSYSVPNTLLVKFTVDAIDDTDIVEDVLRPRVDSIGGQIKKVILSGTHLTPCIQALSFVVLQDVKWQVGSEYTPADAIAQGLKSLALSETRVLSRTIADWFTSL

SEQ ID NO: 88750 - protein, 476 aa, Streptomyces coelicolor A3(2)
MSVPTAVATPLPVLGRDVTVPLVTGGQVAYAALDYAASAPALQRVWDDVAAYAPYYGSVHRGAGYLSQLSTDLFENARGTVAGFLGCRDDDQVVFTRSTTDSLNLLAAALPAHCRVFVFETEHHASLLPWRAADVTYLDAPRTPAEAVETLERALAAREPYGPALVCVTGASNVTGELWPVRELAAAAHAHGARIVLDAAQLAPHHPVSVRDLDVDWVAFSGHKLYAPFGSGVLAGRADWLREAEPYLAGGGASRSVSRRADGGVDVQWHDSAARHEAGSPNVIGVYAIASACKALTEAGFDTLVAREEYLIRKVREGLAEVPEVRVLSLFGDDAPRVGVLSFVVEGWNSSHFAAALSAEYGIGVRDGLFCAHPLVRTLLGSDPQTQGECGAPEAAPGEKSLNAIRVSFGAGTPDEHVERFVSAVRELVSDGARWNYRTEDGRCVPDPASGDTASGDHASGDPASRGTAPVTGTAA

SEQ ID NO: 88751 - protein, 437 aa, Helicobacter hepaticus ATCC 51449
MLDLKALDLAHIWHPCTQMKDHETLPLIPIKSAKGVYLYDFEGKAFIDGISSWWVNLFGHCNPFINAAITKQLQQLEHIILAGFSHEGIIRYSEKLCALLPQSLQKCFYADNGSSAIEVALKMSFHSHYNAGNKDKNAFLSLSNAYHGETLGALSVGDVALYKSTYQPLLLECLSAPVPRGIWNPDDGTISGDYHMELEALEEILKHHAHRICAFILEPLLQCAGGMNMYPAAYIKEACALARKHNIHIIFDEIAVGFGRTGSMFALEQCDVTPDFLCLSKGITGGYLPLSVVVTSNNIYEGFYAPYEEQKAFLHSHSYTGNALAIAAANAVLDIFEQDDIIFSNHSLSVAIVKRWSMLAKHKKVGNLRVCGMVFAFDLQGCKLKRAGLYVYENALAKGVLLRPLGNTIYFMPPYVINLEIAEYVCNVLDAILEDDF

SEQ ID NO: 88752 - protein, 746 aa, Staphylococcus warneri
MKNRENKYSIRKFSVGTSSILIAALLFIGGGSAQAAENQDKGNVDSEAQQAQSIGEQQGNDVKNEQTNQSSELKERNDSVEAQNDNQQDATPTSLHKETSEKDTTQTSQDNTEEKQTKDATVETEQSANQVQQDVKTTKEKTTEDQATKSVEKSDATTPNQKDKADGKATKEETPTTSPKAQDKASSTQTHQHDVDPEFNSKHKASQVDPEFSHKQAQKKADVDSEFNKNHKAQQVDPDFSRRHATEKATHATVNKEKADATINQKDQQKVTAQSVDQKATAPKQTDSSQKSKQKQPVSLEQLEKDSPLLSKDNPSKKDKEQKDGLQALKSNSVATLNNQSKNKVAVADKDQTNKKAKQQQYKNHDPIILVHGFNGFTDDINPAVLSHYWGGDKMNIRQDLEENGYKSYEASISAFGSNYDRAVELYYYIKGGRVDYGAAHAAKYGHERYGKTYEGVYKDWKPGQKVHLVGHSMGGQTIRQLEELLRNGNQEEIEYQKKHGGTISPLFKGNNDNMVSSITTLGTPHNGTHASDVLGNEAVVRQVVYDIGKAFGNKDSRVDFGLSQWGLKQKPNESYIDYAKRVKNSKLWKSQDNGFYDLTRDGATDLNRKTSLNPNIVYKTYTGEATHPSLFGRQKADLNMFLPFILTGNVIGKANEKEWRENDGLVSVISSQHPFNQKYTQATDKNQKGIWQVTPTKHDWDHVDFVGQDSSDTVRTREELQQFWHGLADDLVQSEKLTSEQKAQA

SEQ ID NO: 88753 - protein, 776 aa, Oryza sativa Japonica Group
MKLRLRSMDQRGGAGGAAETHRVQLPDTATLSDVKAFLATKLSAAQPVPAESVRLTLNRSEELLTPDPSATLPALGLASGDLLYFTLSPLPSPSPPPQPQPQAQPLPRNPNPDVPSIAGAADPTKSPVESGSSSSMPQALCTNPGLPVASDPHHPPPDVVMAEAFAVIKSKSSLVVGDTKREMENVGGADGTVICRLVVALHAALLDAGFLYANPVGSCLQLPQNWASGSFVPVSMKYTLPELVEALPVVEEGMVAVLNYSLMGNFMMVYGHVPGATSGVRRLCLELPELAPLLYLDSDEVSTAEEREIHELWRVLKDEMCLPLMISLCQLNNLSLPPCLMALPGDVKAKVLEFVPGVDLARVQCTCKELRDLAADDNLWKKKCEMEFNTQDTCGCMMCKCIYSDQRKDIVLADKYTCGNYMQKPVTQPGRWLIILVYHSLLCQYITIGLSLLWYHLVDLVQDAPAAGIHFDCIIPLPINPYQLPPSAGACCSTTQASASAKDGGNMYSPPCSAAASSQGHCFAVGANQLASLDLAMDFDEPILFPVHNASLQEGIQFYNPTGDTQLSRNMSIDKCLKGSKRKGSGEGSSSLHSQEETGEMPQRELSMEHAGEKAGDADASREEYVHVRAKRGQATNSHSLAERFRREKINERMKLLQDLVPGCNKITGKAMMLDEIINYVQSLQRQVEFLSMKLSTISPELNSDLDLQDILCSQDARSAFLGCSPQLSNAHPNLYRAAQQCLSPPGLYGSVCVPNPADVHLARAGHLASFPQVYI

SEQ ID NO: 88754 - protein, 711 aa, Staphylococcus warneri
  misc_feature (162)..(162): Xaa can be any naturally occurring amino acid
MIKLINSYFFESISEGNTYRGDFLKNNNSKRQFSIRKFTIGVVSIVAGITFFVSEHDVQAAEQQSSHLSQESVLSHSKPSDQDANVSSKESEIDKNINKVDDAQSYSQQNEQQSSKAENKEIQKLTQAEQVEKQEQPASNQTANHSSKGPSINNQESHNKQXPSDDKTPNTEPEKIEKVDNHKRIQDQYQDKNKKVDNKQSNNSQLNQKEHPNSSNNKQQKQRLDVKPQKDNQQLQSRNDVKEKLDNQPIEQKDTKQQSNNKSKDNTTSVKSHSQQHKPHSLKTQSHSTPGQKVNTNISTKPTQQQTTNQNIKPKNTDEATIKSNQYKNKYPVVLVHGFLGLVGDNAPALYPNYWGGTKFPVKKRLEKLGYDVHEASVGAFSSNYDRAVELYHYIKGGKVDYGAAHAAKTGHDRYGKFYQGIMPDWEPGKKIHLIGHSMGGQTIRLLEHFLRHGNQEEIDYQKAHGGEISPLFTGGKDNMISSITTLATPHNGTPAADKLGNTDFVKGVFNRIGRLSGNKYSHIDLGFSQWGFKQRPDESYIDYVKRVANSKIWKTQDSAVYDLTTEGSEKLNQMTSLNPNIVYTSYTGLDTHTGPLGNENPNIRQFFLFDLTSRLIGRDDNVNVRKNDGIVPVSSSLFPTNQAAKTVGMTSPTTDKGIWQVKPVMNGWDHLDFVGLDATDYKRIGEELSQFYLGIINNLIRIEDIDGIKH

SEQ ID NO: 88755 - protein, 586 aa, Halobacterium sp. NRC-1
MDDELRERVRRAAERAALFNALKHGSDAQVGAIMGPMMGEHPDFRAHGDEIPGVIAPVIEDVNGMSDDEQRARLAELAPEDVEELDSEDEGDDHALPALPNAEAYDEVRMRCAPNPNGPWHVGHARMPSVIGTYKQRYDGSFVVRFDDTDPETKRPDLDAYDQILEDLSYLGFEADEVLTASDRVETYYEHARRLIGMGGAYTCSCPGAEFSDLKNSGEACPHRDKDPETVADEFEAMVDGEYNSGEMVLRVKTDITHKNPALRDWVAFRMVDTPHPRDAASGYRCWPMLDFQSGVDDHRTGVTHIIRGIDLQDSAKRQRFLYEYFGWEYPEVVHWGHVQLDAYDVAMSTSTIKERIAAGELEGWDDPRAPTMQSIRRRGIRGAAVVDAMVELGTSSSDVELAMSAVYANNRDLVDDTAPRQFLVRDGFEARGEGPEESHEAVEVPVDDGPDEATPQVHPEHPDRGDREIPVGERVLVEATDLPAAGDRVWLKGYGPVRYDGERFAFLDADIDIVREEGVDVVQWVPAEHNVDVRLRTMDGDVTGYAEPGFADRDADEIVQFVRVGFARVDAHRDGGASVAYFTHP

SEQ ID NO: 88756 - protein, 120 aa, Halobacterium sp. NRC-1
MPVYVDYDVPADLQERALESLEVARDTGSVKKGTNETTKAIERGNADIVFVAEDVSPEEIVMHLPELAAEKGIEVVFVETQDELGNAAGLEVGSAAAAVVAAGDAEDEIEDISTKVEDLQ

SEQ ID NO: 88757 - protein, 191 aa, Lactobacillus plantarum WCFS1
MELLIDNYDSFTYNLYQLIGRLTPDVRVIKNDDLTVAAIKALQPDHIILSPGPGTPAHTGVSPQVVQQLAGQVPILGICMGLEVMVTAFGGSLQGAQHLVHGQATLMHVQPSSLFKDCPMQFMAARYHSLVADAGRLPVNFRIIGTSDDQEIMAVEDVGRQLYGVQFHPESIMTPAAVGEQLIRNFLALKH

SEQ ID NO: 88758 - protein, 161 aa, Halobacterium sp. NRC-1
MTDHDERTFVMVKPDGVQRGLIGDIVTRLETKGLKMVGGKFMRIDEELAHEHYAEHEDKPFFDGLVSFITSGPVFAMVWEGADATRQVRQLMGATDAQDAAPGTIRGDYGNDLGHNLIHGSDHEDEGANEREIALFFDDDELVDWDRDASAWVYEDLADHD

SEQ ID NO: 88759 - protein, 206 aa, Oryza sativa Japonica Group
MNSLSNGLLKGLRRVLEQQRKPIDFYRKSQAWSSTVSFSDIDEKSEMGGDDDYTDSRRELEPQSVDPKKGWGFRGVHRAIICGKVGQVPVQKILRNGRTVTVFTVGTGGMFDQRVVGDADLPKPAQWHRIAIHNDQLGAFAVQKLVKNSAVYVEGDIETRVYNDSINDQVKNIPEICLRRDGKIRLIKSGESAASISLDELREGLF

SEQ ID NO: 88760 - protein, 251 aa, Methanothermobacter thermautotrophicus str. Delta H
MPERYEGMAYWEMVSRQMGLLSRADQLKLKDSTVSVIGCGGIGGAAVEMLARMGVGSLRIIDSDVFDVSNINRQLMSSFRDLRIPKVDVAAERIRTVNPFSRVKVYHEIFDEENAAEIIPGSDAVVDALDNITSRVIASRRCTSEGIPFIHGAIHGSMGQVTVFREGSPSYEELFRLPSVGLELTADVKAKLRDLSSKTPPVIGPVANITGCLQAAEVLKLITGRGDVIAAPRMLKFDLFQGEPFKIVELS

SEQ ID NO: 88761 - protein, 393 aa, Vitis vinifera
MLGFSVPIQPQFQGFTMCDCAPSTLLLNSTVRIRNLGFTTRDWNPRNHAKLSTFCNSHLIFHRNGGSRLISAEIDALNSTTCVRAIPNRGELGFKDEGKRDFGFETKGVDSSTSSAFDFLELEEQEGRTGEKSAGNPEDEDLVRVGGGSELEGAEKVDERLGLRSGRQVMRRSNMLAKQVISIRSALSLGFVSQLWVDTTSWMVLVIEVRPNLLSGELERFLLEDVSRVGDVVLVQDESVMDNEYKMLGLETLVGYNVVTPGRRNIGKVRGYTFNINSGAVESLELDSFGISLIPSSLVSTYALFVEDVLEVVSDTVIVHEVAASRIQRLTKGFWDARKGGTSIDEPGEYSDFASKRVRSDHSQSTRRNFRNKKFRPKVREMEDDWELPMDYL

SEQ ID NO: 88762 - protein, 494 aa, Bacillus cereus ATCC 10987
MESMTFVLFGATGDLAKRKIYPALYNLYRDQKLPKQISVIGLGRRQVSHVDFQGRIKESIETFSRHREEGTLELEGFLDNFRYCPLDVSKPEDYERLLQVVREREEELHIKGNRMFYLSVAPEFFETIALNIKESGLDKTDGWKRLMIEKPFGHDLQSARELNDKLSRTFEEDEIYRIDHYLGKPMIQNLEALEFANPVLQSIWNKEHIANVQITASETVGVEERAGYYDQAGAIRDMVQNHMLQILMMTAMNLPEKVNACEIREEKRKVMETLRKVKKEDVQNHIIRGQYASGEIKGEQVVAYKEEPGVNPSSNIDTFVAARLWIDNPFWTDVPFYIRTGKRMKEKSTRIVIEFKNTLKQQYQDNNPNAAPNLLIIEISPGENVSLQLNSKNPLKNGEIEPMRINFTCEQADVGVPEAYERLIHDAVSGDATFFAHWREVELSWEWVQPILEAFEENLLPLHEYESGSYGPDASHELLQESGFKWWLDQETEK

SEQ ID NO: 88763 - protein, 365 aa, Populus trichocarpa
MDFETESQKKKCGVLGDVLGGVTMVLPKELDEPIPLPSPPTLAVPFELRFQLPDLKLAVRDFMRSREAGEFLSGALAGAMTKAVLAPLETIRTRMVVGVGSKNISGSFLEVIEQQGWQGLWAGNGINMLRIIPTQAIELGTFECVKRAMTSAQEKWSQSECPRVQLGPLSLSFSLSWISPVAVGGAAAGIFSTLACHPLEVLKDRLTVSRDIYPTLSIAISKIYKDGGIGAFYAGISPTLIGMLPYSTCYYFMYDTMKTSYCKGKNKKSLNRPEMLLIGAFSGFTASTLSFPLEVARKRLMVGALQGKCPPHMAAALSEVIREGGLMGLYRGWGASCLKVMPSSGITWMFYEAWKDILLVEKRLL

SEQ ID NO: 88764 - protein, 219 aa, Rhizobium leguminosarum bv. viciae 3841
MELQERLNDVRSRIAAGERAAGRPAGSVQLVAVSKTFEADAIRPAIEAGQRVFGENRVQESQGKWPALKAEHQDIKLHLIGPLQSNKAADAVALFDVIETVDREKIARALAEEMKRQAKALRLYVQVNTGLEPQKAGIAPDDTPAFVALCRDELGLSIEGLMCIPPAEENPGPHFALLAKLALKCGVEKLSMGMSGDYETAIAFGATSVRVGSAIFGTR

SEQ ID NO: 88765 - protein, 90 aa, Prosthecochloris aestuarii DSM 271
MNIYIGNLPYNITEDDLREAFNEFGQVDSANIIIDKFSGRSKGFGFVEMPNDEDAEKAIDSLNDTDFNGRTIKVNQARPREERPVRRDRY

SEQ ID NO: 88766 - protein, 524 aa, Bordetella parapertussis 12822
MAPPGHVVPSPANGHRHDARPATRLPEPTSLRRTLSARHLTMIAVGGSIGTGLFVASGATIAQAGPGGALLAYLLVGIMVYFLMTSLDELAASMPVAGSFSTYGAKYVDEGFGFALGWNYWYNWAVTVAVDLVAAQLVMAYWFPEMPGVLWSAAFLALIVGLNALSARGFGEAEFWFALIKVIAVLAFIAMGVLMLLGIIRGGEHGGLAYWTLDDAPFAGGFAALIGVAMVVGFSFQGTELIGIAAGESKDPARNLPRAVRQVFWRILLFYVLAIAVIGLLIPYTDPQLLRNEVSDVSVSPFALIFERAGLLAAASIMNAVVLTSVLSAGNSGMYAATRMLYSLARDGKAPARFGRLSRSGVPLWALLATTAVAALCFLSFLFSPKAVYIWLLNTSGMTGFIAWLGIAISHYRFRRGYVAQGNNLADLPYVSPFFPFGPLFAFVLCLVITLGQNYHAFLQDRIDWTGAAATYVGIPLFLAIWAGYRLVRGSRFVRYRDMQFPDLRMRNRELNAMLSGDCAEPRR

SEQ ID NO: 88767 - protein, 726 aa, Erythrobacter sp. NAP1
MAKAREEGSYKGAHMKKIVILAALAALIAAYFFFDLGAYLTLDGIKQVSDDASAFYDENPALVLGVFFAAYVAVTAASLPGAAIMTLAAGALFGLVTGTILVSFASTLGATLAFLSSRYVLRDTIESKFGERLKAINNGLERDGAFYLFTIRMIPLFPFFVVNLVMGLTRIKTWTFAWVSQAGMLLGTIVYVNAGTQLAQIDSLSGIASPAVIGSFVLLGIVPWIAKGIIGLMKRRKVYAGYTKPKSFDRNMVVIGAGSAGLVSAYIAATVKAKVTLVEANEMGGDCLNTGCVPSKALIKSAKVAAMMEHADRYGITPVKPEVPFRQTIARVMEIIKTIEPHDSVERYEGLGVDVIKGYATIIDPWTVEIALNDGGTQRLTTRSIVIASGAEPVVPPIEGVESSGYLTSETMWDAFSQMDKAPARVAVLGGGPIGCEISQALSRLGSQVTQVEMGEQLLGREDEDVAEIAKSSLEASGVKVLTGHKAVRLADKVLTAEGPEGSVDIPYDALILAVGRKARLKGFGLEKLGVDTDKTVNTDEFLATKFPNIFAAGDVAGPYQFTHTASHQAWYASVNALFGQFKKFKADYRVIPAVTFTDPEIARVGLNETEARDEGIEFEVTTYGLDDLDRAIAESETKGFVKVLTPPGKDTILGATIVGSHAGELLAEYTLAMKHKLGLNKILGTIHPYPTMAEANKFAAGNWKKANKPEKLLEWVEKYHGWRRG

SEQ ID NO: 88768 - protein, 736 aa, Staphylococcus warneri
MKNRKNSYSIRKLSVGASSIIVASMLFVGAESAQAAETESQDQTTVQNVKETTESSNSNQTQQQPLESTKAKDSDTNNTNVERPELNWTQTSNQDTDKMQDTSTNQTNENSKHIIDKTNDVSHETTKTNDTDQTSHLQLTQDKSEQSPAVESNEKSTSNDKSTPTKQEPNNTKQDIDETSKPNEDSKLVPSKSVITSKADKQEQSSKKPVKDNAKKDKQVSKDSSLEKQGTQEIPQTDSHKDVNVTPSKSSSEQQLSTTQHITAKDSSASQEVPVHSLDSSKQDHTTSTESHINLDNLDKQATKDRTPTDNGDDQSKDGLNTLTKNAVAIHNNKSKAQATQPTKDQTNKVAPQQQYKNHDPIILVHGFNGFTADNGPGLGDSNYWGGERLNITQEARAKGYNVSEASVSALGSNYDRAVELYYYIKGGTVDYGAAHAAKYGHERYGKSYAGAYRDWKPGQKIHLIGHSMGGQTVRLLEEMLRNGNPEEIEYQKQHGGEISPLYKGGQDNMISSITTLASPHNGTHASDLLGNEAIVRQAVYDFAKSQGNKFSRADLGLTQWGLKQRPDETYIDYVKRVENSSLWKTKDNGFYDLTTEGAQELNNHTSLNPKIVYKTYTGESSDPDKNGIHHRNSHMNIKYLPTTNVIGKLDDQAWDENDGLVSVVSAQHPSNQKYVDATDQIQKGVWQVTPVQHDWDHGDFVGTQKDENGISIEQFQGFWDNLLNDAVRNEKVTDQ

SEQ ID NO: 88769 - protein, 184 aa, Glycine max
MSAYKDQDTRLHGIKTKIRVVPNFPKSGIMFQDITTLLLDPKAFKDTIDLFVERYKGKNISVVAGIEARGFIFGPPIALAIGAKFVPLRKPKKLPGKVISQEYILEYGRDCLEMHVGAVEPGERALVVDDLIATGGTLCAAMDLLERVGAEVVECACVIELPELKGRERLNGKPLYVLVEYVEI

SEQ ID NO: 88770 - protein, 267 aa, Desulfitobacterium hafniense DCB-2; identical to SEQ ID NO: 1264

SEQ ID NO: 88771 - protein, 316 aa, Lactobacillus plantarum WCFS1
MKALFFNDFGDASVLQYGEVADPIVTANTVLVKTTYIGLNFADIYRRRGTYHLEKHQPYIDGYEGVGTVVAVGKQVANFKRGDRVLFVDVPFANASLVAVPADQAIKVPRAINDQQVASIGLQGMTAEFLVHDLAQNQPHDRVLIHGISGGVGQLLTQLLVANEVAVYGVASTPAKAELAYQAGATTVFMRHDPWDTTHHNFFDTVFDGVGKTLPVSLATTKHRGRVIFYGMAAGNPPVIDPVKLMSESKSLMTGDLWDYLDSAVARQCRANQLFDDVLTHRVTIRPATVYSLAEGAVAHWALETGQVAGKILLRP

SEQ ID NO: 88772 - protein, 327 aa, Salinibacter ruber DSM 13855
MRAVRVPDPGAPSAMTIGEVPTPTPGADEVRVQVHATALNRADTFQRRGHYAPPEGASSIMGLEMAGVVQETGPDVTDWHEGDRVFSLLAGGGYAEQVVVHKDLLMAVPPGLSMREAAAIPEVFLTAYQALHWLGGLQRDHEVLVHAGASGVGTAAIQLAREAGARPYITASAPKHDLCRDLGAAATIDYESEDFAARVDDLTGGAGVDVVLDFIGAPYFHQNVEALSVDGRIVQLATLGGSTVEEVSLRALMAKRIQLLTSTLRDRSLDYKVQLTQEFAGDIVPKFVDGQLRPVIDSTYDWTEVADAHRRMENNANAGKIVLQVVS

SEQ ID NO: 88773 - protein, 359 aa, Erythrobacter sp. SD-21
MSFADLGLSEDLLKAVEEAGYTEPTPIQAQAIPPILMMKDIIGIAQTGTGKTASFVLPMIDVMASGRRRALMPRSLILAPTRELAAQVAENFEKYGKNHDLKLALLIGGVQMGDQIKALNEGVDVLIATPGRLMDLFERGKILLNGCELLVIDEADRMLDMGFIPDIEFICSKLPEQRQTMLFSATMPPPIEKLAKKFLDNPKRIEVSRAATTNKDITAFKIPVESRKKRETLRWLLRNDHVETAIIFANRKTTVRELNKSLQQHGFASSEIHGDMDQSSRIKELDRFKNGEVNILVASDVAARGLDVKGVSHVFNFDTPWHPDDYVHRIGRTGRAGAKGRAFTSSRRKTPRQSRTSRN

SEQ ID NO: 88774 - protein, 587 aa, Corynebacterium efficiens YS-314
MAILQVVSHAERIKQFDHIFLPLFHFTFQHVNGVRIPGSQKDPYAKRRIAAMSATEVKEGGTGDTGGAREAGDVGEVMKVGDRREWHRRARGLITGVVLALLVYLFFPSNAVEVVAESAGFDPEAEYSREAMRITAATTVLMAAWWMTEAIPLPATALIPLIAFPLFQVSSFADAASPYANPTIFLFLGGFLLALGLQKWDLHRRMALAVVLAVGTRPKQLVLGFMVATGFLSMWVSNTATAVVMLPIGMSVLVLTAETVGGMKNQKKFATGLMLAIAYSASIGSLGTLIGTPPNALLAAYMSESHDITIGFGQWMLVGVPIAVIFTVIAWLVLTTVFKPEIDEIPGGKELIREEIKKLGPWTKPQISVGIVFLAAALSWVFIPLILDWTGSELAIHDAMIGIIAGVLLFTIPANFKNGERLLDWKTANETPWDVLILFGGGLSLSAMFTQTGLSLWIGEMAKGLGTLPVILLIFSVAALVLFLTEFTSNTATAATFLPIMGGVAVGIGLTAGGEQNVLLLTIPVALSATCAFMLPVATPPNAIAFGSGYVKIGEMVKGGVWLNIIALILITIATYLIAIPVFGIVL

SEQ ID NO: 88775 - protein, 357 aa, Moorella thermoacetica ATCC 39073
MYKIAVLPGDGIGPEIVPEAVKVLEAVSRRVGIEFQFTEALVGGAAIDARGIALPPETLELCRQSDAVLLGAVGGPKWDTLPPAERPETAALLPLRKELGLYANLRPAFLYDSLVEASPLKKEIVTGTDLIIVRELTGGLYFGAKKREQTAEGEMAYDTMYYTRAEIERIVRLAFTIARQRRCHLTSVDKANVLTTSRLWRDTVEDIKGEFPEVTVEHMYVDNCAMQLVRRPAQFDVIVTENTFGDILSDQASVLTGSIGMLPSASIGGAVALYEPCHGSAPDIAGQQKANPLATILSAAMMLKYSFKMDQAAAAIEAAVGRVLAKGYRTPDLYVPGTQLVGTAEMGQLVRRELEEG

SEQ ID NO: 88776 - protein, 319 aa, Synechococcus sp. CC9311
MTGIGFGTWAWGNQLLWGYQPERDDPDLAATLSAAVQGGLSLVDTADSYGTGRLNGRSELLLGQFLRAMKPAQSQQLKVATKLAPFPWRLGRGGFKRAFVASKKRLGGHLDRIQLHWSTARYAPWQELPLLDGLGDLVEQGLVPELGLSNVGPKRLRFLHGHLLTRGIRLQSVQVQLSLLAPEPVLNGQLAQVCQELGVELLAYSPLALGVLAIPPGVQGTSSTVLRSRLFQRLLPASEDLRSVMVEIASQRRASMAQVALNWCRAHGACPIPGLRRPTQAHDAAKALRWSLSATERQALDQLSQRTLARMPANPFQSA

SEQ ID NO: 88777 - protein, 347 aa, Lactobacillus plantarum WCFS1
MKSTIFEKAGLVSVQEVDKPTLQSDDDVIVRIVRTCVCGSDLWSYAHGDDKAAHSINEGHEAIGIVEAIGSAITTVKPGDFVITPFTHGCGECAACLAGFDGTCDRHPGHTNWSNGFQAEYIRFTYGNWALVKIPGQPSDYTEGMLKSLLTLADVMPTGYHAARCANVQKGDKVVVIGDGAVGQCAVIAAKLRGAAQIVLMSRHEDRQQMALASGATAVVAERGDEGIAKVREILGGGADAALECVGTEAAIDQALGVLHNGGRVGYVGVPHYNNRPLGSTFAQNIAVAGGSASVTTYDKQFLLKAVLDGNINPGRVFTQTYPLADINQAYQDMQNRKTIKAMITID

SEQ ID NO: 88778 - protein, 215 aa, Triticum aestivum
LEIHPTKGNKSWSSTAVAAALELVDPPGCRNSASPRAPPSPSSSSIPMQQRRGRPSGTDGSDFSYRMVVDSRYQRVADGRSRLARLMLVQTLHQVAGGALLLLSLSKGTEINKFAVLSLAAGLLAILLGEFGRRRTVAVFLRLYTSLSSIAIAFSVTCIIRSDLFVKITKQNTAAITSYEMFDVVRVALGVLLQLVVIATTTRLLQNMSPPKRTS

SEQ ID NO: 88779 - protein, 172 aa, Moorella thermoacetica ATCC 39073
MKRTLSVLVENRPGVLTRVAGLFSRRGYNIDSLAVGRTENPAISRMTIVVDGDEQIIEQVSKQLNKLIDVIKISDITNDPYVGRELILIKVNADPSVRGEIMQIVDIFRARIVDIARNSLIIEATGDADKIDAIENSLRPFGIREVVRTGKIAMLRGAKTRGMEASGNGTGD

SEQ ID NO: 88780 - protein, 230 aa, Glycine max
  misc_feature (66)..(66): Xaa can be any naturally occurring amino acid
  misc_feature (84)..(84): Xaa can be any naturally occurring amino acid
  misc_feature (133)..(133): Xaa can be any naturally occurring amino acid
  misc_feature (185)..(185): Xaa can be any naturally occurring amino acid
  misc_feature (195)..(195): Xaa can be any naturally occurring amino acid
  misc_feature (197)..(197): Xaa can be any naturally occurring amino acid
MGRNEAAISFLTNVARTAFGLGAAATAVSSSLYTVDGGQRAVLFDRFRGILDSTVGEGTHFLIPWXQKPYIFDIRTRPHTFSSXSGTKDLQMVNLTLRVLSRPDTEKLPTIVQNLGLEYDEKVLPSIGATRSXKAVPSRKFNADQLLPRSGSQVSGPSVRDSLIRRAKDFNIRFLDGRRDYFTPXLTGGGFLPAXVXSRKQVAQQEAGRIILVVMKAEQERRAAIIRAEG

SEQ ID NO: 88781 - protein, 414 aa, Legionella pneumophila subsp. pneumophila str. Philadelphia 1
MSTNPSLMTSFDVNKIRKDFPVLHQKINEYDLVYFDNAATTQKPKAVIDAIAQFYEKDNSNVHRGVHALSVRATEMYEAARAKVKRFINARSPRECIFVRGTTEAINLVAQSLVAPRILPDEEILITHMEHHSNIVPWQMVCKKMGCKLQVAPISLNGEVILEEFERKLNENTKMVAINYASNSLGTINPVKTMIKMAHEVGAKVLLDGAQATAHLIVDVQDLDCDFYAFSGHKMYGPTGIGVLWGKEELLNSMTPYQGGGEMINSVSFEATEYAAIPHKFEAGTPNIAGAIGLAAAIDYIWSLDLDAIAEYETQLLNYATKAIEAVKGYNIIGTAANKVPIISFVHGKIHAHDIGTILDSEGIAIRSGHHCTMPLMDFYDVAATSRISMSFYNTFKEIDYCMEALQRVKEVFA

SEQ ID NO: 88782 - protein, 385 aa, Vibrio harveyi
MSKRDFYEVLGVSRDASERDIKKAYKRLAMKYHPDRNQGDESAADKFKEVKESYEILTDPQKKAAYDQYGHAAFEQGGGGFGGGGFGGGGADFGDIFGDVFGDIFGGGRRGGGQQRAQRGADLRYNMELSLEEAVRGVSKEIEVPTLVHCDTCDGSGAKKGSSAETCGTCHGHGQVQMRQGFFAVQQTCPTCHGKGKIIRPCNECHGQGRKQKTKTLNVKIPAGVDTGDRIRLSGEGERGEMGAPAGDLYVQVHVKEHHIFEREGNNLYCEVPVSFLMACSMAALGGEVEVPTLDGRVNLKVPTETRAGRMFRMRGKGVKGVRGGGVGDLIVKLVVETPVNLSARQKELLKEFDESCGGDAQLSTNQNLKGFFNGVKKFFDDLTS

SEQ ID NO: 88783 - protein, 337 aa, Zea mays
MAKIKIGINGFGRIGRLVARVALQSDDVELVAVNDPFISTDYMTYMFKYDTVHGQWKHHEVKVKDSKTLLFGEKEVAVFGCRNPEEIPWGSVGAEYVVESTGVFTDQEKAAAHLKGGAKKVVISAPSKDAPMFVVGVNEKEYKSDINIVSNASCTTNCLAPLAKVINDKFGIVEGLMTTVHAITATQKTVDGPSSKDWRGGRAASFNIIPSSTGAAKAVGKVLPVLNGKLTGMSFRVPTVDVSVVDLTVRLEKSATYDEIKAAVKAEAEGSLKGILGYVEEDLVSTDFQGDSRSSIFDAKAGIALNGNFVKLVSWYDNEWGYSTRVVDLIRHMNSTK

SEQ ID NO: 88784 - protein, 337 aa, Populus trichocarpa
MSQLTTGGTDFSLPDEILAVIPMDPYDQLDLARKITSMAIASRVSYLESERGRMKQRMFDKDRIIFELREKLGHLQRVCQESESKLSLALDENVKLSKEKDSLAMTAKKLGRDLAKLETFKRQLMQSLSDDNSSQAETVDIGTCDQSVPRAYSEKDEGMNVYVAHHNFNGSTDMGNTDEAPRHAGQRYSITPYITPRLTPSGTPKIISTSASPKGYSAAGSPQKTSGATSPTKPQYDGRASLSSWYPSSQQSSAANSPPRGHPIPGRAPRVDGKEFFRQARSRLSYEQFSAFLANIKKLNGQEQTREETLRKAEEIFGTDNKDLYFSFRGLLNRNIH

SEQ ID NO: 88785 - protein, 383 aa, Lactobacillus sakei
MAEKRDYYDVLGVGRDASDDEIKKAYRKLSKKYHPDINKAPDAEAKFKEVTEAYEALSDPQKRAAYDQYGHAGMNGGFGGGAGAGQGFGGFGGGAEGFGGFDDIFSSFFGGGARQQPNGPRQGSDLQYRMDLKFEEAVFGKETKISYSREAECHTCHGSGAKPGTSAETCHKCHGAGQIQVERQTPLGRMMSRETCDVCGGTGKEIKSKCDTCHGTGREEERHTVKVKVPAGVEDGQQMRLQGQGEAGSNGGPYGDLFIVFRVAPSDEFERDGAQIFVEVPISFVQAALGDEIEVNTVHGPVKLKIPAGTQTNTVFRLRGKGAPKLHGTGNGDQKVTVNVVTPKSLNSKQRDALKAFAVASGDSVNPQDNNLFDKILNKKHKK

SEQ ID NO: 88786 - protein, 584 aa, Streptococcus thermophilus CNRZ1066
MAFEIIMPKLGVDMQEGEIIEWKKQEGDVVNEGDILLEIMSDKTNMELEAEDSGVLLKITRQAGETVPVTEVIGYIGAEGEVVADNSTSAPAAEATAQLEAAGLEVPKAPSQPSPATAEKAALADNEYDIVVVGGGPAGYYAAIRGAQLGGKVAIVEKSEFGGTCLNKGCIPTKTYLKNAEILDGLKIAAGRGINLASTNYTIDMDKTVDFKNSVVKTLTGGVQGLLKANKVTIFNGLGQVNPDKTVTIGSETIKGRNIILATGSKVSRIDIPGIDSQLVMTSDDILDLRELPKSLAVMGGGVVGIELGLVYASYGVDVTVVEMADRIIPAMDKEVSLELQKILSKKGMKIMTSVGVSEIVEGNNQLTLKLNNGEEIVAERALLSIGRVPQLNGLENLNLELDRGRIKVNEYQETSIPGIYAPGDVNGTKMLAHAAYRMGEVAAENAMHGNVRKAHLDYTPAAVYTHPEVAMCGLTEEDARAKYGDVLIGKSSFAGNGRAIASNEAHGFVKVVADAKYHEILGVHIIGPAAAELINEAATIMENELTVDELLQSIHGHPTFSENMYEAFADVLGEAVHNPPKRK

SEQ ID NO: 88787 - protein, 241 aa, Brassica napus
  misc_feature (228)..(228): Xaa can be any naturally occurring amino acid
MELLSTIHLLALVLLPFVVPKIWKACWIFLLRPWMITRRFKKQGISGPKYRFVYGNLKEIKKMKKEAKDWVLDPNSNDIFPRVVPRYHNWLSQYGETFIYWNGTKPTLFISDPELGKQILSRKLGFAVIAKTRPEVFILFGKGLPFIEGDDWARHRRILNPAFSMDRLKVMTKRMVDCTLRMLEEWRQQRSGEEVMMRMEINKDFHRLISDIIAGTALGSSYEERIEXVKSQTELEEYLLL

SEQ ID NO: 88788 - protein, 477 aa, Bordetella parapertussis 12822
MRTITSLIDGQWAGGAGDSENINPSDLSAPVCLVAQASAQQAAQAVEAARRAQPGWAATGLAARAQILKDIGRGIVANSQQLAHILASEQGKTLPEARGEVQRAADIFDYYAGEVFRLGGEMFPSIRAGVEVEISREPLGVVALITPWNFPIAIPAWKTAPALACGNAVVLKPSEFTPATAVMLAEIIRAAGVPDGVFNLVLGTGADVGQVLTGHPAVAGVSFTGSSATGRKIAASAVAGHKKLQMEMGGKNPLVVLDDADLEIALACALDGAFHATGQRCTASSRLIVTPGIHDRFVQELAQRVMALNVGHALDERSQIGPVSNGAQFDKDLSYIALARDEAQRVIGGAALQRAQRGYYLQPCLALDVSLDARIAREEVFGPLACVLRAQDYEHALAIANDTEYGLSAGICTQSLKHATHFRRHVQSGLAMVNMPTSGVDFHVPFGGRGASSYGSSEQGHYAREFFTSLKTSYIRP

SEQ ID NO: 88789 - protein, 190 aa, Physcomitrella patens subsp. patens
MGLTFTKLFQKLFSKREMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSSNIANKIGCHDVPSVL

SEQ ID NO: 88790 - protein, 548 aa, Magnaporthe grisea 70-15
MGAEQSSNRPANGQNSNTVVRKTCYYELMGIERTATEDEIRKAYKRKALELHPDRNFNDVENATRKFAEVQTAYEILSDPQERAWYDSHRDAILSGDPDGSGAGEGAAPSQYNNIRITTAEEIYALMGRFNSSVPMNDSPNGFFAILDEFFGHLADEEAAACEWDGLEPPEYPPFGSSTDDYDAVARPFYNAWSSFATRKSFSWRDKYRLSDAPDRRVRRLMEKENKKSRDDGIRDFNDAVRSLAAFVKKRDPRYVPNTQSEAERQRVLRDSAAAQAARSRAANQEKLAAYVLPDWAQARNENEADPHEGEFSDSEDQSEVEEIECVVCAKTFKSEKQFEAHEKSKKHQKAIQQLRRQMKRENLDFDLNEDETAAEVPPASGANVVPASGKDLGDSAKKDDPPSQTAQGTKDAPETTAKPRKDGSDESSSQADSLDDEYASRDDVENRITGAAAKSKDPLNANEVEAAEAASAVEQLALDDTPGPKKMGKAKQKKQKKAARQAALEEQGASHACNICRATFPSRTKMFAHIDEEHPAPKHTKGKKSKR

SEQ ID NO: 88791 - protein, 340 aa, Glycine max
  misc_feature (153)..(153): Xaa can be any naturally occurring amino acid
  misc_feature (159)..(159): Xaa can be any naturally occurring amino acid
  misc_feature (180)..(180): Xaa can be any naturally occurring amino acid
MGKVKIGINGFGRIGRLVARVALQRDDVELVAVNDPFITTDYMTYMFKYDSVHGHWKHHDVTVKDEKTLLFGDKPVTIFGHRNPEEIPWGSTGADIIVESTGVFTDKDKAAAHLKGGAKKVIISARSKDAPMFVVGVNEHEYEPELDIMCNAXSCTTNXLAPLAKVINDRFGIVEGLMTXTVHSITATQKTVDGPSAKDWRGGRAASFNIIPSSTGAAKAVGKVLPALNGKLTGMAFRVPTVDVSVVDLTVRLEKEASYDEIKNAIKEESEGKLKGILGYTEDDVVSTDFVGDSRSSIFDAKAGIALNKNFVKLVSWYDNEWGYSSRVIDLLVFVAKKSF

SEQ ID NO: 88792 - protein, 181 aa, Physcomitrella patens subsp. patens
MGLTFTKLFTKLFSKREMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSSNIANKS

SEQ ID NO: 88793 - protein, 428 aa, Synechococcus sp. CC9311
MPSLRQKINSLAIAPLPNLLAGLVMALVLIPEAIGFAGVAGVPPELGLYGAIFLTITIAFTGSRIAMITSASGSTAVLMTGLAAQGNNFADNKGIIFLLTASMLAGLLQIIWSLLNISALMKYIPKPVVSGFVNALALLILQAELPQLGFEQLLGLERHQVTYLPTVKELPTVWALTAIGLLIIYSFPYITKKIPSQLISISVVTILAWTMRFDVPRVSDLGSLPQGIHLPEIPFLINGANNIAGLDLIWTTAPIAIAISLVGLLETFLTVDYIDTLTETTADKRSEGIGQGIANIITSLFGGMAGCALVGESVMNVKNGAKSRLSTLSTGLFIVTILIFARSILGLIPLAAVAAVMISIAVATADSDSLRRIGRLPKIDTLLMIATFLATMLTHPHNLAVGVIVGVSTSQLYGYIRRKANLRSDKSD

SEQ ID NO: 88794 - protein, 117 aa, Synechococcus sp. CC9311
MSEIKRVIRPWGWYEDLGSGQGYKLKRLLIRQGQRLSLQRHQHRSENWTVAEGSGELFCHGQWSNVLAGDTLHIPKGAIHRASGGAGDLLIIEVQHGSILEESDIERLEDDFGRVLR

SEQ ID NO: 88795 - protein, 372 aa, Candida glabrata CBS 138
MLRGSATRLTAMRGFSSTRLAQKALTIGLIPGDGIGKEVIPAGKQILEKVGPKFDLDFKFIDLHAGWETFQNTGKALPDETVEVLRRDCQGALFGAVQSPTTKVEGYSSPIVALRKAMGLFANVRPVKAVEGTNDRPVDMVIVRENTEDLYIKIEKTYTDPATGTRVAEATKRISEVATRRIATIALDIALQRLQSRGHATLTVTHKSNVLSQSDGLFREICKDVYESNKDKYGKIQYNEQIVDSMVYRMFREPECFDVVVAPNLYGDILSDGAAALVGSLGVVPSANVGPEIVIGEPCHGSAPDIAGRGIANPIATIRSTALMLEFLGYPEAAQPIYKAVDSNIRENQIKTPDLGGKSTTQQVVDDILSKI

SEQ ID NO: 88796 - protein, 295 aa, Pyrococcus furiosus DSM 3638
MDTEKLMKAGEIAKKVREKAIKLARPGMLLLELAESIEKMIMELGGKPAFPVNLSINEIAAHYTPYKGDTTVLKEGDYLKIDVGVHIDGFIADTAVTVRVGMEEDELMEAAKEALNAAISVARAGVEIKELGKAIENEIRKRGFKPIVNLSGHKIERYKLHAGISIPNIYRPHDNYVLKEGDVFAIEPFATIGAGQVIEVPPTLIYMYVRDVPVRVAQARFLLAKIKREYGTLPFAYRWLQNDMPEGQLKLALKTLEKAGAIYGYPVLKEIRNGIVAQFEHTIIVEKDSVIVTTE

SEQ ID NO: 88797 - protein, 450 aa, Erythrobacter sp. NAP1
MAVTDHVNLEQFMEGVKKRNPGQPEFVQAVHEVAQDIFEFMEDKVEYHEAQILRRIAEPDRIVSFRVCWEDDNHNIRVQRGWRVQNNNAIGPYKGGIRFHPSVTESVLKFLAFEQTFKNSLTGLPMGGGKGGANFNPKGKSDAEVMRFCQSFMTELYRHIGPDTDVPAGDIGVGGREIGYMFGQYKRITNRWEGVLTGKGQEYGGSQMRPEATGYGAVYFLQNMLKHQGKDVEGHTAVISGSGNVATHAAEKITQLGGKVLTLSDSGGFIHDPDGIDQEKIDWVKHLKTVKRGRISEYVDEFKSATFHEGRPWNIAADLALPCATQNELNEDEAKALVSNGCKGVSEGANMPTTLEGVKVFHDAKILYGPGKAANAGGVAVSGLEMSQNSERISWNHERLGEMLTDLMSGIHEKCTEYGEQDGGYVDYVKGANIAGFKKVADAMLAFGVV

SEQ ID NO: 88798 - protein, 154 aa, Staphylococcus aureus subsp. aureus MRSA252
MNFEGKLIGKELKVVIVVSRFNDFITGRLLEGAKDTLIRHDVNEDNIDVAFVPGAFEIPLVAKKLASSGNYDAVITLGCVIRGATSHFDYVCNEVAKGVSKVNDQTNVPVIFGILTTESIEQAVERAGTKAGNKGAEAAVSAIEMANLLKSIKA

SEQ ID NO: 88799 - protein, 555 aa, Glycine max
ETSTLPPIINAIEIYRVKEFPQQDTYQGDVDAITTIKSVYGVTRDWQGDPCSPKDYLWEGLNCTYPVNDSPRIITLNLSSSGLSGKIDPSILNLTMLEKLDLSNNSLNGEVPDFLSQLQYLKILNLENNNLSGSIPSTLVEKSKEGSLSLSVGQNPYLCESGQCNFEKKQKNIVTPIVASICGALILLVAVAILWTLKRRKSKEKSTALMEVNDESEISRLRSTKKDDSLAQVKKQIYSYSDVLKITNNFNTIIGKGGFGTVYLGYIDDSPVAVKVLSPSAVHGFQQFQAEVKLLIRVHHKNLTSLIGYCNEGTNKALIYEYMANGNLQEHLSGKHSKSTFLSWEDRLRIAVDAALGLEYLQNGCKPPIIHRDVKSTNILLNEHFQAKLSDFGLSKAIPTDGESLVSTVLAGTPGYLDPHCHISSRLTQKSDVYSFGVVLLEIITNQPVMERNQEKGHISRRVRSLIEKGDIRAIVDSRLEGDYDINSAWKALEIAMACVSKNPNERPIMSEIAIELKETLAIEIARAKHCDANPRHLVEAVSVNVDTEFMPLAR

SEQ ID NO: 88800 - protein, 393 aa, Staphylococcus aureus subsp. aureus MRSA252
MQFDNIDSALMALKNGETIIVVDDENRENEGDLVAVTEWMNDNTINFMAKEARGLICAPVSKDIAQRLDLVQMVDDNSDIFGTQFTVSIDHVDTTTGISAYERTLTAKKLIDPSSEAKDFNRPGHLFPLVAQDKGVLARNGHTEAAVDLAKLTGAKPAGVICEIMNDDGTMAKGQDLQKFKEKHKLKMITIDDLIEYRKKLEPEIEFKAKVKMPTDFGTFDMYGFKATYTDEEIVVLTKGAIRQHENVRLHSACLTGDIFHSQRCDCGAQLESSMKYINEHGGMIIYLPQEGRGIGLLNKLRAYELIEQGYDTVTANLALGFDEDLRDYHIAAQILKYFNIEHINLLSNNPSKFEGLKQYGIDIAERIEVIVPETVHNHDYMETKKIKMGHLI

SEQ ID NO: 88801 - protein, 488 aa, Candida glabrata CBS 138
MAETTSLINEPDVDFHLKLNQHSFNIPYEQLQRNSRYLNRLIEKEIDELNSHYERLNIALGSGNIEGDKKALQELKDIIRSVEIFEKRLQKRVNEEVPILKRLEVRINFFKELENAKQQVADITPLMEWYLKFTNILIGDYLTRHTTSNSSPELGLPGVTFLEQEGIQDLLDTDILLTGNRISTALVDNHDLRPLLDWINDSKSYLKKNGSRLEFEARFQQYIELLKASEYEEAIKCFQDYLLKFVNTNFNELTHASGLLLSINYCKEIMKAKASERSAILTKDDGNPLENEIRAYKYFFHKKPKIVEQQHVKPVDLSYMNLSQNTDFEKYMLLLDDKRWGLLNELFLKDYYSLYGISQNDPLLIYLSLGISTLKTRECLHHRRVAKSSSPLVDKKVEEEVLQNSCPVCDKTFAPIAESLPFAHHTQSQLFDDPIMLPNGNIYEAKRLKRLAKYLVDIKAIELGETEVIDPIDKQIYNEADFITMYPT

SEQ ID NO: 88802 - protein, 151 aa, Methanothermobacter thermautotrophicus str. Delta H
MGFRVLDGARIVGDVRIGDGSSVWYNAVLRGDLEPIEIGRCSNIQDNCVVHTSRGYPVRVGDCVSVGHAAVLHGCIVADNVLIGMNSTILNGAVIGENSIVGAGAVITSGKEFPPGSLIIGTPARAVRELSDEEIESIRDNARRYALLARE

SEQ ID NO: 88803 - protein, 339 aa, Corynebacterium efficiens YS-314
MIITEGVDSFVFPHRSGPRVGLCRIFHVFGAVGFDFFDTVQGVAPRCVEHEGPRGIFPILAPMKTIVITGASDGIGAAAARIISTACPEDRLVLVGRNPGKTEGVAKQLDAEWHTADYADLDQVRRLAGELAALDRIDVLANNAGGIFAGPKKTVDGFELTWQINVVAPYLLTNLLMPVLLESRASVVATSSNGALFAKFDESDPNTFKGFTSDRAYGNAKLGNILFTKELHRRYHSAGMNAVAFHPGIISSNFGQEDAGLLGRMFQSPVSRFFSTPEFGGENLAYHIAGVPGIHWESGRYYDEKRRPGRQRAIAHDLDVARRVFDDMAASLEVEWPEG

SEQ ID NO: 88804 - protein, 507 aa, Saccharomyces cerevisiae
MTKSEQQADSRHNVIDLVGNTPLIALKKLPKALGIKPQIYAKLELYNPGGSIKDRIAKSMVEEAEASGRIHPSRSTLIEPTSGNTGIGLALIGAIKGYRTIITLPEKMSNEKVSVLKALGAEIIRTPTAAAWDSPESHIGVAKKLEKEIPGAVILDQYNNMMNPEAHYFGTGREIQRQLEDLNLFDNLRAVVAGAGTGGTISGISKYLKEQNDKIQIVGADPFGSILAQPENLNKTDITDYKVEGIGYDFVPQVLDRKLIDVWYKTDDKPSFKYARQLISNEGVLVGGSSGSTFTAVVKYCEDHPELTEDDVIVAIFPDSIRSYLTKFVDDEWLKKNNLWDDDVLARFDSSKLEASTTKYADVFGNATVKDLHLKPVVSVKETAKVTDVIKILKDNGFDQLPVLTEDGKLSGLVTLSELLRKLSINNSNNDNTIKGKYLDFKKLNNFNDVSSYNENKSGKKKFIKFDENSKLSDLNRFFEKNSSAVITDGLKPIHIVTKMDLLSYLA

SEQ ID NO: 88805 - protein, 423 aa, Methanothermobacter thermautotrophicus str. Delta H
MQAVILTAGEGTRMRPLTLTRPKTMLPVAGKPILQYSVDALRDNGVHDIVMITGYHEEAVRSHFGDGSGSGVNITYVRQEERLGTAHAIGQASELIDDEFIVLNGDIITDPGLMGDLIGSYHERKPETLMVLREVPDPSSFGVVKVEGDRVREIIEKPGPDAGAGNLINTGIYVFSPAVFDYIERTPLSRRGEYEITDTIMMQVRDDLPVRAIISDRDWIDVGRPWELLEASERLMKDLEDSVEGDVEDGVTIHGPVAIGEGTIIRSGTYIQGPVYIGRNCDIGPNSYLRAHTCIGDGVSIGNAVEVKNSIIMDGTNINHLSYVGDSVIGMNCNIAAGTNIANLRFDDGPVRMVVKDDVVETGRRKLGAVFGDGVKTGINSSFNPGVKVGKDSCIGAGCVISRDVPSDRLVILRQEHTTMEYR

SEQ ID NO: 88806 - protein, 255 aa, Coxiella burnetii RSA 493
MQRRPLVAGNWKMHGSRESVGQLLRALKHGCERLETAELAVFPPFVFLQQCEEALMRTQISWGAQDVSEFERGAYTGEVSAAMLRDFHCRYVIVGHSERRQRHGETNEQVAAKVRAALRCGIRPIICVGETEKQRNANQTLSVIKEQLAVVLQMNDNLASLEGMVVAYEPIWAIGTGKNATPSQAEEVHAALRDQLHRQDATLAESTRLLYGGSVKPDNAAALFEMPNIDGALVGGASLEAEQFLKIGQQCNQSF

SEQ ID NO: 88807 - protein, 435 aa, Ustilago maydis
MLSSGAGSSIRKKRNFKGLQLAESPLASPVDASATTPSHKPGEGSAASNASTIGKSSAVTPGGSLALPVKNGLDTEPNSGANYHNKLTQQLANLELGVEYKLDLKNEDLKTLSELGAGNGGTVTKVLHEKSGTVMAKKVVFIDAKPSVRKQILRELQILHECNSPYIVSFYGAYLNEPHICMCMEFMQKDSLDGIYKKYGPISPEICGKIAVAVSHGLTYLYDVHRIIHRDVKPSNILVNGAGQIKICDFGVSGELINSIADTFVGTSTYMSPERIQGDQYSVKSDVWSLGVSIIDVALGRFPFAENEEDDDSDADNNYTNEDLAGTLSPTKPAPMISLGQNEKQRRRKSKPAGVTLEGSSHQMSILDLLQHIVNEPPPKLPEGRFPKHMEEFVNLCLLKDPAKRPTPKDLTKHQYVIDADAAKVDLQAWADGMK

SEQ ID NO: 88808 - protein, 492 aa, Xanthomonas campestris pv. vesicatoria str. 85-10
MTAKPRLNFWQIWNMCFGFLGIQFGFALQNANASRIFQTLGAQVDDVPGLWIAAPLTGLIVQPVIGYLSDRTWTPWGRRRPYFMVGAVFTTLALLVMPNAPMLWVAAGTLWVLDASINISMEPFRALVGDQLPPSQRPTGYAMQSFFIGIGAIVASFLPWLLTHWGIANTAPPGQLPDSVRYTFYLGAAVLFLSITWTVLRTREYSPEQLAGFDDAHPPLAQVASTGMAPTPMASVLWCGLGVLLATAIAWQHGDRMLYVLAGLCLAYGVLLALARMLPATSMLVAIVQDVRSMPMTMRRLAWVQFFSWFALFAMWIYTTAAVTQVHFGANDTASAAYNDGANWVGVLFGAYNGFAALAAVVIPLLVRAIGLRWGHLCNLWLGAAGLLSMLVIRDPQWLLLSMVGVGFAWASILSLPYALLSDSVPAPKMGVYMGIFNFFIVIPQLVAASALGFVLRVWLGGQPIYALAIGGLSLLIAGVCVVRVPVASGGQ

SEQ ID NO: 88809 - protein, 516 aa, Moorella thermoacetica ATCC 39073
MVSCNLLPAPYILIIKSPFGNDNSTNCKGGDNMATATQTGTQAVATGKKAGTRWAYFIIGLAVLGLFYILPVPAGMKPAAMRTLGVMATTVFWWLTETLPIPVTALMVPLMLHFTGILSLDKSVAQSFGDSFVPFLIGVLALSVAFTMSGLGKRITYLLLALSGTKVSRVIGIYFLVSFVISMFVTDVAVVAMMLPIVVGLLQSVDAKPGESNLGRGLMMAIMFGSTLGGICTPSGVASNVITMSFLTKNAKIGVSFLDWVAIATPIFVAVGIIAWWLILKIFPPEIKELPYGKDMIHKELKGMGSWSIEEITTMVVFLLAVVLWLTSSWNGLPIAFVSLLILGLLSMPGVGVFKKWSDVEKRLEWGALMLVVGGFALGLAASQSGLAQWVAQHALKPMTILPRPLQPLAVTLLVAVDSLGFSSFTAAASVNVPFIIAYAQQNALPVLSMALAAGFAASTHFILVTESPSFVLPYAYGYFSFKDLFKIGVILTIVSAGAIAIGLVLAGMPAGVPLH

SEQ ID NO: 88810 - protein, 358 aa, Moorella thermoacetica ATCC 39073
MTYMIPEKMKALVLFGPNDVRLVEKPVPKPGPGEVLVRVAACGICGTDVKIITKGMPKMPPYGEFTFGHEWAGTIVALGETVDEFQVGDRVAIEAHKGCGRCENCIDGKYTACLNYGRLDKGHRAAGMTVDGGFAEYAVQHVNSVYKIPDNITFNEATYVTTAGCALYAIDKSGGYIAGDTVLVIGPGPIGLSVVQGARSLGAEKIILMGTREDRLVKGRELGATHTINIREVADPVAEVMAITGGKGCERVFECAGNSQSFEYGIKAAKKGGVMVLVSFYKEPVMANLDYVVLNQISLLTVRGEGNQNCKRALSLMAQGKIDAKPIMTHAFPLEEFQKGLDYFVNRKDGAMKVVINP

SEQ ID NO: 88811 - protein, 461 aa, Shigella flexneri 2a str. 2457T
MAINSPLNIAAQPGKTRLRKSLKLWQVVMMGLAYLTPMTVFDTFGIVSGISDGHVPASYLLALAGVLFTAISYGKLVRQFPEAGSAYTYAQKSINPHVGFMVGWSSLLDYLFLPMINVLLAKIYLSALFPEVPPWVWVVTFVAILTAANLKSVNLVANFNTLFVLVQISIMVVFIFLVVQGLHKGEGVGTVWSLQPFISENAHLIPIITGATIVCFSFLGFDAVTTLSEETPDAARVIPKAIFLTAVYGGVIFIAASFFMQLFFPDISRFKDPDAALPEIALYVGGKLFQSIFLCTTFVNTLASGLASHASVSRLLYVMGRDNVFPERVFGYVHPKWRTPALNVIMVGIVALSALFFDLVTATALINFGALVAFTFVNLSVFNHFWRRKGMNKSWKDHFHYLLMPLVGALTVGVLWVNLESTSLTLGLVWASLGGAYLWYLIRRYRKVPLYEGDRTPVSET

SEQ ID NO: 88812 - protein, 472 aa, Shigella flexneri 2a str. 2457T
METNIVEVENFVQQSEERRGSAFTQEVKRYLERYPNTQYVDVLLTDLNGCFRGKRIPVSSLKKLEKGCYFPASVFAMDILGNVVEEAGLGQEMGEPDRTCVPVLGSLTPSAADPEFIGQMLLTMVDEDGAPFDVEPRNVLNRLWQQLRQRGLFPVVAVELEFYLLDRQRDAEGDLQPPCAPGTDDRNTQSQVYSVDNLNHFADVLNDIDELAQLQLIPADGAVAEASPGQFEINLYHTDNVLEACDDALALKRLVRLMAEKHKMHATFMAKPYEEHAGSGMHIHISMQNNRGENVLSDTEGEDSPLLKKMLAGMIDLMPSSMALLAPNVNSYRRFQPGMYVPTQASWGHNNRTVALRIPCGDRHNHRVEYHVAGADANPYLVMAAIFAGILHGLDNELPLQEEVEGNGLEQEGLPFPIRQSDALGEFIENDHLRRYLGERFCHVYHACKNDELLQFERLITETEIEWMLKNA

SEQ ID NO: 88813 - protein, 128 aa, Brassica napus
  misc_feature (125)..(125): Xaa can be any naturally occurring amino acid
MSAYCGKYKDELIKNAAYIGTPGKGILAADESTGTIGKRLSSINVENVEENRRALRELLFCCPGALQYISGVILFEETLYQKTKDGKPFVDVLKEGGVLPGIKVDKGTIEVVGTDKETTTQGHDXLGK

SEQ ID NO: 88814 - protein, 633 aa, Zea mays
MLELEEGPGRTPSGYGGGVGRDAKGERSEEDKEGPRPTQCTTQGIVSGGGGGGPAETPRPGAVCRLEGEMKATLKGRYEGDKATAATTLAAPAGDLRLKASATEAAFTNGPSLRGLTLTLEKPGAFLVDLKPHNQDVRFQFMNSALVLDKRVSLTYTHSTSLAAAPAAAPPSRTALDCTVTFDPANKVSLSHSLGSGGCRLKYTYAHGVDRLTTIEPLFDTNKNAWEFAITRKFAGGDAVKGTYQASTKLLGLEWSRDSLAGGSFQDRRPAAAATEEKSLTHGHGWTTISSSSSNTTNSHMDAKPRNLGGSLPTPTATRASSVPVVDLARLLDPSSHGDEESAKLKAACEEWGFFQVINHGVPDAVVADVKADLQAFFRLPLADKRAVAQEPGGIEGYGQAFVVSEDQKLDWADMLFLSTQPPEYRAPRFWPARPATFGDSLARYSAEVQRVAARLLASMAANLGVADAARLARVADAQAVRVNYYPACPHGRGRVLGLSPHSDAAGLTLLLQVSAVPGLQIRRRGAWISVDPIPGALVANVGDVVEVLTNGRYKSIEHRALVSPTHHRVSVAAFHSARFGDTYAPLEETIVDGDEPARYRSIGVEDYVRLVLSSKLQGKNIMDAMKINPVTE

SEQ ID NO: 88815 - protein, 861 aa, Ralstonia metallidurans CH34
MTGRGTWEETCRGNSAGDSAGKAHRHGAYCTETQRCPKQKAYCEILFHNIKCTLPKAPTAETAGSWSRPALNRQRYSVRLHRSEDAQMTSPQQSPSQDDLKQQQREALRKAALEYHEFPTPGKISVTPTKPLSNQRDLALAYSPGVAAACEEIVANQANSFRYTARGNLVAVITNGTAVLGLGDIGAAASKPVMEGKAGLFKKFAGIDVFDIEVDEKDPEKLVDIIASLEPTFGGINLEDIKAPECFYVERKLRERMKIPVFHDDQHGTAIVVGAAVINGMQVVGKDISKVKLVASGAGAAALACLDLLVDLGLPIENIWVTDLAGVVYEGRTELMDPEKARFSQKTDKRKLAEVIEGADIFLGLSAAGVLKPEMVQKMADKPLVMALANPNPEIMPELVKEVRPDAVIATGRTDYPNQVNNVLCFPFIFRGALDCGATTITREMEIAAANAVAELARQEQSDIVASAYGIQDLSFGPEYLIPKPFDPRLIVKIAPAVAEAAAKSGVASRPIEDMDAYRLQLQQFVYHSGTLMKPIYAAARKVQKEKKRIVFAEGEEERVLRAVQVIVDEKLANPILIGRPAVLAHRIERFGLRLRMGEDFTVVNPEHDERFREYSDAYYRMMAREGITPQYAKLEMRRRTTLIGAMLVEKGEADGMICGTVSTTAAHLRYIDQVIGGTNCVYAAMNGLVLPGRQIFLVDTHVNVDPTAEQLAEITIMAAEELKRFGIEPKVGLLSHSNFGTSEAPSARKMRDTLKILRDRAPDLEVDGEMHGDSALDEKLRDSLVPDSALKGEANLLVCPNIDAANISYNLLKVAAGNNVAIGPILLGVKAPVHILTPSATVRRIVNMTALVVVDAAAKV

SEQ ID NO: 88816 - protein, 506 aa, Zea mays
MVAMAAPGRVALLAAALLFGAFFPSAFATSSYPARLAGRLLSTTASAVAKQLWSLKSAATKTATASVAGRSMVRYEGGYAVDTVFDGSKLGIEPHAAQINRAGDLLLLDSINSNIYRVQLPLSPYSRPKLLAGSPEGLSGHVDGRLREARMNHPKGFTVDDRGNIYVADAMNMAIRKISDTGVTTIAGGKSIRGGYIDEPSVSDDAKFSTDFEVQYISSTCSLLVIDRGNQAIREIPLNDDDCAYQYEAGFPLGFALLCAAGFFGYMLALLQHRLLGMPSTINKPQAPPRPSIASIPPYQKPLNPYVRQPFIPREETARQEPEEGFFTSAGKLVGGAKSSVAEVFGFKKKSLSNPYHQQQRRANPWPVQESYAIPHDEPPPALDTRAPAPQKNYSSEKIHYVRHGHPYFNSWDGHRLPQQQPDQQLYHQQQQQHLQQHRQCSAGPQTFYEQSCEATNEVVFGAVQEVDSKRRMVEIKAVNYGDTFYEQYGMRYRNNFIGYNNTNNY

SEQ ID NO: 88817 - protein, 480 aa, Arabidopsis thaliana
MEESKPGPLLTTQSARCMDCGTPFCHQENSGCPLGNKIPEFNELVYQNRWQEALNRLLETNNFPEFTGRVCPAPCEGSCVLGIIENPVSIKSIECAIIDKAFEEGWMVPRPPLKRTGKKVAIIGSGPAGLAAADQLNKMGHLVTVYERSDRIGGLMMYGVPNMKTDKIDVVQRRVDLMTKEGINFVVNANIGKDPSYSLDGLKEENDAIVLAVGSTKPRDLPVPGRDLSGVHFAMEFLHANTKSLLDSNHEDGNYISAKGKKVVVIGGGDTGTDCIGTSIRHGCTNIVNLELLPQPPSTRAPGNPWPQWPRVFRIDYGHQEATTKFGKDPRTYEVLTKRFIGDDNGNVKGLELVRVSWEKDETGRFQFKEIEGSEEIIEADLVFLAMGFLGPEPTLAEKLGLECDNRSNFKAEYGRFSTTVEGVFAAGDCRRGQSLVVWAISEGRQAADQVDKFLTKTDDDEDAKLQQDLNQMKHNTITN

SEQ ID NO: 88818 - protein, 234 aa, Helicobacter hepaticus ATCC 51449
MTLWGIIKEDFSIIKQKDPALNSSVELFFNYPGLIALVHYRIAHRFYKAGFKILARILMGLTGFITNVDIHPAAIIGRRVFIDHATGVVIGETAEVGNDVMIYQGVTLGGTSLDKVKRHPTIEDGVVIGAGAKILGNIRIGANAKIGANSVVIKDVPQDCTAVGIPARVIVKGRAQGINAINKLPDIDRALFEYLFKRIQILESTQDEQNCTKLKAELQSLDEIYAHFLQSLKG

SEQ ID NO: 88819 - protein, 457 aa, Alteromonadales bacterium TW-7
MQVALVGLGVMGKNLALNLIDKGITLVAYDKNPHAGEELISCAKSQGMADKLHIVSDLGDMVRRLEAPRSILLLVPAGELVDTVCNELVNAGVECDDIIVDCGNSNYKDGITRKLKYQNKFEFATMGISGGAEGARHGPAMMASGSEGGWERIEPWFEKVAASYNGSSCFARVGQSASGHFVKMVHNGIEYALMQLIAEMYQLLRSGTNRSPKEVAAIFDEWSQGQLNSYLLSISSHILTLENDKNVPLVDLIDNKVGAKGTGLWTAQNALELGIAVPSLVAAVQARHLTNACDTTAAQEMTYASKSTNIVDIDLDELKDAFTLASLLAYRQGLALIKGASRTHQWKVDLSKTLQTWRAGCIIRADYLDSVAQGVEFIDSLDKEANALRKITGQAVMSGLAFPVLSSTQTYLATLTTPSNGHLVQAQRDYFGEHGIKTHSGETCHLTDLVEIDAKVR

SEQ ID NO: 88820 - protein, 276 aa, Triticum aestivum
  misc_feature (153)..(153): Xaa can be any naturally occurring amino acid
MGGGVMRTAAAAPLLSAAGEIPPVAPAGSQWASWEVDDWEFADWRSESASEADVAVVGGPRLVFAPPSREEAEEATAELREAIDRVYFKETPVEVVKEHDQELSKLGADALISAMPGHVGQAFTLLKSSPDCGEQAQSVVASLASDKNVWDAXVLKNERVMEFYKSHQQTLVNTFPEGTDSTDSVESPEKFEEASPEYALPTASPLSDFVDNAKKTMMEMVDNITNFFQDLFHNPAEAEAGPGSSSKKPSFPEMAAGGSFMALAMAVILVVLFKRA

SEQ ID NO: 88821 - protein, 299 aa, Bacillus cereus ATCC 10987
MKTINVFHYDAFTNKPNMGNPAGIVLEADGLTEEEMQIIAEKVGYNETTFVLSSEVGDIRMRYFTPGFEMDLCGHGTVGTLYALREKGLLEEKSNLTIETKAGILPIQIGVNENGETFIKMRQAAPQFKEFTGSKEELAHSIGLEVNDLDVSLPIVYGSTGNWTVIVPIKNLDACERMNPNNAAFPSVLKEIPNASIHPICLETYDEQAQMHGRHFSSAYAGTIEDPVTGTASGVMGAYYAMYLEKDFDHEMELIVEQGQEINKDGRVTVYVTKDVENEKLQIDIAGTAVYVKEFEVSI

SEQ ID NO: 88822 - protein, 478 aa, Alteromonadales bacterium TW-7
MLRRTKIVATLGPATDRDNNLEKIIRAGANVVRLNFSHGVAQDHKDRAQAVRDIAKRLNKHIAILADLQGPKIRVSTFKEGKVTLEVGAKFILDAKMEKGQGDVNAVGIDYKELPQDVSPNDLLLLNDGLIQLTVDKVVDHLVHCTVTVGGVLSNNKGINRLGGGLTAPAFTDKDKEDLITAAEIDVDYIAVSFPRSGDDMRYVRSLAEAAGSKAQLLAKIERAEAVETQEAIDDIVLASDAVMVARGDLGVEIGDAALMGKQKLIIRRARSLNRTVVTATQMMESMIDNPMPTRAEVMDVANAVLDGTDAVMLSAETAAGDYPEETVATMARVCLGAESQKETHVSKHRLDSRFSNNAESIALSAMYAANHLDSVKAIVTLTESGSTAKLMSRISSGLPIYSLSRHASTLGQTALYRGVYPVFFDSTQTEKDAMVKAALDTLVAQGSLASGDTVILTHGDSMETVGATNTMKIVTVE

SEQ ID NO: 88823 - protein, 636 aa, Prosthecochloris aestuarii DSM 271
MHDGGFFFQAFVYLTAAVVSVPLAKKLGLGSVLGYLIAGVVIGPFVFGFIGEEGQNVMEFAEFGIIMMLFLIGLELQPQMIWKLKGPILGMGGLQVTVTALLVLAGALLFGLEWKTGLALGLVLALSSTAIVLQTLHEKGLMKTDGGQNSFSVLLFQDIAIIPILAVLPLLAAGHSAGETFHAGDAHHGPVTWVEGLPLWGQTVTVLGVVSGIVVAGKYLINPAFRLIARTRLRELFTAAALLLVIAITILMGKVGLSPALGTFLAGVILAQSEYRHELETNIDPFKGLLLGLFFIAVGASIDFHVIGENPLLILQLVVALMVLKFLVLALIGKVFRMSYDNILLFAFALAQGGEFAFVLFSFGLNNNVFEPSLVNPMIAVVAITMALTPLLLLLNEKLIQPRFGTKEKAAPEERSSSSIDESSRVIIAGFGRVGSTVGRFMQANDENATYLDMDPDNVDLLRKLGLNVFYGDASRYDLLHAAGAAEAQLLIIAVDDPEKTVAIARTAMKHFPHLEIIARTNGLVDSHELIDLGVKRVYPETLDSSLRIGVDALSLLGHRRYQAIRSMHTFRHHEERHFHELAALRHDRKELIRETKKRIEDLEELMLTEKREEHKDKELGWDAAGHMSDKGHMPG

SEQ ID NO: 88824 - protein, 281 aa, Brassica napus
MGAGTVVRDRVRKDLSEISNKTTKPIVSASPEIRSNSRKKIQRRSKKAVISPVQKLFETCKKVFANGKSGAVPSQEHINMLRAVLDEIKPEDVDVSSKMPCFRSKSNGRPPVTYLHIYKCHSFSMGIFCLPPSGVIPLHNHPEMTVFSKLLFGTMHIKSYDWVADSPQPSSDTRLAKVKVDSDFTAPCDTSILYPADGGNMHCFTAKTACAVLDVLGPPYSDPAGRHCTYYFDHPFSSFSVDGVEVGEEEKHKYEWLKEREEEPEDLTVMAMMYSGPIIKE

SEQ ID NO: 88825 - protein, 171 aa, Physcomitrella patens subsp. patens
MVNPRVFFDVTIGGNPAGRIEMELFADTTPKTAENFRALCTGEKGKNRLGKPLHYKGSKFHRVIPQFMCQGGDFTRGNGTGGESIWGEKFDDENFIKKHTGPGVLSMANAGKNTNGSQFFLCTVATPWLDGKHVVFGQVTKGMNVVSEIEKQGSSNGTPKNVVEIADCGQL

SEQ ID NO: 88826 - protein, 486 aa, Streptomyces coelicolor A3(2)
MSGRTPAADRSLETGVAHMHGGRDVANDASTVFDLVILGGGSGGYAAALRGAQLGLDVALIEKNKLGGTCLHNGCIPTKALLHAGEVADQSRESEQFGVKTSFEGVDMAGVHKYKDEVIAGLYKGLQGLVASRKITYIEGEGRLSSPTSVDVNGQRVQGRHVLLATGSVPKTLPGLEIDGNRIISSDHALTLDRVPKSAIVLGGGVIGVEFASAWKSFGSEVTVIEGLKHLVPVEDENSSKLLERAFRKRGIKFNLGTFFQKAEYTQDGVKVTLADGKEFEAEVLLVAIGRGPVSQGLGYEENGVATDRGFVLVDEYMRTNVPTISAVGDLVPTLQLAHVGFAEGILVAERLAGLKTVPVDYDGVPRVTYCHPEVASVGLTEARAKEVYGADKVVSIKFPLGGNGKSRILKTAGEIKLVQVKDGAVVGVHMVGDRMGEQVGEAQLIYNWEALPAEVAQLIHAHPTQNEALGEAHLALAGKPLHMHD

SEQ ID NO: 88827 - protein, 590 aa, Streptomyces coelicolor A3(2)
MAVSVTLPALGESVTEGTVTRWLKAEGERVEADEPLLEVSTDKVDTEIPAPASGVLSSIKVAEDETVEVGAELALIDDGSGAPAAAPAPQAEQVAEPAPEPAPAAPSTEQAAPAPAPTADAAAGGSAQGTDVVLPALGESVTEGTVTRWLKSVGDSVEEDEPLLEVSTDKVDTEIPAPASGTLLEIVVGEDETAEVGAKLAVIGAAGAAPAAAPAAPAAPAQEAPAAPAQPEPTPAPAPAQAAPAPAPQAPAAPAPQPAAPAPAPAPAAAPAAPAAAQPVDDGAYVTPLVRKLAAENGVDLSTVKGTGVGGRIRKQDVAAAAEAAKAAAPAPAAAPAAPAAKKAPVLEASPLRGQTVKMPRIRKVIGDNMVKALHEQAQLSSVVEVDVTRLMKLRARAKDAFAAREGVKLSPMPFFVKAAAQALKAHAPVNAKINEAEGTITYFDTENIGIAVDSEKGLMTPVIKNAGDLNLAGIAKATADLAGKVRASKISPDELAGATFTISNTGSRGALFDTIIVPPGQVAILGIGATVKRPAVIETEDGPVIGVRDMTYLTLSYDHRLVDGADAARYLTAVKAILEAGEFEVELGL

SEQ ID NO: 88828 - protein, 645 aa, Arabidopsis thaliana
MAILSVFLSLLLLSLPLPSTQDLNADRTALLSLRSAVGGRTFRWNIKQTSPCNWAGVKCESNRVTALRLPGVALSGDIPEGIFGNLTQLRTLSLRLNALSGSLPKDLSTSSNLRHLYLQGNRFSGEIPEVLFSLSHLVRLNLASNSFTGEISSGFTNLTKLKTLFLENNQLSGSIPDLDLPLVQFNVSNNSLNGSIPKNLQRFESDSFLQTSLCGKPLKLCPDEETVPSQPTSGGNRTPPSVEGSEEKKKKNKLSGGAIAGIVIGCVVGFALIVLILMVLCRKKSNKRSRAVDISTIKQQEPEIPGDKEAVDNGNVYSVSAAAAAAMTGNGKASEGNGPATKKLVFFGNATKVFDLEDLLRASAEVLGKGTFGTAYKAVLDAVTVVAVKRLKDVMMADKEFKEKIELVGAMDHENLVPLRAYYFSRDEKLLVYDFMPMGSLSALLHGNRGAGRSPLNWDVRSRIAIGAARGLNYLHSQGTSTSHGNIKSSNILLTKSHDAKVSDFGLAQLVGSSATNPNRATGYRAPEVTDPKRVSQKGDVYSFGVVLLELITGKAPSNSVMNEEGVDLPRWVKSVARDEWRREVFDSELLSLATDEEEMMAEMVQLGLECTSQHPDQRPEMSEVVRKMENLRPYSGSDQVNEAD

SEQ ID NO: 88829 - protein, 393 aa, Mesorhizobium loti MAFF303099
MMRYPEHADPVITLTAGPVNAYPEVLRGLGRTVLYDYDPAFQLLYEKVVDKAQKAMRLSNKPVILHGEPVLGLEAAAASLISPDDVVLNLASGVYGKGFGYWAKRYSPHLLEIEVPYNEAIDPQAVADMLKAHPEITVVSVCHHDTPSGTINPIDAIGALVSAHGAYLIVDAVSSFGGMKTHPEDCKADIYVTGPNKCLGAPPGLTMMGVSERAWAKMKANPLAPRASMLSIVDWENAWSRDKPFPFTPSVSEINGLDVALDLYLNEGPEAVWARHALTAKAMRAGVTAMGLSVWAASDSIASPTTTAVRTPDGVDEKALRQAARARYGVVFSSGRGETLGKLTRIGHMGPTAQPIYAIAALTALGGAMNAAGRKLAIGKGIEAALAVIDADA

SEQ ID NO: 88830 - protein, 495 aa, Shigella flexneri 2a str. 2457T
MNFHHLAYWQDKALSLAIENRLFINGEYTAAAENETFETVEPVTQAPLAKIARGKSVDIDRAVSAARGVFERGDWSLSSPAKRKAVLNKLADLMEAHAEELALLETLDTGKPIRHSLRDDIPGAARAIRWYAEAIDKVYGEVATTSSHELAMIVREPVGVIAAIVPWNFPLLLTCWKLGPALAAGNSVILKPSEKSPLSAIRLAGLAKEAGLPDGVLNVVTGFGHEAGQALSRHNDIDAIAFTGSTRTGKQLLKDAGDSNMKRVWLEAGGKSANIVFADCPDLQKAASATAAGIFYNQGQVRIAGTRLLLEESIADEFLALLKQQAQNWQPGHPLDPATTMGTLIDSAHADSVHTFIREGEGKGQLLLDGRNAGLAAAIGPTIFVDVDPNASLSREEIFGPVLVVTRFTSEDQALQLANDSQYGLGAAVWTRDLSRAHRMSRRLKAGSVFVNNYNDGDMTVPFGGYKQSGNGRDKSLHALEKFTELKTIWISLEA

SEQ ID NO: 88831 - protein, 941 aa, Oryza sativa Indica Group
MFRRLLLPLRCCLSTSTSSSATPTLYSSGTTPVSILSWGRGASGQLGGGKEERRLYPSPVAHLSLPDPAPVLSPTPGRLPDAAAAGTAAGAVEVGISCGLFHSAVVVDGGAWVWGKGDGGRLGLGDESSAFVPRHNPNLSELRVLALGGIHSAALTASGEVFTWGYGGFGALGHYVYHRELLPRKVNGPWEGKISHIATSGAHTAAITDSGELYTWGRDEGDGRLGLGSGGGPGEAGSLSVPSKVNPLPVSVAAVACGGFFTMALTSDGQLWSWGANSNFELGRGSNSSDWRPQLIPSLKNLHVIQVACGGYHSLALTDEGVVLSWGHGGHGQLGHPTLQNHRVPLAIKALSEERIVYIACGGSTSAAITEKGDLYMWGNARDCQLGVPGLPEIQPLPLMLSFARTSFGGQTAHLPKSKSSGYKHFVSISSGLPCFLAIRRQSPGYSSVHTASFSSQHNQLSTDRSGTVMAERELIDKDKLVLRGLQFHGFHGVKQEEKTLGQKFVVDVDAWMDLSAAGETDSISDTVSYTDIYRIAKDVVEGPSRNLLEAVAHRIASATLLKFPQISAVRVKVGKPHVACLFASTLSDFEDHRFTQQKLQACKPILIPQTVILVLVFVGLIFIPIGLACIAASNKVVELVDRYDTKCVPRNMLRNKVAFIQNSSIDKTCTRVFKVPKDMKKPIYIYYQLDKFYQNHRRYVKSLNDMQLRNPKKVADTQYCSPEATANGRPIVPCGLIAWSLFNDTYSFTRGHGNETLIVNKDGISWKSERNRRFGKNVYPKNFQNGTLIGGGQLNPSKPLSEQEDLIVWMRIAALPTFRKLYGRIDMDLQAGDRVEVTMQNNYNSYSFNGKKSLVLSTAGWLGGKNAFLGRAYAIVGLACFLLALLLALLYFVFPMSVSATAELKPSVLHPLHEMLFMDSYVGERSICRCTTLLLDLYDD

SEQ ID NO: 88832 - protein, 416 aa, Actinosynnema pretiosum subsp. auranticum
MAAPAGDSLVALLFLDLAVVLALGALLGALARRLGQPSVVGEVAAGIALGPSLLGLLPGDPVALLFPPEARPPLAFAAQLGLVLFMFLVGCELDVAELRGAGRVVGAVSAGSVVLPFCLGLGVAALLWPQGGDALALFTAAALSITAFPVLARILAERRMQRTRSGVVALASAAVNDVVAWCALAVVAGIVTARGPWSAVATLAWTAALVLVAVLLVRPLVGWVARTVGGSPRADAVLFAVVVQGLLLFALATTAIGLHAVFGAFLFGAVVPKDALREAAPTLVDRVGGLSSLLLPVFFVVAGLSVDVGGLGWSGAAEALLVLVAACVGKLVGAAGGGLLAGLPARDAAEVGVLMNARGLTELVVLGVGLELGVLDGRLFTVLVVMALVTTAATGPLLTLIARRSGREVAALEGLR

SEQ ID NO: 88833 - protein, 658 aa, Oryza sativa Indica Group
MEKAAGFLSSLLGGGGGEEVPQEPAATVRSILIYPIKSCRGISVPQAPITSTGFRWDRQWVVVNSKGRAYTQRVEPKLALVEVEMPPEAFAEEWRPTVDSYLGILAFSLYYLIIYYHFFVRAPGMEPLKIPLSAEQAIIDDVSVWEWSGAAYDEGAEAAEWFSSYFGNPSRLVRFKEASEIRPTNPDYAQGYKIMFTDCFPFLMASQGSLDALNEVLKEPVPMNRFRPNILVDGCHPYSEDLWKTIKINKLTFQGVKLCNRCKVPTINQENGILGTEPTETLLTFRSDEVLRPSHKNKRQVYFGQNLVCKESLSAKGKGRIIKWLVMNSAGRGFTQRVEPKLALIELEMPQEAFTEEWQPTPDSHMGISQFHHLFTINDAQSRNVMPFFFHVRVGVLRISFLSEPLLIAVIRAPGLDPLKIPLGAKRATVDDVSVWEWSGSAYDEGDEAAEWFSSCFGKPTRLVRFNEASEIRETNPDYAQGYKVLFADAFPFLLASQGSVDALNSILKEPVPMNRFRPNIIVEGCHPYSEDLWKTIKIDKLTFLGVKLCDRCKVPTINQDNGIPGEEPTEALQALRSDEVLRPSHKNKRRVYFGQNLVCKESLSAKDEGRIIKMKFQHEQGGHSGNCSEVSNRSIYARMDENLTLQIRLEKVCYMPE

SEQ ID NO: 88834 - protein, 421 aa, Shigella flexneri 2a str. 2457T
MSNNEFHQRRLSATPRGVGVMCNFFAQSAENATLKDVEGNEYIDFAAGIAVLNTGHRHPDLVAAVEQQLQQFTHTAYQIVPYESYVTLAEKINTLAPVSGQAKTAFFTTGAEAVENAVKIARAHTGRPGVIAFSGGFHGRTYMTMALTGKVAPYKIGFGPFPGSVYHVPYPSDLHGISTQDSLDAIERLFKSDIEAKQVAAIIFEPVQGECGFNVAPKELVAAIRRLCDEHGIVMIADEVQSGFARTGKLFAMDHYADKPDLMTMAKSLAGGMPLSGVVGNANIMDAPAPGGLGGTYAGNPLAVAAAHAVLNIIDKESLCERANQLGQRLKNTLIDAKESVPAIAAVRGLGSMIAAEFNDPQTGEPSAAIAQKIQQRALAQGLLLLTCGAYGNVIRFLYPLTIPDAQFDAAMKILQDALSD

SEQ ID NO: 88835 - protein, 232 aa, Halobacterium sp. NRC-1
MSHEAVFVDLDNTLYPYQPCNEAGQQAAWETATDRGYDVSRAAFESLYSRARAAVKREVSETASAHDRGLYFKRAIELQAGTPNAADALALADAYWDAYIDALSLFDGVRETLDRLRDAGLDVAVVTNLTTRVQLRKLAATGLADRVDCVLTSQEVGREKPASVMFTVPLARLGVAPADAVMVGDSVASDVVGANGVGLTSVLCNNDRTGLTGRESPDHRIESFRDVTDVVL

SEQ ID NO: 88836 - protein, 348 aa, Actinosynnema pretiosum subsp. auranticum
MTLTDDEHTAHRHDEGAAAFQALATAAAGWGALRAAVELRLPDLLPDAPTAVPDLAALAGVAPTRLAQLVAVLADVGVLALDERAHVRHTPLSRALRSTDGLALTRLLTAGWADEAWRGLAEGVRTDTSPLELVHGRPLFDLLAADPAAAAVFHDAVATGPGDPFDEAIRSALDLTGAARVVDVGGGRGRLLAALLREHPVLSGVLFDLPEAVRDAVPELRGDDRVQIRAGDLFADRVGAADVYVLRTVLHVLDDAQAVRALANVRADAPAHARVVVVEALSDDEANRTYAAHSSLRLFVLCGGRERSTAEFAELFDRAGLELRSVTPTGTPYHLLEGAPRLSPRTDG

SEQ ID NO: 88837 - protein, 387 aa, Methanothermobacter thermautotrophicus str. Delta H
MEMDETLLMIPGPTRVAQRVLKAMSENIVNHRSALFGRILTETTEMMSDVFRTSNKSYLLTGSGTAAMEAAVANIIEPGDKILNVVGGKFGQRFAQIVEAFGGESITIDVEWGKAVNPDDIGYTLEENDDIKAVTVVHNETSTGVANPIREIGKIMDDYDALYIVDTVSSLGGDEVDVESYGIDICVTGSQKCLAAPPGMAAITLSNDAWRVIEAVDNPRTYYLNLKKYRKSGDAEPPETPYTPAVSLIYAMHEALKVIMEEGLSNRIKRHKIAAEATRNAVKALDLELFPDEAVSSTTVTAVNLPEGVTDGELRGTMRNKYHVELAGGQDHLKGRIFRIGHMGNITHRELITTFSALEMTLRELGFEVEMGEAVAAVADTYLPEDL

SEQ ID NO: 88838 - protein, 106 aa, Cicer arietinum
TEDRVGLLSDITRIFRENSLCIKRAEISTENGKAKDTFYVTDVTGSPVDPKIIDSIRRQIGDTVLQVKHNSSLSPKPPQGTKIGFLLGSFFKARSFQNFKLIRSYS

SEQ ID NO: 88839 - protein, 428 aa, Corynebacterium efficiens YS-314
MNERCARVALVVQKYGGSSLESAERIRNVAERIVATKKAGNDVVVVCSAMGDTTDELLDLAAAVNPVPPAREMDMLLTAGERISNALVAMAIESLGAEAQSFTGSQAGVLTTERHGNARIVDVTPGRVREALDEGKICIVAGFQGVNKETRDVTTLGRGGSDTTAVALAAALGADVCEIYSDVDGVYTADPRIVPNAQKLERLSFEEMLELAAVGSKILVLRSVEYARAFNVPMRVRSSYSNDPGTLIAGSMEDIPMEEAVLTGVATDKSEAKVTVLGIPDKPGEAAKVFRALADAEINIDMVLQNVSSVEDGTTDITFTCPRSDGPRAMELLKKMQQQGDWTNVLYDDQVGKVSLVGAGMKSHPGVTAEFMEALRDVNVNVELISTSEIRISVLIREDDLDKSAKALHEKFQLGGDEEATVYAGTGR

SEQ ID NO: 88840 - protein, 570 aa, Vitis vinifera
MLRVLGRRASTSHQWRNPVSLLQKCQFCIGVLPDGVDRQSPSFSQNSAIMNDYISQLKSHVQKVLGGGGAESVRRNRSRNKLLPRERIDRLLDPGSSFLELSQLAGHELYEEPLPSAGIITGIGPVHGRLCMFVANDPTVKGGTYYPITIKKHLRAQEIAAQCKLPCIYLVDSGGAYLPKQADVFPDRDNFGRIFYNEAQMSAEGIPQIALVLGSCTAGGAYIPAMADESVMVKGNGTIFLAGPPLVKAATGEEVSAEDLGGATVHCKTSGVSDYFAQDELHGLAIGRNIIKNFHMAGKLGIVNELQNIIPEFKEPVYDVKELRSIAPADHKQSFDIRSVIARIVDGSEFDEFKKLYGTTLVTGFARIFGQPVGIIGNNGILFNESALKGAHFIEICTQRNIPLVFLQNITGFMVGSRSEANGIAKSGAKMVMAVSCAKVPKITIIVGGSFGAGNYAMCGRAYSPNFMFLWPNARISVMGGAQAAGVLSQIERGNKKKQGIQWPKEEEEAFKAKVVEAYEKEGSSYYSTARLWDDGIIDPADTRKIIGLCISATTTNHAPEDTKYGVFRM

SEQ ID NO: 88841 - protein, 392 aa, Erythrobacter sp. SD-21
MALSAFSHAQPKGATGVIVFADGTCIWGKGFGASGSAVGEVCFNTAITGYQEVMTDPSYDSQIVTFTFPHIGNVGANEEDVESRGLGAVGLVVRQDVTRHSNFRARDEFVEWCVRHGKIGLSGVDTRALTRRIRMQGAPNAVIAHNPRGRFDMKALKKQAAEWSGLEGLDLVPGVTRDAHEEWKGGYWQLGTGHSEANNTSPHVVAIDYGAKDNIFRNLVKAGAKVTVVPARTSLEDVLALQPDGVFLSNGPGDPAATGEYAVPVIKGLLDRDIPLFGICLGHQMLALAAGAKTAKMFQGHRGANHPVQRVGEGWGESTGLVEITSMNHGFAVDGKTLPDIVEQTHVSLFDGTNCGISIRGKKAFGVQYHPEASPGPQDSFYLFEKFVGMLG

SEQ ID NO: 88842 - protein, 518 aa, Alteromonadales bacterium TW-7
MFNLLSRAPSSAKNDILSGLTVALALVPEAVAFAFVANVEPLVGLYAAFIVGLITAIFGGRPGMISGATGALAVVMVSLVLDHGVEYLFATVLLMGILQILAGIFKLGKFIRMVPHPVMLGFVNGLAIVIFLAQLGQFKVPDGMGGQQWMTGEPLFIMLGLVALTMGIIHFLPKLTTAIPSSLVAIVTVTGLVIGLDLEAHTVLDFLKGMTGDEAATIAGGLPEFHIPMVPFNLDTLQIIFPYALILAAIGLIESLLTLSLIDEITETRGHSNKECIGQGAANITCGFFGAMGGCAMIGQSMININSGGRSRLSGISAALMLLAFIIFASSLIEMIPLAALVGVMFMVVLGTFEWASFKMMKRVPLSDAFVIVLVSGVTVITDLAIAVCVGVIVSALVFAWQHAKHIYTTNYIDEEGSKVYELHGPLFFGSVKNFSELFDVKNDPENVIVEFKHSRVSDHSAIEAIDALADKYTKAGKQLHLRHLSKDCTQLLHKARDLVEVNVIEDPTYKVASDKLA

SEQ ID NO: 88843 - protein, 450 aa, Helicobacter hepaticus ATCC 51449
MSYASNVLNKLKEQYPSQTLFHQAVAEVFESLEPALQKDKKYETYAILERLTIPDREIHFRVSWTDDNGKIQTNRAYRIEFNAAIGPYKGGLRFHPSVNEGVIKFLGFEQILKNSLTTLAMGGGKGGSDFDPKGKSEGEIMRFCQAFMNELYRHIGATTDVPAGDIGVGGREIGYLFGQYRKLTNCFEGVFTGKAIPWGGSLVRTEATGYGCVYFAQEMLKDRGESLEGKVCSVSGAGNVAIYTIEKLLQLGAIPVTASDSQGMIYDKEGIDLALLKEVKEIKRLTLAEYAKARPQAVYTKVADYPKDSNPVWAIPCFAAFPSATQNELNGNDAKTLLANGCKCVSEGANMPSTIEAVHQFLDAKICYGPGKAANAGGVAVSGLEMAQNASMNPWTFEVVDKRLHTIMESIYANASETAKEFGEPTNLVLGANIAGFRKVAGAMIDQGVI

SEQ ID NO: 88844 - protein, 503 aa, Bacillus cereus ATCC 10987
MNKGIVMDIKKHSVVVLTPNGEFITCKRKGDSCMIGEEISFEEQEQRASRFSIPYFLKPASLLAACFLCGLLFFYNQPEEKVFAYVSVDINPSLEASVTKDLRVIDLRACNDDGRRILKEMKRWENKHLQDVIRTIIKQSQEDKYLTNDKQVMLTAIAKDKSLEPQLEKAMLELKKEYEFKHITVEYQSSTMQIREDAKKAGVGTGVYIKQENEKKKLLTPPAPPSYQEQQKSSSDVSSDASPVKEESNERGEYIEQQQSKAQQPKQIKENNRNQQENNGRELQQGNNGRGSQGNKGHQQENNGRGSQGNNGNQEGNNGRGSQGNNGHQQGNNGRGSQGNNGNQEGNNGRGSQGNTGHQQENNGRGSQGNNGNQEGNNGRGSQGNNGHQQENNGRGSQGNNGNQEGNNGRGSQGNNGNQQGNNGRGSQGNNGNQEGNNGRGSQGNNGNQEGNNGRGSQGNNGNQEGNNGRGSQGNNGHQQENNGRDSQGNSGHKQENNGRGSQ

SEQ ID NO: 88845 - protein, 331 aa, Thermus thermophilus
MKVGINGFGRIGRQVFRILHERGVEVALINDLTDNKTLAHLLKYDSTYGRFPGAVGYDEENLYVDGKAIRATAIKDPREIPWKQAGVGVVVESTGVFTDGEKARAHLEAGAKKVIITAPAKNEDITVVLGVNHEQYDPAKHHILSNASCTTNSLAPVMKVLEKAFGVEKALMTTVHSYTNDQRLLDLPHKDLRRARAAALNIIPTTTGAAKATALVLPSLKGRFDGMALRVPTPTGSISDITALLKREVTAEEVNAALKAAAEGPLKGILAYTEDEIVLRDIVMDPHSSIVDGKLTKAIGNLVKVFAWYDNEWGYANRVADLVELVLKKGV

SEQ ID NO: 88846 - protein, 565 aa, Helicobacter hepaticus ATCC 51449
MAVISGIILSRLKIPTIIGYIITGVLSAYIFGFALEDSESLNSIAELGIVFLMFMIGLDFSFKSITAMKQEVLVFGGMQIGISIAFFFVVCFYFLGFNFATSIIIASAVSLSSTAIVLKFLNESNQTKTPYGTASIGILIFQDIAVIPILLMIKLLSDKDSHLWALILTTFLSAIILLIVLVLPGRIVAKVFLRFSANMKTDEIFVGAVFLIVLGAAYISKSFGFSLTLGAFLAGMIISNTPYKYQVSSVLVHFRDILLGIFFITVGMQVDVIFLLEHFVIIVILVALMMGAKTLLMYLFLLFFKGQRIGMRIALSLAQIGEFSFAIFLLASQHKILNLTLDGGILKAIFGEAIFANITPEEIYQFLTLMVIFSMIATPFILDRLDKVTDFFLRYMHPLHIFQTTKNNDEEETLQESHHKEAGLEGHIIVCGYGELGRKILEYFKGCDVRYIAVDKDYNKVERGIKNDDNVIYGNITRRRILEQLGIEQCAAVIIAIDSIEVVQHVYQEILSIAPLCKIILKTKNSAFESQMKTQGIYGIVHERRELAKILSDLALQATNEYLRD

SEQ ID NO: 88847 - protein, 556 aa, Physcomitrella patens subsp. patens
LGVVKAMVAGYLLSHMSVFPIDSLTIYYRMLAKEVNPIEIDALHEVGGGGEAGGVTAVDYALRSMAEAGGLQIEDIEDCQYGGFHVLVLNFDRGRLIKELPGGCLPPPPRMGGDHHHRGVMEPNVGPHGLPTRPDMWDHLQGGPLMLPRNGPRGMGMLGMPGGGPGLGGGFGGPFPRPPHAPGLHGGMGGKGRGPAEEEDIDALLHKKSFKEQQQSKTAEELLELLHRPTAKETANAAKFKTKGGSALKEYCAALTKEDCRHQRNHFMACEKMHFRRIIAPHTDSNLGDCSFLDTCRHMKTCKYVHYELDPIPDVPDLMMTPGIPPNQRPGSRPQRAEYCSDAELGEPQWVQCDIRNFKMDVLGQFGVIMADPPWDIHMELPYGTMADDEMRNLNVPALQTDGLIFLWVTGRAMELGRECLELWGYKRMEEIIWVKTNQLQRIIRTGRTGHWLNHSKEHCLVGIKGHPDVNRNIDTDVIVAEVRETSRKPDEMYPLLERISPRTRKLELFARMHNTHAGWISLGNQLNGVRLVDEGLRARYKAAYPDQVIQPPDSP

SEQ ID NO: 88848 - protein, 404 aa, Oryza sativa Japonica Group
GPFNHGNAKDLFGDGIFAIDGEKWKQQRKIASYDFSTRALRDFSCAVFKRNAAKLAGIVSNHAASNQSMDFQGLMLRATMDSIFTIAFGTDLNTLDGSGEGSRFAAAFDDASEFTMLRYISPLWKLARLLNVGVEAMLKERIKVVDEFVYRLIRARSDELSNSHDSGSRQDILSRFLQATTSDSVVDYKYLRDIILNIVIAGKDTTAGALAWFLYMVCKHPEVQEKICHEAMVATSAGDTASVDEFLQSLTDQALNNMHYLHAALTETLRLYPSVPMENKQCFSDDVLPNGFNVSKGDIVFFIPYAMGRMESLWGKDAEYFRPERWLDENGVFQQESPFKFTAFQAGPRICLGKEFAYRQMKIFAAVLLRFFVLKLRDEKEIVSYRTTLTLAIDQGLHLTATAR

SEQ ID NO: 88849 - protein, 277 aa, Staphylococcus aureus subsp. aureus MRSA252
MEVKTFYNGNTMPQIGLGTFRVENDENCMESVKYAIEQGYRSIDTAKVYGNEEQVGAGIRAGLESTGIAREDLFITSKLYFEDFGRENVAAAYEASLSRLGLKYLDLYLVHWPGTNEAVMVDTWKGMEDLYKNNKVKNIGVSNFEPEHLEALLAQVSIKPVINQVEYHPYLTQHKLKLYLAAQHIVMESWSPLMNAQFLNDETIKDIAQELGKSPAQVVLRWNVQHGVVTIPKSVTPNRISENFRIFDFELSDEQMTRIDGLNQDKRIGPDPKTFEG

SEQ ID NO: 88850 - protein, 416 aa, Halobacterium sp. NRC-1
MTESGPLENMLAQMEQAREYVDIDDGIYERLKSPERTLSVSLPVRMDDGSVEVFDAYRCQFDSARGPYKGGIRYHPTVSEEEVSALAGWMTWKTALVDLPFGGAKGGIVCNPKELSDNEIEQLTRRYTEGIRRMIGPETDIPAPDMNTDPRTMAWVMDTYSVYQGYAVPEVVTGKPPEIGGTDGRVEATGRGVSIITEETFEYFDTDIQDADVAIQGFGNVGSVTADLLSERGANIVAVSDVTGAIHDPTGLDIADVQAYADANGGRLEGYDAEPISNDDLLTLDVDALIPAAIEDVITVDVAERLAADVIVEAANGPTTFDAAQVLSDRGVPVVPDILANAGGVIVSYLEWVQNSQQYSWDVEEVNRDLRQRLTGAFDEMLVAYEDRNIPTLRTAAYTIALERSADAHEFRGLFP

SEQ ID NO: 88851 - protein, 1071 aa, Erythrobacter sp. NAP1
MATNATLTPIPQPPGKPLIGNALTVDASQQIQSLMELAEEYGPIFQLDMMGTPIVIISGADLVAEVCDEKRFDKSVRGPLKRLRLIGGDGLFTGDTDAPNWSKAHNILLPSFSQKAMGSYLPMMTDIATQLVMKWERMNSDDVIDVPKDMIRLTLDTIGVCGFGYRFNSFYREDFHPFIRALTRTLETTQKIRGIPGEKLLKGDAVKQLHRDAKYMNNLVDEIIRERQRSGGDGPEDLLDFMLSGRDPLTGERLSDENIRYQINTFLIAGHETTSGLLSFTLYYLLKNRDVLTRAYAEVDTVLGRNIDQPPSLKQIGQLPYIRAILFEALRLWPTAPAFGLAPFEDEVLGGKYLIPKGTFTTVLIPSLHRDKSVWGENPEVFDPENFTAEAEAARPPHAYKPFGNGQRACIGRQFAIQESILVLAMILQRFELFDHSDYKLDIKETLSIKPDEFTIKARMRKDVERGGKATEDAEEASTEPAEPKVPKHDTPLLVLYGSNLGSSESFAREVAQKGEFSGFEVEMAPLDDYVGKLPEDGAVAIACASYNGMPPDNAAKFIDWIEGKDGAAPDLSGVSYMMLGCGNSDWAATFQAVPRLIDARMEELGAKRIVPTTELDARSDVDTQFHTWLDALMPQLGEHFDLDLSGEAAGIAEPLYKVEVTQSVTANTVASRVGAHAVKMVANRELKNTDIGEGRSTRHIEVELAQGETYQPGDHLCVVPENDDAVVERLLRRFNLDADTYVRIESRSEMRGPFPSGSTFSVYNLAKTAGELQAVATRKDIATLALYTECPNSKPALEKLAQPPQEDGTDQYATDVLAKRKSVLDLLEDYPACDLPLAVFLEMIPFLSPRYYSISSAPGDTPQTCSITVGVVKGPALSGKGTFKGTCSNYLAELEPGASFNAVVREPTANFRLPDDPKVPLIMVGPGTGLAPFRGFLQERDALASSGEELGPARLYFGCRTPDEDFLYRDELEDYDKRGIVTLRTAFSRVDEGKCYVQDHIADDADAIWEMLEAGGRIYVCGDGARMEPDVRAALAKIHSDKTGSTPAEAQSWVGDLITNERYSLDVWVG

SEQ ID NO: 88852 - protein, 275 aa, Zea mays
  misc_feature (166)..(166): Xaa can be any naturally occurring amino acid
  misc_feature (179)..(179): Xaa can be any naturally occurring amino acid
  misc_feature (186)..(186): Xaa can be any naturally occurring amino acid
  misc_feature (207)..(207): Xaa can be any naturally occurring amino acid
MSQEQPRRPSGHDETSGGEQGAVRYGDVFPAVSGGLAEKPVAPQDAATMQSAENLVFGQTLKGGPAAAMQSAATANERMGAVGHDQATDATAVQGVTVSETRVPGGGRIVTEFVAGQAVGQYLARDDDGGGGIAGPGAGAGVAGKDITKVTIGEALEATALAAGDXAPVERSDAAAIQXAAEARAXTGLDANVPGGLAAQAQSGRGXANSWAWGDEDKATLGDVLAVRVTNTTCHRFRFVAAAAIYLTVRVGGATEQRSFDQKKKKKSLSIPSTV

SEQ ID NO: 88853 - protein, 333 aa, Streptococcus salivarius
MAILVLGGAGYIGSHMVDRLVEKGQEKVVVVDSLVTGHRAAVHPDAIFYQGDLSDQDFMRKVFKENPDVDAVIHFAAYSLVGESMEKPLKYFDNNTAGMVKLLEVMNECGVKYIVFSSTAATYGIPEEIPILETTPQNPINPYGESKLMMETIMKWSDQAYGIKYVPLRYFNVAGAKPDGSIGEDHGPETHLLPIILQVAQGVREKIMIFGDDYNTPDGTNVRDYVHPFDLADAHLLAVEYLRKGNESTAFNLGSSTGFSNLQILEAARKVTGKEIPAEKADRRPGDPDTLIASSEKARTVLGWKPQFDNIEKIIASAWAWHSSHPKGYDDRG

SEQ ID NO: 88854 - protein, 175 aa, Triticum aestivum
MAPTVMASSATSVAPFQGLKSTAGLPVSRRSSSAGLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 88855 - protein, 226 aa, Zea mays
MKLNISYPANGSQKIIEVDDERKLRPFMEKRMGTEVAGDSLGDEFKGYILKITGGNDKQGFPMKQGVLLPTRTRLLLADGHSCYRPRRTGERKRKSVRGAITGQDLAVLALSIVKQGEGELPGLTDTVVPKRLGPKRATKIRRFFGLDKKDDVRKFVIRRTVTREGKPDYTKAPKIQRLVTPQRLQRKRQRIALKRRRAEAAREAANDYAKLLARRVHEEKAKRDE

SEQ ID NO: 88856 - protein, 507 aa, Hordeum vulgare subsp. vulgare
MEVEAGAHGDAAASKFTLPVDSEHKAKSFRLFSFANPHMRTFHLSWISFFTCFVSTFAAAPLVPIIRDNLNLAKADIGNAGVASVSGSIFSRLAMGAICDLLGPRYGCAFLVMLSAPTVFCMAVIDDASGYIAVRFLIGFSLATFVSCQYWMSTMFNSKIIGTVNGLAAGWGNMGGGATQLIMPLVFHAIQKCGATPFVAWRIAYFVPGMMHIVMGLLVLTMGQDLPDGNLASLQKKGDMAKDKFSKVLWGAVTNYRTWIFVLLYGYCMGVELTTDNVIAEYYFDHFHLDLRAAGTIAACFGMANIVARPMGGYLSDLGARYFGMRARLWNIWILQTAGGAFCIWLGRASALPASVTAMVLFSICAQAACGAVFGVAPFVSRRSLGIISGLTGAGGNVGAGLTQLLFFTSSQYSTGRGLEYMGIMIMACTLPVALVHFPQWGSMFFPASADATEEEYYASEWSEEEKSKGLHIAGQKFVENSRSERGRRNVILATSATPPNNTPLHV

SEQ ID NO: 88857 - protein, 104 aa, Oryza sativa
MEYSNLRRQIIFMKKNLFDQGYLDEQFNQLEELQDESSPNFVEEVAALFFKDSSRLLTNIEQAIDKYPQDFYRLDSLVAQLKGSGSSIGALRMKNECSVFKVTA

SEQ ID NO: 88858 - protein, 429 aa, Erythrobacter sp. SD-21
MTAIIDIHAREILDSRGNPTVEVDVLLEDGSFGRAAVPSGASTGAHEAVELRDGDKGRYLGKSVTKAVEAVNTEIRDLLVGNFDAEDQRDVDLSMIALDDTPNKGRLGANGILGVSMATAKAAANARGLPLYSYIGGVSAHVLPVPMMNIINGGEHADNPIDIQEFMVMPVGADSLAEAVRWGAEIFHTLKKKLSEKGLATAVGDEGGFAPNLASTRDALDFIMASVEQAGFKPGDDVMLALDCASTEFFKDGKYQISGENLSLDGHQMAEYLDKLCRDYPIRSIEDGMAEDDFEGWKALTDRIGKSIQLVGDDLFVTNPQRLREGIDQGLANSLLVKVNQIGTLTETLDAVAIANRASYTAVMSHRSGETEDATIADLAVATNCGQIKTGSLARSDRLAKYNQLIRIEEELGDSAFYAGRDCFGKIVC

SEQ ID NO: 88859 - protein, 179 aa, Coxiella burnetii RSA 493
MIKIGEQFPSFSLKAVISNDVNKAFTEINEKSYANKWLVLFFWPKDFTFVCPTEIAEFGRLNGEFADRDAQVLGASVDSEFVHLAWRREKEELSQLPFPMLSDIRRDLSQRLGILNEKEGVAERATFIVDPNHIVRFVMVNDLNVGRNPQEVLRVLDALQTDELCPCNWQQGEETIVVA

SEQ ID NO: 88860 - protein, 487 aa, Sinorhizobium meliloti 1021
MRAQPKASHFIDGEYVEDAAGTVIESIYPATGEIIARLHAATPGIVEKAIAAAKRAQPEWAAMSPTARGRILKRAAELMRQRNRELSELETLDTGKPIQETIVADPTSGADSFEFFGGVAPAALNGDYIPLGGDFAYTKRVPLGVCVGIGAWNYPQQIACWKGAPALVAGNAMVFKPSENTPLGALKIAEILIEAGLPKGLFNVIQGDRATGPLLVNHPDVAKVSLTGSVPTGKKVAGAAAAELKHVTMELGGKSPLIVFDDADLESAIGGAMLGNFYSTGQVCSNGTRVFVQRKIKEPFLARLKERTEAIVIGDPLDEATQLGPMVSAAQRDKVFSYIGKGKAEGARLVTGGGIPNNVSGEGTYIQPTVFADVTDGMTIAREEIFGPVMCVLDFDDEVEVIARANATEFGLSAGVFTADLTRAHRVADRLEAGTLWINTYNLCPVEIPFGGSKQSGFGRENSVAALNHYTELKTVYVGMGPVEAPY

SEQ ID NO: 88861 - protein, 341 aa, Triticum aestivum
  misc_feature (21)..(21): Xaa can be any naturally occurring amino acid
HASDIVAPGRGILAMDQSNAXCGKRLASIGLENTDANRQAYRTLLVTPPGLGNYISGAILFEETLYQSTVDGKKIVDILVEQGIVPGIKVDKGLVPLVGSNDESWCQGLDGLASREAAYYQQGARFAKWRTVVSIPNGPSELAVKEAAWGLARYAAISQDNGLVPIVEPEIMLDGEHGIERTFEVAQKVWAETFYYMAQNNVMFEGILLKPSMVTPGAECKDRATPEEVASYTLKLLQRRIPPSVPGIMFLSGGQSEVEATLNLNAMNQAPNPWHVSFSYARALQNTCLKTWGGRPENVAAAQEALLLRAKANSLAQLGKYTSDGEAAEASENMFVKNYSY

SEQ ID NO: 88862 - protein, 675 aa, Oryza sativa Japonica Group
MSKESCGVQGLSLDGGSKKRSHEQVFLFSPPPPFLPPSPLLPATRRRPPRPCPPFLAAARPRPPPPAAAASPMAKSTPAAAAAAPEEATAAALRLRLRRLVAAVTAGGVGGGEAFDEAASALAALRDAELGPPPKDRPGAGAERRRSGHAEAAAVPEQFLCPISSEIMRDPVVLASGQTYDRRFIQEWLSAGNRTCPQTQQVLSNTILIPNHLVRSMIAQWCTENGIALSPLENQEEDLVTNNERKSFSELFDRISSSSNISEKRQAIKDLRLLTKRNSSFRAVIGENPDSISQMISAVSNPELESNSEVLEDTVTTILNLSIHESNKKIIGDDTKAITFLISALQSGTMEARSNAAAAIFSLSALDSNKAKIGESGAMRPLVDLLEHGSMTAKKDAASAIFSLCKLHENKSRATKSGVIDVVLKAISDESLTDESLTILALLSSDHETVEEIGETGGVPCMLHIIKDDQCKRNKENAVAVLFSICMYDRTKLREVVEDENLNGSLAWLAQNGTSRARRKAAETEQAEQPNSVRSYYSRQPEIPQLKKGRAAVVAAAASGRSSGGGERSRRQASSGGRAWLRVLMADKQAGGALESGAGGGRRRASATTSGDGGQEGTRSDGERCLRRAAAAAADAERRRAAWAAGEARHPPVLDQPTVGQGMVGWLASCMQCAN

SEQ ID NO: 88863 - protein, 253 aa, Populus trichocarpa
MSHPQITNRWSLQGTTALVTGGTKGIGYAVVEELAALGACVHTCARTQGQIDACLRQWKERGLKVSGSVCDVSSQADREKLIKEVSSLFGGKLNILINNAGTNVYKPTLEYTAEDFSFLMNTNLQSAFHLSQLAHPLLKASGAGRIVFVSSICGVTSVNIGYPIYSASKGAINQLTRNLACEWAKDNIRVNSVAPWFINTPMNEDSLQNESVVKELAYRTPHGTCWRTRRSLFCCRISLPAWAIVYNWTGHLY

SEQ ID NO: 88864 - protein, 404 aa, Populus trichocarpa
MASATFSVAKPSLQASGKGFTDFSGLRSSSAFLPFTKKTSDDFVSAVSLQTSALGSSSGGYRKSAAEAKLKVAINGFGRIGRNFLRCWHGRKDSPLDVIAINDTGGVKQASHLLKYDSTLGIFAADVKPVGDNGISVDGKVIKVVSSRNPLDLPWKDLEIDLVIEGTGVFVDREGAGKHITAGAKKVLITAPGKGDIPTYVVGVNADAYSSDEPIISNASCTTNCLAPFVKVLDQKFGIIKGTMTTTHSYTGDQRLLDASHRDLRRARAAALNIVPTSTGAAKAVALVLPTLKGKLNGIALRVPTPNVSVVDLVVQVSKKTFAEEVNAAFRESAEKELNGILSVCDEPLVSVDFRCSDVSSTVDSSLTMVMGDDMVKVIAWYDNEWGYSQRVVDLADIVANNWK

SEQ ID NO: 88865 - protein, 345 aa, Oryza sativa
  misc_feature (32)..(32): Xaa can be any naturally occurring amino acid
  misc_feature (214)..(214): Xaa can be any naturally occurring amino acid
  misc_feature (260)..(261): Xaa can be any naturally occurring amino acid
TAHKICTPGKGILAADESPGSVEKKFKGIGLXNNADNRRRYRDMLLTSPGIQQYISGVIFHEETAKQLHSNGQNYTDYVKSLGIVAGIKVDKGLGILDNGKEENFTKGLEQLPAMAADFYALGCRFAKWRAVLKIGNGSPTDLAIQENAVGLAKYARACQDHGLVPIVEPEILSDGTHSAEECQRITEKVLSAVFKALADHKILLEGCLLKPNXTYGSEHPKKKENNIVEEAVRTVRALSRTVPPALTGITFLSGGQTEXXASLHLNSMNQVDSIRRPWFLSFSFGRALQNSSIKAWGGHDANIHAGQEAFLKRAKANSEAQLGKYQGSNDKAANESLFEASYSY

SEQ ID NO: 88866 - protein, 196 aa, Zea mays
RRKIAQKMAESKHLIPHFSYVEEIDVTELEDLRVSLNAKFGESRGKLTLLPLLARAMVIALRDFPQINARYDDEAGQVTRYGAVHIGIATQSDGGLMVPVMRHAETRDLWSMAAEIGRLAQAVRSGGAGRDELSGSTITITSLGPLGGIVTTPVINHPEVGIVGVNRIVERPAFRNGAVVARKLMNLSSSFDHRER

SEQ ID NO: 88867 - protein, 230 aa, Rickettsia sibirica 246
MKVDSLHNLSYKEEFEGDMKRSTAAYKKVSEDASIGSTYIADTSEVGSQISDEPVQHIKIPEHRQILKFNIPNLEVSKVYKLPLEGGYARSLIKPVIMAGGNGKRLWPLASKDKPKQFKKILSDLTLLQQTLNRNKFLGQPTIITSKKYESITKEQAAEIDVEIALITEPLQKNTAVCAIITALSATALGFDIVVLLPSNHHIADDINYLNTINKALHYVNECGICTIFL

SEQ ID NO: 88868 - protein, 406 aa, Magnaporthe grisea 70-15
MAYHHHSRADGTFFVESDDIAMSRMSAREAAKILARNRREVIGNELSRLAGEEYLEDIMQHMRHMEDETLPDASLIDMQREIQWFMRPYLIDFLVEAHAAFQLLPETLFLTVNLLDRYCSKRVVYKQHYQLVGCAALLIAAKYGDKKDRVPQINELNNMCCGLYDAGMFTQMEMHVLNTLDWTVGHPTVDFFAQLIVAEERDDKEVEYMAAYISEISLYYRDFVSTKPSTMARASLALARAILGRQEVNDGEWDHDQNATLVTLSQHVHQPSVTLSRKYASTHYLQVSNKLSDFLAHQAAINRAAALPENPLTPTTNELMAAKANIYSTPQKGLGSVPGVADGYLTPPITPDGQYGAPNPHGLPPRCPVTPTPQHQQQQHQQQQRYYPNCYQPTQQQQTSNHGSYL

SEQ ID NO: 88869 - protein, 248 aa, Rickettsia sibirica 246
MNQTNFGFKKVDYTKKQGLVNNVFSNVADKYDLMNDLMSLGLHRLWKDEFIRQIPNLNSHILDVASGSGDIALKLAKKARDRVNNISLTLSDINEEMLKQAKKKAIDLNLFQNLKFTVASAEELPFPDDSFDYYTIAFGIRNVPDINKALKEACRVLKPMGKFICLEFSKVKEGYIKDFYKFYSFNIIPSIGQMIAGNKEAYEYLVESIDLFPSQDEFRIMIKDAGFEEVGYKNLSGGIVAIHSAYTQ

SEQ ID NO: 88870 - protein, 219 aa, Brassica napus
  misc_feature (169)..(169): Xaa can be any naturally occurring amino acid
MHCSRHNNMSLLWITGLCVTALVVVRISNWWYRWSNPKSNGKLPPGSMGFPIIGETFDFFKPHRFYEISPFLKKKMLRYGPLFRTSILGVNTVISTDMDVNLDILRHENEYFNLSYPDGLVKPLGKESMFLKTGNIHKHIKKICMRLLGSENLKRKIIKDMDHVTCEHXSLKVGQGRFDLRDLASSVFFLSFFICLLSSTNINWLLSNLVKILINNLSL

SEQ ID NO: 88871 - protein, 535 aa, Erythrobacter sp. NAP1
MNQAAATGSARKPAMNAGQIWNMSFGFLGIQIGFDLQNGNVSRIFQTLGAEVNELAILWIAAPMTGLIVQPVIGHLSDNTWGRFGRRRPYFLVGALLATLALFIMPNSPTLWIAAGMLWIMDASLNITMEPFRAFVGDNLPDRQRTRGYAMQSFFIGVGAVIAGALPWVMTNWMGLSNVAPEGQIPETVQWAFYIGGAALFAAVCWTVFKTNEYSPEQLAGFEAARHMALGVTPRDASTTRRSAAKFQRGGLLWIIIGIAFAALVMAARTDPRPAWLGDLEIAQELYVLAGLIAAFGVIQFIASFLRKSGRDDNGFMEVVNDLFAMPKTMRQLAVVQFFSWFAMFSMWIYGTPAVAEYHFASPDPVTQGYQDAADWWSLLGSVRNGIAAAAALGFIIIAAKMDRCRLHALNLTIGAVGFASMLLIRDPGLLWLPMVAVGIAWASIVSLPYAILAGSVPAKKMGIYMGIFNIFIVVPQLIAATLLGFLLTTFFDGAPIYAMMISAVSFALAAVATFFVTDGTSAILERQAQLKEAS

SEQ ID NO: 88872 - protein, 182 aa, Triticum aestivum
  misc_feature (140)..(140): Xaa can be any naturally occurring amino acid
  misc_feature (156)..(158): Xaa can be any naturally occurring amino acid
  misc_feature (166)..(166): Xaa can be any naturally occurring amino acid
  misc_feature (170)..(170): Xaa can be any naturally occurring amino acid
  misc_feature (173)..(173): Xaa can be any naturally occurring amino acid
KPYVLPVPFMNVLNGGSHAGGRLAFQEFMIVPSSAPSFSEALRQGAEVYQILKGLAKKKYGQSAGNVGDEGGVAPDIQTAEEALDLITDAIEAAGYTGKMFIAMDVASSEFYKEDAKKYDLDFKNPESDPTKWLTYVELXDKYQTLGKDIPIVKNXXXFAEDDWEXWSYXKDXDFKLPCSTI

SEQ ID NO: 88873 - protein, 398 aa, Halobacterium sp. NRC-1
MAIRTLDDLAAANRAIGVRVDINSPLTAAGGLADDARLRAHVDTLAELLAADARVAVLAHQGRPGGDEFARLERHADRLDALLDAPVSYCDATFSTGARDAVADLAPGEAVVLENTRFYSEEYMAFAPERAADTALVDGLAPALDAYVNDAFAAAHRSQPSLVGFPEVLPSYAGRVMEAELDALSGVADTPTPRTYVVGGAKVPDSVEVAAHALSHGLADNVLVTGVVANVFLAATGVDLGRASTDFIHERDYGTEIARAADLLAAHNDALHLPVDVAVERDGARCELSTDALPPAGDEAVCDIGSDTVDAYADVLADSETVVVNGPAGVFEDDLFADGTRGVFDAASEVEHSIVGGGDTAAAIRRFDITGFDHVSTGGGAAINLLTDADLPAVAALR

SEQ ID NO: 88874 - protein, 126 aa, Botryococcus braunii
YCHYVAGVVGLGLSQLFVASGLQSPSLTRSEDLSNHMGLFLQKTNIIRDYFEDINELPAPRMFWPREIWGKYANNLAEFKDPANKAAAMCCLNEMVTDALRHAVYCLQYMSMIEDPQIFNFCAIPQ

SEQ ID NO: 88875 - protein, 248 aa, Halobacterium sp. NRC-1
MTAVGVQPAKRCIQHASPPFAVSMTIPSFAIGIAGGTGAGKTTVAREITDNVGESATLIPLDNYYEDLSDRPFEERANANYDHPSAFEWELLRTHIDALLSGQSIEMPQYDFERHVRKADRVVVEPTDVIVLEGILALSDETVNDMLDLHIYVETDADVRILRRIERDVVERGRELEGVMDQYLSTVKPMHEQFIEPTKRHADIIIPEGANSVAVNLLEEKVQAETSEMTAWAARDDTAFEDATYNPQ

SEQ ID NO: 88876 - protein, 128 aa, Triticum aestivum
QKSSDVPGRNSRDIVDPRVRRCFPPKTAKNFEIARLSDRVRGDEAANREMSQRNQEAIEMSRQQRNQRKMRQKWFWGSFGITITLGTAAIAFFFLPARPTQAGPPLIFPPPPREGGGGEDASSPCIRP

SEQ ID NO: 88877 - protein, 291 aa, Thermomyces lanuginosus
MRSSLVLFFVSAWTALASPIRREVSQDLFNQFNLFAQYSAAAYCGKNNDAPAGTNITCTGNACPEVEKADATFLYSFEDSGVGDVTGFLALDNTNKLIVLSFRGSRSIENWIGNLNFDLKEINDICSGCRGHDGFTSSWRSVADTLRQKVEDAVREHPDYRVVFTGHSLGGALATVAGADLRGNGYDIDVFSYGAPRVGNRAFAEFLTVQTGGTLYRITHTNDIVPRLPPREFGYSHSSPEYWIKSGTLVPVTRNDIVKIEGIDATGGNNQPNIPDIPAHLWYFGLIGTCL

SEQ ID NO: 88878 - protein, 321 aa, Geobacter metallireducens GS-15
MGTGRNGGRAIVATGLGQCCWDTLAVVDSYPSPDSKAEAAVWAEQAGGPTATALVALARLGIPCRFAGVVGDDDAGSRIRQALDSEGVDGAFLVTRRRGASQRAFIMIERGSGRRTIVWRRPTGDPLDPREVPDAFLAGSSLLLLDGLMADASLHAAGRARSLGIPVMVDAGRMRPGMLDITRQCDYVVAAEQFFLDLGWDRTPEHFRGLAADLGAPVVTVTLGAAGSLTWSGHEPFHVPAFTVDAVDTTGAGDVFHGGYGYGILQGWSVRETVVFASAMAAMKCRQVGAQQGIPRLPDVLEFLTRRTITVLSNPQTEVSP

SEQ ID NO: 88879 - protein, 140 aa, Erythrobacter sp. SD-21
MANFLIVEARFYDHLNDMLVAGAKAALEEAGHSVEVLTVPGALEIPGAIALVAETGRYDGFVAIGVVIRGETYHFEIVAGESARGIMALTMDGIAIGNGIITVENEEQALVRADPSKKDKGGEAAKAALALLDLQGRFAA

SEQ ID NO: 88880 - protein, 203 aa, Neisseria gonorrhoeae
EFRLCSTGKNQSPVNITETVSGKLPAIKVNYKPSMVDVENNGHTIQVNYPEGGNTLTVNGRTYTLKQFHFHVPSENQIKGRTFPMEAHFVHLDENKQPLVLAVLYEAGKTNGRLSSIWNVMPMTAGKVKLNQPFDASTLLPKRLKYYRFAGSLTTPPCTEGVSWLVLKTYDHIDQAQAEKFTRAVGSENNRPVQPLNARVVIE

SEQ ID NO: 88881 - protein, 397 aa, Erythrobacter sp. SD-21
MTRAGLARAAGLHANTLRDCTDDSWNPTAETLGKLESFLEANDETPVIVGAEEIIDEARNGRMFILVDDEDRENEGDLVIPAQMATPNAINFMATHGRGLICLSLDSKRVKALGLEPMSRDNRESMQTAFTTSIEAKTGVTTGISAADRSRTVSVAIDPTKGPDDIVTPGHVFPLTARDGGVLVRAGHTEAAVDISRLAGLNPSGVICEIMKDDGTMARLDDLVSFARKHDMKIGTIRDLIEYRMRHDHLVERTAEDTFDSDYGGAWRMLTYRNTVDGSESYVLQKGEVSQGQPTLTRVHPISIFDDVLGKPGPRKRTLQRAMQVMGEHGSGVIVIITGRPASGYGQSEAERNVGIGSQILADLGVEDMILLSNSQPTVVAIEGYGLNIVDHMPIPE

SEQ ID NO: 88882 - protein, 341 aa, Actinosynnema pretiosum subsp. auranticum
MPRRLAEQVVVVVGASSGIGRVTALRFAAAGARVVCAARNTRALDGLVEEVRGAGGRAVAVTADIADEAAVRAVADVAVERFGRVDTWVNAAGIGVYGRVEDTPAGEFDRVMRVNYLGHVHGAKAALPALRRAGGGVLIGVASVLGLRSAPLQAPYAASKAAVRAFYDALRVELAHDGESIAVTAVLPAAINSPFFEHCRSRVGSLPKPPPPVYAPELVAEAVLRAAERPRREVPVGDAALAFYLGQRLFPALTDALMSVRAVGRSGMRSELPDNGVDNVDSPVDEDGRVHGSYPGRVLDSSPVTALLARVPRPGELATSLVSGAHRVGGAVRGGLRAARS

SEQ ID NO: 88883 - protein, 357 aa, Zea mays
MADMQNYAAPPLLTHATAKRKRVTLNQLPTLPNAVLGAHDEGGGGDDKPVKKQHLLPAAKPEPNAAPAPAAAASDVEEDPQLRKPYASDIYSYLRSTESQATRRPATDYIAAVQVDVTPNTRAILVDWLVDVSEEYRFVSDTLYLTVSYIDRFLSANALNRQKLQLLGVAAMLIASKHEEISPLNVEDFCYITDNTYTKQEVVKMESDILNVLKFEMGNPTPKTFLRMFTRFSKEDTKKYRSLQLEFLGSYLCELSLLDYSLLRFLPSLVAASVLFVARLTLDPHTHPWSKKMQTLTGYKPSELKDCVAAIHHLQLNRKYSSMMATRDKFKERRFKGVSALLPPVEIPAPYFEKLKE

SEQ ID NO: 88884 - protein, 1116 aa, Oryza sativa Indica Group
MASSIAMSLRSLAATDAFLPKPSPSSAPFLLLLSPSTPRLRLHLHLRSTRRLPLAPLAASDSFESASSSSAAALDFAEPGAAEESDVPEESDQEEEGYAPEAEEEAEADEEVEEEAVEASAEVAEEAEDVEEVGEYVEPPEEAKVYVGNLPYDIDSERLAQLFEQAGIVEVSEVIYNRETDRSRGFGFVTMSTVEEAEKAVEMFHRYDVDGRLLTVNKAAPRGARVERPPRQFGPSFRIYVGNLPWQVDDSRLVQLFSEHGKVVDARVVYDRETGRSRGFGFVTMATQEELDDAIAALDGQAMLLSEETIISDVGFRCICGWPNLPPDLLREISGQLHDAVDLSRFHTVCTAWRDMVRLPAAEPQCPALLPWLVARGWPGCFSRSHLRSIFSNATPAWHSPRPTTRDMWLASTDGAGVWVLTADGDRLVDPLTGATVRRLPRLPRTSNNDHVCYIDGVVCGDGTIVAYATSDGFKHSSQIEAAILRPGDTAWTTVESKGMMHAAFGYGCCTTYHQGGVVFADLYQTFVVRVLVDDDDAAGGGRVVESRTRRWPPDYGFLHKRLLSTYTFEFRGKLMSACVEIPWQSSAYQIDAAALSVSLYTLETTAAAGDGGELAHLWVRAADGGRLLGEHALFLGCPTSFAVDAARFGAGGEEIRERLIRHGERPKTFKIKLNNLTPRARLGSSGDSWLRGEFRYHGYVIDANVHYRNGAIFGVVTMTTVQKSADIVAALDKRGLLDLHPLLAVEFAEQRPRQEWILTEAALAIAPTTVHSFSPKDFSIYVGNLRWDVDRLRLLKFFGEHGRVLVAQVVCYRQTGRSRGFGFVSMATLREPDDVIASLNGQIMDGRPMRPLRDQIRFNSKGKRINSFMLVYLILVLGGARLSVDQHEGRVDERGGGCTAAADVGGGGDGARRSGGDGDGEVSTEQEETRAAAADADERGWRGEEERRRQMRTRGSGGARSSCPAGSCSGAGEEGRRPAASASSGSGSGSSRASLKKLASMRSSAAPSSSSSPSPHERLRREPPRRQQRMRCGVRRQTRAVGRGGAAAAADAGGGARRSGGDNEVRSREERRPWEKKRNANRILCNAEVDNFFPEKQGVEVILIFTTLKASFGQK

SEQ ID NO: 88885 - protein, 156 aa, Oryza sativa Japonica Group
MAALGSKLATLGSAAREAARVAARQGCAYNKAVVEGSRQLQSRACEATRSAAKHGRAFHEELMERNKRYVIDPPTIQTCQELSKQLFYTRLASIPGRYESFWKEVDGAKLLWKNRKNLNLKAEDIGVATLFGIELIAWFAGGEVVGRGFTFTGYHV

SEQ ID NO: 88886 - protein, 322 aa, Castellaniella defragrans
MRAQDMLLDAARRDPKRIVLCEGDDPRVKAAARRAAADGIAQVLLLGSSEDVPGVHGIRPADSGWLDAFAEELLSLRRARGMTPEQAREAVRQPLVFAALMVRLGHADGSVAGAVHTTADVVRTAIQVIGKRPGVRTVSSFFMMMRDEPFPTGEHAMVFSDCGLVIEPDSRELAEIALASARSARTLLGIEPRVAMLSFSTHGSAAHQQIDKIREAMALARRQAPDLLIDGEMQLDTAIVPEVARRKWPQSSVAGQANVLVFPSLDAGNIGYKLVERLGHATALGPILQGLDKPANDLSRGCSADDIHQVIAVTAVQAAWTD

SEQ ID NO: 88887 - protein, 411 aa, Legionella pneumophila subsp. pneumophila str. Philadelphia 1
MDNEVIKQRALDYHEFPVPGKLSVHLTKSTNSQDDLSLAYTPGVAAPVLAIAEAPENAYRFTSKGNLVAVMTNGTAVLGLGNLGPLASKPVMEGKAVLFKRFADLDVFDIEIDAEDPQSFIATAKRIAPTFGGINLEDIKAPECFEIEQALIEQLNIPVFHDDQHGTAIVVAAGLLNALELQNKKLSDIKIVCMGAGAAGIASMRLLVALGAPKSNMLLLDTKGVIHSGREDLNPYKFAFARNTSCRTLEDALVDADVFIGVARPDLLNAHLLSLMAPNPVIFALSNPDPEIKPELAHSVRKDLVMATGRSDYPNQVNNVLCFPYIFRGALDVRATCINQAMQIAAVEAIRQLVHEPVPQVVKDNYPGVVNWDFGPDYIIPKPIDPRLKERVPAAVAKAAIASGASQFNNL

SEQ ID NO: 88888 - protein, 317 aa, Bacillus cereus ATCC 14579
MSTQYLNSNLKVFSLNSNKELAEQIAKHIGVGLGKCSVDRFSDGEVQINIEESIRGCDVFIIQSTSFPVNEHIMELLIMIDALKRASAKTINIVIPYYGYARQDRKARSREPITSKLVANLLETAGATRVITLDLHAPQIQGFFDIPIDHLMGVPILSDYFETKGLKDIVIVSPDHGGVTRARKMADRLKAPIAIIDKRRPRPNVSEVMNIIGNIEGKTAILIDDIIDTAGTITLAANALVENGASEVYACCTHPVLSGPAIERIQNSNIKELVVTNSIVLPEEKKIDKVHELSVAPLIGEAIIRVYEEESVSVLFN

SEQ ID NO: 88889 - protein, 329 aa, Glycine max
MDEIVSDDSFADFEPIKNSEAKKDSLSKQEKKGKPDSANCSSSLESLADGSEEDAGNMDIDEGYNSEECSEGTQEKMQVLPVKSSENSEKGIEEKDSKAPQENPKMLSTPNERNAGSKTIVTRNLSYSVERADLENLSKPCGEVVDVRLHTDAEGRFRGFGHVEFATAQAAQKALQLNYTELLRCRIRVVLAPQKHKHTANRSFHVNSSNLSHSFQRSERTQPVKASEISGDWEQETESKIIANCKDLSATSKTIYASNLAYSMEKDDMEFLFKNCGEIVDIRLHTDHNGRFKGHGHVEFATTEAAQKARHSSRLFIALSLESNVGLAS

SEQ ID NO: 88890 - protein, 365 aa, Oryza sativa
MGTRAAFVVAFLIRSLYGGMQIVTKFAFNEGMSTSVFVFYRHVIAILFLVPVAFVLERKTAPPLTFKVSLKLFLHALYGMESLNLKRINGIAKVSGVVLCIVGVIILAFYQGPELKSFNHHHLFRTSTVYAAATSHPATTWILGIFLTTLSTTCWALWTVLQGPMLEVYPSKLLNTTIQIVFATIQCFFIALAIERDFSRWKLHLDMGLIAVIYSGVLVSGVAYYMQVWVIDKSGPVFLAMTMPITLLVTIMLSSFVLGEAVTLGSIISGVVMVGGLYCVLWAKKSEQAAISKQQMGLLHAIKAVFPDCAQSPEEGEKRRLICVPSRLKSALTLPTGCSARSGLGNSNKPFALPSHLTPLAHHFM

SEQ ID NO: 88891 - protein, 275 aa, Sinorhizobium meliloti 1021
MHAVSSNGANIPALGFGTFRMSGAEVLRILPQALKLGFRHVDTAQIYGNEAEVGEAIQKSGIPRADVFLTTKVWVDNYRHDAFIASVDESLRKLRTDHVDLLLLHWPGSDVPMAERIGALNEVRNAGKVRHIGISNFNTTQMEEAARLSDAPIATNQVEYHPYLDQTKVLQTARRLGMSLTSYYAMANGKVPADPLLTEIGGRHGKTAAQVALRWLVQQQDVIVLSKTATEARLKENFAIFDFALTREEMAAVRELARPNGRIVNPQGLAPEWDA

SEQ ID NO: 88892 - protein, 339 aa, Triticum aestivum
  misc_feature (108)..(108): Xaa can be any naturally occurring amino acid
MGKSEPECVNSSNPAHECNDYCLNKIAEAKRRLLEEQPDSWKGPPEDRTVHPDCINASNPYHDCSEYCFKKIADANAAAERGEPEKPAGGSGKSGVTPEQADGDDDSXRQEDAAAAEDRFTPQMTEKQKKLFELQLKMNEARKANQQAMVAEKKRMEPRGESRGVSKEKWLEDRKKKIGKLLDSNGLDMSKSYMLDTQDMAEAKYKKWEKEPAPHGWDVFNQKTLYDAYKKRTKNIEVDMDAYNRAKETDPEFYREASSLQYGKVSRVAEPNIDRMVNELKERDEKRKAFSRRRKFNEDKDVDSINDRNEHFNKKIERAFGKYTLEIKNNLERGTALPD

SEQ ID NO: 88893 - protein, 473 aa, Salmonella enterica subsp. enterica serovar Muenchen
MSKLIPVIMAGGIGSRLWPLSREEHPKQFLSVDGELSMLQNTIKRLTPLLAGEPLVICNDSHRFLVAEQLRAINKLANNIILEPVGRNTAPAIALAAFCSLQNVVDEDPLLLVLAADHVIRDEKVFLKAINHAEFFATQGKLVTFGIVPTQAETGYGYICRGEAIGEDAFSVAEFVEKPDFDTARHYVESEKYYWNSGMFLFRASSYLQELKDLSPDIYQACENAVGSINPDLDFIRIDKEAFAMCPSDSIDYAVMEHTRHAVVVPMNAGWSDVGSWSSLWDISKKDPQRNVLHGDIFAYNSKDNYIYSEKSFISTIGVNNLVIVQTADALLVSDKDSVQDVKKVVDYLKANNRNEHKKHLEVFRPWGKFSVIHSGDNYLVKRITVKPGAKFAAQMHLHRAEHWIVVSGTACITKGEEIFTISENESTFIPANTVHTLKNPATIPLELIEIQSGTYLAEDDIIRLEKHSGYLE

SEQ ID NO: 88894 - protein, 393 aa, Anabaena sp.
  misc_feature (13)..(13): Xaa can be any naturally occurring amino acid
  misc_feature (53)..(53): Xaa can be any naturally occurring amino acid
  misc_feature (69)..(69): Xaa can be any naturally occurring amino acid
  misc_feature (98)..(98): Xaa can be any naturally occurring amino acid
  misc_feature (127)..(127): Xaa can be any naturally occurring amino acid
  misc_feature (234)..(234): Xaa can be any naturally occurring amino acid
  misc_feature (256)..(256): Xaa can be any naturally occurring amino acid
  misc_feature (372)..(372): Xaa can be any naturally occurring amino acid
MGSDKIHHHHHHXAQIISINDNQRLQLEPLEVPSRLLLGPGPSNAHPSVLQAXNVSPVGHLDPAFLALXDEIQSLLRYVWQTENPLTIAVSGTGTAAXEATIANAVEPGDVVLIGVAGYFGNRLVDXAGRYGADVRTISKPWGEVFSLEELRTALETHRPAILALVHAETSTGARQPLEGVGELCREFGTLLLVDTVTSLGGVPIFLDAWGVDLAYSCSQKGLGCSPGASPFTXSSRAIEKLQRRRTKVANWYLDXNLLGKYWGSERVYHHTAPINLYYALREALRLIAQEGLANCWQRHQKNVEYLWERLEDIGLSLHVEKEYRLPTLTTVCIPDGVDGKAVARRLLNEHNIEVGGGLGELAGKVWRVGLXGFNSRKESVDQLIPALEQVLR

SEQ ID NO: 88895 - protein, 439 aa, Physcomitrella patens subsp. patens
MAATRIRGYIATKLSPAQSPRFSAIARSRDRSCTSWDPVPSNECLRLDRTKSGHRRRTMDRSPGFSRTVPAWSQACVVSSIAGWEGGRMDADEICVVLARASELHAKFNEAIERALTSDVVQSTGDERFDADFHSVLDGDEINGFERLDRDFSKGVEGNAEARTLGLICDTLDTLEGQLEALQVLKVLHWDPKMNHQRAEKDAALAELEESRHLLLLKLKNHRGREWQVVQEALAFAGEPVEEREDLLLPPYSRPVVDDVSTVNDQSSKLLRRTISLPRGRAVKKLVLSERDEEVDNDVHRNKGTSEAVGDKQDYQERSIPKHKVDGGGSIAFAGGFMRGFGGRVGHVLAHAAKAVFVVASVVAFLAFTEHNHRRPVPSATTPVLVSESRPRPPSPLKCSPGKKRIVLDDGSEKCVVKERFEVPFCREVEAPYVLYGRG

SEQ ID NO: 88896 - protein, 510 aa, Gossypium hirsutum
MPSFDTILLRDLVAAACLFFITRYFIRRLLSNPKRTLPPGPKGWPIVGALPLLGSMPHVELAKLAKKYGPVMYLKMGTCNMVVASTPDAARAFLKTLDLNFSNRPSNAGATHIAYNSQDMVFAEYGPRWKLLRKLSNLHMLGGKALEDWSQVRAVELGHMLRAMCESSRKGEPVVVPEMLTYAMANMIGQVILSRRVFVTKGSESNEFKDMVVELMTSAGLFNIGDFIPSIAWMDLQGIEGEMKKLHNRWDVLLTKMMKEHEETAYERKGKPDFLDIIMDNRENSAGERLSLTNVKALLLNLFTAGTDTSSSIIEWALAEILKNPKILNKAHEEMDKVIGRNRRLEESDIPKLPYLQAICKETFRKHPSTPLNLPRVSTQACEINGYYIPKNTRLSVNIWAIGRDPDVWGNPLDFTPERFLSGRFAKIDPRGNDFELIPFGAGRRICAGTRMGIVLVEYILGTLLHSFDWMLPPGTGELNMDEAFGLALQKAVPLSAMVRPRLAPTAYVS

SEQ ID NO: 88897 - protein, 522 aa, Uromyces viciae-fabae
MPAVMAGPVSFAPPEGKSSKVAIVIAVFAAFGGFLYGYDTGYIAGVKAMPFWLRSAGQRGPDGKYMITTSQDSMVTSILSVGTFVGALLAYPIGDRFGRRIGIMIACAIFSVGVALQTASTKIPMFVVGRVFAGLGVGVASCLVPMYQSECAPKWIRGGIVACYQWAITIGLLVASITVNATKDFDSANSYRIPIGIQFIWAAILTIGLLVLPESPRYLLLKGREDEAWKSLSRLYSAPYDDPDVQAEFSEIMASLEKERSFGKTTLLDCFKTDKRKNLQRTLTGLGVQGWQQASGINFFFYYGTTFFKNAGIENAFLVTVATNVVNVVMTIPGIWAVDKVGRRTMMICGAAMMFTCELILACVGTFTATSNLASQKVLVAFSCIFIGLFAATWGPIPWVVTSEIYPLATRGKQMAMSTASNWAVNFFIGFITPYLVDSGAGQAGLGVKVFWLWAALCFGAMVFSFLLIPETKGLSLEQVDLLYTNSTVLKSNTYRSQLIANNLHEGMTPAEKAYQEKLEHI

SEQ ID NO: 88898 - protein, 319 aa, Mycobacterium avium subsp. paratuberculosis K-10
MRDDSPMARLTVIATGGTISTGTGADGVHRPCYSGADLTAPFRADHDVEVVDLLAVDSSELTLADWDRMRGAVTGALDGGGADGVVILHGTDTMEETALWLDLTYDGPAPVVLTGAMRSADAPDADGPGNVRDALAVAAHPAARGLGVLLCFAGRVLQPLGLSKVATEDLSGFAGRLVGTVAGDVALTGPKTRPYLGDLGAAAAPRVDIVAAYLGSDAVALDACVAAGARAVVLEALGSGNAGPAVVDAVRRHCGTGVVIAVSTRVPGGRVGASYGPGHEMAAAGAVPVPTLRPPQARVLLIAALAAGLPAADVLGRWG

SEQ ID NO: 88899 - protein, 311 aa, Zea mays
EPHIRSKRAPPDSFTTDGCCMIDRRMGVYGYPIEIQALFFMALRCALQMLKHDNEGKEFVEKIATRLHALSYHMRSYFWLDFQQLNDIYRYKTEEYSHTAVNKFNVIPDSIPDWLFDFMPCQGGFFVGNVSPARMDFRWFALGNMIAILSSLATPEQSNAIMDLIEERWEELIGEMPLKICYPAIENHEWRIVTGCDPKNTRWSYHNGRSWPAILWLLTAACIKTGRPQITRRAIDLAQRRLLKDGWPEYYDGKLGRYVGKQARKFQTRSIAGYLIAKMMLEDPSHLGMISLEEDRARLKPCFERAASWTN

SEQ ID NO: 88900 - protein, 340 aa, Pseudomonas fluorescens
MRALQLVDKQRLALRELVLPARPAPGHARVRMAFMTLNHLDLFGYRGMAFARRTLPVTVGAEGAGFVQDVGPGSDPELIGQAMAIYPSVFCGCCPACLAGRENLCADSPGVMGFHCDGVAAEYVDVPLRMLVPIPAGVPMDMAACAPVTFATVHHMLIDNARLMSGETLLVHAGGSGIGSIAIRLARHLGVTVFATVGRADKVERARALGAEYVIDYREERFLRVIREQTARRGVDVVFEHVGADTWEQSLLSLARGGRLVICGSTTGVEAPTNLMHLFNQQIHIHGSFGAPLSGLRDALALIQQGVLPVIDCVMPVAGFESGLQRLRERDVFGKIVLQF

SEQ ID NO: 88901 - protein, 305 aa, Glycine max
MAATSTSLFFSNLHSLNPQPFSSSLSFFRNVHSTLSFPSSSKPSRGVVAMAGSGKFFVGGNWKCNGTKDSISKLVSDLNSATLEPDVDVVVAPPFVYIDQVKNSITDRIEISAQNSWVGKGGAFTGEISVEQLKDLGCKWVILGHSERRHVIGENDEFIGKKTAYALSEGLGVIACIGELLQEREAGQTFDICFQQLKAFADAVPSWDNIVIAYEPVWAIGTGKVATPEQAQEVHAAVRDWLKKNVSAKVASKTRIIYGGSVNASNSAELAKQEDIDGFLVGGASLKGPEFATIINSVTSKKVAA

SEQ ID NO: 88902 - protein, 337 aa, Candida albicans SC5314
MKILYSFLMLFVVAFASLGDNLPEFQSCLYQCDCHVIPQSIFWSCPANCNYYCQQLITDQLESSNVPMVQFYGKWPFKRVLGVQEFFAMIFSIGNLYVNYKNLRIIYRQFKRNESEYKTMYVQYLILLIVTCIGWSFSVIFHFKDTTMSETLDYFGAFAIILCNLNAIVVRVFQLFKHRKKLIIWHTALVALYLYHVIRLKRNWDYSYNTLINIIVGVSAMILWCFHSWRVYRVYNQKRIIYNNSIQLLPYETKLLQKLSYVGMSLSSLIPLIPIFNNVMLLLGISLELNDFPPVARLVDAHALWHLVTIFPSIIWFDWNVWDIEMLKITNNSETKV

SEQ ID NO: 88903 - protein, 175 aa, Triticum aestivum
  misc_feature (62)..(62): Xaa can be any naturally occurring amino acid
  misc_feature (91)..(91): Xaa can be any naturally occurring amino acid
  misc_feature (105)..(105): Xaa can be any naturally occurring amino acid
  misc_feature (116)..(116): Xaa can be any naturally occurring amino acid
SPPEPPYERERERDIHHRAYVGHGQLHAIGHALHIFPRRKHSMTILHDVSGIIKPRRMTLLXGPPGSGKTTLLLALAGKLDKELKVQGRVXYNGYEMNEFVPERXAAYISQHDLQXGEMTVRETLAFQDAPRCWLPKLKVELIGRKGKSEDLRPNMDLMLFKASQGEGKNKVVTK

SEQ ID NO: 88904 - protein, 190 aa, Rickettsia sibirica 246
MFIQTEDTPNPDAITFFPGQEISSDQPVFFSELAEVKGRSKLAESLFYINNVKSVFFGSDFITVTKQAEGNWQVIKPEILMVIMDHFVSGFPVFEENTKADNVNHNLDGLSEIEKQIVEIIETRVRPSVAQDGGDIIYKGFENGVVKLALRGACLGCPSSTITLKNGIESMLKHFVPEVQEVEAVEEDFE

SEQ ID NO: 88905 - protein, 341 aa, Solanum chacoense
MAELLSNWSSTLEAVPPSHCIPVHERPSDPVEIVDSIPVIDLGKANGEERSAVVKDLLKAFEEYGFFQIINHGVPVDLMDEAMKVYKEFFSLPAEEKAEYAKDAANDTNRGAATLYSSSAKHYDSEEHRYWRDVLEHSCNLDGKDKKTWPSNPPRYREVIGAYGDELRRVSKVILGLLAEGLGLEAGFFDKELGQRMLVNHYPACPDPSLTLGVGGHCDPNLITIIQQEVYGLQILKDDKWIGVQPIRNAFVVNSGLPITVVSNGKLTSVAHRVVTNTTHSRTSIGTFICPHDIVEPAKALVGPENPPQFKSFNWGIDFMPHYLSKKSVYHASLEPFKIDA

SEQ ID NO: 88906 - protein, 312 aa, Synechococcus sp. CC9311
MSAAATSPESVPSSGELLSTFDFANYLKLSRDRVEIALDASMGPERPESLRDAMRYSLLAGGKRLRPILCLAACELVGGSSELAMPTAVALEMIHTMSLIHDDLPAMDNDDLRRGRPTNHKVYGDAMAILAGDAMLSRAFEMVAVRSANVPADRLLRVVGELALVSGAPGLVGGQVVDLESEGQAVDLETLEYIHLHKTAALLRACVVTGALIGGANDDQLQAMRTYANGIGLAFQIIDDILDVTASSEVLGKTAGKDLLADKTTYPKLLGLDASREKALQLVRESKAALEPWRDKAAPLLALADYVASRDC

SEQ ID NO: 88907 - protein, 583 aa, Saccharophagus degradans 2-40
MMEAEHTSMTIPYLYETIAFLLTVVIVVPLFKRIKMSPILGYLAVGAIIGPYGAAVIHDANAVQHFAELGVIILLFTIGLELSFARLKSFSKLIFGLGAAQVLVSASIISGLAFWWGNTIEAAVIIGLCLALSSTAMVMQILHERSESATTYGRASFAILLFQDLAVVPILILLTILGDTSSGDSSLWLTVGSALLKAAITIGFIIFVGRFLLSFLFRHVARLRNIDVFTALMLLVILATSVITGLAGLSMALGAFLAGLLLAETEFRHQIESEIAPFKGLFLGLFFMGVGMNLDLVMAFEYGVWVVLSVVGLLALKATIATLFARLFGLSWQDALRTGLIVSEAGEFAFVVIGQATLSYQLIEPNIGQFMVVVAGLSMIFTPFLAMFGKWLADKYNLSQTPNAAPDALHDHIIIAGFGRVGQAVAHILTQQSIPYIALDTNADEVRRLQKQGAHIFLGDASKQEVLHMASVDNASVLLVTMDDSHASIRTTHGARQHHPELKIVVRSKDEQHSTALLHAGANQVVPETLEASLQLCAHTLQASGMSREEATACVEIERSEAYSRLLHEAKAIGNQNPACDKP

SEQ ID NO: 88908 - protein, 216 aa, Arabis pumila
MSSFSAFSEMFGSDYESMISSVGDYSPTLATSCPKKPAGRKKFRETRHPVYRGVRQRNSGKWVSELREPNKKTRIWLGTFQTAEMAARAHDVAAIALRGRSACLNFADSVWRLRIPESACAKDIQKAAAEAALAFQNELMSDTATTDHGLDMEETLVEAIVTAEQIDTFYIDEETMFGMPSLMANMAEGMLLPLPSIQWINNYDVEGDADMPLWSY

SEQ ID NO: 88909 - protein, 218 aa, Candida albicans SC5314
MSVAKAVSKNVILLPQTNQLIGLYSIIRDQRTKRGDFVFYSDRIIRLLVEEGLNQLPVEEAIIKCHGGYEYKGAKFLGKICGVSIVRAGESMEMGLRDCCRSVRIGKILIQRDEETALPKLFYEKLPEDISERYVFLLDPMLATGGSAMMAVEVLLARGVKMDRILFLNLLAAPEGIKAFQDKYPDVKIITGGIDEKLDENKYIVPGLGDFGDRYYCI

SEQ ID NO: 88910 - protein, 542 aa, Saccharophagus degradans 2-40
MPGFCFPPIFLQSENTMPNTDIHSQRILILDFGSQYTQLIARRVREVGVYSEIRAWDVSDEEIKEFAPKGIILAGGPESVTAGFSPRAPQLVFELGIPVLGICYGMQTMAEQLGGKVESSNVQEFGYAQVKIENECALIKDIKDHVDDGGAALLDVWMSHGDKVVAMPEQFTLMASTPSCPIAGMAWEEKKFYGVQFHPEVTHTLQGKRIFEHFALELCGCEALWTAANIVEDAIGRVRAQVGDDKVLLGLSGGVDSSVVAALLHKAIGDKLTCVFVDNGLLRKNEGDQVMDMFAKNMGVKVIRADAADLFLGNLAGESDPEKKRKIIGNTFIDIFDQEASKLKDVKWLAQGTIYPDVIESAASKTGKAHVIKSHHNVGGLPEDMQFELVEPLRELFKDEVRKIGLELGLPYDMVYRHPFPGPGLGVRILGEVKKEYAEILREADAIFLEELHAAGWYHKTSQAFAVFVPVKSVGVVGDARRYAWVIALRAVETIDFMTARWAHLPYELLEKVSNRIINEISGVSRVTYDVSSKPPATIEWE

SEQ ID NO: 88911 - protein, 635 aa, Geobacter metallireducens GS-15
MYKLLDTITGPADLKNIPREELPGLADEIRRFLIETVSQTGGHLASNLGAVELSVALHYCFDSPADKLIWDVGHQAYTHKILTGRRESFHTQRQYKGISGFPKRSESPHDAFGAGHSSTSISAGLGMAAAQDLKGSGSRAIAVIGDGSLTGGMAYEALNQAGHLKKNLIVVLNDNEMSISQNVGAFSSFVSRKMTGSDFRKLKKEMQGLLENIPAIGKDILHFARRAENSLKGFLTPGMLFEALGFDYIGPIPGHDLPQLLEVFENVKGLEGPVLVHVMTTKGKGYQPAEENPAAFHGVGPFDVATGKTTGGKPGAASYTGVFGATLVKLAEEDEKIIAITAAMPDGTGLTPFAKRFPERFFDVGIAEQHALTFAAGLAADGFRPVTAIYSTFLQRAYDQVFHDVCLQKLPVTMALDRGGLVGDDGPTHHGTFDLSYLRHLPEMTLMAPKDENELQHMLKTAIYAGRPVALRYPRGAGYGLPLDQTIQSLEIGRGELLTEGDDVAIVAIGSTVYPAQEAAKLLEARGIRATVVNARFVKPLDRELILGAARRTGCIVTVEENALQGGFGSAVLELLADEGMTDVRAKRIGIPDRFIEQGPQPQLRKDLGLDGAGIAATVEAFLTAKGQAALSLVK

SEQ ID NO: 88912 - protein, 567 aa, Helicobacter pylori J99
MRRSFLKTIGLGVIALSLGLLNPLSAASYPPIKNTKVGLALSSHPLATEIGQKVLEEGGNAIDAAVAIGFALAVVHPAAGNIGGGGFAVIHLANGENVALDFREKAPLKATKNMFLDKQGNVVPKLSEDGYLAAGVPGTVAGMEAMLKKYGTKKLSQLIDPAIKLAENGYAISQRQAETLKEARERFLKYSSSKKYFFKKGHLDYQEGDLFVQKDLAKTLNQIKTLGAKGFYQGQVADLIEKDMQKNGGIITKEDLASYNVKWRKPVIGSYRGYKIISMSPPSSGGTHLIQILNVMENADLSTLGYGASKNIHIAAEAMRQAYADRSVYMGDADFVSVPVDKLINKAYAKKIFDAIQPDTVTPSSQIKPGMGQLHEGSNTTHYSVADRWGNAVSVTYTINASYGSAASIDGAGFLLNNEMDDFSIKPGNPNLYGLVGGDANAIEANKRPLSSMSPTIVLKNNKVFLVVGSPGGSRIITTVLQVISNVIDYNMNISEAVSAPRFHMQWLPDELRIEKFGMPADVKDNLTKMGYQIVTKPVMGDVNAIQVLPKTKGSVFYGATDPRKEF

SEQ ID NO: 88913 - protein, 728 aa, Halobacterium sp. NRC-1
MKTLERDLGLGAVFAISVGAMIGSGIFILPALALKMAGPAVIVAYLLAGLLVVPAALSKSEMATAMPEAGGTYIYIERGMGPLLGTVAGVGTWFSLSFKSALALVGGVPYLVLLFDLPVQPVALGLAALLIVVNLLGAKQTGRLQTVIVSLMLGALGWFVAGSAGQVQQANFQGFLTGGWEGLLAATGLVFVSYAGVTKVASVAEEVENPDRNLPLGILGSLAFTTLLYVGIVAVMVGVTDSGAVAGSATPVAVAADATLGTAGVYAVIAAAVLALVSTANAGILSSSRYPFAMSRDQLAPPTFAEIHDRFGTPTTAITLTGAVVLALIAFVPILDIAKLASAFQILVFVLVNLALVAFRTGTTDYDPDFESPLYPWMQGFGVLSGLALLTQMGWVPIAGAAVITLGSVVWYRVYARPRVRREGAATDVVRRRLGRDVLTETEALVDATGAEAGGPEVLVALTREASADRERALLSLAADRARNEDGQVVVVRFDEVPDQAPLDHAADVQSPADVRFEERTEGLSTEFDVDIAYGEVVSHDTKRAILNVAEQRSVDTVVAEHERLRLRSRLLGDPIDWVVRHAPCDVLLVENRGYDAPQNVVLEGDGGPYDPATVAVADAVAGAAGGTVTLQFPLSADHPDKRQETVHAYQDELAGLLSAPVRTADLRADGGDQTAPDLVVRTGAHRRVRGGRGSHTQTAADCTELTVYPHESRQPGLLRRLAERLVF

SEQ ID NO: 88914 - protein, 401 aa, Oryza sativa Indica Group
METSPAPRPAHIPRSTAVRPPCATPFSRAHWHTTCAAIRRVPRVNGDSNSSIKPALADHAAPPLDLDLLPVSNLPRPLTITDLSPAPMHGSQLRVAYQGVPGAYSEAAAAKAYPSCDAIPCDQFEVAFQAVELWIADRAVLPVENSLGGSIHRNYDLLLRHRLHIVGEVQLPVHHCLLALPGVRSDLLTRVISHPQALAQCELTLNAMGLNVAREAFDDTAAAAEHVAAAGLRDTAAIASSRAAELYGLQVLADGIQDDAGNVTRFVMLAREPIIPRTDRPFKTSIVFAHDREGTSVLFKVLSAFAFRDISLTKIESRPHRHRPIRLVDDANVGTAKHFEYMFYIDFQASMAEVRAQNALSEIQEFTSFLRVLGSYPMDMTPWEYSSSSSPSPAPGGDTSR

SEQ ID NO: 88915 - protein, 381 aa, Geobacillus kaustophilus HTA426
MIAQLAVILFAAKLAGDAAVRLGQPAVLGKLLIGIVLGPSVFGVIEDTDLLQELSQIGVILLMFIAGLETDMDQFRRTGKAAVAVGVLGILVPLLAGYAAGAAFGMETGTALFLGLLLSATSVSISVQALKEMGQLQSKEGSAILGAAVIDDVLVVIALAFLLSLTGGDVELGAVVLKKAVFFAVAILLAWKAIPLVLKWFAPLRVTEAVVSAGLVICFAFAYFAEAMGVAAIIGAYMAGLGASFTDYREEVFEKVETIAYSLFVPVFFTSIGVAADFSGIVEHWPLIVGWSALAILTKLVGAALGAKWAGFSWGSSLAVGAGMVSRGEVALIIAGIGLEAGLLDGNMFAVMIIVVLVTTVVTPPLLKMIFSRLHPVRRTA

SEQ ID NO: 88916 - protein, 406 aa, Oryza sativa Indica Group
METLPAPRPTQIPRSTAIRPPCATPFSRAHWQTTCAAILATTTTTNAKAYGAPRVNGDSIKPALADHAAPPLDLDLLPVSNLPRPLTITDLSPAPMHGSQLRVAYQGVPGAYSEAAAAKAYPSCDAIPCDQFEVAFQAVELWIADRAVLPVENSLGGSIHRNYDLLLRHRLHIVGEVQLPVHHCLLALPGVRSDLLTRVISHPQALAQCELTLNAMGLNVAREAFDDTAAAAEHVAAAGLRDTAAIASSRAAELYGLQVLADGIQDDAGNVTRFVMLAREPIIPRTDRPFKTSIVFAHDREGTSVLFKVLSAFAFRDISLTKIESRPHRHRPIRLVDDANVGTAKHFEYMFYIDFQASMAEVRAQNALSEIQEFTSFLRVLGSYPMDMTPWEYSSSGQTAGDTSSS

SEQ ID NO: 88917 - protein, 338 aa, Shewanella sp. MR-4
MIRVAINGYGRIGRSILRALYESGKRQQIQIVAINELAKPEAIVHLTQYDTTHGRFQPRVKLVDDQMLIGDDVIKILHEPDPAKLPWHEMDIDIVYEATGAILDRNSCEAHIHAGAKQVLISHPSSADVDGTIVYGVNQDLLRAEHTVVSNASCTTNCIVPVIDVLDKHFGVKSGAITTIHSAMNDQQVIDAYHDDLRRTRAAGQSIIPVDTKLARGIERILPHMKDKFEAISVRVPTINVTAIDLSVTLDKTVDIATVNQVLELAANGRFNGILGYTDEPLVSCDFNHDPRSSIVDGTQTRVSAGQLVKLLLWCDNEWGFANRMLDTSLAMIAAKQS

SEQ ID NO: 88918 - protein, 391 aa, Shewanella sp. MR-4
MAIINMSDLDLQGKRVLIREDLNVPVSNGVVTSDARLRASLPTIELALAKGAAVMVMSHLGRPTEGEYNSEFSMQPVVDYLAKALSCTVRLATDYLDGVEVAVGEVVVFENVRFNKGEKKNDEALSKKMAALCDVYVMDAFGTAHRAEASTNGVGLHAPIACAGPLLAQELEALGKALDNPARPLVAIVGGSKVSTKLTVLESLSGIVDQLVVGGGIANTFIAAAGHNVGKSLYEADLIDEAKRLVANAQSRGGDIPVPTDVVVAGEFSPTAAATLKAVNEVADSDMIFDIGPDSAEALAKIIESAGTIVWNGPVGVFEFDQFGEGTKRIAQAIADSKAFSIAGGGDTLAAVDKYDIADKVSYISTGGGAFLEFLEGKELPAVAMLKQRGA

SEQ ID NO: 88919 - protein, 346 aa, Sinorhizobium meliloti 1021
MKAMYYDAFEKMPEIRTLPDPAPTENGVVIKIEATGLCRSDWHGWMGHDPDIRLPHVPGHELAGTIAATGRGVLRYRIGDRVTVPFVSGCGRCFECSSGNSQVCEAQFQPGFTHWGSFAEYVAIDFAEQNLVHLPETMDFATAASLGCRFATSFRAVVDQARVKGGEWVAVHGCGGVGLSAIMIAAALGANPIAIDISEEKLAFARTLGAVATINGRETEDVAGAVRELTRGGAHVSLDALGSPVTCFNSIKNLRRRGRHVQVGLMLAEQATPQIPMAQVIGHELEIYGSHGMQAWRYDAMLAMITAGKLNPKALIGREISLEEAAPALAAMDRATDLGISVITRF

SEQ ID NO: 88920 - protein, 481 aa, Burkholderia xenovorans LB400
MAIPSYTDTRLLINGEWCDAASGKTLDVINPATGQAIGKVAHAGIADLDRALAAAQRGFEAWRKVPANERATTMRRAAALVRERASDIGRLMTQEQGKPFAEARIEVLAAADIIEWFADEGRRVYGRIVPSRNLAAQQLVLKEPIGPVAAFTPWNFPVNQVVRKLSAALACGCSFLVKAPEETPASPAALLQAFVEAGVPAGTVGLVFGDPAEISGYLIPHPVIRKVTFTGSTPVGKQLAALAGAHMKRATMELGGHAPVIVAEDADVALAVKAAGGAKFRNAGQVCISPTRFLVHNSIREEFAAALVKHAEGLKLGDGLAEGTTLGPLANARRLSAMSKVLDDARKTGAKVETGGERVGSEGNFFAPTVLTNVSLEADVFNNEPFGPIAAIRGFDKLEEAIAEANRLPYGLAGYAFTKSFSNVHLLSQQVEVGMLWINQPATPSPEMPFGGVKDSGYGSEGGPEAMEGYLVTKAVSVMAV

SEQ ID NO: 88921 - protein, 464 aa, Escherichia coli
MSSPLIPVILSGGNGTRLWPLSREEYPKQFLKLTDSISMLQSTISRLDSLNTSSPVVICNELHRFIVAEQLRHLNKLDNNIILEPSGRNTAPAICIAALILKMKHPNENPLMLVLPADHSVKKVKTFCNTIKSAIPFAEAGNLVSFGIKPTHPETGYGYIQKGKVLSDSDIYEVSEVRTFVEKPNLKTAESFIEKDEYYWNSGMYLFSVERYLQELSLYRPDIVKVCQETVKNIHYDMDFIRLDDKIFRNCPQESIDYAVMEKTKDAVVATMDIGWNDVGAWSSLWELGKKDSSGNVITGDIVCHETENSYIYTESGLVATIGIQDLVIIHTKDSLLVSRRDSVQNVKNIVQHLDLSGRKEHKEHREVFKSWGRCDSIDSSEKYHYQVKRITVNPSENYRCNYIITVRNIGVVVMGIAKLTVAEEIKILKENESVYIPAGIKHSLKILDNTTCVNRSLDRFLSC

SEQ ID NO: 88922 - protein, 471 aa, Escherichia coli
MLLPVIMAGGTGSRLWPMSRELYPKQFLRLFGQNSMLQETITRLSGLEVHEPMVICNEEHRFLVAEQLRQLNKLSSNIILEPVGRNTAPAIALAALQATRHGDDPLMLVLAADHIINNQPVFHDAIRVAEQYADEGHLVTFGIVPNAPETGYGYIQRGVAVTDSAHTPYQVARFVEKPDRERAGAYLASGEYYWNSGMFMFRAKKYLSELAKFRPDILEACQAAVNAADNGSDFISIPHDIFCECPDESVDYAVMEKTADAVVVGLDADWSDVGSWSALWEVSPKDGQGNVLSGDAWVHNSENCYINSDEKLVAAIGVENLVIVSTKDAVLVMNRERSQDVKKAVEFLKQNQRTEYKRHREIYRPWGRCDVVVQTPRFNVNRITVKPGGAFSMQMHHHRAEHWVILAGTGQVTVNGKQFLLSENQSTFIPIGAEHCLENPGCIPLEVLEIQSGSYLGEDDIIRIKDQYGRC

SEQ ID NO: 88923 - protein, 462 aa, Bacillus cereus E33L
MNKTSKAYSAIEDIKHNFLEVKPDLTFKEVIEEANRCLYCYDAPCIKACPTSIDIPSFIKKITTDNLKGSARVILEANPVGATCARVCPTEELCEGACVLNEASQPIKIGDLQRHVTNWTMKNEVQLFKEGEKKGKTIAIVGGGPAGLSTARELARLGYAVTIFEAKEKAGGLDTYGIVSFRLPQEVSLWEVDQIKKLGVKILTNTKVGKDITVSELMNNFDVIVLAIGMASVPNLNIEGENLEGVYDAIQFVEDTKSKEPTSRFLGSRIAVIGAGNTAIDAATCSVRLGAENVKMIYRRTQEEMPAYQFEYEFAKQGGVEFKWLTQPKRIIGNENGHVKQLESIRMELGAEDSSGRRRFIPIEGSEFIFEVDAVIKAIGQTRYIKLIEEFGLLHNKGIVKINPKTKQTSNPKIFAAGDVVFDDDQGEAMVVSAAEQGKQTAYAIHKYVFGYKLDGVMKEVL

SEQ ID NO: 88924 - protein, 307 aa, Bacillus cereus ATCC 14579
MRVAQSVSELIGKTPIVKLNRIVESDSADIYLKLEFMNPGSSVKDRIALAMIEDAEKKGLLKEGDTIIEPTSGNTGIGLAMVAAAKGYNAILVMPETMSIERRNLLRAYGAELVLTPGPEGMGGAIRKATELAKEHGYFIPQQFKNQSNPEIHRLTTGPEIIEQMGDQLDAFIAGIGTGGTITGAGEVLKEAYKDIKIYAVEPADSPVLSGGKPGPHKIQGIGAGFVPETLDVEVYDEIIQVKTEQAFEYARRVAKEEGILVGISSGAVIYAATEVAKKLGKGKKVLVIIPSNGERYLSTPLYQFES

SEQ ID NO: 88925 - protein, 329 aa, Coccidioides immitis RS
MAKPVSITSSEQFFQLLTSTKILIADFYADWCQPCKVIAPVFEQLSTQLSRPNQVSFVKINVDEQQEISQAFGVTAMPTFLIFKDGDVVQTIQGANSRGLTDAVRKFAAGGEGGDTGAAAGGESSESGSNWLGAAVPKGYQDITDQVDLKGIDLLNCDNDIGPGKNIFERSQPSALKPKAKEESKPDWVESDTDEQLMLFMPFNASLKIHSLHITSLPPKDEDDEVPMRPKTIKLYTNRSHIIGFDEADDVQPTQEVTIEPRDWDAKTGTAKVDLRFVKFQRVASLVVYFVDGDGDGEKIRVDRIRLFGDSGEKMEMGKLEKFGEPGGE

SEQ ID NO: 88926 - protein, 467 aa, Listeria monocytogenes str. 4b F2365
MLYSEDDKRKQESYRIPLFGSEEESTSIPKYVLKKEPMEPRIAYQLVKDQLMDEGNARQNLATFCQTYMEKEAEILMAETLEKNAIDKSEYPQTAELENRCVNILADLWNAPKDMSYLGTSTVGSSEACMLGGLAMKFRWRNHAEKRGLDIQAKRPNLIISSGYQVCWEKFCVYWDVDMRVVPMDKEHLSIDVDKVFDLVDEYTIGIVGILGITYTGKFDDIQLLDEKVEAYNEANEHQLVIHVDGASGAMFTPFVNPELPWDFRLKNVVSINTSGHKYGLVYPGVGWILWKDKEYLPKELIFEVSYLGGSMPTMAINFSRSASQIIGQYYNFLRYGFEGYREIHEKTKKTALYLAKSVEKSGYFEIINDGANLPIVCYKMKEGLDVEWTLYDLADQLLMKGWQVPAYPLPADLSDTIIQRFVCRADLGYNVAEEFAVDFADALHNLEHARVLYHDKERNDSYGFTH

SEQ ID NO: 88927 - protein, 545 aa, Acidobacteria bacterium Ellin345
MISFSNINKQYGKQLLFVDASFQLNPGEKVGLVGPNGAGKTTLFRMVVGEEAPDEGAVSVPRKITIGYFRQDVEEMQGRSVLDEAIAGSGRVGNLHHELEALHQEMSDPDKTDEMDRILERFGHVQEEYEHLGGYALESQAREVLHGLGFKDDQIDGDVGALSGGWKMRVALARVLLGMPDVLLMDEPTNHLDIESIIWLEKFLKSFPGALLMTSHDREFMNRLVSKIAEIDGGEIITYSGNYDFYERERAIRETNQQAAFARQQSMLAKEQRFIDRFRTHAAKAAQVQSRIKALDKIEKIELPKKRQVVKFDFRVPPRSGEQVAVLENLHKSYGPRVIYEGFNLTIRRGERWAVMGRNGAGKTTLLKMIAGASAPDAGNVRLGASLYMGYFAQQSLDVLNPDLTVIEQLQQDFPQDGLGVLRNLAGAFQFSGDDVDKKIRALSGGEKSRLAIARMLYNPPNFLVLDEPTNHLDLATKEMLVDALKDFEGTMIFVSHDRTFLRGLGSRVLELGGENGTDRHPTVYPGSYVEYVQKLGHEAPGIYS

SEQ ID NO: 88928 - protein, 461 aa, Pyrococcus furiosus DSM 3638
MKTLILAGGKGTRLWPLSRELMPKQFIKVFSNKSLFQKTVERALIFSKPKEIFVVTNKEYRFRVLDDLNEIGVNIPEENILLEPVGKNTLPAIYWGLKVIDESFGDSIVAVLPSDHAIDVNENYIEAFKKAEKLAENYLVTFGIKPTKPHTGYGYIKPGEKISNLGFLVDEFKEKPDLETAKRYVENGYYWNSGMFMFRTTLFMEEARKHAPDVVKAFEEGKTIEEAYELAPEISVDYGIMEKTDKAAVVPLNTYWNDLGSFDAVYEALQKDENGNAVEVRGFKAKYINVDSKNNLILTERLTATVGVEDLIIVDTGDALLVAKKGETQKVKEVYKKLKEENDERAIVHRTAYRPWGSYTVLEEGERYKIKRITVLPGKRLSLQLHYHRSEHWVVVRGTAKVRVGDKEFILRPGESTFIPAGVIHRLENPGKVVLEVIETQIGEYLGEDDIVRIEDDYQRA

SEQ ID NO: 88929 - protein, 178 aa, Triticum aestivum
MAPDVMASSDTTVAPFQGLKSTDGLPVSRRSSGSLGYVSNGGRIRCMQVWPIEGIKKFETLSYLPPLSTEALLKQVDYLIRSKWVPCLEFNKVGFVFRDHNSSPGYYDGRYWTMCKLPMFGCTDATQVLNEVEEVKKEYPDAYVRVIGFDNLHQVQCVSFIAFRPPGCEESGKAYTTS

SEQ ID NO: 88930 - protein, 532 aa, Streptomyces avermitilis MA-4680
MTVLASALDTTGPEYAANREAMLGKLAQLTAEHAKALAGGGEKYVARHHKRGKLLARERIELLLDPDTPFLELSPLAAWGSEYAVGASLVTGIGVVEGVECLITANDPTVRGGASNPWSLKKALRANDIAYANRLPCISLVESGGADLPSQKEIFIPGGAIFRDLTRLSAAGIPTVAVVFGNSTAGGAYIPGMSDHVIMVKERAKVFLGGPPLVKMATGEESDDESLGGAEMHARVSGLADYHAVDEQDALRQARRVVARLNHRKAYGDPGPAVPPKYDEDELLGIVPGDLKVPFDPREVIARVVDGSDFDEFKPLYGTSLTTGWATLHGYPIGILANAQGVLFSQESQKAAQFIQLANQRDIPLLFLHNTTGYMVGKEYEQGGIIKHGAMMINAVSNSKVPHLSVLMGASYGAGHYGMCGRAYDPRFLFAWPGAKSAVMGPQQLAGVLSIVARQSAAAKGQPYDEDADAALRAMVEQQIESESLPMFLSGRLYDDGVIDPRDTRTVLGLCLSAIHTAPYEGVRGGFGVFRM

SEQ ID NO: 88931 - protein, 315 aa, Pyrococcus furiosus DSM 3638
MVVSLAGRDLLCLQDYTAEEIWTILETAKMFKIWQKIGKPHRLLEGKTLAMIFQKPSTRTRVSFEVAMAHLGGHALYLNAQDLQLRRGETIADTARVLSRYVDAIMARVYDHKDVEDLAKYATVPVINGLSDFSHPCQALADYMTIWEKKGTIKGVKVVYVGDGNNVAHSLMIAGTKLGADVVVATPEGYEPDEKVIKWAEQNAAESGGSFELLHDPVKAVKDADVIYTDVWASMGQEAEAEERRKIFRPFQVNKDLVKHAKPDYMFMHCLPAHRGEEVTDDVIDSPNSVVWDQAENRLHAQKAVLALVMGGIKF

SEQ ID NO: 88932 - protein, 573 aa, Streptomyces avermitilis MA-4680
MTTDRNKTAERDTTHKPLRVTARGRAVLADPRLNRGTAFTDEERRALGLVGLVPPRVLTQDEQADRAYAQFREQPGDLAKNVYLTALHDRNEVLFYRLVGDHLEEMLPIVYTPTVGTAIKRYSYEYRRPRGIYLSVNAPDDIERSLRAAGLGADDVDLIVATDGEGILGIGDWGVGGIDIAVGKLAVYTAAAGVDPRRTLPVMLDVGTNRQELLDSPLYLGNRHPRVDRDTYDAFIDAYVTAATKLFPRALLHWEDFGPANARRIFNHYRDDVFTFNDDIQGTGAVNLAAVLSGAKAGDLPLRDHRIVVLGAGSAGIGVADQLRDALVAEGLSSDEATARFWCVDRYGLLTADQGDKLRDFQVPYARPADEVSDWQRDDDLPGIPLDEVVRRVHPTILIGTSGQGGAFTETVVREMAAHTPRPIILPMSNPTDLAEAKPADLLAWTDGKALVATGSPFDPVELNGTTYRIGQANNALIFPGLGLGAIVARATRVTDRMLRAAADAVANQTDVTDPGAPVLPPVRDLRETSFAVAVAVARAAAEDDVARAGTDDIEAAVRAVTWEPVYPPVQAV

SEQ ID NO: 88933 - protein, 256 aa, Triticum aestivum
MAPRKFFVGGNWKCNGTGDDVKKIVTFLNEAEVPSEDAVEVVVSPPFVFLQQAKGLLRPDFAVAAQNCWVRKGGAFTGEISAEMLVNLQVPWVILGHSERRALLNESNDFVADKVAYALAQGLKVIACIGETLEQREAGTTMEVVSAQTKAIAEKTSDWTNVVLAYEPVWAIGTGKVASPAQAQEVHDGLRKWLHANVGPAVAESTRIIYGGSVNGANCKELAAQPDLDGFLVGGASLKPEFVDIIKSATVKSSSA

SEQ ID NO: 88934 - protein, 318 aa, Arabidopsis thaliana
MAGGGNRRDEGSITIQSTNLFAALDTRKKKKKSDKAGKSKGSSKSREPEKEPEPQVYWAPTPLKVKSWADIDDEDDDDDYYATTAPPQSGWSTSLPSHTDSKDVHVEESESEEDILDEGDDDVEEEQEQETEVQVHPEPEVKKAPEVPAPPKEAERQLSKKERKKKELAELEALLADFGVAPKENNGLEESQEAGQEKKEDVNGEGEKKENAAGGESKASKKKKKKDKQKEVKESQEQQANNNADAVDEAAGSEPTEEESPIDVKERIKKLASMKKKKSGKEVDAAAKAAAEEAAARRKKLAAAKKKEKNHYNQQPVR

SEQ ID NO: 88935 - protein, 366 aa, Erythrobacter sp. SD-21
MGFRCGIVGLPNVGKSTLFNALTETQAAQAANYPFCTIEPNVGQVSVPDERLDKIAAIAGSAKIIPTQLAFVDIAGLVKGASQGEGLGNQFLGNIREVDAIVHVLRCFEDDDIQHVANKVDPITDAEVVETELMLSDLESLEKRVPAAEKRATAGDKESKIIASVLGQALALLRDGKPARLTEPNDEEEARVLRQAQLLTAKPVLYVCNVGEEDAAKGNAFSDLVFEKAKAEGAQAVVVSAAIESELVAMDAEDRAEYLAELGLEESGLSRVIKAGYKLLGLNTFFTAGPKESRAWTFPEGAKAPQAAGEIHTDFERGFIRAETIAYEDYIALNGESGARDAGKLRQEGKEYLVRDGDVMLFKFNV

SEQ ID NO: 88936 - protein, 425 aa, Bacillus subtilis subsp. subtilis str. 168
MMNKDITAQSPRSKAVQDALDGKIRGFRGLLPFLGPAFIAAIAYIDPGNFATNISAGSKYGYMLLWVILFSNIMALLIQSLSAKLGIATGKNLPEVAREEFPKPVSIGLWIQGELVIIATDLAEFIGAALGLYLLFGIPMLEASIIAAIGSFAILELQRRGYRSLEAGIAGMLFVVVIAFALQTFFAKPDAVSVMKGLFVPAFHGTDSVLLAAGILGATVMPHAIYLHSALTQRRVVGKTDAERKKIFRFEFIDILIAMLIAGAINASMLIVAAALFFKNGLFVEDLDVAFQQFGHLVSPMSAALFGIGLLVAGLSSSSVGTLSGDVIMQGFINYRIPLYVRRFITIIPPILIIASGVNPTTALVLSQVVLSFGIAFALIPLIMFTSNKRIMGSLINAKWITVVSWLIAVLIVALNVFLIVDTFR

SEQ ID NO: 88937 - protein, 401 aa, Coccidioides immitis RS
MASGNSLSTYFVVRFLLSRLEFDPESQKHEDAKRKSAAILRRLDRGDDSDDSSSSRQKRSQKQKKQDLVLTQYEQAIAMDVVAPEDIPVSFNDIGGLDDIIEELKESVIYPLTMPHLYRSSSSLLSAPSGVLLYGPPGCGKTMLAKALAHESGACFINLHISTLTEKWYGDSNKLVNAVFSLARKLEPSIVFIDEIDAVLGTRRSGEHEASGMVKAEFMTHWDGLTSANAMGQPQRVMILGATNRIQDIDEAILRRMPKKFPVTLPAAAQRRRILGLVLKDTKIERENFDVDLLVQAMAGMSGSDIKEACRDAAMVPVRELIRSKRDAGALINSMNPDEVRGLRTDDFFKKAGGVRPTNPYSEAIQRASHKLQSEKEWVTDSEPDNVEAEARIVPVADGPD

SEQ ID NO: 88938 - protein, 415 aa, Arabidopsis thaliana
MGACISFFSSSSPSKTAATTNNHSNGTEFSSTTGATTNSSVGQQSQFSDISTGIISDSGKLLESPNLKVYNFLDLKTATKNFKPDSMLGQGGFGKVYRGWVDATTLAPSRVGSGMIVAIKRLNSESVQGFAEWRSEVNFLGMLSHRNLVKLLGYCREDKELLLVYEFMPKGSLESHLFRRNDPFPWDLRIKIVIGAARGLAFLHSLQREVIYRDFKASNILLDSNYDAKLSDFGLAKLGPADEKSHVTTRIMGTYGYAAPEYMATGHLYVKSDVFAFGVVLLEIMTGLTAHNTKRPRGQESLVDWLRPELSNKHRVKQIMDKGIKGQYTTKVATEMARITLSCIEPDPKNRPHMKEVVEVLEHIQGLNVVPNRSSTKQAVANSSRSSPHHYRYKAGALGAERKRATPGRFGSVEK

SEQ ID NO: 88939 - protein, 217 aa, Glycine max
MSLLSRIRHYLPNGLCRQPLHPTVVRLNASNLNVFSRHFGQPARKEEEEEDVEEVEINQRSLPADFDPATFDPNDHRGPPSERVFRLVDEVASLTVAEAAELGLTLMKKMGVKEMPNVGFMKAGAGNLAGMAAKAPTAAKEEQKPEKTVFELKLESYEAASKIKIIKEVRGFTDLGLKEAKDLVEKTPAVIKKGVSKEEGEQIIEKLKALGAKVVME

SEQ ID NO: 88940 - protein, 469 aa, Helicobacter pylori J99
MKAMEGKIIQVLGPVVDVEFESYLPAIFEALDINFEVNGTQKALVLEVAAHLGGNRVRAIAMDMTEGLVRNQAVKARGKMIEVPVGEEVLGRIFNVVGESIDNLEPLKPSLTWPIHRKAPSFEQQSTKTEMFETGIKVIDLLAPYSKGGKVGLFGGAGVGKTVIIMELIHNVAYKHNGYSVFAGVGERTREGNDLYFEMKEGGVLDKVALCYGQMNEPPGARNRIAFTGLTMAEYFRDEKGLDVLMFIDNIFRYAQSGAEMSALLGRIPSAVGYQPTLAGEMGKLQERIASTKNGSITSVQAVYVPADDLTDPAPASVFAHLDATTVLNRKIAEKGIYPAVDPLDSTSRILSPQMIGEKHYEIATGIQQVLQKYKDLQDIIAILGLDELSEEDKKTVERARKIEKFLSQPFFVAEVFTGSPGKYVTLQETLEGFGGILEGKYDHIPENAFYMVGSIQEVLEKAKNMKNS

SEQ ID NO: 88941 - protein, 573 aa, Geobacillus kaustophilus HTA426
MEKTIHGIAASSGIAIAKAYRLETPHLAAEKRTVADVEAEIARLEAAVAKAKEELEAIKQHALEKLGEDKAAIFAAHLLVLDDPELLNPIKEKIKTEQVNAEYALHETASFFISMFEGMDNEYMKERAADIRDVTKRVLAHLLGVTISNPSLISEEVVIIAEDLTPSDTAQLNRQYVKGFATDIGGRTSHSAIMARSLEIPAVVGTKAITAEVQNGDIVIVDGLDGQVVVNPSPELLARYEEKRARYEEQKAEWAKLVDQPTVTADGVHVELAANIGTPDDVKGALANGAEGIGLYRTEFLYMGRSELPTEDEQFAAYKTVLEQMGGKPVVVRTLDIGGDKELPYLHLPKEMNPFLGFRAIRLCLEMQDMFRTQLRALLRASVHGNLKIMFPMIATLDEFRQAKAILLEEKEALLRQGVPVADGIEVGMMVEIPAAAVMADQFAREVDFFSIGTNDLIQYTMAADRMNERVSYLYQPYNPAILRLISYVIDAAHREGKWVGMCGEMAGDPIAIPILLALGLDEFSMSATSILPARAQLKRLSKEDAVCVKETVLSLGTAEEVVSFVKRTFHMA

SEQ ID NO: 88942 - protein, 588 aa, Burkholderia sp. ICD
MTPSEAFVETLAANGVTEMFGIMGSAFMDAMDIFAPAGIRLIPVVHEQGAGHMADGYARVSGRHGVVIGQNGPGISNCVTAIAAAYWAHSPVVMITPEAGTMGIGLGGFQEAKQLPMFQEFTKYQGHVTHPARMAEFTGRCFDRALAEMGPTQLNIPRDYFYGQIKAEIPQPQRLDRGPGGDQRLDEAAELLAQAKFPVIISGGGVVMGDAIEECKALAERLGAPVVNSYLHNDSFPANHPLWCGPLGYQGSKAAMKLIQRADVVVALGSRLGPFGTLPQHGMDYWPQNAKIIQIDADHKMLGLVKKISVGICGDAKAAAKALTQRLEGRTLVCDASREERAGEIAAEKAAWEKELDGWTHERDPYSLDMIEEQKGERTPGGGNYLHPRQVLRELEKAMPEDVMVSTDIGNINSVANSYLRFNKPRSFFAAMSWGNCGYAFPTIIGAKVAAPHRPAVSYAGDGAWGMSLMETMTCVRHNIPVTAVVFHNRQWGAEKKNQVDFYNRRFVAGELDNQSFAGIARAMGAEGVTVDRLEDVGPALKRAIDAQMNHGKTTIIEIMCTRELGDPFRRDALAKPVRLLDKYKDYV

SEQ ID NO: 88943 - protein, 285 aa, Burkholderia sp. ICD
MKAINRIIERARISPRRIVLCEAEDPRMLEAAQRASREGIAHIVLVGPSERIRAAAAGHNIDLSGMELVDPAISPLAPSLTEALFALRSKKGMTLEQAQQEILKPLCFANLMVRLDHADGSVAGAVHTTADVVRTAIQIIGIHPSFKLVSSFFLMMLCEPFHTLKGGLIFSDCGLVVDPDAGELAQIAMAAADSAQSLLMEEPRVAMLSFSTSGSARHAAVDKVVEATRQVRAARPHLAIDGDVQLDAALVSEIAMRKIEHSQVQGHANVLIFPSLEAGNIGYKL

SEQ ID NO: 88944 - protein, 195 aa, Bacillus cereus ATCC 14579
MILMIDNYDSFTFNLVQFLGELGQELVVKRNDEVTISDIENMKPDFLMISPGPCSPNEAGISMEVIKYFAGKIPIFGVCLGHQSIAQVFGGEVVRADRLMHGKTSLMHHDGKTIFSDIPNPFTATRYHSLIVKKETLPDCLEVTSWTEEGEIMALRHKTLPIEGVQFHPESIMTSHGKELLQNFIRKYSPSATLC

SEQ ID NO: 88945 - protein, 490 aa, Sinorhizobium meliloti 1021
MTAFRFDNSYARLPANFYARVQPTPVAEPWLIKLNRPLAGELGLDAEALERDGAAIFSGNLVPEGAEPLAMAYAGHQFGTFVPQLGDGRAILLGEVTDAGGRRRDIQLKGAGQTPYSRRGDGRAALGPVLREYIVSEAMHALGVPTTRALAATATGQPVYREQILPGAVFTRVAASHIRVGTFQFFAARGDMESIRTLADYVIGRHYPELKTDEKPYLALLKAVAARQAALIARWLHVGFIHGVMNTDNMTISGETIDFGPCAFMDDYDPKTVFSSIDQFGRYAYANQPAIGQWNLARLAETLVTLFDPVADTAVNLANDALGEYGTIFQKHWLDGMRRKIGLLTDEDEDLDLVQSLLTLMQNGKADFTLTFRRLAASAENATADTELASLFEEPQALSPWLEHWRRRLEREPQPATERAAAMRSVNPAFIPRNHRVEQAIAAATEDADFSLFEALLDVTSRPYEDQPGHAAYAAPPEPGEEVLQTFCGT

SEQ ID NO: 88946 - protein, 120 aa, Bacillus cereus ATCC 14579
MDKIYIHDMEFYGYHGVFPEENKLGQRFKVDLTVELDLKRAGESDDLEHSVNYGELFELCRKVVEDRKYKLVESIAENIAADILKQYESISRCTIKVIKPDPPIPGHYRAVAVEITRERP

SEQ ID NO: 88947 - protein, 439 aa, Xanthomonas axonopodis pv. glycines
MSSTVPPLSFVRILALNAGFFGVQYSFGLQQSNMSPIYNYLGADHANLPYLWLAGPITGLVLQPFVGAWSDRSVTRWGRRMPYMVLGALVCSLCLLAMPFSTALWMAVCLLWVLDAANNVAMEPYRALVSDVLTPPQRPLGYLTQSAFTGLAQTLAYLTPPLLVGMGMNQDAANAHHIPYVTIAAFVIGAGFSAGSILLTARSVREPAITPAEIARIRQSGAGLGATVREIGSALREMPPTMRQLAPVMLFQWYAIFCYWQYIVLSLSTTLFGTTDPTSHGFREAGLVNGQIGGFYNFVAFLAAFAMVPVVRRFGPKYTHAACLVAAGIGMWLLPGIENRWLMLLPMIGIGLAWASMMGNPYLMLADSIPPERTGVYMGLFNLFIVLPMLIQIVTLPLYYEHVLHGDPRNVVRLAGALMLAAAAAMLCVRLRKPKAVAA

SEQ ID NO: 88948 - protein, 427 aa, Mycobacterium avium subsp. paratuberculosis K-10
MSAELSQSPSVAPLSAADIDDAAKRIAAVVTPTPLQFSDRLSAITGAQVYLKREDLQIVRSYKLRGAYNLLVQLSETELAAGVVCSSAGNHAQGFAYACRMLQVHGRVYVPAKTPLQKRDRIRYHGGEFIELIVGGTTYDQAAEAALADVASTGATLVPPYDDLRTIAGQGTIAVELLDQLDTEPDLVVVPVGGGGCIAGITTYLAERTDTTAVLGVEPAGAAAMMAALAAGEPVTLDHVDQFVDGAAVRRAGDLTYAALAAAGDMVSITTVDEGAVCTAMLDLYQNEGIIAEPAGALSVTGLLEADIEPGSTVVCLISGGNNDVSRYGEVLERSLVHLGLKHYFLVDFPQEPGALRRFLDEVLGPNDDITLFEYVKRNNRETGEALVGIQLGSSADLDGLLARMRATELHVETLKPGSPAYRYLLL

SEQ ID NO: 88949 - protein, 353 aa, Cryptococcus neoformans var. neoformans JEC21
MSGLSYCPRVGGYLKLSRTPTFTILPIFNSLIMSAPTSFKLNTGASIPAIGLGTWQAKAGEVRQAVAHALKAGYRHIDGALCYQNEDEVGLGIKDSGVPRSEIFLTSKVWSSYHDRVEECLDTTLKSLQTDYLDLYLIHWPVRLAPNGTHPLFPVKPDGSRNLDWDWDQAKTWAQMEDVLKKGKAKAIGLSNAGIPIIEHIIKTGKVTPAVNQVELHPYCPQHALLKYCKEKGILLEAYSPLGSTSSPLHEDPDLLAVAKKHNVPTATVLISYQVNRGVVVLPKSVTPARIESNLKTIKLDEEDMNKLDKLAEGGKQTRFTAPPWGSDFGFPDWFGPGNKDAPEGARLLAGKA

SEQ ID NO: 88950 - protein, 334 aa, Aspergillus oryzae
MSMSLPPTMKGVRIRQQGDPANMVIETGLPLPTVKDTDVLVKLHYSGVNFIDIYQRTGVYGVQVPFTAGREGAGTIVQVGAKVTSSYGLKVGDRVAVFTQGAFAEYVAAPAEGVMRLPPSVSTKVGAAVMLQGLTAWTMVQESHKVSSGQIILVQAAAGGTGGLLVQMCKYLGATVIGAVSSVEKAKVAEENGCDHIILYKTTNVEEQVMRLTGNKGCHAVFSGVGQSTFNADLACTRRKGTLVSYGNSSGVVSNFSILLLSKKNVKLVRPTLANYIAEREEFVERSTQLLKLLEDGAIHMRLGGEYELEDVQKAQDALTGQKTMGKLLINLQA

SEQ ID NO: 88951 - protein, 230 aa, uncultured archaeon
MEIEPADLWRILKASGIKYVKFIIVDINGSPRSEIVPIDMAKDFIDGMPGDASSIPSYSTVNRSDFVAYVDPRAVYIEYWQDGKVADVFTMVSDITDKPSPLDPRRLLNDVLGSAKSKGYEFLMGVEVEFFVVKEDGGKPVLADLGIYFDGWNVTEQSQFMKELITAIAEAGINYTKTHHEVAPSQYEINIGAADPLRLADQLIYFKIMAKDIAQKYGLRATFMPKPFWG

SEQ ID NO: 88952 - protein, 365 aa, Cryptococcus neoformans var. neoformans JEC21
MADSSPADNLSPKAVQEQLPSPDAHGAEHQLSLRSLVSTKEAGIIIGKSGATIATIRDSTGVKAGVSKVVQGVQDRVLSVTGDLEGVASAYAEVARLLLETPLSDSSLPPPPVGSFTSIRLLISHNLMGTVIGRSGLKIKQIQDMSGARMVASKEMLPQSTERVVEVQGSVDAIKTAVLEIGKCLLEDWDRGAGTVLYHPGAAGDAGVLAGGLGAQAVTGSTGGIRRTSVAAGFGGYSGDRRPSRGGSISGPSGVSGERRPSEGPQVNLNDPNLRTQNISIPSDMVGCIIGRGGSKITEIRRLSGSRISIAKVPHDETGERMFTIQGTPEATERALMLLYSQLESEKERRVNGSNSEVPASADFA

SEQ ID NO: 88953 - protein, 228 aa, Brassica napus
CSECSPFGKGRSEGNKGMKSLLGGKGANLAEMASIGLSVPPGLTISTEACQQYQVAGKKLPEGLWEEILEGLSFIERDIGASLADPSKPLLLSVRSGAAISMPGMMDTVLNLGLNDQVVVGLAAKSGERFAYDSFRRFLDMFGDVVLGIPHAKFEEKLESMKESKGVKNDTELSATDLKELVEQYKSVYLEVKGQEFPSEPKKALELAIESVFDSWDSPRAIKYRSIN

SEQ ID NO: 88954 - protein, 408 aa, Glycine max
MEVVLKELHADLQSLSQSLPDPSHHDLLRKIQLRVEDLAKLAEAAPVRRSKVEDMSAEVVDSNPYSRLMALQRMGIVDNYERIRDFSVAIVGVGGVGSVSAEMLTRCGIGRLLLYDYDKVELANMNRLFFRPDQVGMTKTDAAVQTLSDINPDVVLESYTLNITTVTGFETFMSSLKNKSLRPNKQGSGVDLVLSCVDNYEARMAVNQACNELSQTWMESGVSEDAVSGHIQLLIPGETACFACAPPLVVASGVDERTLKREGVCAASLPTTMGVVAGLLVQNTLKLLLGFGQVSPYLGYNSLKDFFPTMQMKPNPQCSNVACLERQEEYLFAKPARDAAAKAKGEAEAPSTEEVPLHEDNEWNIRRLMILFLIIFMCVTEDTKHLSRPLDPKFSKFIHRTFMLKKSC

SEQ ID NO: 88955 - protein, 272 aa, Xylella fastidiosa 9a5c
MAGTSAVITIPSDLRESVIAIATDSGRAIMEIYQDHFQVQIKADMSPLTQADLTSHQIIVHGLKQLTPSLPVLSEESTGITWEERRHWTSYWLVDPLDGTREFVKRNGEFCINIALIHEGIPVYGMILAPVEGTIWHAMHGGQAFRRDGHRDTTLHVRAPAGTALQVAASRSHIDVHTSALLAQMKEITLVSQGSALKFCRLAEGTLDVYPRLGATYEWDTAAGQCLLLAAGGTLLNIETGKPFRYNKRETLLNNGFIALGDATLPWRDWLA

SEQ ID NO: 88956 - protein, 583 aa, Acidobacteria bacterium Ellin345
MIMTRLKAAFSLTFAVVLSTTPLMAETMVNPEHAKHAMVAAVQIDASKVGVEIMKQGGNAVDAAVATGFALAVTHSAAGNIGGGGFMLIRMANGESHFIDYREKAPAKATHDMYLDAQGNVLPDASLVGYKANGVPGSVAGMVYAEKHFGKLTLQQVMAPAIRLARDGFALSFEDAMGFRDENLTKFPESRRIFQRDGKFYEPGDVFKQPELAKTLERIAENPDDFYKGAMAKEIAADQAKGGGLITAEDLAAYEVKDRPVIRGTYRNYQVLSAPPPSSGGIALVEALNILEGYDLGKLGNRSAAAMHLTLEAYRRAFYDRAEFLGDPDFSKIPVAQLIDKHYGVAWRKSIDEQHATPSNEVKRPVGFAQLDQYAVLHPPATNVYEPEDTTHYSVVDNAGNAVAVTTTLNGGFGNYVTVSGLGFLLNNEMDDFSSKPGVPNQYGLIQGEANAIGPGKRPLSAMTPTIVLKDGKLFMVLGSPGGPRIITTVANILMGVVDYGLNIQQSVNAPRYHNQWLPDLEYLEPGFSPDTRAALVKMGHHIAKEEEDWGYWSDGECILVDPLSGERQGASDGRNNGHAVGY

SEQ ID NO: 88957 - protein, 330 aa, Arabidopsis thaliana
MASCLQASMNSLLPRSSSFSPHPPLSSNSSGRRNLKTFRYAFRAKASAKIPMPPINPKDPFLSTLASIAANSPEKLLNRPVNADVPPYLDIFDSPQLMSSPAQVERSVAYNEHRPRTPPPDLPSMLLDGRIVYIGMPLVPAVTELVVAELMYLQWLDPKEPIYIYINSTGTTRDDGETVGMESEGFAIYDSLMQLKNEVHTVCVGAAIGQACLLLSAGTKGKRFMMPHAKAMIQQPRVPSSGLMPASDVLIRAKEVITNRDILVELLSKHTGNSVETVANVMRRPYYMDAPKAKEFGVIDRILWRGQEKIIADVVPSEEFDKNAGIKSVV

SEQ ID NO: 88958 - protein, 433 aa, Photorhabdus luminescens subsp. laumondii TTO1
MSKIVKVIGREIIDSRGNPTVEAEVHLEGGFVGLAAAPSGASTGSREALELRDGDKSRFMGKGVLKAVDAVNGPIAQAVIGQDAKDQANIDKIMIDLDGTENKSQFGANAILAVSLANAKAAAAAKGMPLYEHIAELNGTPGKFSMPLPMMNIINGGEHADNNVDIQEFMIQPIGAKTLKEAVRIGSEVFHNLAKVLKAKGMSTAVGDEGGYAPNLESNAAALAAIKEAVEQAGYVLGKDVTLAMDCAASEFYNPETGNYELKGEGKTFTSQEFTHYLEDLTRKYPIVSIEDGLNESDWEGFAYQTKVLGEKIQLVGDDLFVTNTKILKEGIEKGIANSILIKFNQIGSLTETLAAIKMAKDAGYTAVISHRSGETEDATIADLAVGTAAGQIKTGSMSRSDRVAKYNQLIRIEEALGNRAPFYGLKEVKGQA

SEQ ID NO: 88959 - protein, 309 aa, Synechococcus sp. CC9311
MLNDLVNRCAPLPSGATLCILGAGFSGGHLAKLSKALGTRVICTSRRPESGSDHLPFDSAKGIVPGHEVLASVTHLISTIPPTKEGADPVLSCLGEQLQQLPLQWVGYFSTTGVYGNSNGNWVNETNEPQPTQLRSQKRLDCEQLWRKSGLPVQILRLPGIYGPGRSPLAAVRSGEVTPVDQPGQMFCRIHVDDLAGACWHLMHRAAAGQRPTVVNISDNRPASRLELQRFAAELLGCKLPAPIPFSEAQATMSPMALSFWADNRKVSNALLRDELGYTFLHPDYSSGLKDCFEAEGFNAMNPEPEAEP

SEQ ID NO: 88960 - protein, 188 aa, Brassica napus
  misc_feature (125)..(125): Xaa can be any naturally occurring amino acid
MVRNGGFGQIMEEGDSPGFFKILRREDLSSQLIRMIPHDIIRSISDDSSSFKMVLKVPWGSSWTVKISKNPSFHYMEDDGWNQFVNNNALGENEYLTCTHERNMRFNVNIYGPDGTEMLEPRESXTIASSSGMNKREQREGVYKHVKEEIVSSSESSYHSLKNAQGKKQELNLGKKKAEESKKNKKST

SEQ ID NO: 88961 - protein, 887 aa, Erythrobacter sp. SD-21
MTETVFTFGGNAPHTNARQKDKTVTGGKGANLAEMASIGLPVPPGFTIATEECLKYLAGGSDFSEKLRSDVMAALAHVEKTVGKGFGDAADPLLVSVRSGAAVSMPGMMDTVLNLGLNDETVQGLANTSGDERFAWDSYRRFIQMYGDVVLGVDHGLFEEALEITKEDNGYYADTELSAEEWKTLVAEYKSIVEQELGKPFPQDPVEQLWGAISAVFDSWDTERAKIYRRLNDIPHDMGTAVNVQAMVFGNMGDTSATGVAFTRDPSTGEKAYYGEWLVNAQGEDVVAGIRTPQYLTKARREGAGADKPSMEEAMPDAFAELAHVFELLEKHYTDMQDIEFTVQEGKLWLLQTRTGKRTAKAALKMAVDMVGEGLIDEKAAILRIDPMALDQLLHPTLDPDAPRDVLTTGLPASPGAASGKIVLDADTAELWTGRGEKVILVRVETSPEDIHGMHAATGILTARGGMTSHAAVVARGMGRPCVSGASQVSIAREGRTLTIGNRELKEGDTITLDGGNGQVMAGEVATIEPELAGDFGTLMDWADKHRRMRVRTNAETEEDCRMARQFGAEGIGLCRTEHMFFDAGRISAVRQMILADDEAGRRKALAKLLPEQRSDFGKIFEVMTGLPCTIRLLDPPLHEFLPHGDAEFEELASATGKSVDQLKRRAGELHEFNPMLGHRGCRLGITYPEIYEMQARAIFEAACEVAKASGEAPIPEVMIPLVATRKELELLKAVVDRVAGEVFEASGCKVDYLVGTMIELPRAALMAGEIAEVGEFFSFGTNDLTQTTLGVSRDDAGRFLTEYVDKGIFARDPFVSLDIDGVGQLVELAAERGRKTRGDIKLGICGEHGGDPASIAFCEKTGLDYVSASPYRVPIARLAAAQASLY

SEQ ID NO: 88962 - protein, 474 aa, Oryza sativa Indica Group
MAAAAGLSPRLVVTPGRRSHSHGRRRMCCAAAAAAQGERKTTVRSKEGDAVELCRVVNGMWQVSGPSWGRYETPAAVDAMLRYADGGLSTFDMADISRTLLSPAAPPVPRRGVVRPARCSGGGGAAAVETAASGAKVCTVSNRGDSLAICRVLNGMWQTSGGWGRIDRDAAVDAMLAYADAGLSTFDMADHYGPAEDLYGLFINRVRRERPPELLEEIKGLTKWVPPPVKMTRSYVEDNINRSRKRMDVSALDMLQFHWWDYANPGYLDALKHITDLKEEGKIKTVALTNFDTDRLQIILENGIPIVSNQVQHSIVDMRPQRRMAELCQLTGVKLITYGTVMGGLLSEKFLDTNVSIPFAGPPLNTPSLQKYKRMVDAWGGWSLFQALLQTLKKVSLKHGVSISTVAVRYILNQTSVAGSMVGVRLGLSEHIKDTNAIFSLELDEEDMNSITEASNKGRNLMDIIGDCGDEYRA

SEQ ID NO: 88963 - protein, 159 aa, Oryza sativa Indica Group
MAAAALRDQLTALLSSMFSQVTTYLLPLLSSPLRQTYCLREQPVVNFDKVDAYVHQLKGSSASVGAQKVKFTCMQFRQFCQDKSRDGCLMALAVVRNDFYDLRNKFQTMLQTDNLLGYGIYDLTVDTKLCWKFLKALLEAAHSAFMLSIIKLLLMVPGS

SEQ ID NO: 88964 - protein, 398 aa, Saccharophagus degradans 2-40
MPAQQETPTQTSNSNNLPYYDVIVIGAGIQGAGVAQAAALQGWSVLVIEQFDGPAQGTSSKSSKLIHGGLRYLETAQFSLVKECLQEKAILQKIAPKLVKPATFVIPVYKKNKRSPFWVGLGLWLYSLLGGSAPRKIASVLWKNFPHLNTQNLRAMYSYEDAQTDDAALTRAVLAAAQEDDAEILYSTEVSAINKTGEGYKVNSNRGSFTCSTVVNAAGPWVNTIAGRCTFGAPMIDVDLVQGAHIVLDTPAFEQCFYFESPDDGRAVFTLPWKGKTMVGTTETHFTGDPKTCTPTADEEAYLKRAFDFYFPALANVKILESFAGLRVLPMAEGSATKRARDTRIVFDNNVDTMKGYYAIYGGKLTGYRATAEKVVQCMAPVLGHSATLVSTKNVHLN

SEQ ID NO: 88965 - protein, 568 aa, Glycine max
  misc_feature (131)..(131): Xaa can be any naturally occurring amino acid
MTSELEISPADTRKAPGKEQQAAGVGILLQIMMLVLSFVLGHVLRRKKVYIIPEASASLLIGLIVGILANISDTETSIRGWFNFHEEFFFLFLLPPIIFQSGFSLAPVGPSTLRSVLFAGSLLCLYGLAFXLGVNNVIPLQKPFFSNFGAIVTFAIFGTFIASIVTGILVYLGGLLFLMYRLPFVECLMFGALISATDPVTVLSIFQELGTDVNLYALVFGESVLNDAMAISLYRTMSSVRADPSGQNLFMVVVRFLETFVGSMSAGVGVGFISALLFKYAGLDIDNLQNLESCLFVLFPYFSYMLAEGLGLSGIVSILFTGIVMKHYTYSNLSQSSQRFASAFFELISSLAETFVFIYMGFDIAMEQHSWSHVGFIFFSIIFIGIARATNVFSCAYLVNLVRPTHRKIPPKHQKALWYSGLRGAMAFALALQSIHDLPEGHGQTIFTATTAIVVLTVLLIGGSTGSMLEALDVVGGDNDSPLASVGTITNFDGNNGYIAPHYNEESSSGNKIKMKLKEFHKTAASFTALDKNYLTPFFTSQNGDEDDEAEPFTSTRSELHGQNHYSS

SEQ ID NO: 88966 - protein, 346 aa, Oryza sativa Indica Group
MDLQEAAMEARKGHRIPPTEEKVIIDTDPGIGTLILISPLLLPASVTVIHPSILTITNSYQFPDDSVAIMMAFEAPGVKCDRAGRPEVPVAEGSAEPLKGGKPHVADFVHGSDGLGNTSFPDSTTTNKVEQSAAEFLVDKVSESPGEISVLALGPLTNIALAMKKDSSFASKVKRIVVLGGAFFAAGNATPSAEANIHSDPEAADIVFTSGADIYVVGLNITTQVYFTDKDMLELRNSKGKHAQFLCDICKFYRDWHVHSYGVDALFLHDPVSFTALVHPEYFTFKKGVVRVETQGICKGHTSMDMGLKKWNSDNPWTGYSPISVAWTVDVPKVLAYAKELLFNAQ

SEQ ID NO: 88967 - protein, 306 aa, Erythrobacter sp. SD-21
MKAQSVLETIGGTPHIRLSRLFPDHEVWVKSERANPGGSIKDRIGLAMVEDAEKAGKLKPGGTIIEPTSGNTGIGLAMAAAVKGYKLVLVMPESMSMERRRLMLAYGATFDLTPKEGGMKGAISRAAELVEQTDGAWMPSQFENPSNFEVHKRTTAKEILDDFSDSPIDVMITGVGTGGHLTGCAEVLKETWPEMLAYAVEPTLSPVISGGDPGPHPIQGIGAGFVPENLHTDAIDGAIQVEPEDAKEWARQCAAKEGLLVGISSGATLAAIAKKLPELEAGSRVMGFNYDTGERYLSVPDFLPTE

SEQ ID NO: 88968 - protein, 136 aa, Zea mays
  misc_feature (100)..(100): Xaa can be any naturally occurring amino acid
  misc_feature (113)..(113): Xaa can be any naturally occurring amino acid
MATNRSVGTLGEADLKGKKVFVRADLNVPLEDAQKITDYIRMRASVPTIKFLLEKGAQVILASHLGRPKGVTTKHSLKPLVSRLSELLVIEVVMAHDCIXGEEPEKLAAALPXGGVLLLEIVRFYKEEEKTDLLLV

SEQ ID NO: 88969 - protein, 264 aa, Brassica napus
  misc_feature (32)..(32): Xaa can be any naturally occurring amino acid
  misc_feature (66)..(66): Xaa can be any naturally occurring amino acid
ASIVALLPLKMLGAFYVIHCVWATAEAYSAPXSIVLTSQSRDGLHVFDDFRESYAWLSHNTDVDDXVASWWDYGYQTTAMANRTVMVDNNTAINTHIATVGTAMSSPEKAAWEIFNSLDVKYVLVVFGGLIGYPSDDINKFLWMVRIGGGVFPHIKEADYLRDGNYRIDSEATPTMLNCLMYKLSYYRFVETDGKGYDRVRRTEIGKKNFKLTHFEEVFTSHHWMVRIYKLKPQKNRIRGRAKKLKLKTSSGLDSKAAKKNPWI

SEQ ID NO: 88970 - protein, 294 aa, Brassica napus
  misc_feature (219)..(219): Xaa can be any naturally occurring amino acid
  misc_feature (271)..(271): Xaa can be any naturally occurring amino acid
MAVQPTRIGLAGLAVMGQNLALNIASKGFPISVYNRTTSKVDETVERAKKEGNLPVYGFHDPESFVNSIQKPRVIIMLVKAGAPVDQTIKTLSAYLEKGDCIVDGGNEWYENTERREKAVSENGFLYLGMGVSGGEEGARNGPSLMPGGSFEAYKNIEDILLKVAAQVRDSGPCVAYIGKGGSGNFVKMGHNGIEYGDMQLIAEAYDVLKSVGKLTNEXELHGVFTEWNKGELESFLVEITADIFGIKDDKGDGHLVDKVLDKTGMKGTGXKWTVQQAAELSVPSPTIESSLDA

SEQ ID NO: 88971 - protein, 59 aa, Oryza sativa
MLGIEARGFIFGPAIALAIGAKFIPLRKPKKLPGEVISETYILEYGTDCLEMHVGATEP

SEQ ID NO: 88972 - protein, 524 aa, Burkholderia xenovorans LB400
MLLHELKQAAEAADSVALRHDYLKKTLTARVYDVARETELERAPNLSARLRNPVYLKREDNQPVFSFKVRGAYNKMAHIPAEALERGVITASAGNHAQGVALSAARMGVKAIIVVPVTTPQVKVDAVRAHGGPTVEVVQFGESYSDAYGHAVKLQEERDLTFVHPFDDPYVIAGQGTVAMEILSQHQGPIHAIFVPIGGGGLAAGVAAYVKSVRPEIKVIGVQTDDSCAMAASLKAGERVTLNEVGLFSDGTAVKLVGEETFRLCREYLDDVLLVDTDALCAAIKDVFQDTRSVLEPAGSLAVAGAKQYAEREGIENQTLIAITSGANMNFDRMRFVAERAEVGEAREAVFAVTIPEERGSFRRFCELVGTRSVTEFNYRIADANSAHIFVGVQIRNRSESAQIAGAFEAHGFATVDLTFDELSKQHIRYMVGGRSPLAHDERLFRFEFPERPGALMKFLSSMAPNWNISLFHYRNQGADYSSILVGIQVPESENAAFDQFLATLGYPNWEETQNPVYRLFLAS

SEQ ID NO: 88973 - protein, 438 aa, Mycobacterium avium subsp. paratuberculosis K-10
MPAAKAGLTPEQISAIDAAHLWHPYSTIGAESVAPVVAVGARGAWLTLIRDGAEVRALDAMSSWWTAIHGHGHPVLDAALSDQLAAMNHVMFGGLTHEPAARLAQLLVSITPAGLDTVFFSDSGSVSVEVAVKMALQYWRSRHRPAKHRLMTWRGGYHGDTFTPMSVCDPEGGMHSLWTDILARQVFAPQVPRDYDPAYSAAFEAQLARHADELAAVIVEPVVQGAGGMRFHDPRYLGDLREACTRRDVLLIFDEIATGFGRTGELFAADHARVSPDIMCVGKALTGGYLSLAATLCSTDIAQVISAGEAGALMHGPTFMANALACAVSMASVEVLLGQDWRSRVAEISAGLAAGLEPARELPGVTDVRVRGAIGVIECDRPVDLAVATPAALDHGVWLRPFRNLIYAMPPYICPPDEIARIASAMVQVAARLGSRRL

SEQ ID NO: 88974 - protein, 597 aa, Ostreococcus tauri
MVATAGAPDVHVPVVSSLDDVYGSPTEETRERYRALADAFERAYGRAPSGFARAPGRVNLIGEHIDYEGYSVLPMAIGLDAVVAYGVNETSGKIRVGNANPEYTEKTFETSPGQDVDTSSLHWTNYVMCGYKGVFDFLEESGGKSVEPVGLDLMIDGTVPTGSGLSSSSALCCASALAVMSAHGLSFTKGEIADFTCKCERYSGTQSGGMDQAISIMGEAGVAKLVDFNPIQTNDVYLPENCAFVIGNCLAVSNKAETAHERYNLRVVECRLAAMVLGRKLGMSDEEVVETQTLQDIEKRVGNMSSAKAAAEEYLHDGYYDAREIEEIIGVDAFLDVFSSPASKAVLNHNVTGYKLLSRTLHVYSEAGRVHLFAAACAMKVDPAELGVYMNGSHESCRALYECSCPELDELVDAFRAAGALGARLTGAGWGGCAVALVSMDKVQDVLSQVGKTYYASRIANGVITEDDMSAVLFATLPSNGAVVLKTTLGEGLSARICVHAFCLGRLLRFFRNSSPHSAHRAPSGSLGSPHAGHDPYASICARDSSLSLARVVADMFKAADNSGMSFTYARDASRRNATRRAIGVSLDGRPEGAIKL

SEQ ID NO: 88975 - protein, 158 aa, Bacillus cereus ATCC 14579
MFRIGQGFDVHEFAEGRPLIIGGITIPHEKGLIGHSDADVLLHTIADACLGAIAAGDIGKHFPDTDPAFKDADSAVLLQKVWEFVREQGYELGNLDCTIIAQKPKMAPHIESMRKRISELLETSIDNINVKATTTEKLGFTGREEGIASQAVVLLQKK

SEQ ID NO: 88976 - protein, 480 aa, Ostreococcus tauri
MSSVTTSVMLTQRQACAQTKASPSGCARARTPTWARQPRARTSLWKRPTCSTRDSPRSRIIYRSKSGGLLDVTHDMDALKIYPPEYWKALFDERVGKTTWPYGSGVWSKKEWVLPGIADEDIVSMFEGNSNLFWAERYGRENLGMTDLWVKQCGNSHTGSFKDLGMTALVSQVNRMRKMGKPLSAVGCASTGDTSAALSAYAAAAGIPSIVFLPANKISVAQLVQPIANGALVLSIDTDFDGCMRLIREVTAELPIYLANSLNSLRLEGQKTAAIEICQQFDWQVPDYVIIPGGNLGNVYAFYKGFSMCKELGLVDRLPRMVVAQAANANPLYRAYKKGWDKFEAVKAEPTFASAIQIGDPVSIDRAIFALTETNGIVEEATEEEMMDAAAEADLTGMFNCPHTGVALAALKKLRASQTIAPSDRVVVISTAHGLKFTHSKVAYHEKKLEGIESRYANPPVMVKDDFGAVMDVLGSRLNK

SEQ ID NO: 88977 - protein, 221 aa, Bacillus cereus ATCC 14579
MFKRLREDIEVVFEQDPAARGYFEVILTYSGLHAVWAHRIAHAFYKKNFFFLARFVSQVSRFFTGIEIHPGATIGRRFFIDHGMGVVIGETCEIGDNVTIYQGVTLGGTGKEKGKRHPTIQDNVLIATGAKVLGSITVGENSKIGAGSVVLKEVPAHSTVVGIPGRVVIQNGVKIGQELNHSDLPDPIFDKLKAMEVELDKLKKQLELKVERKDKNDYSHL

SEQ ID NO: 88978 - protein, 537 aa, Coccidioides immitis RS
MAHVENADIEPISSPGNGSDVSTLASADIPSNRIGKSQLSQEISPHALEKLDTARTCVSDDIPGNRRQIGVLTATFLVFNRIIGTGIFATPSTILALTGSVGMSLTVWFVGMIIAMAATAIYASYALFLGWAAGNSVIFGEYLLHAFGVQVNRWNQRGIGLVCITVAFIIHATAVKWGLRIQNTLGVLKLVVILIIAVGGLLACAGFVNIDRPRNFEHPWGEGPPTVYGIVMGLYNVIWSYVGYSNANYCLSETRNPVRTLKIAAPIGVAMVGILYFLVNVAYFAAVPKEEMLLSGRILAASFFRNVFGFKAERALSTFVAFCAFGNVLAVLFSQGRIVQALGREGVLPFSRFWASNKPFNSPAAGLFQHYIVSVVVMLAPPPGDAYNFLLNFQSLIGYPLSTVNVLVSGGLLHIYFCPERYPTWSPGIRATLPVTFFFFFSNVYLAVAPFLPPPRRVGNVYERLPYYTHCLAGLTIFALGALYWLFWAKILPWMGEYRLGEESVVGQDGWARKIVQRIPTAPELEEQGRRNGSMWS

SEQ ID NO: 88979 - protein, 213 aa, Magnaporthe grisea 70-15
MQSTSPDNANPTIRSIASLPSRGRRSDFSLDNSPESKYDNLLLSRNTASDYGLPDVLAWSSDSDSDYDSTDRASPFPSSSSPSSSLYAAEPIDALEIYTLTASISDPEHPHTLGQLSVINLPDIHVTSNHVLVEVTPTITHCSLATVIGLAVRVRLEQALPPAYRVDVRMKQGSHAQDDQVNRQLADKERVAAALENDSLRGMLDKMMETCTT

SEQ ID NO: 88980 - protein, 176 aa, Rickettsia sibirica 246
MSKVKKNDETLSEVLVDVNRVTKVVKGGRSFAFSAYVVVGDKAGRVGAGHGKAKEVNEARGKAKQAAKKRMMKVPLYQNRTIHHDVVGKSGAAKVILRRAKAGTGIIAGGSMRAIFDSLGVHDIVAKSIGSTNVYAMISATFDALNKLASPKSIAMRRDKKVNEISVKSADIQVNE

SEQ ID NO: 88981 - protein, 419 aa, Ostreococcus tauri
MPLGAFARRASTALASARPSTSRAFTALSAGNGDFGRLGHGQVLTDDDVSFRSSNYFHPVRGLEDVDVTQCAAGGAHSIFLAHGGFVFACGLNNYGQLGHGKHSAHVPEAALVDLDVEVVRVAAGNNHTLCVDVDGGVWAFGKNEGGQLGTGLDLDGFQPRRIETLALEGKIVDVASGAEHSLALSEDARVYSWGTSADGVLGHGSETWNEGWFYRTAKTVAKPRLLRALSETKVRSIAAGHMHSACVDERGELFTWGQGRFNQLGQTSKYVDHETAPKSVDTLRFVHQVTCGGLHTLASTSAGVVSWGANQHGELGHGSNSDAKSAIPKPIKLSSRGWSKLSAGWKHSAGVSNDGKLFAWGFGGSVGSHSDEKLSSGGQLGLGNDFDYWEPTEVWLPGDAVGVSCGFNHTLALVRLGA

SEQ ID NO: 88982 - protein, 430 aa, Listeria monocytogenes str. 4b F2365
MSIITEVYAREVLDSRGNPTVEVEVYTEAGAFGRALVPSGASTGEYEAVELRDGDKARYLGKGVLKAVENVNDIIADKIIGFDVTDQIGIDKAMIELDGTPNKGKLGANAILGVSLAAARAAADELGVHLYEYLGGVNGKVLPVPMMNILNGGEHADNNVDVQEFMVMPVGAPNFKEALRMGAEILHALKAVLKGKGLNTGVGDEGGFAPNLKSNEEALETIMQAIKDAGYKPGEEVKLAMDAASSEFYNRETGKYELKGEGVTRTSEEMVTWYEEMITKYPIISIEDGLDENDWDGFKLLTERIGDRVQLVGDDLFVTNTTKLKEGIEKGIANSILIKVNQIGTLTETLDAIEMAKRAGYTAVISHRSGETEDSTIADIAVATNAGQIKTGAPTRTDRVAKYNQLLRIEDNLADLAEYHGNETFYNLKK

SEQ ID NO: 88983 - protein, 469 aa, Rhodopirellula baltica SH 1
MTEVKLPELGDGIESGDVLEIFVSVGDVITAGQDIVEMETDKATVPVPSDVGGKVTKISVGEGDTVPIGGVLIEVEAAAGAESAPAPAAPAEPEKKPEPKPEPQAEAPAPEPAAPPAAKPAAPAAPPVAQPVATPAARTPAVADEPDAPVDGGGSIPAGPAIRRFARETGVNLASVTGTGAGGRITRDDVLAVVRSASQKAAAPAAKPAPSAGTAAPRTNVTSGDLPGTPDTDDYGPIRVERMSKIRKTISAQMHLSWSTVPRVTNFDDADITDLERLRQSSKDDYAAQGLKLTTMPFLVKAVATALRHHPSLNAVIDSENQQVIYKDYVNIGIAVDTDNGLVVPVMHNADQMGIPDTARNIAEMAGKVRGGKFGVNDLRGGSFTISNLGAIGGQYSTPIVNVPEVAILLVGRSRKLPVVMPDDSIQPRLMMPLSLSYDHRLVDGGTAARFLNDVIGYLQAPSRLLLAL

SEQ ID NO: 88984 - protein, 364 aa, Geobacter metallireducens GS-15
MGFNCGIVGLPNVGKSTIFNALTSAGAESANYPFCTIDPNVGIVQVPDERLERLAEIVNPERILPTTIEFVDIAGLVKGASQGEGLGNQFLGHIRSVDAIVHVVRCFDDENVVHVSGSVDPIRDIEVIQTELALADLDSVEKKFQRVEKQAKGGDRKLKDESEFYARVKGALEKGTPGRHVEVGDDERLWMRDLHLLTDKPVLYVANVAEDDLEGAHPFVAKVRDLAESEGARVVVICGRIESEIAELDGDEKKVFLAEMGLAESGLDRLIRMGYDLLGLITYFTAGKKEVRAWTIPAGTKAPQAAGVIHSDFEKGFIRAEVIAYRDFVAAGGETGAKEKGLMRLEGKEYVVQDGDVMHFRFNV

SEQ ID NO: 88985 - protein, 510 aa, Listeria monocytogenes str. 4b F2365
MSKSPVAIIILDGFGKRAETVGNAVAQANKPNFDRYWANFPHGELKAAGLDVGLPEGQMGNSEVGHTNIGAGRIVYQSLTRIDKAIEEGEFQENKALNNAFTHTKENNSDLHLFGLLSDGGVHSHINHLVALLETAKDKGVKNVYIHAFLDGRDVAPQSSLEYLETLQKAISDLNYGAIATVSGRFYAMDRDKRWERVEKAYKAIVNAEGEKFEDPIELVKASYANDKNDEFVVPAIITKDGKPVATVKDNDAVIFFNFRPDRAIQLSNAFTDKEWDHFDRGANHPKNIKFVTMTLYNPSIDAEVAFEPIEMKNVIGEVLSNEGLSQLRIAETEKYPHVTFFMNGGRNEEFPGENRILINSPKVETYDLQPEMSAYEVTDALVEDIKNDKHDAIILNFANPDMVGHSGMLEPTIKAIEAVDENLGRVVDLILEKGGSAIIFADHGNSETMSTPEGKPHTAHTTVPVPVIVTKKGVTLREGGRLADVAPTMLDLLGVKKPAEMTGESLIQK

SEQ ID NO: 88986 - protein, 331 aa, Saccharophagus degradans 2-40
MNSDKTPTTFDSHRFCLAPMMDWSDKHCRYFWRQLTKKSRLYTEMVVTGAIIHGDRERFLQFNNAEHPIALQVGGSDPAALAQCARIAQDWGYDEINLNCGCPSDRVQNGMIGAILMSKPELVAECIDAMQKACDIPVTVKHRIGIDDMEDYEALSNFVTTVAQTGCNTFIVHARKAWLKGLSPKENREIPPLRYDLVVQLKKAFPHLNIVINGGINCLEQAKTLLNDLDGVMIGREAYHNPFFLADVDQKLFGTPNPSANRHEVLDKFIHYAEQQNAAGTRLHHMSRHILGLYLGQKGARAFRRHITIHAANREASAVVLREAKQLVDIG

SEQ ID NO: 88987 - protein, 141 aa, Glycine max
MAEGEETKVEGMREEERADAGAGAEEEEVEVKFRLFDGSDIGPIRCNAAATTVAALKDRVVADWPKDKTIVPKSANDVKLISGGKILENDKNIAQCRAPFGDLPSTVITMHVVVQPSSAKSKPDKKTNKLPKTTRCSCTIL

SEQ ID NO: 88988 - protein, 314 aa, Geobacter metallireducens GS-15
MNDKIKVFSGNSNRQLAEKICENLGLPLGKANVKNFSDGEIMVEIAENVRGRDIYVVQSTCAPTNNNLMELLIMNDALKRASAATITAVIPYYGYARQDRKAAPRTPITSKLVADLVTTSGADRVVTVDLHAGQIQGFFNIPVDNLYAAPVILENLKQRFPENGIVMVSPDAGGTERARAFAKRLGCTLAVIDKRRTGPNVAEVMHLIGDVKDKTAIILDDMIDTAGTLTQAAKALKEHGAKAIYACATHGVLSGPAIDRINGSDIEAVVITDTVPLGDKAERTNKIKVLTVADLLAEAIRRIHSDESVSSLFV

SEQ ID NO: 88989 - protein, 615 aa, Pinus pinaster
MPQAKREEGIESVQESIIIATTERNRKALDFIEHATIHAAEVQAEVLLEILTRNAYTEYLERYQLTGRTDRKSFKERLPVITYEDLQPEILRIANGDMSPILSAHPISEFLTSSGTSAGERKIMPTIHEELKRRTLLYSLLMPVMNQYMKGLDKGKGMYFLFVKSETRTPGGLLARPVLTSYYKSQDFIERPYDPYNVYTSPMEAILCSDSYQSMYCQLLCGLAQNHEVLRVGAVFASGLLRAIRFLEEHWQSLCQDIRSGTVNDEEVTDPCLRESVMKILHPNTQLADLIRTECSKESWQGIITRLWPNARYLDVIVTGAMAQYIKTLDFYSGGLPQVCTMYASSECYFGINLKPLCQPWEVSYTLMPNMAFFEFLPVYRNKNEDAGPVTTATEQPAELVDLVDVKVGQEYELVITTYSGLYRYRVGDVLRVTGFHNAAPQFQFVCRKNVMLSIDADKTDEAELHNAVMNAVKHLEPLEATLVEYTSYTDTSTIPGHYVLYWELRTSALPVPPSVFEDCCLTVEESLNSVYRQCRVADKSIGPLEIKVVEMGTFDKLMDYAISRGSSINQYKAARCVKFAPMVDILNSRVSASYFSPRCPKWTAGRTQWGALPR

SEQ ID NO: 88990 - protein, 54 aa, Glycine max
PVEKYKPLACLCGGLSFFPSLGLLAVWNNKPPKTPFAPKVFPFALLRVGLGGDP

SEQ ID NO: 88991 - protein, 246 aa, Salinibacter ruber DSM 13855
MPDPDDFLQFSKSMTSLPSSIFQGGLGDQPQSGLVPKVVEQTTRGERAYDIFSRLLKERIVFIGTPINDQIANLTVAQLLYLESEGSSQPINIYINSPGGVIYSGLGVYDTMQYVEAPISTTCVGLAASMGSVLLAGGEDGQRACLPNSRVMMHQPMGGTEGQASDIEIQAKEMAWLKKRLYQILSFHTGKDIDQIEEDADRNHWLSAEEAQEYGLVDQVMNEGNLDALKSIHANGEASDADSDEE

SEQ ID NO: 88992 - protein, 511 aa, Bacillus subtilis subsp. subtilis str. 168
MVNHDITETAIRRSLNNLTITFQDFNLSSDLMKAINRMGFEEATPIQAQTIPLGLSNKDVIGQAQTGTGKTAAFGIPLVEKINPESPNIQAIVIAPTRELAIQVSEELYKIGQDKRAKVLPIYGGQDIGRQIRALKKNPNIIVGTPGRLLDHINRRTIRLNNVNTVVMDEADEMLNMGFIDDIESILSNVPSEHQTLLFSATMPAPIKRIAERFMTEPEHVKVKAKEMTVSNIQQFYLEVQERKKFDTLTRLLDIQSPELAIVFGRTKRRVDELAEALNLRGYAAEGIHGDLTQAKRMVALRKFKEGAIEVLVATDVAARGLDISGVTHVYNFDVPQDPESYVHRIGRTGRAGKTGMAMTFITPREKSMLRAIEQTTKRKMDRMKEPTLDEALEGQQQVTVERLRTTISENNLNFYMTAAAELLEDHDAVTVVAAAIKMATKEPDDTPVRLTDEAPMVSKRYKNQRSSKRRDGQGGGYRGGKGKSNNRSSYDKKRSNDRRSSGDRRQKKSY

SEQ ID NO: 88993 - protein, 272 aa, Lactococcus lactis subsp. lactis Il1403
MKLNNQIEIPELGLGVFQIPNDETADVVKNAIVNGYRLIDTAKIYENEEGTGQGIKEGLAMTGLSRDDLFITSKLWGDNHSYEETVQNFEKSLKKLDLDYLDLYLIHWPGTHYAYKEAWNAMEDLYKAGKIKAIGVSNFQKSHLEELLSYAKITPVLNQIELHPKLSQEELRNFLELHDIKVQAWSPLMQGQLLDNEVLKKIADKHGKSVAQIILRWDIQQDILVNVKSIKSERMIANRQIFDFSLDSEDMKAINSLNEELRVGPDPEHFNF

SEQ ID NO: 88994 - protein, 453 aa, Salinibacter ruber DSM 13855
MAQSGDRSPTARLGLLDATMVGMGAMIGAGIFVLTGLAAEIAGPAAILVFALNGVVTVLTGISYAELASAIPKSGGGYVFVREVFSGPTSFLMGWMLSFAYMIAGALYALGFSSNFVEFVHLYWAGLPTGPVWHILYALTVVGLFALLNAVSTEASGGAETVVTIIKIIILLVFAGFGAFAVEGSNFEPFFAKDDSSVAILKAMGLTFIAFEGYDLIATVTEEVENPRENIPKAIFISLVATVAIYLIVVWVAIGTLGAEELGRAGETGIAEAATSFMPTIPLLGEGAALIVFGAVFSTVSALNAVVIASSRVVFAMGREDQLPNPLGQISARFGTPLAAVVVSAAVMLGSVVFLPIEQVGRVSSLFFLVSFVVVNWSVIRLRNRRPNMRRPFEMPFYPAIPILAIVLNLVLAYFLLRDDPYTLVLGVGWIAIGGLVYAALQWRRTETEAAGA

SEQ ID NO: 88995 - protein, 189 aa, Shewanella sp. MR-4
MTQSIINSTIKPFKATAYHNGEFVPVTEQDLLGKWSVVFFYPADFTFVCPTELGDMADHYAKLQSMGVEVYSVSTDTHFTHKAWHDTSDTIKKINFPMLADPTGVISRNFGVMIEEEGLALRGTFVINPEGQVKVAEIHDLGIGRSAQELVRKIQAAQYVATHDGEVCPAKWQPGDETLAPSLDLVGKI

SEQ ID NO: 88996 - protein, 233 aa, Lactococcus lactis subsp. lactis Il1403
MPKLVFARHGESEWNLANLFTGWADVDLSENGTKQAIEAGKLIKEAGIEFDIAYTSVLKRAIKTTNLALEYSDQLWVPVVKSWRLNERHYGGLTGLNKADAAAKHGDEQVHIWRRSYDVLPPAMDHDDKYTAHGDRRYAGLEDSLIPDAENLKVTLERALPFWEDQIAPALKEGKNVFVGAHGNSIRALVKQIKKLSDDEIMDVEIPNFPPLVFEFDDNLNVQNEYYLAPKKA

SEQ ID NO: 88997 - protein, 618 aa, Arabidopsis thaliana
MIPHQEVNEEEASLFDFLWLLLASVIFVPLFQKIPGGSPVLGYLAAGILIGPYGLSIIRNVHGTRAIAEFGVVFLLFNIGLELSVERLSSMKKYVFGLGSAQVLVTAAVVGLLAHYVAGQAGPAAIVIGNGLALSSTAVVLQVLQERGESTSRHGRASFSVLLFQDLAVVVLLILIPLISPNSSKGGIGFQAIAEALGLAAVKAAVAITAIIAGGRLLLRPIYKQIAENRNAEIFSANTLLVILGTSLLTARAGLSMALGAFLAGLLLAETEFSLQVESDIAPYRGLLLGLFFMTVGMSIDPKLLLSNFPVIVGTLGLLIVGKTMLVVIMGKLFGISIISAIRVGLLLAPGGEFAFVAFGEAVNQGIMSPQLSSLLFLVVGISMAITPWLAAGGQLIASRFELHDVRSLLPVESETDDLQGHIIICGFGRVGQIIAQLLSERLIPFVALDVSSDRVTIGRSLDLPVYFGDAGSKEVLHKIGAGRACAAVVALDAPGANYRCVWALSKFYPNVKTFVRAHDVVHGLNLEKAGATAVVPETLEPSLQLAAAVLAQAKLPTSEIANTINEFRTRHLSELTELCEASGSSLGYGYSRTSKPKPQPSDASGDNQIIEGGTVVI

SEQ ID NO: 88998 - protein, 187 aa, Lactococcus lactis subsp. lactis Il1403
MSLVGKKIEEFSTDAYLGGKFIKVSDKDFYGKWSVLCFYPADFSFVCPTELEDLEETYPTLKSLGVEVYSASTDTHFVHAAWHEHSDAISKITYPMLADPSQKISRAFDVLDEEAGLAQRGTFIIDPDGVIQALEITADGIGRDASQLVDKIKAAQYVRNHPGEVCPAKWKEDGASLHVGIDLVGKI

SEQ ID NO: 88999 - protein, 417 aa, Aspergillus nidulans FGSC A4
MGSLGPYKQKHKVTVVGSGNWGTAIAKIVAENTASNPAVFEKDVQMWVFEEKVEIPKSSKHYDPASSLCQGPQNLTDIINHTHENIKYLPGITLPENLIANPSLVDAVQDSTILVFNLPHQFIINICEQIKGKIVPYARGISCIKGVDVNEEGVHLFSETIGKILGIYCGALSGANIANEVAQEKWSESSIGYDPPHFDSKAPSPPNRSPSASTDNILHFEHKDVSGQLSRVKLQALPSEFPPIDHALLKSLFHRPYFHIGVVSDVAGVSLGGALKNVVAVAAGWVVGKGWGDNAKAAIMRVGLLEMVKFGEQFFGATINTRTFTEESAGVADLITSCSGGRNFRCAKLSIERNQPIEKIEETELNGQKLQGTLTAVEVNSFLKKQGLEEEFPLFTAVYRVLQGTMSVDEIPSFIER

SEQ ID NO: 89000 - protein, 421 aa, Zea mays
MGMGSARGGAGGWLPGERWRRVIFLALAAVSFLISLILLFLSAPRLRLPSVVLPYTTASASAVRRGPGEPPCLVYLLTGARGDGRRLLRLLLAVYHPRNRYVLHLSADAPDDERLSLATGVVAAAPAVGAFENVVIIGNPTAGTPVGSSGLAGTLRAAAVLLRLHADWDWFLTLNAADYPLVTQDDLIHVLSSVPRDLNFIDHTGDVGSKEPEKVQQIIVDAGIYLSGRTNFFRGTQKRAAPEAFKFFTGSPWVILNRQFIEYCILAWENLPRILLMYFNNVIQPQEGYFQTVICNSLDFRNFTVNNDLRFMVQDDSAQKKSLFTSREHYGHMVDSGAPFARPFQENDPLLDQIDGNILKRWSHGPVPGAWCTGRKRWFSDPCSQWGDVNVLRPGPQAVMLHQYVNRTLEEAKSSSNSCRR

SEQ ID NO: 89001 - protein, 96 aa, Zea mays
  misc_feature (70)..(70): Xaa can be any naturally occurring amino acid
  misc_feature (76)..(76): Xaa can be any naturally occurring amino acid
  misc_feature (84)..(84): Xaa can be any naturally occurring amino acid
  misc_feature (89)..(90): Xaa can be any naturally occurring amino acid
FGADSLRGSPRGCVRDSDGGAGARGQPAGSVQAPLWHRPHAPRFAAVIMRIREPKTTALIFASGKMVCTXAKSEQXSKLAARKXARIIXXLGFPVK

SEQ ID NO: 89002 - protein, 304 aa, Streptococcus pyogenes M49 591
MTKVRKAIIPAAGLGTRFLPATKALAKEMLPIVDKPTIQFIVEEALKSGIEEILVVTGKAKRSIEDHFDSNFELEYNLQAKGKNELLKLVDETTAINLHFIRQSHPRGLGDAVLQAKAFVGNEPFVVMLGDDLMDITNASAKPLTKQLMEDYDKTHASTIAVMKVPHEDVSSYGVIAPQGKAVKGLYSVDTFVEKPQPEDAPSDLAIIGRYLLTPEIFDILERQTPGAGNEVQLTDAIDTLNKTQRVFAREFKGNRYDVGDKFGFMKTSIDYALEHPEVKEDLKNYIIKLGKALEKSKVPTHSK

SEQ ID NO: 89003 - protein, 422 aa, Geobacillus kaustophilus HTA426
MAEIKVPELAESITEGTIAQWLKKPGDYVEKGESICELETDKVNVEIMAEESGVLQQLLANEGDTVAVGQAIAIIGEGAAAPTAALQAAPQPADETETVAPADSNEQPAPQPVAVAQAPSQRPIASPAARKMAREKGIDLTQVPTVDPLGRVRKQDVASFAAQPAAAPQPAPQAAPTSTPAAVPAAEAGKPVIREKMSRRRQTIAKRLLEVTQTTAMLTTFNEIDMSAVIDLRKRKKDKFFEEHDVRLGFMSFFVKAAVAALKKYPYVNAEIQGDEILLKKYYDIGVAVSTDEGLVVPVVRDCDRKNFAEIERDIAELAAKARSNKLSLADLQGGTFTITNGGVFGSLLSTPLLNGPQVGILGMHSIKLRPVAVDEERIENRPMMYVALSYDHRIIDGKEAVGFLKTVKDLIENPEDLLLES

SEQ ID NO: 89004 - protein, 482 aa, Bacillus cereus E33L
MIRVGGEWMYTETKEKKQSPNKMVRKIAFISTFGGLLFGYDTGVINGALPYMSDSNQLDLNPFTQGLVASSLLLGAAFGALFGGRLSDYNGRRKNILYLALLFFISTLGCTLAPNTTLMVICRFILGLAVGGASVTVPTFLAEMSPAETRGQIVTQNELMIVTGQFLAFTCNAILGNVLGDVGYVWRLMLVIASLPAVVLWFGMLIVPESPRWLASKGKIGDSLRVLKQIREENQANIELEEIKSALAEDSKLEKSSFKDLSTPWVRRILFLGIGVAIVNQINGVNAIMYYGTEILKNTGWGTKAALIGNVANGVISIAAMLVGIWLLGRVRRRPMLIIGLCGTTTSLFLIGFFSFILNGSVMLPYIVLSLTVIFLAFMQGAIGPVTWLTLAEIFPLRMRGLGMGFSVFWMWIVNFLISLSFPVLLSKIGLSATFLLFGILGLVAIAFVNKYLPETKGKSLEELEHYFRSYDDQGLENKQAR

SEQ ID NO: 89005 - protein, 575 aa, Trichodesmium erythraeum IMS101
MLRLENISKIYPTGVILKDVNWEVKPGDRIGLVGVNGAGKSTQLKIITGEIEPTSGEVIRPANLHIAYLTQEFEVNPNRTVREEFWTVFIEANKIHESLLQVQREMEIATPEKLDELIHKLDRLQRQFEALNGYGLDAEIEKILPEMGFESDDGDRLVSAFSGGWQMRMSLGKILLQKPDVLLLDEPTNHLDLETIEWLENYLKNLATPMVIVSHDREFLDRLCTQIVETERGVSTTYLGNYSTYLEQKSENKAAQLSTYERQQKEIEKQQTFIEHFRASATRSTQAKSREKQLEKIELIEAPTVGLKTLTFHFPPAPRSGREVAVIKDLVHTYGDKILFLGANLEIERGDRIAFLGLNGCGKSTLLRMIMGLEKPTEGIVELGKYNVIPSYFEQNQAEALDLTKTVINIIHDEVPDWKNEEVRTLLGNFLFSGDTVFKKVAALSGGEKARLALAKMLLKPGNFMLLDEPTNHLDIPAKEMLESALKNYDGTVIIVSHDRYFISQVANKIVEIRDGEFYTYLGDYHYYIDKLESEKELERLAKITAEKAAKKAQKAAKKKQKKKKVKNQTPPEKS

SEQ ID NO: 89006 - protein, 250 aa, Ostreococcus tauri
MPSAAEAVTLYVAPALGTVLAMFMFGSPLPEISRSREKGTIGSLNPTPYPIVAANCASWMMYGAISGNYWVYCPNFTGLLAGAYYSGVSYALSERHRPVLEKLSGGLIFLVSLIGMVLSCVMRGSSENSRLMVAGIQANTILAVYYVSPMSTMSEVVRTRDSKSMHFPLVVTNFLNGLCWFAFGIGLNDWWLAAPNLFGACVSVVQIGLIMVFPNSERRAGISTTPSTDGLMELNPTSSFSESPRSSTAV

SEQ ID NO: 89007 - protein, 396 aa, Listeria monocytogenes str. 4b F2365
MAKKVVTDLDLKDKKVLVRVDFNVPMKDGKITNDNRIVAALPTIEYILEQNGKAILFSHLGKVKTEEDKEGKSLRPVAARLSELLGKEVKFVPTTRGPELEKAIDELKDGEVLLFENTRFEDIDGKKESKNDPELGKYWASLGDVFVNDAFGTAHRAHASNVGIASNLESAAGFLMEKEIKFIGGVVDNPARPLVAILGGAKVSDKIGVIENLLTKADKVLVGGGMTFTFMAAQGQEIGKSLLEADKVELAKGLLEKAGNKLVLPVDAVVSKEFSNDAPFHTVSADSIPADEMGLDIGQATIDLFTKELQGAKTVVWNGPMGVFELSNFAKGTIGVCEAIANLTDATTIIGGGDSAAAAMDLGFADKFTHISTGGGASLEYLEGKELPGVASISDK

SEQ ID NO: 89008 - protein, 332 aa, Bacillus cereus E33L
MNPLIFKEDCPLDLIAVGRLCVDLNANETQRPMEATRTFTKYVGGSPANIAIGATRLGLQTGFIGKVSDDQMGRFITRYLQDNNINTDQICIDRTGAVTGLAFTEIKSPEDCSILMYRDNVADLNLDPTEVSEDYIKQSKALLISGTALAKSPSREAVFLALEYARKHDVVVFFDVDYRPYTWQSEAETAVYYNLAAEKSDVIIGTREEFDMMEKLLNYEESNDQVTAERWFSHHAKIVVIKHGGDGSIAYTRDGQSHRGGIFKTKVLKTFGAGDSYASAFIYGLMQGLEIPQAMRLGGASASIVISKHSCSDAMPTRAEISAFMEIAEEIV

SEQ ID NO: 89009 - protein, 487 aa, Bacillus cereus E33L
MTVQTAQIVKNYIGGEWVESISTKMEAVYNPATGEVIAQVPLSTKVDVEQAVLAANEAFKSWSKTAVPKRARILFKYQQLLVDNWEDLAKLITIENGKSYNEAYGEVLRGIECVEFAAGAPTLMMGKQLPDIATGIESGMYRYPIGVIGGITPFNFPMMVPCWMFPLAIACGNTFVLKPSERTPLLAAKLVELAEEAGLPKGVLNIVNGAHDVVNGLLEHKLVKAISFVGSQPVAEYVYKKGTENLKRVQALAGAKNHSIVLSDANLELATKQIISAAFGSAGERCMAASVVTVQEEIADQLVGRLVEEANKIVIGNGLDEDVFLGPVIRDNHKERTIGYIDSGVEQGATLVRDGREDTAVKGAGYFVGPTIFDHVTQEMKIWQDEIFAPVLSIVRVKSLDEAIEIANESRFANGACIYTDSGASVRQFRETIESGMLGVNVGVPAPMAFFPFSGWKDSFYGDLHANGTDGVEFYTRKKMLTSRWEK

SEQ ID NO: 89010 - protein, 200 aa, Chaetomium globosum
MADPRIEELPDEETKKPTVEELDESSDEESDAEAGDASLPAGSTAVIHSRNEKKARKAIEKLHLTRVPGITRVTLRRPKNILFVINNPEVYKSPNSNTYIVFGEAKIEDLNASAQAAAAQQLANQTAEHDHAGHTHDHKHEAAKEEEEEEDDGEEVDAEGIEDKDIELVMTQANVSRKKAIKALKENDNDIVNSIMALSV

SEQ ID NO: 89011 - protein, 508 aa, Yarrowia lipolytica CLIB122
MVTLVLGLLKHLEHTMEVSTSGKGHSNYSRTALTQLTSFGKQQETSNLDHKLSLALREDFKHRNQPKGQQTDDDNDDDDDGDDDDDDDDDDELDELPISHELFASISKQPVSCLVQEKSGSRLILATGRKTEFYDFPTLDKPFREVDQDAQVTCLAHDPSNIVLAVSETKKVKIYSRDGQELAESVEGDMYLVTPQNTKGHTATVLTGIALGGCEFVTSSRDQTVRIWKYTPGSLKQTNVIVTKTKGVKKVAGDDSGVVYHLAALDGLIVAATKDSLITYSKSNGYSRSMSTLQVEVTSLTSNSTNLVVTTTDKSLKILSKDLKVQLENNLDEVVTSTAYSPDSKYIVAVSDSLRILDSSDLAEVYKCKLRSPAKCVSWHAGLNQICLGLENGQLQMLFSPELSSKGALAVLERGHRKRDIDDVLQTVDVSSTSLKTVNPFADDFHKDNQKRKKQAASHHPDNKLDVWGTPDQKHVDATTDKAYRQDPREELLKYAEKAKNSDILERK

SEQ ID NO: 89012 - protein, 481 aa, Zea mays
SLWLYAESSCAALVVASISSFGINHQFTPMVYPLLVSSVGIIACLITTLFATDFFEIKAANEIEPALKKQLIISTVVMTIGIALISWLGLPYTFTIYNFGAQKTVQSWQLFLCVAVGLWAGLVIGFITEYYTSNAYSPVQDVADSCRTGAATNVIFGLALGYKSAFIPIFAIAFSIFLSFSLAAMYGVAVAALGMLSTIATGLAIDAYGPISDNAGGIAEMAGMSHRIRERTDALDAAGNTTAAIGKGFAIGSAALVSLALFGAFVSRAAISTVDVLTPKVFIGLIVGAMLPYWFSAMTMKSVGSAALKMVEEVRRQFNTIPGLMEGTTKPDYATCVKISTDASIKEMIPPGALVMLTPLIVGILFGVETLSGVLAGALVSGVQVGGSSSQISIAISASNTGGAWDNAKKYIEAGASEHARTLGPKGSDPHKAAVIGDTIGDPLKDTSGPSLNILIKLMAVESLVFAPFFAAHGGIIFKWL

SEQ ID NO: 89013 - protein, 505 aa, Oryza sativa Japonica Group
MELLPWLLGFVVKYPEIMASAACFLLLFCRFRRRSKRIPTNWPVVGALPAIVANAGRVHDWVTEFLRAAAMSHVVEGPWGSPGDVLITADPANVAHMFTANFGNYPKGEEFAAMFDVLGGGIFNADGESWSFQRRKAHALLSDARFRAAVAASTSRKLGGGLVPLLDGVAASGAAVDLQDVFMRLTFDLTAMFVFGVDPGCLAADFPTVPFAAAMDDAEEVLFYRHVAPVPWLRLQSYLKIGHYKKMAKAREVLDASIAELIALRRERKAADANATGDADLLTAYLACQDEIGMDGAAFDAFLRDTTLNLMVAGRDTTSSALTWFFWLLSNHPGVEARILAELRAHPPSPTGAELKRLVYLHAALSESLRLYPPVPFEHKAAARPDTLPSGAAVGPTRRVIVSLYSMGRMEAVWGKGCEEFRPERWLTPAGRFRHERSCKFAAFNVGPRTCLGRDLAFAQMKAVVAAVVPRFRVAAAAAPPRPKLSIILHMRDGLKVKVHRRQED

SEQ ID NO: 89014 - protein, 310 aa, Zea mays
  misc_feature (223)..(223): Xaa can be any naturally occurring amino acid
  misc_feature (252)..(252): Xaa can be any naturally occurring amino acid
  misc_feature (292)..(292): Xaa can be any naturally occurring amino acid
MALTRIGLAGLAVMGQNLALNIAEKGFPISVYNRTTSKVDETVQRAKLEGNLPLYGFHDPASFVNSIQKPRVVIMLVKAGAPVDQTIATLAAHLEQGDCIVDGGNEWYENTERREKAMEERGLLYLGMGVSGGEEGARHGPSMMPGGSLEAYQYIEDILLKVSAQVPDSGPCVTYIGKGGSGNFVKMVHNGIEYGDMQLIAEAYDVLKSVGKLTNGELQQVFXEWNKGELLSFLVEITADIFSIKDDQGEGXLVDKVLDKTGKKGTGKGTVQQAAELSGAAPTLEGSLEFRXFSGLKEETGRGFPKFFQG

SEQ ID NO: 89015 - protein, 106 aa, Triticum aestivum
  misc_feature (5)..(5): Xaa can be any naturally occurring amino acid
  misc_feature (8)..(8): Xaa can be any naturally occurring amino acid
  misc_feature (14)..(14): Xaa can be any naturally occurring amino acid
  misc_feature (16)..(16): Xaa can be any naturally occurring amino acid
  misc_feature (20)..(20): Xaa can be any naturally occurring amino acid
  misc_feature (23)..(25): Xaa can be any naturally occurring amino acid
  misc_feature (38)..(38): Xaa can be any naturally occurring amino acid
  misc_feature (45)..(45): Xaa can be any naturally occurring amino acid
  misc_feature (51)..(51): Xaa can be any naturally occurring amino acid
  misc_feature (61)..(61): Xaa can be any naturally occurring amino acid
  misc_feature (90)..(90): Xaa can be any naturally occurring amino acid
AVGLXILXLPKLAXGXKVLXSAXXXYRSLDALAMQVVXKPGGLLXECSCSXAMTPSGLFLXTIPGAASMAGRKVTVLRQAGAACDHPIDXSYPEGQYLSNYLLRVM

SEQ ID NO: 89016 - protein, 251 aa, Zea mays
  misc_feature (128)..(128): Xaa can be any naturally occurring amino acid
MVKLAFGSVGDSFSATSIKAYVAEFIATLLFVFAGVGSAIAFGQLTNGGALDPAGLVAIAVAHALALFVGVSVAANTSGGHLNPAVTFGLAVGGHITVLTGLFYWVAQLLGASVACLLLRFVTHGKAXIPTHGVSGGTTELEGVVFEIVITFALVYTVYATAADPKKGSLGTIAPIAIGFIVGANILAAGPFSGGSMNPARSFGPAVAAADFAGNWVYWVGPLIGGGLAGLVYGDVFIGGSYQQVADQDYA

SEQ ID NO: 89017 - protein, 482 aa, Geobacter metallireducens GS-15
MERELFDKPLKIDTRPLWLILIDRSARYQVFAGLIIACAILFRLTPPEGLSAAGYHALIVFGATIFLWISGLLPIAVTALFSMALLPLLGIMEAKKTYALFGNEAVFFIIGAFILAAAMTGTGLSARLARAMLARFGKTPRSLALTVFLLSAILSFCMSEHAVAAMMFPVVEEIGTSLGLERGRSRYAKLLFMSMAWGCIIGGIATFLGGARAPLAVGMLRETSGLDYTFFEWTVAAIMIVAPLLVIGFLLLLLFFPPDIAGVDEGLRFLNRKRLETGKMGYGEMTVAAVMVVTIACWMALGKELGLANIAILAMVALFVFRVVSWQTIEEYVNWGIILMYGGSIALATALEKTGAALWIVERGLGAFSPSPLMVIAVISLVSILLTECISHAAVVAILMPIGMSLAKSLGMDLKVMTLAIALPAGLAYCLPMGTPATAIAYASGYLRSKDIIIPGALVMAISWLLFMAAAIFIWPLIGLNI

SEQ ID NO: 89018 - protein, 281 aa, Photorhabdus luminescens subsp. laumondii TTO1
MRYVFSNEVSNYLEIHLHKLREEIRRIWLAKLSTIHIGYDNKYHGETVEIDIILNNIIYEHLDKSELKVTIISEDDSESQSVNIKDKVSLLIDPIDGTHNLLMGYPAYTTSIAVYKNNRYIMGWVYDIPRDIIYKASLGEGSYIQSIYTSKRIYTSPSFQLNDLRVSFHRARNNQYTEVQNKIINEANKVRISSCSSLDICLIASGVLHAFLDLSLMGHERCVDIAAAKLILEESGGYIMTRDGNSYNILSPTDSLFFEKKAIIAVSSKSAGDTILELMRV

SEQ ID NO: 89019 - protein, 159 aa, Ureaplasma parvum serovar 3 str. ATCC 700970
MMIKIISVGKLKQKAFVDLINDYLKRINHYLKCQEIVVSDEPEPVQISNKSLEQIKSKEASKIFKNINQNDFVIALIIESNIISSETLAKKIQQWLNTFSHDICFIIGGSNGLHESIYERANYHLSMSKMTFAHGLAKVMLCEQIYRALSILNNGKYHK

SEQ ID NO: 89020 - protein, 238 aa, Ureaplasma parvum serovar 3 str. ATCC 700970
MKYIIANFKMNATQELINHFLNNLTLFDEQKIIIGLAPGDLYLKTFVNLAEIKKVNLYAQNPSLHNKGPYTGQISCLQLLDINIKNALVGHSEIRIDFSQSIIDQKIKISMDLLEQVIICVGETFDAYKQNKSLNFVLNQLANIINYKGLKKIIIAYEPIWAIGTDLELDFKHINYMIEGIKTYLYNCTGINIPILYGGSVNDNNINELCNQKLIDGFLIGNASLDVNVFNKIIDKCK

SEQ ID NO: 89021 - protein, 257 aa, Helicobacter pylori J99
MEILQFIGYGNMAQAILEGSHEILSKRFILEITGRNPEKIAPFLQEKNIQAQIVPYKDAIDIHQKFVFLLFKPYNLKDFNYQGQAKSVLSALAGVNFEALSNAINSLHYLKCMPNIASKFALSSTAVCEKSVAPSISEKALNIIESFGNCVRVGNEEQVDSSVATNGSALAFLSLVASSLKDAGIREGLNAKDSLELVKMSFKGFAKLLEKERPEMIIEQICTPKGATIEGLSVLEKKGVRGAFIKACHESVKKMRL

SEQ ID NO: 89022 - protein, 322 aa, Arabidopsis thaliana
MDIISGQALLLLFCFILSCFLIFTTTRSGRISRGATALPPGPPRLPIIGNIHLVGKHPHRSFAELSKTYGPVMSLKLGSLNTVVIASPEAAREVLRTHDQILSARSPTNAVRSINHQDASLVWLPSSSARWRLLRRLSVTQLLSPQRIEATKALRMNKVKELVSFISESSDREESVDISRVAFITTLNIISNILFSVDLGSYNAKASINGVQDTVISVMDAAGTPDAANYFPFLRFLDLQGNVKTFKVCTERLVRVFRGFIDAKIAEKSSQNNPKDVSKNDFVDNLLDYKGDESELSISDIEHLLLVSLTLLQIIMIYKIME

SEQ ID NO: 89023 - protein, 179 aa, Rhodobacter capsulatus
MKTNSKLPDVTFHTRVRDESVGGPNPYRWQDMTTADYFAGKRVILFSLPGAFTPTCSTYQLPGFEKGFPEFAAQGIDEIYCLSVNDSFVMNQWAKAQGLENVQVIPDGSGEFTRRMGMLVRKDNLGFGLRSWRYAAIVTNGVIEAWFEEPGLMDNCPEDPYGVSSPENVLAWLKTAKVA

SEQ ID NO: 89024 - protein, 593 aa, Comamonas sp. SFCD1
HGPQAMTPSEAFVETMVANGVTDMFGIMGSAFMDAMDIFAPAGIRLIPVVHEQGAAHMADGYARASGRHGVTIGQNGPGISNCVTAIAAAYWAHSPVVIVTPETGTNGMGLGGFQEANQLPMFQEFTKYQGHVCNPKRMAEFTARCFDRAMSDMGPTQLNIPRDYFYGTIECEIPKPIRIERGAGGEKSLNAAVELLSTAKFPVILAGGGVVMGDAVKELQALAERLGAPVATGYLRNDAFPASHPLWAGPLGYQGSKAAMKLIAQADVVIALGSRMGPFGTLPQHGMDYWPKNAKIIQVEADHTNIGLVKKITVGIHGDAKAVAKALVERLAGKTLAADATKAERAQAIKAEKDAWEQELDGWTHEKDPYSLDMIEEAKGEKPFSGGEYLHPRQVLRALEKAMPPRVMVSTDIGNINSVANSYLRFEEPRSFFAPMSFGNCGYALPTIIGAKLACPDRPAVAYAGDGAWAMSMVEIMTAVRHDIPVTAVVFHNRQWGAEKKNQVDFYNRRFVAGELDNESFAAMAKAMGAEGIVVDRLEDVGPALQKAIDMQMNEGKTCVIEVMCTRELGDPFRRDALAKPVRMLDKYKDYV

SEQ ID NO: 89025 - protein, 250 aa, Desulfovibrio vulgaris subsp. vulgaris str. Hildenborough
MARLILLRHGQSAWNLENRFTGWTDVDLSPAGEAEALAAARLIRDEGLDFSVCHTSMLTRAIRTLHLVQQELDRLWTPVRKHWRLNERHYGALQGLDKRETAARHGEDQVFVWRRSYDVPPPVIAPDDPKHPVHDPRYADVPPDVLPCGESLEATVARVLPYWYDAIAPDLMAGRDVLVAAHGNSLRALVMHLDGLDREDVSRLDIPTGLPRLYELDAALRPVSYRYLGDPAEAEERARAVAAQGRLEKN

SEQ ID NO: 89026 - protein, 162 aa, Capsicum annuum
MAPIAVGDVIPDGTVSYFDEQDQLQSVSVHSLAKGKKVIMFAVPGAFTPTCSTKHVPGFIEKADLLKSKGVEEILCVSVNDPFVMKAWAKTFPENKHVKFLADGAGKYTHALGLELDLSEKGLGVRSRRYALLVDDLKVKVANVESGGEFTVSGADEILKAL

SEQ ID NO: 89027 - protein, 545 aa, Helicobacter pylori J99
MLTQLKTYPKLLKHYEEIKEVHMRDWFSKDKERASRYFVQLESLSLDYSKNRLNDTTLKLLFELAKDCSLKEKIEAMFKGEKINTTEKRAVLHTALRSLNDAEILLDNMEVLKSVRSVLKRMRAFSDSVRSGKRLGYTNQVITDIVNIGIGGSDLGALMVCTALKRYGHPRLKMHFVSNVDGTQILDVLEKINPASTLFIVASKTFSTQETLTNALTARKWFVERSGDEKHIAKHFVAVSTNKEAVQQFGIDEHNMFEFWDFVGGRYSLWSAIGLSIMIYLGKKNFNALLKGAYLMDEHFRNAPFESNLPVLMGLIGVWYINFFQSKSHLIAPYDQYLRHFPKFIQQLDMESNGKRISKKGEIIPYDTCPVVWGDMGINAQHAFFQLLHQGTHLIPIDFIASLDKKPNAKGHHEILFSNVLAQAQAFMKGKSYEEALGELLSKGLDKDEAKDLAHHRVFFGNRPSNILLLEKISPSNIGALVALYEHKVFVQGVIWDINSFDQWGVELGKELAVPILQELEGHKSNAYFDSSTRHLIELYKNYNQ

SEQ ID NO: 89028 - protein, 213 aa, Oenococcus oeni PSU-1
MPKLDYDNQNNWLFKTGQMQSPVALESNKAEKIEKQATLKLNYSTNASYVHDNGQGIEIGLSGKAIIDNRFFSLQQFHIHAPSEHLLNNYRFDGEIHFVHQAKDGRTAVIAVFLKAGKTSKTFSQIFNHLNQDQNFVCDLTDLIPENKSYYHYLGSLTTPPLTENVEWYILANPVEISRQQLAEFHKLYPYNNRQLQSLNGRPVLYCSSTIKN

SEQ ID NO: 89029 - protein, 257 aa, Burkholderia xenovorans LB400
MSRIFITGSADGLGQMAARLLVDAGHQVVLHARSAARAEHALQAVPQAETALVADLSSIAATAELAQQVNRLGRFDAVIHNAAVGYQEPRRIATVDGLSHVFAVNTLAPYILSALIGKPKRLVYLSSALHRSGDASLDDLAWERRPWRGTAAYSDSKLHDALLAFALARRWPQVLSNALEPGWVATKMGGPGAPDDLLAAPKTQVWLAVSDEPAATVSGAYFYHMKPRETHPAVHNVAVQERLLEACAGFSGIRLPD

SEQ ID NO: 89030 - protein, 174 aa, Glycine max
MQAPRCYLFIYLSTRRRRRRRSKRERGENMATTGALCGTMLNTSFLKRQASVNMTSFKANAAVFGVKGGRGGRVRAMATYKVKLITPEGEQEFECPDDIYILDQAEENGIDLPYSCRAGSCSACAAKVVSGKLDQSDGSFLDDDQIDAGFVLTCVAYPTSDIVIETHREEELTA

SEQ ID NO: 89031 - protein, 392 aa, Caulobacter crescentus CB15
MGPGPINVHPRVLRAMSVQLLGQFDPEFTGYMNEVMALYRGVFQTQNRWTFTIDGTSRAGIEAALVSTLQPGDDVVVVNAGRFGLLLAEIAERCDAKVTFVEASWGAVVDPQAVEDAVKRVKPRLVACVHGDTSTTMAQPLGEIGAICRAHGALMYVDATATLSGMDVPVDAWGADIVTAGLQKCLGGPSGSAPITISDQAAEHIFSRRHVEKGLAGTGGAAGAGRRIASNYFDLAMIMDYWSEKRLNHHTECAPMLFAARECARLVLEEGLPARFDRHAQAGAAMTAGLEAMGLSIYGDKAHKMTNVTGIWVPKGVDYDRVKARMRTDFEIEIGSAFGPLTGKIWRIGTMGVNARKHAVLQTLAAFEAVLRWEGFSAPAGAGVDAAAKVYG

SEQ ID NO: 89032 - protein, 463 aa, Listeria monocytogenes str. 4b F2365
MTKVNSFFRKKSFHNPATDKHHLNKTLGAFDLTMLGVGAVVGGGIFILPGQVASVIAGPGIIISFIIAGIACCLAALCYSEFASKLPVAGSAYTYSYHVFGEGVAWILGWSLILEYGLAVAAIASGWSSYMKSLLAGFDLHIPTVISSAYDPSAGTYFDLLAFVVVMVIGILLSFGIRESTRVNNIMVLVKIAVVVLFILVGAFYVKPDNWTPFLPFGVQGVITGASTVFFAYIGFDAVSSAAEEVKNPQKNMPIGIISSLAICTLLYILLSAVLTGVVPYTDLVDVSAPVAFALQAINQNWIAGLLSVGAIVGMTTVVLVMSYGGTRLLFAMGRDGLLPKSFSKISKNDTPVRNTMIFATVMGLIASTVPMADLAQLINIGTLFAFAMVSIGIFFLRRNPDLNQKGFRTPFYPVVPALSFLLCVYLMINLSKTTWIAFGIWFVIGILVYTFYGRKHSALRIK

SEQ ID NO: 89033 - protein, 785 aa, Yarrowia lipolytica CLIB122
MVDDVFKRNRSTSASAALTLGPGDDTTTAKDSGKEITFPQRLKSFFKFNNTNSPVANSGNGPDEEIAFPKYDPTPTIHVQGVPGASNTSPPPDDKETKSSFKQRFLRGRSPSTPSTKDTNTPDQHNQHHGSVPTVPDIPSEFAPKLHYPKHLAAHTPEDEAVDPMDSTKPVPVVDEWPVQPAHMSGSASPNSPNFHSPPSSPSPNNNSNNYNYNNNNSSNYGGLGVPGQHPRKNIRRVASEPNVKNAISNSHSHSGGHHQQHLPIIPAGSEDVRLQDLVREEQQHPSDPITDRDRTHSAPLNDGINHGNGSHGQNSRSGSATPQSRSRTNSKSFARTYSSNSIKVCDVEVGPSSFEKIRLLGRGDVGKVYLVKEKKSTKLYAMKVLSKKEMIKRNKIKRAFAEQEILATSNHPFIVTLYHSFQSNDYLYLCMEYCMGGEFFRALQTRERKCVAEADAQFYAAEVTAALEYLHLMGYIYRDLKPENILLHQSGHIMLSDFDLSKQSEQLGAPTIQSSTNVPQLDTKSCIANFRTNSFVGTEEYIAPEVIRGNGHTSAVDWWTLGILIYEMLFGMTPFKGKNRNLTFSNVLKQEVNFPSGSGYQSISSSCKNLIRKLLIKDEHKRMGSKAGASDIKNHPFFKNTQWALLRNQTPPLVPVPSRGADAVNFRTMKDSSSVDFVTDKKQDKSISSVLSVNTDRSSTNSVAGPRSYGREGDYDPFQNFNSVTLHHVGADSEGEDDDGDITITNQDIPHTFQPNPAKSPNMKNSSGFFFGGQKDKLWKTNRT

SEQ ID NO: 89034 - protein, 497 aa, Oryza sativa Japonica Group
MAATPPSSQHRRPLSSSASAASLAGKPRGGGLLLGRYELGRLLGHGTFAKVYQARSADSGEPVAIKVLDKEKAMRHGLVPHIKREIAILRRVMATKSKIYFVMELVRGGELFGRVAKGRLKEDTARRYFQQLVSAVGFCHARGVFHRDLKPENLLVDEHGDLKVSDFGLSAVADQFHPDGLLHTFCGTPSYVAPEVLARRGYDGAKADIWSCGIILFVLMAGYLPFHDQNLMAMYRKIYRGEFRCPRWFSKDLSSLLNRILDTNPETRITVKEVMESRWFQKGFRPVRFYVEDDQVHSLADGDNDMPELEPSEPPPPPPFPPPPPQQDDDGEESGWESDSSVASCPATLSSEERRQRPLGSLTRPASLNAFDIISFSKGFDLSGLFEERGSEVRFISAEPMQTIITKLEEIAKVKSFFVRRKDWRVSIEGTREGLKGPLTIGAEIFELTPSLVVVEVKKKAGDKEEYDDFCNRELKPGMQHLVHHMGSVPNIPSDTE

SEQ ID NO: 89035 - protein, 166 aa, Rhodopirellula baltica SH 1
MMTQPQPLAFRIGLGYDSHRLGPDGPLRIGGLDVAGDFHAIGHSDADVLLHAVTDALMGAIAGPDIGRLFPDDADENRGRDSRDFVEEALRRVNEAGYEINNVDAVILAQKPKMAPHIDSMRAAVAEMLQTTIEQVGLKAKTGEGVDAVGRSEAIAARAVVMLSRR

SEQ ID NO: 89036 - protein, 502 aa, Ureaplasma parvum serovar 3 str. ATCC 700970
MKLNKKIGLIIIDGLGIGKEDNTNAVHLANPPTLNYLINNFPTLQISAAQQNIGLLENQAGNSEIGHLTIGAGRIILNDNANINNYMKSVDYESAVLSNIKNEIVHIVGMYSNGLVHSNYEHIHWIIKQIIKNNNQVVLHLISDGRDDYPYGFAQFIEQINALKKQYNIIVKSLSGRYFAMDRDQRWERTQKAFNAMFVKQDKICEKTFLEVAQSIANSYKSDEFVQPVVFNDDEKYNLKPHQKVILANYRSDRMRQLAHLLKPNKKFHYNNPFLVQDVNLITLVPFPDVDAIALFEKQNLNNTLGDVFNKHQIKEARIAETEKYAHISFFFDGGVNKYYSTKTQYLIPSQKVATYDLCPQMSAHLITKTIIDHYFDHDVFIVNYANPDMVGHSGNMQQTIEAILSVDHEIRKLYDFFEKNNGVLMITGDHGNAEMMLDDQKQVITSHSVNDVWFIITDNKVILNSTQKFSLANIAPTILEYLNIAQPIQMTATSMIKKICE

SEQ ID NO: 89037 - protein, 327 aa, Listeria monocytogenes str. 4b F2365
MSIVVLGGAGYIGSHAVDELITRGYEVVVIDNLRTGHKESIHTKAKFYEGDIRDKAFLSSVFEKEKVDGVIHFAASSLVGESMEVPLVYLNNNVYGTQIVLEVMEQFGVKHIVFSSSAATYGEPERVPITEDMPTNPESTYGETKLIMEKMMKWCDKAYDMKYVALRYFNVAGAKADGSIGEDHKPESHLVPIILQVALGQREKLAIYGDDYNTPDGTCIRDYVQVEDLIDAHIKALEYLKNGGESNIFNLGSSNGFSVKEMLEAARTVTGKEIPAEVVPRRAGDPGTLIASSDKAREILGWEPTYTDVKDIIATAWKWHVSHPNGY

SEQ ID NO: 89038 - protein, 440 aa, Ureaplasma parvum serovar 3 str. ATCC 700970 [sequence omitted]

SEQ ID NO: 89039 - protein, 474 aa, Ureaplasma parvum serovar 3 str. ATCC 700970
MFSKTRIIATVGPATTKLFSNWLEFNDLNNINDAQQVCINIKDLILSGVNIFRMNLSHGDQKIHLFRTQLIKKIADELKIKVEILFDTKGPEIRVCEMSDNNFIIKNSEVIIHCKEKVLGSFNEFSVTDATGQYNMISDVKINHRILIDDGKLILIVKKIDFLKNIIYTTAKNSYSLKTNKRLNLPDANYSLPFLSKKDIDDINLAVKLKIPYLALSFISNIKQINEVKQLLKKSSFIPKLIAKIETQEAIDNLEEIIKNTDGIMVARGDLGLEVPFYKIPIYQNKIVELCHKYNKYCIIATQMLDSLERNIIPTRAEVTDVYYAVKQKVNATMLSGETAAGIDPINAVQVMKSIILETENNNIENEITFKKNELLIPKEVKLKILSFHKLKINKHKLLVVNLISKNSKHLVYDILKYDFNFNILFVIDKNQEHDLLLKNANFIISENKMLKQEELLKSFNIDFNNHEFLFISI

SEQ ID NO: 89040 - protein, 246 aa, Silicibacter sp. TM1040
MARKLAAGNWKMNGTGEHLAELENLAQGDLPEGVDVLICPPATLISRAADRAGDIAIGGQDCHAKTSGAHTGDLSADMLRDAGATYVIIGHSERRADHGEGDADVRAKTEAAQAAGLVAVVCIGETLEEREAGTTLEVVGAQLAGSLPDGVTAENTVVAYEPVWAIGTGKVPTLDQIAEVHDALRADLVARFGAAGKDLPLLYGGSVKPGNAAEIFGVSNVDGALVGGASLKAADFGPIIAALAAS

SEQ ID NO: 89041 - protein, 394 aa, Methanosarcina barkeri str. Fusaro
MSMTIGLAGKPNAGKSTFFKAATLADVEIANYPFTTINANHGVTYVRVECPCKEKEKRCGKCVDGVRLVPIDIIDVAGLVPDAYKGRGLGNTFLDELRQAQAIIHVVDASGGTDAEGNPVDIGDHDPLEDVAFLNREITMWLYGILERNWVKLARKIQAEGLKLEVVIAEQLAGAGIRESHVNAALIKTGLSRLDHVKWSEEDMIRLCDTMREISKPLLIAANKADIASRENLDRLKDLDRIVVPASAAAELALKSAAKNGLIKYSPGDRKFEVLGGDLTKAQKKGLEAIHKVIERLGSTGVQECINRTVFELLDLIVVYPVEDEGKWSDKSGNILPDAYLMKRGSTCHDLAYQIHTEIGDRFLYAVDARTRLRLGEKHELKNGDVIKIVSTAK

SEQ ID NO: 89042 - protein, 589 aa, Arabidopsis thaliana
MGICLMKRCCSWFLLISFLSALTNENEAISPDGEALLSFRNGVLASDGVIGLWRPEDPDPCNWKGVTCDAKTKRVIALSLTYHKLRGPLPPELGKLDQLRLLMLHNNALYQSIPASLGNCTALEGIYLQNNYITGTIPSEIGNLSGLKNLDLSNNNLNGAIPASLGQLKRLTKFNVSNNFLVGKIPSDGLLARLSRDSFNGNRNLCGKQIDIVCNDSGNSTASGSPTGQGGNNPKRLLISASATVGGLLLVALMCFWGCFLYKKLGRVESKSLVIDVGGGASIVMFHGDLPYASKDIIKKLESLNEEHIIGCGGFGTVYKLSMDDGNVFALKRIVKLNEGFDRFFERELEILGSIKHRYLVNLRGYCNSPTSKLLLYDYLPGGSLDEALHKRGEQLDWDSRVNIIIGAAKGLAYLHHDCSPRIIHRDIKSSNILLDGNLEARVSDFGLAKLLEDEESHITTIVAGTFGYLAPEYMQSGRATEKTDVYSFGVLVLEVLSGKLPTDASFIEKGFNIVGWLNFLISENRAKEIVDLSCEGVERESLDALLSIATKCVSSSPDERPTMHRVVQLLESEVMTPCPSDFYDSSSD

SEQ ID NO: 89043 - protein, 609 aa, Oryza sativa
MEMSLGGDALAVYALATLFNRKKKLQHDNNGSHDLEVVWAPILLMHLGGQMFITAYNIEDNELWRRHILTALSQVTVAIYVFCQSWSSSADRRLLAAAILLFIVGIVKCFEKPMSLKAASFNELVSSNYDAELDIVVNREEMLESFVNEAKALLQRSDHSPPASQQGTREEISSPEFDVPTMLFVDFAYPYSDRLDNLKYFFTLDLTQVCKTINSGLSSIFDILYTRNKIDSEQPDANRYCWLSTWMLAILLVIPAVGLLHSSHKQAYSHNDVIVTFLMAYGTLLLEIISMAVVWKYLDVLPNTMAQQSLVGFFTRNKRHAWLISIAGCLQCKGLLDQYWCMNLCDMSTDITNLVHNYVKDGWTKYIETPRATGVSMTTWDSGHLMMSRAISNYIMHLLFANPEMLMAGSRSNLFTTAYRELDSILHKEKNLPVDDEEKLTLKVIEKVEHKRNCFIHDAFRLARDLLLARGYKKMWDVIIDVWVEMLCFSAGRCRGYLHAKSLGSGVEYLSHVWLLLAHAGMETFPEMLQRRQLFHLPTEEPEDEREDGVIGPSDSQGSKNPHNLKEEGGHGVAPTDTSQGAESRKEKQDQHVAPSAPQGDIVVPPATE

SEQ ID NO: 89044 - protein, 996 aa, Arabidopsis thaliana
MGKECYYLSWILKFHLLLVLIQLVDSGSTIRFLPGFQGPLPFELETGYIGVGEAEKDQMFYYFIKSESNPEKDPLLLWLSGGPFCSSFTALIYENGPIAFKAEEYNGSIPSLVSTTYAWTKVASILYLDQPVGTGFSYSRNPLADIPSDTGVAKPVNEFLHKWLDKHPEFLSNPLYVAGNSYSGIVIPTIVQEISNGNHLDSKPQINLQGFVLGNPATDTDIDLNSRIPFAHGKALISDEHYESLKRSCQGNYISVNPRNTKCLKLLEDFKKCVSGISEEYILKPDCMWLYSCMANLHSLSEYWANEKSVRKALLVNEGTVRKWIRCNTEIAYNKDIRSSVPYHKYISIEGYRSLVFSGDHDMLVPFLGTQAWIRSLNYSIVDDWRPWMVQNQVAGYTRTYANKMTFATVKASCFCMLFFSGKEEHKFTLDNYHVVEQVRRGKSSSDFVVLHDIEDKKYAMKKICLAKHTDKLKQTALQEMKLLSSLKNPYIVHYEDSWIDNDNNACIFTAYYEGGNMANAIKKARGKLFPEERIFKWLAQLLLAVNYLHSNRVVHMDLTNGFSDYRLSMQCSNIFLPKDDHVQLGNYGLAKLINPEKPVSMVSGISNSMCPEVLEDQPYGYKSDIWSLGCCMYEITAHQPAFKAPDMAGLINKINRSLMSPLPIVYSSTLKQMIKLMLRKKPEYRPTACELLRNPSLQPYLLQCQNLSPIYLPVFPIKPVNSPKDKARRNSLPGKFGKERVSREKSEVSRSLENLYPFWTNTETGSSSSSQPASSTNGAEDKLETKRIDPSCDTLKISEFTSQKSDESLIDPDIAVYSTETPAEENALPKETENIFSEESQLRDVDVGVVSAQEVACSPPRAIEEAETQEALPKPKEQITVPISSVAHSSTEVAAAKDHLSGSLEGDKAKMVKLTASEMSSVLSKLTKLGPPQSKERADALECLLEKCAGLVKQEKYEELAGLLTPFGEDGVSARDTAIWFAKTLLSSDKLNQGT

SEQ ID NO: 89045 - protein, 396 aa, Shewanella sp. MR-4
MDKVGMSSYDIAIIGGGISGVGIAQYAAAAGYSTLLIEKGEIGGQTSANSSKLIHGGLRYLESGQVNLVRKSLQERRHLLDFAPSLVKPVPFYIPVYQDNQRNPWMIRAGLSLYALLSEFDPLGRFVSIPAVHWHRFNGLKLQGLKAVFQYWDAQTDDKLLTQSVARSAEALGAHVYAEAEFLQLNHLNEQIELSFRHRGEVQQIEAKLVINAAGPWVNEVIAKVTPPLAGAKIDWVQGAHLLLDLPAPDGILYLESCFDKRVIFVMPWYGQLLIGTTETELTSLDMLPQVTESEINYLLGIYRHYFPMSPSIDELKTKIVQTFCGVRVLPKQASSAFERPRETLMQTSISHPRLLSLYGGKLTTFRSTSAEVLEWIEQKLGKRTPIADVDSLRLS

SEQ ID NO: 89046 - protein, 279 aa, Aspergillus nidulans FGSC A4
MSLSPGARDQYIPIIDSILSASDLNTISEKRIRKGLQDEIGYDLTPQKAAVKQLIMERFDIFAEKKGIGAPPTPNGQNGHEQQHNTATPVEPSSPSQSSTAQKRQADSADSDDRSSKTPPPKKQKANHDIDADALYAAKLQAEENMRARPTRGASTRKAAPVKKKKSTAKTAKKVKAEDDSDIGSGSESGKKVNRSGGFHKPLNLSPALSALLGGAATLSRPQTVKKLWEYIHEHDLQDPSDRRQIRCDDPMRAVFKQDRIHMFTMTKILSQNLYSPDE

SEQ ID NO: 89047 - protein, 457 aa, Lactococcus lactis subsp. lactis Il1403
MNTNQNEENKPSQRGLKNRHIQLIAIAGTIGTGLFLGAGKSIHLTGPSIIFVYLIIGALMYILLRAIGEMLYQDPNQHSFLNFVSRYLGEKPGYFIQWSYLLVVVFVAMAELIAIGTYINFWLPDLPIWMTEVFVLVLLTLLNTLNPKFFGETEFWFGMIKIVAIIGLILTAIILIFSHYHTGTDTVSVTNITKGFEFFPNGLSNFFESFQMVMFAFVSMEFIGMTAAETDNPRPTLKKAINQIPIRIVLFYVGALLAIMSIYQWRDIPADKSPFVTIFQLIGIKWAAALVNFVVLTSAASALNSALFSITRNLYSLSKLNNDKILKPFTKFSKAGVPVNALLFTSLLILFTPFISMIPAISNSFVFITSVATNLFLVVYLMTLITYLKYRKSSDFDPKGFVLPAAHIFIPLAIAGFVLIFISLFCFKDTIVPAIGSVIWVLIFGLFTFFKKIKTAE

SEQ ID NO: 89048 - protein, 385 aa, Geobacillus kaustophilus HTA426
MKHLIQPRVQAIQLSGIRQFFNLVADRPGLVSLTIGQPDFPTPDHVKAAAQEAIAADFTTYTANAGLLELRQAACQFVADKYGLRYTPDEVIATVGASQALDITFRTILEEGTEVLLPAPVYPGYEPLIRLCGAKPVYIDTRPNGFRLSAELIAPYLTEKTRCLVLPYPSNPTGTALSAEELENIASLLKGRPIWIVSDEIYSELVYHGRHHSIAEWLPEQTIVINGLSKSHSMTGWRIGFVFAPAFAVEQMVKVHQYSVSCTSSISQKAAVEALTAGKHDAEAMRAAYAERLEYAYHRLTAMGLPVEKPDGAFYLFPSIAAFGMSSFDFALDVVENAGVALVPGSAFSEYGEGHVRLSYAYSLDVLKEGLDRLERYIQTKRRRP

SEQ ID NO: 89049 - protein, 355 aa, Prochlorococcus marinus str. MIT 9215
MALNYYKNELKENAQLLASKGKGILAVDESTKTVGKRLAGIGVENTEDNRKAYRGMLFTTEGLGKYISGAILFEETLYQNHQDGESMVKKLNDLGIIPGIKVDKGLNPLPGGGDVETFCSGLDGLVERAAKYYEQGARFAKWRAVLQITNDGCPSKLSIQENAWGLARYARSVQESGLVPIIEPEILMDGDHTIEKTAEVQEEVIKQVYIACQANGVFLEGTLLKPSMTVNGADCPTKADPMKVAEMTIRTMERCVPASVPGIVFLSGGLSEEAASVYLNNMNTLYRKALWNVSFSYGRALQHSCLKAWKGSDVEGGQKALIARAQANSEAATGSYVAGSQPSSDEQLFVAGYTY

SEQ ID NO: 89050 - protein, 1705 aa, Shewanella sp. MR-4
MKLKILTCTIAAALYGAGAMQAAASIGDVHKLKGLQLTSDQIAKLNAPETKIDDADLGIGLNLQITPQANKFEFEDGITGEQIYIVRLNQKPLAQVSTELLASTTASKTFGKSSNSKLFVAGQPASSAVKNYRSRLLDSQRQVIADVQSTVGARQVRQQFTNAVNGFSIAMTQEEAQRVSQLANVSSVRRSKTYELLSDAGPELIQANKIWSGEATDSVPYKGEGIIVGIVDTGINSDHRSFADVGDDGYDHTNPWNAGNYVGDCTKSGFETMCNDKLIGVRSYPVITDNFTSGVYGATRPAVGEDYQGHGTHVASTAAGNVLLDVDYVNPDSGTEASDGSVIKPKLFPRMSGVAPHANIVAYQVCHPSNAINAGCPGEALIAGIEDAINDGVDVINFSIGGQDSNPWADDVELAFLSAREAGISVAVAAGNSGQPVGYKEYFGRIDHASPWLMNVAASTHAREVEITTKLIDPMGGSEVPKWSEIVGGAINTAPVTGMVVNAKNFGDEYCAKPFPAGTFDLKDGDGNPTDVIVVCKRNSLEDPNAVARTAKADNIKAGGADGMIMYNYATADALVPTASYSVPSIHITKEEWDGRYDNGLAGYGLSDWLAKGSNHMLTISGTTIERTMDPERADWLAAFSSRGPSPSTPEALIPAVAAPGVDIYAAFADEHPFSSSAASGDFAFLSGTSMASPHVAGSMALLRQAQPSWSATEIQSALAMTAENKVQYYRLDDKNGDVALASTYRAGTGRINVANAVNAGFVMDETVERFKAADPHNGGAVHKLNIPQLVNFECKPKCQWIRTIKATKDGTWSVTNGDVINWSVDSRSQFVQNGVSIKVTPNEFTLAAGETMDIVVEASIMDTQDWFSNAEVELHSNLTFTETSGRASEAHWPVVFKYDKNGMPGRLSAVAHRNEANAVIKGIDLPEGDNIHGRIFSPVKAEVKTVVLPKDGDGNFPWSSNADLTVSMDERIDEATYVEMIDVPANARRLIVESFGTTQSELSEVLDKGNLIVFVGKDYNGNGKADPFEELLCVSNHIQYNNFCNINQPEEGKYWALFYNPRKGSASNNYYNALEETFQYATTVVMDQVASEMSVDVPASNGRDPVDITVNWDMPEMKEGDVYYSLLDFGTSEVNAGNIGKVAFKLERGVDDVHLDATQTAAVAGDQIPFTFEVQPNNTGADRAFSIVATIPSGFSLRAEDVLSSSSTIVKDVKLENGKLTISGIQPDTSELEPRYNITTNVDDAMCRTPDFGNKKPGGYVNLEEFTIYPIFSGFAPVEYGANGKALSGKDNNILYRNGITLPISTVFNGAYDSFHLYNNKDSINVWKQNHLDIRGHGIVSLFQNQPFFYPYHDIFPYNSFPYASIGMLWRGFGLGAGATQDILSVPLINKTTERAGISIASTPSGWGILEYDNARSYKPLGYDANRVYQWEEKDDRFDFELIFNANTRFGDGEYELMMAYDNINFGSQDDRGSIGLQGFQGGLYAYGPLQKYLGEQYAFNNLKDKIHNGLVICYDYVGPESSQFEVTAWTTVKNNAAGQVLTVDAVSQVEGMADISMSHSVTVPSNISIGAIADQTIAENTSLEGLKVVFADEQNSVNKITVTGEHISAVVDGNTSGSSITITPEANFHGDVEVTVTVSDVESPTDAASTSFMLTVESDGVEPPTTPVTPEPKPDTNKDSGGALGGLSMLLALGALIRRRKTH

SEQ ID NO: 89051 - protein, 391 aa, Oryza sativa Indica Group
MQAKKTRDFSGGWRMRIALARALFMNPTILLLDEPTNHLDLEACVWLEETLKKFDRILVVISHSQDFLNGVCTNIIHMQNRKLKLYTGNYDQYVQTRAELEENQMKQYRWEQDQIASMKEYIARFGHGSAKLARQAQSKEKTLAKMERGGLTEKVVRDKVLTFRFTDVGTLPPPVLQFVEVTFGYTPDNLIYKNLDFGVDLDSRVALVGPNGAGKSTLLKLMTGDLIPLDGMVRRHNHLRIAQFHQHLAEKLDLDMSALQYMMKEYPGNEEERMRAAIGKFGLSGKAQIMPMRNLSDGQRSRVIFAWLAWREPHMLLLDEPTNHLDIETIDSLAEALNEWDGGLVLVSHDFRLINQVAQEIWVCEKQAVTRWEGDIMEFKEHLRSKAGVDD

SEQ ID NO: 89052 - protein, 459 aa, Lactococcus lactis subsp. lactis Il1403
MENLQEKHEAQRGLQNRHIQLIAIAGTIGTGLFLGAGKTIQMTGPSVIFAYILIGIAMFFFLRTIGEMLYNDPSQHSFLNFVTKYSGVRTGYFTQWSYWLVIVFVCISELTAIGTYIQFWLPQVPLWLIEIVMLALLFGLNTLNSRFFGETEFWFAMIKVAAIIGMIVTAIILVAGNFHYSTVLSGKTVHDSASLSNIFDGFQLFPHGAWNFVGALQMVMFAFTSMEFIGMTAAETVNPKKSLPKAINQIPVRILLFYVGALLAIMAIFNWHYIPADKSPFVMVFQLIGIKWAAALINFVVLTSAASALNSSLFSATRNMYSLAQQHDKGRLTPFTKLSKAGIPINALYMATALSLLAPVLTLIPQIKNAFDFAASCTTNLFLVVYFITLYTYWQYRKSEDYNPKGFLTPKPQITVPFIVAIFAIVFASLFFNADTFYPALGAIVWTIFFGLYSHYKKI

SEQ ID NO: 89053 - protein, 444 aa, Oenococcus oeni PSU-1
MKTDQKQDNQQKSLDEVNGSIKVPKNAGFWRTLLAYTGPGSLIAVGYMDPGNWITSIGGGAQFKYALLSVILLSSLIAMLLQSMAAKLGIVTGKDLAQLTRDRTSKRVGFVLWIITELAIMATDVAEIIGSGIAIELLFGIPLIVGILITSADVLILLLLMRSGFRKIEAIVATLVAVVLFVFSYEVILSQPNIPEVLKGYLPTYKIVTNTPMLYLALGIVGATIMPHDLYLGSSISQTRRVDRSDKNSVKNTIRFTTIDSNIQLTIAFVVNCLLLVLGAALFYGTNSSLGRFVDLFRALNNSQVVGAIASPVLSMLFAIALLASGQSSTITGTLSGQIIMEGFIHLHMPLWIQRLLTRLISVTPVLIFAIIYHGNEAKIEQLLTFSQVFLSIALPFAVVPLVIFTNDEKLMGEFKNHAWVKWTSWLITAVLIVLNIYLILQII

SEQ ID NO: 89054 - protein, 198 aa, Oenococcus oeni PSU-1
MKITNPKLIISAVSKKQYPAGNLSEIAFVGRSNVGKSSLINTLIERNGLAHTSGQPGKTQTLNFYNLDEKLFFVDVPGYGYAKVSKAQREQFGSMVEEYLSSRDQLKGVISLIDARHEPTEDDKLMYNWLEYYQVPILIVATKADKVASGKFNAVESQIKKTLKFNSTTSSLILFSAIKKFGAKEIWNWIKGQAELQE

SEQ ID NO: 89055 - protein, 1432 aa, Shewanella sp. MR-4
MIELRIDNQIVTAEPNDNLLRAASKAGIAIPSLCDPTDATRQLGAAPHADKQDCNLCLVQIENTDASLRCVKACETPAEAGMKVITQSAYLTKQRQAALSTILSDHFADCEAPCQQACPAGVDVQSYLYHIAQGDHSQAIKVIKDTLPLPLSIGRVCPAFCETECRRGLVDDPIAIRQLKRHAADLDLADDEQGGSYQPPRLADTGKKIAIIGAGPAGLSAGYYLSNQGHSVEIFEAMPKAGGWLRYGIPEYRLPKAILDKEIELLCRNGLTIHTDTRLGHEIHLAQLVADFDAVCLAIGAQKAVPMNYKGSELAGCYLGVGFLKEHCLDKQLKLGKKVAVIGGGNTAIDCARTAVREGCDVTLIYRRTRAEMPAEAYEVHEAEVEGVKFHFLTNPIENHSDANGQVEAVTFSKMALGEADASGRRAPVDTGETFTEAFDTVIAAVSQAPDLSFMQDPMGQLSHGELALSRWNTLIGCEQTMSSGVEKLFVMGDARRGPATAVAAIGDGRKAAIAIDKMLKIGLSCDLHAHEFNSVKTIPSALIPNALKQTETSSKAGSTHYPHTPRQPRLKMPELTALQRLLNYSEVELGFPADAAMQEAARCLECACQANTDCKLRDYATDYGVEAKSLATENARHFSVDKSAPFIQFDANRCISCGKCVDVCQQQSGHCAIQFSQDSYQALPQEMTQHMERRAPRVGFSASMADSLCVQCGNCVQVCPTGALVDARDKRQGDSTELKTASTICTYCGVGCRLDLKIDSNANRIRHIEGNKDSVVNQGMLCVKGRFGFDFIHSDKRLTTPLIRKNGELQPSSWPEAIAYVAKRLTEIKQKDGSNALASLASAKATNEDNFVLQKFVRSVLGTNNIDHCARLCHSSTVTGLQQSIGSGAMTNDIPSIKDSDVIFILGSDTTCAHPIIASKIQQAVMQHGARLLVADPKRVGIAEKAELYVAHRPGTDVMLLNAIMAEIIRNDWQDKDYIAERTEGIVALYAELSKEDYSLENAALITGVKAEDIARLARTIGTAQKTAVYYAMGITQHTTGHDNVTAISNLQLLCGNIGVSGAGINPLRGQSNVQGACDMGALPNYFTGYQKVTDIHARMRFEDHWQTPLSEEIGVTATHMMHDIAKGNIKALYVMGENPVLSDPDQAHVLNALSKVEFLVVQDIFLTETAELAHVVLPAAAFVEKRGHFTNTERRVQRLEQALASPGEALPDWQIVQAVANAMGANWDYANEEAIWCEINELTPQYRGIRWDRLSANAEGQISQGIQWPCPDETHPGTPIMHQSQFTRGLGLFTPVSYRLPAEMPCNEYPLTLSTGRLLEQFHTGTLTRKTPGLDLLGAPKVMISVYDAEQLGIHNGDKLRLTTRRGEIEIDAFVTKRAQAGVLFLPFHFVEAAANKLTINALDPVAYIPEYKVCAVRAEKVTTSVSEPA

SEQ ID NO: 89056 - protein, 299 aa, Prochlorococcus marinus str. MIT 9215
MSKRHPVVAVTGSSGAGTSTVKRAFEHIFAREDIVPAVVEGDSYHRFERMPMKKAMAEALSKGENFSHFGPEANLFDKLEELFKIYGETGGGKKRYYLHSPEEAEEHNSRLGTSLEPGQFTPWEDIPKGTDVLFYEGLHGGVEGDGYNVASYADLLVGVVPITNLEWIQKIHRDNAERGYSAETIVDTILRRMPDYINHICPQFSKTDINFQRIPTIDTSNPFICRNIPTPDESFVIIHFRKGAREKWGIDFQYLLGMIHDSFMSSPTSIVVNGGKMGFAMELILTPIIHKMIEEKNKG

SEQ ID NO: 89057 - protein, 357 aa, Prochlorococcus marinus str. MIT 9215
MKKHKIVLLSGDGIGPEISEVSKKVLKKISNNHNFDIEIIEKLFGGIAYERYGTPAPDETLDQCKKSDAVLLACVGDIKYDSLARELRPESGLLKLRSALNLFANIRPVKIRKSLLDASTLKKEIVEHVDLIVVRELIGGIYFGKPRGHITNTKIPKAFNTMVYDSAEIERITEIAIKIANQRNKKICSVDKSNVLEVSQLWRDTVLNVTSKDKNISLSNMYVDNAAMQLVRDPGQFDVILTSNLFGDILSDLAAMLTGSIGMLPSASLNNDGPGVFEPVHGSAPDIAGKNMANPIAMLLSASMMLKIGLNEEKAAENLETAIDKVLSNGFRTADLADGSSEVLSCSEIGDKILDEI

SEQ ID NO: 89058 - protein, 220 aa, Streptococcus equinus
MSNNKIAPSILAADYANFASELKRIEETSAEYVHIDIMDGQFVPNITFGADVVASMRKHSKLVFDCHLMVVNPERFVDAFAQAGADIMTIHAESTLHIHGALQKIKKAGMKAGVVINPGTPVSAIEPVLSLVDQVLIMTVNPGFGGQAFIPEMLEKVQKVAKIRDEKGYDFDIEVDGGVDNKTIKACYQAGANVFVAGSYLFKASDLTAQVETLRVALDD

SEQ ID NO: 89059 - protein, 134 aa, Brassica napus
  misc_feature (128)..(128): Xaa can be any naturally occurring amino acid
MASLGDHDEIIKSVSDAPPTHYMVKIESFSLLTKHAIERYETESFEAGGYKWKLVLYPNGNKSKNMKEHVSVYLALADSTSLGPGWEVSAVFRLYLLDQNKDSYLILQGKERRFHTFKREWGFDKFIXTATFFN

SEQ ID NO: 89060 - protein, 255 aa, Geobacillus kaustophilus HTA426
MNGKVIIVTGGSSGMGKYMAKRFVSDGANVVITGRRAEALEEAKREIAAPDGGKVLTIPMDVRNPEQVAHMVERTDAEFGRIDALINNAAGNFICPAEKLSINGWNSVINIVLNGTFYCSREVGNYWIQRGLKGNIINIVATYAWHAGAGVIHSASAKAGVLAMTRTLAVEWGKKYGFRVNAIAPGPIERTGGAERLWESEEAERMTLESVPLGRLGTPEEIAAVASFLLSDEAAYINGACITVDGGQWLNRRPF

SEQ ID NO: 89061 - protein, 284 aa, Picea sitchensis
MSILPKSDSIHIREVWADNLEEEFNLINEIVDDYPLVAMDTEFPGIVVRPLGKFKTVQDFNYETLRSNVDVLKLIQLGLTFSDEDGNLPSCGTDRYCVWQFNFREFNIWEDAYASDSIELLRQSGIDFKKNSELGVDSHRFAELLMSSGIVLNENVRWITFHSGYDFGYLLKLVMNRRLPLTQAGFFYLIRMYFPNLYDIKHLMKFCNSLHGGLNRLAELLEVERFGACHQAGSDSLLTSCTFRKLRESFFNGAADKYAGVLYGLGEESNTDNNDNSNQNDPQC

SEQ ID NO: 89062 - protein, 588 aa, Arabidopsis thaliana
MGSTPTDLPGEDVADNRSGVGGGISDVYGEDSATLDQLVTPWVTSVASGYTLMRDPRYNKGLAFTDKERDAHYLTGLLPPVILSQDVQERKVMHNLRQYTVPLQRYMALMDLQERNERLFYKLLIDNVEELLPVVYTPTVGEACQKYGSIFRKPQGLYISLNEKGKILEVLKNWPQRGIQVIVVTDGERILGLGDLGCQGMGIPVGKLSLYTALGGIRPSACLPITIDVGTNNEKLLNDEFYIGLKQRRATGQEYAEFLHEFMCAVKQNYGEKVLVQFEDFANHNAFDLLSKYSDSHLVFNDDIQGTASVVLAGLIAAQKVLGKKLADHTFLFLGAGEAGTGIAELIALKISKETGAPITETRKKIWLVDSKGLIVSSRKESLQHFKQPWAHEHKPVKDLIGAVNAIKPTVLIGTSGVGQTFTKEVVEAMATNNEKPLILALSNPTSQAECTAEQAYTWTKGRAIFGSGSPFDPVVYDGKTYLPGQANNCYIFPGLGLGLIMSGAIRVRDDMLLAASEALAAQVTEEHYANGLIYPPFSNIREISANIAACVAAKTYDLGLASNLPRAKDLVKFAESSMYSPVYRNYR

SEQ ID NO: 89063 - protein, 398 aa, Bacillus cereus E33L
MHHLLNSRVKQIEISKIRQISEMAARYDNVISLTIGQPDFYTPEHIKSAGQAAILNNKTSYPPTSGYKELLISAAGFLQQKYGLHYDSNSEILVTNGATEGIYIALRSILDEDSEVILPAPIYSGYEPIIRLCGARPVYVDTSSTDFKITAQALENAISEKTRCIILAYPMNPTGATLSKKEMNEIRNVLIDKEIFVVSDEIYSELNLDNEHVSIAQTEGMKYKTIIVNGLSKSHAMTGWRIGFTFAPSYITEQMKKVHQYAVTAVSSISQMAAIDALTVGRNDASVMREEYRKRRDYVLKRLKSMKFDVIKPEGAFYIFPSISKFKITSHQFAIDLLENAKVAVVPGDAFSEFGEGYIRISYASSMVELKEALDRIENYMNTKYESFYRMYSAKLEL

SEQ ID NO: 89064 - protein, 323 aa, Caulobacter crescentus CB15
MTTPTKIIFDTDPGIDDAMALLFIEASPALDLIAVTTIFGNADIETTTRNALYLKDRFGLTAPVYKGTDKPLTRPRNPSPTFVHGVNGLGDVELTGLVPAQPEAKPAHQAIIDLARQYPGEVVLCAVGPLTNLALALQADPEVATLLKSVVIMGGAFGVAGKPGNVTPVAEANIWNDPEAADQVFTAPWNLTAVSLDVTTQVVMSPDYMDALAAGGSDACGFLNAISKPYAAFYGERDGVVGCCVHDAAAVAYVIDPSLFTVRRGSVRVVTEGIALGQTCQKAEGELFGPSAWDDQPIQAATVAVDGARLLTLYAQTMAAKYG

SEQ ID NO: 89065 - protein, 543 aa, Zea mays
MEKTRRHRVLAVLLLLVVVLVSALPDLGSCHKDDAGQGGTTNPEEDMVSVSEARTTHHGDRTRKFLHEQQQQNRYWSGDFGDKVSSLTDSSQYPPDSGGSSSQSPASTFKPDQWQPWLPWAPKAPPPMSVPPAQAPAPFPAGVVSNPGHSIALPPQPAVVVPADAGSRPAVGAGVPAGGAGARPRSGGVGRPVYAMAAAGASLAAAAAVALLVLCYRSSSVVTVRPWATGLSGQLQKAFVTGVPSLKRSELEAACEDFSNVIGSLSDYMVYKGTLSTGVEIAVVSTTKNSAKEWSKHCESQFRKKITSLSRVNHKNFVNLLGYCQEEQPFTRMMVFEYAPNGTLFEHLHVREDGYLDWPTRLRVAVGVAYCLEHMHQLSPPEILRALDTSTICLTDDFAAKISDVFFCDEPRRQEGSLSLSALSDRESVVYSYGMVLLETMTGRFTASDGGLLEAWAAAYLRGERQLRDVMDPALRRSFHAATVDRLDGVIRGCTDREPRRRLTIAEVAKRLREITAMSPDAATPKVSPLWWAELEIICAEVN

SEQ ID NO: 89066 - protein, 280 aa, Vibrio cholerae O1 biovar eltor str. N16961
MSIKIKNAVEIEKMRVAGRLAAEVLEMIEPHVKAGVTTEELDQICHKYITEVQGAIPAPLNYHGFPKSICTSINHIVCHGIPASEDTYFGQIQRPAVLRDGDILNIDITVIKDGYHGDTSKMFLIGDVSIEDKRLCHVAQECLYLALKQVKPGVQLGEIGTTIEKHIKTNNKNNPRFKFSIVRDYCGHGIGAEFHEEPQVVHYKNSDRTVLREGMIFTIEPMINAGKFGCRLDDEDSWTVYTADGKKSAQWEHTILVTATGCEILTLRSEESLPRILNNA

SEQ ID NO: 89067 - protein, 758 aa, Caulobacter crescentus CB15
MDEDFRKAALDYHRLPRPGKLAIEATKRMATQRDLALAYSPGVAAPCIAIAENPELARDYTARGNLVAVISNGTAVLGLGDIGPLASKPVMEGKAVLFKKFAGIDVFDIEVDAKDPDRFIEVVAALEPTFGGINLEDIKAPECFVIERKLRERMNIPVFHDDQHGTAIVCAAAVRNALLVQGKQLKDVKLVTSGAGAAALACVDLLVSMGLPVENVTLTDIKGVVHAGREPDMPDNMARYARQTDARTLPEVLPGADIFLGLSAPRVFKPEWLPLLAPNPLILAMANPEPEILPELVYESRPDAIMATGRSDYANQVNNVLCFPFIFRGALDVGASEINEAMKVAAVEAIAELARAEASEVVASAYGGAAPVFGSQYIIPKPFDPRLILQIAPAVAKAAMDSGVATRPIADFDAYQAELELFVYRSGQLMRPVFERARKQPVKVAYAEAEDERVLRAVQTVVDEGLAYPVLVGRREVITGKIEELGLRLAGKVEIIDPQADKDLFAPLIADYQRLVGRRGVPPIAAERRVTGRRTVAASMLLATGYVEAALVGGSGDWWQHMKYALPIIPRRDNVSRVYAMSSLILDKGTLFFCDTHVNVDPTAEQIAECTQLAAEAVRRFGLTPKAALLSHSSFGASDSPTARKMREALALLRTQAPDLEVDGEMHADAALSQHLRDRMVADSPLKGSANLLVMPTLDAANIGLTLLSAATESLLVGPVLLGMAKPLHVLIPSVTARGIVNLTALAVNQAVSERAAS

SEQ ID NO: 89068 - protein, 330 aa, Ureaplasma parvum serovar 3 str. ATCC 700970
MSKNDDILLFSLSNSHQLANKIANLLKIELSPIRIDKFADGELIVAPQVPVRGRRVIIIQSTSKPVNDSLMELLIAIDSIKRASAKAISVVIPYYGYARQDRKAKPREPITARLVAKMIESAGATSVLTWDIHSLQTQGFFDIPFDSLEAVWVLMKHYFSAYKDSSNITIVSPDYGGVKRAREISIATGATLAIVDKRRSGKNQVEINNVLGDVKDRDCVIVDDMIDTGGTILGAAKIVREKGAKSITIIATHGLFNNNARQHFQQAIKDRIINKICIADTIENEPFDGLEIVSIAPAIAKCIEIYSEGTGSMSFVHDENSKVLFAKKIY

SEQ ID NO: 89069 - protein, 265 aa, Rhodopirellula baltica SH 1
MLTKQRKLILSETQRDMMRAAGQANAALLDYVRPHVKPGITTGKIDQMIHDWTYGHGYRAATLGYQKYPKSCCTSVNEVICHGIPDDYELKEGDIINVDITTVVDGWHGDQSETFLLGEVSEEKRAVTQCAFDCMHLAIDALTPGCRVATIGEAVVPEAEGRGFTVVREYVGHGLGKQFHLDPSIPHFPNRQSRIDRLFPGMCFTIEPMINAGSRYTQCDKADGWTVRTKDGRPSAQFEHSILMTESGPEILTQTKDGPKKGHKF

SEQ ID NO: 89070 - protein, 293 aa, Triticum aestivum
  misc_feature (54)..(54): Xaa can be any naturally occurring amino acid
  misc_feature (81)..(81): Xaa can be any naturally occurring amino acid
VGTTDTLGGTLSGRPWGGRAFPTFGKEPPLPGSAFRRHNLSPTEFCSEELPLPXRRLALTAPDRAVPGSIIDDEYAGATLXSPKILLTTSRNPSAPLTQFVKELKVVFPNSQRMNRGGQVISEIVESCRSHEITDLILVHEHRGQPDGLIVCHLPLGPTAYFGLLNVVTRHDIKDRKAMGKMSEAYPHLILDNFTTKTGERTANIMKHLFPVPKPESKRLITFANRDDYISFRHHIYEKHGGPKSIDLKEVGPRFELRLYQIKRGTVDQSEAQNEFVLRPYMNTAKKQKSLGV

SEQ ID NO: 89071 - protein, 337 aa, Oryza sativa
MVPKVGINGFGRIGRIVFRNATQAGTVDVVAVNDPFIEVHYAAYMLRYDSTHGQFKGTIEINGTEGLIVNGKKIRFYAERDPAAIPWGKEGADYVVESTGVFTTTDKASAHIKGGAKKVIISAPSADAPMFVMGVNNDSYTKDVNVLSNASCTTNCLAPLAKVINDKYGLVEGLMTTVHSYTATQKTVDGPSGKDWRGGRTAAQNIIPSSTGAAKAVGKVIPSLNGKLTGMSMRVPTANVSVVDLTCRIEKGATYEEIKATIKAASENELKGILGYTEDDIVSTDLNGDDHSSIFDAKAGIALNANFIKLVSWYDNEWGYSHRVVDLISYIAKVDGQ

SEQ ID NO: 89072 - protein, 339 aa, Photorhabdus luminescens subsp. laumondii TTO1
MTIKVAINGFGRIGRSILRALYESGRRAEIAVIAVNELADAEGIAHLLKYDSSHGRFAWDVRLNNDVLQVGDDNIRLFHQSDISMLPWQELGIDIVLDCSGIYGSRADGEAHLASGAKKVLFAHPGGNDLDATVVYGVNQHLLTAEDRIVSNASCTTNCIIPIIKLLDDQFEIESGTVTTIHASMNDQPVIDAYHKDLRRTRAASQSIIPVDTKLAAGITRIFPKFCDRFEAISVRVPTINVTAIDLSVTVKSSVTVNKINELMQKSAATSFRGIVDYTELPLVSTDFNHDPHSAIVDGTQTRVSGQHLIKTLVWCDNEWGFANRMLDTTLAMAAMGFK

SEQ ID NO: 89073 - protein, 294 aa, Nicotiana tabacum
YTTYFAEALIAEAEADKDIVAIHAAMGGGTGMNLFHRRFPTRCFDVGIAEQHAVTFAAGLACEGLKPFCAIYSSFLQRAYDQVVHDVDLQKLPVRFAMDRAGLVGADGPTHCGAFDVTFMACLPNMVVMAPSDETELFHMVATAAAIDDRPSCFRYPRGNGIGVELPVGNKGTPLEVGKGRILVEGERVALLGYGSAVQNCLAAAAVLESRGLQVTVADAPFCKRLDHALIRSLAKSHEVLITVEEGSIGGFGSHVAQFMALDGLLDGKLKWRRIVLPDRYIDHGSPVDQLAEA

SEQ ID NO: 89074 - protein, 387 aa, Photorhabdus luminescens subsp. laumondii TTO1
MSVIKMTDLDLAGKRILIRADLNVPVKDGKVTSDARIRASLPTIEAALKQGAKVMITSHLGRPTEGEYSEEFSLKPVVDYLEEKLSSPVRLEKEYLEGVDVAEGELVVLENVRFNKGEKKDDETLAKKYASLCDIYVMDAFGTAHRAQASTHGVAKFAPVACAGPLLSAELEALGKALDNPARPMVAIVGGSKVSTKLTVLDTLSKIADQLIVGGGIANTFVAAEGHNVGRSLYEDDLLPEAKKLLISCDIPVPTDVRVATEFSETAEAILKSTHDIKDDEQILDLGDESAQRLADILKNAKTILWNGPVGVFEFPNFRQGTEIVARAIADSDAFSIAGGGDTLAAIDLFGIADKISYISTGGGAFLEFVEGKKLPAVVMLEERAKQ

SEQ ID NO: 89075 - protein, 302 aa, Oryza sativa Japonica Group
MDRYQRVEKPRNETPISENEIRITAQGRMRNYISYGMSLLEENGHDEIVIKAMGRAINKTVMVVELIKRRIGGLHQITSTESIDITDTWEPLEEGLLPLETTRHVSMIAITLSKKALDTLSPGYQPPIPAEEVRPAFDYEHEAQPFDDKFLHGNLESFPTNRGRGRGGGRRGRGRAMSNGPPAYDYGEEWEEEGDYYNYRGRGRGRFRGRGRGRGRGGYYGGGRRGGYGYDYGYGGRGDYYEDQGEYFEEPEDYPPPGRGFAISLLMAPLILGRLHRTWQGKKGRRTGTIPWSRPWAWSILR

SEQ ID NO: 89076 - protein, 553 aa, Sulfitobacter sp. EE-36
MARTTFRSFTKNLDVTDLRWMPGEGFSPSRLRIELLSGLTVALALVPEAVAFAFVAGVHPLVGLYAAFLVGLITALIGGRPGMISGATGALAVVMVALVAQHGVEYLFATVVLMGLIQIFAGVMQWGKFMRLVPHPVMLGFVNGLAIVIFLAQMGQFKVPGTMVDTGHGMSGGEWLSGGPLYLMLALVAATMAIIWVMPRITKLIPAPLAGIGIIAILVIATGMDVPRVGDLASIEGGFPTFHMPFGEGVGLYGTALAPFTLETLYIILPYAVILAAIGLIESLLTLNLVSDLTNTRGGASQECIAQGVANTVTGFFGGMGGCAMIGQSMINVKSGGRTRVAGIAAAVFLLLFILVGAPLIEQIPLAALVGVMFMVVIGTFAWNSFGILRKVPLTDAFVILLVTVVTVYEDLAVAVVVGVIVSALAYAWNNARRIHAKTYTTPEGAKVYQIQGPLFFGSSEGFAELFNVKADPSEVIVDFEDSRVVDQSALQAIETIAAKYEGAGKRIQLRHLSRDCHRLLKKAGHLMIDSDDDPDYEIAANYQVRTGILGGH

SEQ ID NO: 89077 - protein, 178 aa, Prochlorococcus marinus str. MIT 9215
MKEANSNDNYDAQTLLLNDSNGNELFCYLEQLVSIEGQEYALLTPVDTPVSLFKINEKDEPELIEKIDKNEQILKNAEAVLQEHDLRLIRSAVTLTVSGELEEPIYDELEEDYVDDDSESYELLVNFNLFDQEYGLYIPLDPFFIVGKLKDKGALLVEDDEFDKIQPLIETELEKSSS

SEQ ID NO: 89078 - protein, 176 aa, Sulfitobacter sp. EE-36
MKQVQDYIRTIVDFPHEGIMFRDVTTLFADPRGFRMAIDQMLHPYAGIDIDKVVGLEARGFILGGAIAHQLSVGFVPIRKKGKLPGRTISQDYKLEYGEAIVELHDDAIKPGEKVLVVDDLLATGGTAEAGIKLIQRLGGEIVSCAFIIDLPELGGRKRLEAMGMEVNALCAFEGA

SEQ ID NO: 89079 - protein, 477 aa, Lactococcus lactis subsp. lactis Il1403
MENQNQVKRNLKQRHITMIALGGTIGTGLFLTSGATISQAGPWGAVLAYCFIGIMVYFVMTSLGEMATYLPTSGSFSDYGGRYVDPAFGFALGWNYWLNGAITIAVDLTTAGLITQFWFPHLPSWIFSGIATVLIFIINVMAVGAFGETEYWLSTIKVITIVLFLAIGLLTIFGVLGQGNVDVVANLSAGNHGFVGGISGFVGVLLIAGFSFQGTELLGITAGESEDPGKSIPKAMNSIFWRILLFYIFSIIVIAAIINFKDPRLLNPNSTAVMSPFTIVFKNIGFAVAASVMNAVILTSVISSANSVMYASTRILYSLGQEKGAPKFFGRTAKNGIPFYALLATTIICFIAFLTGIFGTQIYLFLVDLSSLTGFLAWLGISISHIRFRRAYIAQGKKLEDLPYKAKWFPFGPIVALLMTAAIAINLDPAMLFSEHWGEGLALYAAIPIFIILYFGYKWKYNTKIIPLEEVDLSREK

SEQ ID NO: 89080 - protein, 247 aa, Helicobacter pylori J99
MKKTFLIALALTASLIGAENTKWDYKNKENGPHRWDKLHKDFEVCKSGKSQSPINIEHYYHTQDKADLQFKYAASKPKAVFFTHHTLKASFEPTNHINYRGHDYVLDNVHFHAPMEFLINNKTRPLSAHFVHKDAKGRLLVLAIGFEEGKENPNLDPILEGIQKKQNLKEVALDAFLPKSINYYHFNGSLTAPPCTEGVAWFVIEEPLEVSAKQLAEIKKRMKNSPNQRPVQPDYNTVIIKSSAETR

SEQ ID NO: 89081 - protein, 338 aa, Pseudomonas fluorescens
MNLNRFKRYPLTFGPSPITPLKRLSEHLGGKVELYAKREDCNSGLAFGGNKTRKLEYLVPEALEQGCDTLVSIGGIQSNQTRQVAAVAAHLGMKCVLVQENWVNYSDAVYDRVGNIEMSRIMGADVRLDAAGFDIGIRPSWEKAMNDVLERGGKPFPIPAGCSEHPYGGLGFVGFAEEVREQEKQLGFKFDYIVVCSVTGSTQAGMVVGFAADGRSKNVIGIDASAKPEQTKAQILRIARHTAELVELGREITEDDVVLDTRFAYPEYGLPNEGTLEAIRLCGSLEGVLTDPVYEGKSMHGMIEMVRRGEFPEGSKVLYAHLGGAPALNAYSFLFRNG

SEQ ID NO: 89082 - protein, 363 aa, Oenococcus oeni PSU-1
MVKRYLLLENGSIYSGQGFGSLKKAKGELVFNTGMAGYQETITDPSYHGQIIVFTYPLIGNYGINRDDFESLNPTASAIVVHELARRPSNWRMDMSLGQWAENVGMPIISGIDTRALTKEIREFGVMKACIIDQVNDSSLKELQASRFSDQQVKEVASRTAYQGPSNGPTIAVIDFGLKNSILFSLAKRHCNVIVFPPDTSAKIVLNANPDGVLLSNGPGNPDSVAYALPLIKRLQEAKPLFGICLGHQLFALANGASTYKMKFGHRGFNHAVRSIDSKRLDFTAQNHGYAVDEKSLANTDLLVTYREVNDQTIEGLKSTKYPAFSVQFHPDAAPGPHDTDYLYDDFIQLINENKGRQNAKKS

SEQ ID NO: 89083 - protein, 364 aa, Hordeum vulgare subsp. vulgare
MAPSSPLLAAAVALLVLALGSAVAYAAAEHEELRSRQPPITRGLSFDFYHGRCPGAESIVRKFVQDAVRKDKGLLRLHFHDCFVQGCDASVLLHGSAAEPGEQQAPPNLTLRPSALKAIDNIRDQLEHHCHGAVVSCSDILALARDSVVATGGPDYCVPLGRRDSARFATRDAVGSGLPRPSSNVTTLLDVFRKLGLEATDLVALSGGHTIGLGHCNSFEKRLFPLPDTTMSPSFVARLKRTCPTMGTDGRPAALDVRTTNVFDNKYFVNLVNQEGLFVSDQDLYTNAITQPIVEHFARSQGDFFDQFGVSMVKMGQIRVLTGDQGQVRHCAVPNPGTVDGDDGLEWPSLVQTVVDAAAENLGF

SEQ ID NO: 89084 - protein, 717 aa, Arabidopsis thaliana
MASSAFAFPSYIITKGGLSTDSCKSTSLSSSRSLVTDLPSPCLKPNNNSHSNRRAKVCASLAEKGEYYSNRPPTPLLDTINYPIHMKNLSVKELKQLSDELRSDVIFNVSKTGGHLGSSLGVVELTVALHYIFNTPQDKILWDVGHQSYPHKILTGRRGKMPTMRQTNGLSGFTKRGESEHDCFGTGHSSTTISAGLGMAVGRDLKGKNNNVVAVIGDGAMTAGQAYEAMNNAGYLDSDMIVILNDNKQVSLPTATLDGPSPPVGALSSALSRLQSNPALRELREVAKGMTKQIGGPMHQLAAKVDEYARGMISGTGSSLFEELGLYYIGPVDGHNIDDLVAILKEVKSTRTTGPVLIHVVTEKGRGYPYAERADDKYHGVVKFDPATGRQFKTTNKTQSYTTYFAEALVAEAEVDKDVVAIHAAMGGGTGLNLFQRRFPTRCFDVGIAEQHAVTFAAGLACEGLKPFCAIYSSFMQRAYDQVVHDVDLQKLPVRFAMDRAGLVGADGPTHCGAFDVTFMACLPNMIVMAPSDEADLFNMVATAVAIDDRPSCFRYPRGNGIGVALPPGNKGVPIEIGKGRILKEGERVALLGYGSAVQSCLGAAVMLEERGLNVTVADARFCKPLDRALIRSLAKSHEVLITVEEGSIGGFGSHVVQFLALDGLLDGKLKWRPMVLPDRYIDHGAPADQLAEAGLMPSHIAATALNLIGAPREALF

SEQ ID NO: 89085 - protein, 157 aa, Caulobacter crescentus CB15
MEDPRSIKNKGGHAVLVSQILKDKGDLVFTASPQETVGAAAALLHTRKVGAMVVVDDKEAVVGIVSERDIVRMVAKEGAAALTKPISGCMSANVVFAQPDETIDALLERMTDRRIRHLPVVQNDRLAGIISIGDLVKYKIQATQAEAEGLKAYIAAG

SEQ ID NO: 89086 - protein, 270 aa, Oryza sativa Japonica Group
MSSAAGEPSSSSAAAAAISCSSSNDDEKPPPSLEGKELRRVEEEEPAAAARPEKLTEGSSRAAEAEEEEEVVEDEEDDDEEDEGKVAEAIDLGPRVSIKEQLEMDKEDESLRRWKEQLLGSVDLNSVGESLEPDVRITSLCILSPGRPDVLLPLPVEPSNSKEPWFTLKEGSTYRLKFTFSVSSNIVSGLRYTNTVWKAGIRVDKTKEMLGTFSPQLEPYTYVTPEETTPSGVFARGSYSAKTKFVDDDRKCYLEINYTFDIRRDWPCKS

SEQ ID NO: 89087 - protein, 300 aa, Zea mays
KFVQKSRLVPVSLGPGIPGIRVVRNRMAPPRAEPGRFVLWQMAPDMWYVELAVGGSKVHAGSNGRLVWRHTPWLGAHAAKGPVRPLRRALQGLDPLTAAGLFAEARCVGEKKVNGEDCFILKLAADPRTLKLRSEGPAEIIRHVLFGYFSQRTGLMVHIEDSHLTRIQPHAGGDAVYWETTTSSALEDYRAVEGVMVAHSGRSAVTLFRFGEAAMSHTKTRMEEAWSIEEVAFNVPGLSADCFIPPADIQSGPVGEACELPSSQSRAKAVAVHPSRVAAVDRATAAAACRGRKTTWRVEV

SEQ ID NO: 89088 - protein, 369 aa, Vibrio cholerae O1 biovar eltor str. N16961
MPISTPQEIIEDIRQGKMVILMDDEDRENEGDLIMAAEHITPAAINFMATHGRGLICLTLTKERCRRLGLNPMVQDNNAQYTTNFTVSIEAAEGVTTGISAADRARTVQAAVAKEAKAADLVQPGHIFPLAAQDGGVLTRAGHTEAGCDLARLAGLEPASVIVEILNDDGTMARRPDLEVFAEKHGLKLGTIADLIEYRNHTETTIERVAQCKLPTEYGEFELVTYRDIIDKQIHFALRKGDITSAPTLVRVHLQDTFTDLLHSNRAAERSWPLATAMQRIGQEGGVLVILGHEESSELLLHRVKMFELQDKGEAPAMAKKQGTSRRVGVGSQILADLGVKEMRLLSSPNKKYHALGGFGLNVVEYVCE

SEQ ID NO: 89089 - protein, 271 aa, Zea mays
MVAAGRNRAERWNLAGATALVTGGSKGIGYIHTYIQHAIVEELAGFGARVHTCSRNAAELEECRRRWDEKGLQVTVSACDVSARADRERLVATVGATFGGRLDILVNNAGQSLFKRTAECTGEDYSRIMATNLESCFHLSQLAHPLLRLASGGGGGSVVHVSSVAGFVGLPALAVYSMSKGALNQLTRSLAAEWAGDGIRVNCVAPGGIRTDISSDKTIDPELAKREMARVPMGRIGEPEEVASMVAFLCMPAASYMTGQVICIDGGRTIA

SEQ ID NO: 89090 - protein, 351 aa, Parvularcula bermudensis HTCC2503
MKQQLNVVRTASLGATASAHPQFDTVTVLGAGAWGTALAIAFARAGRTVRLWGRNAEMMGDMARLRRNMAYIPGVLLPDTVIPISDLSAAVDGVDAVFIALPSKGVGAIADKIASDVKPLAPVISCAKGLDPETEELLTDRIQSAIPQARAMFLSGPSFAAEVARGEPTSVVIAGEGELAAEMAASLTSDSFHVEPVEDLIGAQIGGIMKNVIAIACGVADGLGHGSNTRASILARGLEEAASLADALGGSAHTLLGVAGAGDLALACTDPQSRNYSYGRALADPAAPLTATTFEGADSVAKVCAVMTAQGVSAPIACAVDAMLKRDLTPEAMVASLFRSVTAARTPEATQ

SEQ ID NO: 89091 - protein, 254 aa, Buchnera aphidicola str. Bp (Baizongia pistaciae)
MIMSSKEVEIIWHQIISEVEILMDQEPELAGFYHAYILQHDSFDMALSYILSNQLSNKVMSTVFVRDIINKVYIACRKIVAYAIQDIKALFNHGLVHCYSFSLLHSKGFHALQAYRISNFLWCEEKKSLALYFQNRISCLFSVDIHPASMIGSGIVLDNAIGITIGQTSAIKDSVSVLSQSLALLGSAFKISSVQCPKINEGVIIGANVAILGNVVIGEKTKIQACTVVLQSVPPNSIVTSVLAKIVSFKNINE

SEQ ID NO: 89092 - protein, 83 aa, Glycine max
MAANFWTSSHYKHLLDQEDVDVVNTLDKEKGITLEDFKLIKMHMANYILKLAQQVKVRQRVVATAVTYMRRVYTRKSMAEYDP

SEQ ID NO: 89093 - protein, 432 aa, Streptomyces avermitilis MA-4680
MAAQTVASTSVTSPANSVDLGPAAALSCRECGHRVPLGPVFACDECFGPLEIAYDFSGYDTEELRKQIEAGPANIWRYAPLLPVPADVAEKPNINPGWTKLVQADNLARELGVDAGKLFVKDDSGNPTHSFKDRVVAQAIEAARAFDFTTLSCSSTGNLAGAVGAAAARAGFRSCVFIPHDLEQGKVVMAAVYGGELVGIEGNYDDVNRFCSELIGDPAGEGWGFVNVNLRPYYAEGSKTLAYEICEQLGWRLPDQLVVPIASGSQLTKIDKGLQELIKLGLVEDKPYKIFGAQAEGCSPVSVAYKAGQDVVRPQKPNTIAKSLAIGNPADGPYVLDIARRTGGAVEDVNDEQIVDAIKLLARTEGIFAETAGGVTVGVAKKLIESGLLDPTLTTVVLNTGDGLKTLDAVAGTGLTATIRPSLDSFREAGLA

SEQ ID NO: 89094 - protein, 376 aa, Physcomitrella patens subsp. patens
MGDWQEKMQTIIIGFVFTCMVVMLFSVISSFRAGNLRVARETDDEVPLLVPSEAAELSPAHEQNTPLVATDEETEADGDSELEDSAHDFSSFATDDWEAIESTELEKRFGAASTYASTMVVSPNVKSSSEALLQLYAFYKIATEGPCSNPQPSILQPTARAKWNEWQKLGSMPQEEAMQKYIAVLTEVNSTFQSGGEMDALPGLSKLITSGGGQEEDVFTAAVSSKYIVESIHVCVIEGDLEHLRELTDLGSSIDTKDGDGRTPLILAASRGELNVMKILIAKGAEIHKKVTVGRTALNHATLHGQEPAPKYLIQHGADVNAVDNDRTSPLKLCPPHWLWLQGSATSQDRLQVVPERCNQQLLNSRIKIDRCQGSV

SEQ ID NO: 89095 - protein, 500 aa, Glycine max
MAMANLARRKGYAVVLSSRSSLCLTRWRGFASGSDENDVVVIGGGPGGYVAAIKAAQLGLKTTCIEKRGTLGGTCLNVGCIPSKALLHSSHMYHEAKHAFANHGVKFSSVEVDLPAMMAQKDKAVSNLTKGIEGLFKKNKVNYVKGYGKLVSPSEVSVDTTEGGNTVVKGKHIIIATGSDVKSLPGITIDEKKVVSSTGALALTEIPKRLIVIGAGYIGLEMGSVWGRLGSEITVVEFASEIVPTMDAEVRKQFQRSLEKQGMKFKLKTKVVGVDTSGDGVKLTLEPAAGGDQTTLEADVVLVSAGRTPFTAELGLDKIGVETDKIGRILVNERFATNVSGVYAIGDVIPGPMLAHKAEEDGVACVEYIAGKVGHVDYDKVPGVVYTMPEVASVGKTEEQVKELGVEYRVGKFPFLANSRAKAIDNAEGLVKILAEKETDKILGVHIMAPNAGELIHEAAIALQYDASSEDIARVCHAHPTMSEAVKEAAMATYDKPIHI

SEQ ID NO: 89096 - protein, 449 aa, Pseudomonas fluorescens PfO-1
MRVTVFGTGYVGLVTGACLADVGHDVMCVDVDNAKIESLKQGIIPIYEPGLDALVAQNQREGRLHFTTDARQAVDFGQLQMIAVGTPPNEDGSADLQHVLAVARTIGEYMTEHKVIVNKSTVPVGTADKVSRTVDAILQARDAGLDFDVCSNPEFLKEGSAIEDFAKGARIIVGTESETVKAIMRECYAPYSRNHDKLIFMDVRAAELTKYAANAMLATKISFMNEIAQMAERLGADIEQVRLGIGSDPRIGFQFIYPGCGYGGSCFPKDVQALARTAQEIGYEAQLLNAVEAVNNRQKNVMFEKLSLAFDHDLKNKTIAVWGLSFKPNTDDMRAAPSRNLIEAIWAAGGKVQAFDPAAMSEATRIYGARDDLQLTANREMALEGADALVICTEWKQFRTVDFKKLKTCLNYPVLVDGRNLFDPAAAKEAGFMYYAIGRADSLMPVLQP

SEQ ID NO: 89097 - protein, 434 aa, Geobacillus kaustophilus HTA426
MAFEFKLPDIGEGIHEGEIVKWFVKPGDEVNEDDVLCEVQNDKAVVEIPSPVKGKVLEILVPEGTVATVGQTLITLDAPGYENMTFKGQEHEEVKKEEKAETVSKKEMVEIAAPSAPAAEAEADPNRRVIAMPSVRKYAREKGVDIRLVQGTGKNGRILKEDIDAFLAGGAKAAAEPTPQAAEEKAAPQAPAAKPVVPEGEFPETREKMSGIRRAIAKAMVHSKHTAPHVTLMDEADVTKLVAHRKKFKAIAAEKGIKLTFLPYVVKALVSALREYPVLNTSIDDATEEIIHKHYYNIGIAADTDRGLLVPVIKHADRKPIFALAKEINELAEKAREGKLMPNEMKGASCTITNIGSAGGQWFTPVINHPEVAILGIGRIAEKPIVRDGEIVAAPVLALSLSFDHRMIDGATAQKALNHIKQLLSDPELLLMEA

SEQ ID NO: 89098 - protein, 336 aa, Pseudomonas fluorescens PfO-1
MKILVTGAAGFIGFHVSQALLARGDEVVGIDNLNDYYEVALKDARLAQLTPQEGFRFIRMDIGDRTAMAELFETEGFEKVVHLAAQAGVRYSLENPHAYADSNLTGFLNVLEGCRQTHVKHLVYASSSSVYGANESMPFAVQDNVDHPVSLYAATKKANELMAHSYSHLYRLPTTGLRFFTVYGPWGRPDMSPFLFVRAILEGKPLKVFNYGKHRRDFTYIDDIVDGVIRVLDHVAAPNAQWSGLKPDPASSAAPWRLYNIGNSQPVELLDYIKHIEQALGKTTHKELLPLQPGDVEHTYADVEQLKIDTGYAPDTPIESGIQRFVNWYKDFYNIS

SEQ ID NO: 89099 - protein, 297 aa, Zea mays
PPMAAGGGAPWAERARVVGTQIRNRFRVAPVDHRSLWLRADGRVATEAVRRWSDRVRALLQRGRSADRNSTSTDTSPEAVAKPSSSVLRFYRKRVGKEVNGIEDSVIFRSLQALAVPLIGNACYVFMHGLNSVQVYGVEKLHQALHGRPKGKALLTVSNHVAAMDDPFVIASLLPPSVMLEAQKLRWTLCATDRCFTNPVLSTFFRSVKVLPVSRGDGIYQKGMDMALSKLNSGGWVHIFPEGSRSRDGGKTIAPAKRGVGRLPSSCNTLCPYWDAGYNACWKTNPQSRKKGDCGRG

SEQ ID NO: 89100 - protein, 470 aa, Geobacillus kaustophilus HTA426
MVVGDFAIETETLVVGAGPGGYVAAIRAAQLGQKVTIVEKGNLGGVCLNVGCIPSKALISASHRYEQAKHSEEMGIKAENVTVDFSKVQEWKASIVKKLTGGVEGLLKGNKVDIVKGEAYFVDANTVRVVNGDSAQTYTFKNAILATGSRPIELPNFKFSGRILDSTGALNLGEIPKSLVVIGGGYIGIELGTAYANFGAKVTILEGAGEILSGFEKQMVSIIKRRLKNKGVEVVTNALAKGAEERADGVTVTYEANGETKTIDADYVLVTVGRRPNTDELGLEQIGIKMTNRGLIEVDQQCRTSVPNIFAIGDIVPGPALAHKASYEGKVAAEAIAGHPSVVDYIAIPAVVFSDPECASVGYFEQQAKEEGIDVITAKFPFAANGRALSLNDTDGFLKLVVRKEDGVVIGAQIIGPNASDMIAELGLAIEAGMTAEDIALTIHAHPTLGEIAMEAAEVALGTPIHIIAK

SEQ ID NO: 89101 - protein, 486 aa, Triticum aestivum
MALSRAQTNSGESLISSTFASRYVRTALPRFRIPEQSIPKDAAYQIINDELMLDGNPRLNLASFVTTWMEPECDKLIQNSVNKNYVDMDEYPVTTEFQNRCVNMIAHLFNAPIGEDETAVGVGTVGSSEAIMLAGLAFKRKWQNKMKAEGKPHDKPNIVTGANVQVCWEKFARYFEVELKEVKLREGYYVMDPAKAVELVDENTICVAAILGSTLNGEFEDVKMLNDLLVAKNAETGWDTPIHVDAASGGFIAPFIYPELEWDFRLPLVKSINVSGHKYGLVYAGVGWIIWRNKEDLPDELIFHINYLGADQPTFTLNFSKGSSQIIAQYYQLIRLGFEGYKDIMQNCRDNATVLREGVEKMGYFHLVSKDSGVPLVAFSLKDSSKYTVFEVVESLRRFGWIVPAYTMPADAEHIAVMRVVIREDFSRGLAERLITDLKKVMVEMDAHAKKHGHHEHVKKTAHQIEKEVTTYWRTFVARKKHSLVC

SEQ ID NO: 89102 - protein, 364 aa, Pseudomonas fluorescens PfO-1
MSEQELKALRVRIDNLDEKILQLISDRARCAEEVARVKMASLAEGEQPVFYRPEREAQVLKRVMERNKGPLGNEEMARLFREIMSSCLALENPLKVAYLGPEGTFTQAAAMKHFGHAVISKPMAAIDEVFREVAAGAVNFGVVPVENSTEGAVNHTLDSFLEHDMVICGEVELRIHHHLLVGENTKTDSISRIYSHAQSLAQCRKWLDAHYPNVERVAVSSNAEAAKRVKGEWNSAAIAGDMAAGLYGLTRLAEKIEDRPDNSTRFLMIGNQEVPPTGDDKTSIIVSMSNKPGALHELLVPFHDNGIDLTRIETRPSRSGKWTYVFFIDFVGHHRDPLIKGVLEKISQEAVALKVLGSYPKAVL

SEQ ID NO: 89103 - protein, 314 aa, Rhodopirellula baltica SH 1
MTDTMTRPKITVVGSANVDLTFRTPRLPVPGETFAGHSLHQGMGGKGANQAVVAARLGAEVAFVARVGNDGFATQAIDAYQTDGINTSFVQHSKDQPTGTAAILVDDDAENCIIVVAGANAELNADDVRSAKDVIAFSDVVICQLETPVEAALEAFKLARAANVLTMLTPAPAELVSDELLSLCDVCVPNKTEIAAITGCSVETQADCAAAAEQLRQRGVRQVALTMGGEGVLVLDRSGMSLIPASPVKAVDTTGAGDAFTGALAVSLAEGMSLADAATRAGIVAAISVTRVGTQTSFPSLDEINRWKQAENTA

SEQ ID NO: 89104 - protein, 211 aa, Buchnera aphidicola str. Bp (Baizongia pistaciae)
MTQNLLDQFGTPKTRVKNAISALRYGHGIIVLDNEDRENEGDLIFSGETMTTEQMALTIRYGSGIVCLCITESKRKQLKLPMMVQNNTSKFGTNFTVTIEAAEGISTGVSAKDRLTTIRAAINDNAKPSDLNRPGHIFPLQAHKNGILGRIGHTEAAIEFVTLAGFKPAGIICELTNRNGTMSKVPDIIKFSKLKKMTIVTIRDLIQYISR

SEQ ID NO: 89105 - protein, 176 aa, Caulobacter crescentus CB15
MTVYSLGATTPTLPAQGEYWIAPSASVMGNVILKKNASIWWGAVARGDNDPITIGENSNVQDGSVLHTDLGAPLTIGANVTIGHMVMLHGCTIGDGSLIGIGSIVLNGAKIGKNCLIGAGALITEGKEIPDNSMVMGAPGKVVREIGEQHAMILQASALHYVENWKRYVRDLKIVE

SEQ ID NO: 89106 - protein, 86 aa, Brassica napus
MGFFESVKSINWEHESFPTYQDFVCLPLFAVFFPSIRFLLDRFVFEKVGRFLIYGRQSPKKNDKKTKIRKFKESAWKCIYYLSAEV

SEQ ID NO: 89107 - protein, 576 aa, Buchnera aphidicola str. Bp (Baizongia pistaciae)
MISGILASPGITFGKALLLKNEILSINYKKISNQDIHQEVKKFINGKNKTICQLQEIKNKTQQKFENTQSNIFEGHIMLLEDDEFQQKIISLIQDRNISSEYATKIIIEEHAKTLEQLNDEYLKNRAIDIQDIGNRLLKNILNIDIKDLNNIKNPVILIARDLTPSETAQINLKKVLGFITDLGGQTSHTSIIARSLELPAIVGTKNITEKAKNDDFIILDSINNKISINPSLEEIHRIKQKKKKYESEKKLLIESKNLYAITKDKHKVEIGANISTIQDINNAKKYGAECIGLYRTEFLFMNRNYLPSEEEQFNTYKTIAEEMKNKSIIIRTMDVGGDKNISYMNIPKEENPFLGWRAIRIAIDRKEILHAQLKAILRASAFGKLRIMFPMIISVEEVRTLQYELEKLKQLLHHQKIPFNAKIEVGIMIETPASAIIAHHLAQEVDFFSIGSNDLTQYTLAVDRGNDLISHLYNPMSPSVLSLIQQVINASHKVGKWTGMCGELAGDEKATLLLLGMGLDEFSMSAATIPKIKKIIRESTFLDVKKLAKKVLLQPTYNEVNNTINTFININNKNK

SEQ ID NO: 89108 - protein, 377 aa, Triticum aestivum
  misc_feature (193)..(193): Xaa can be any naturally occurring amino acid
  misc_feature (246)..(246): Xaa can be any naturally occurring amino acid
  misc_feature (267)..(267): Xaa can be any naturally occurring amino acid
NKFVQKSRLVPVRNSRDIVDPRVREIALSGGRFQSCLREIRKRARDVEDEKRGIKIKKEDWEKLHVHIASYNNFPTAAGLASSAAGFACLVFTLGKLMNVNEDYGELSSIARQGSGSACRSIYGGFVKWCMGKNDDGSDSMAVQLVDESHWDDLVIIIAVVSSKQKETSSTSGMRDTVETSPLLQYRAQTVVXPGRILKMEEAIKNRDFESFARLTCADSNQFHAVCLDTSPPIFYMNDTSHRDIXALGGERWNHSGRNPPRLAYTXFDAGPNAVLIARNRKTAALLLQRLLYCFPPQENNLDSYMVGDKSILSDAGVQSLADIEALPPPREMKTPTQKFKGDVSYFICSRPGAGPKVLTEESHTLIDSATGLAKGV

SEQ ID NO: 89109 - protein, 252 aa, Sinapis arvensis
ENQLCFDLLESWLIQNPDAAGFKRDGQSIFRELALFQDYHSLSSFKNALAVFMSENRQNRVSFDSNNLVLTAGATSANETLMFCLANPGDAFLLPTPYYPGFDRDLKWRTGVEIVPIQCSSSNGFRITKLALEEAYEQAKKLNLNVKGVLITNPSNPLGTTTTQTELNILFEFISKNKNIHLVSDEIYSGTAFSSSEFISVMEILKNNQLENTDVFNRVHIVYSLSKDLGLPGFRVGAMYSNDKDVISAATK

SEQ ID NO: 89110 - protein, 469 aa, Bradyrhizobium sp. BTAi1
MTSFQDFNLADALTRALKEENYTTPTPIQAQTIPIALQGRDVIGIAQTGTGKTASFALPILHRLLENRIKPQPKTARVLVLSPTRELSGQILDSFNTYGRHIRLTSALAIGGVPMGRQVRALMPGVDVLVATPGRLLDLVQGNALKLTQVEFLVLDEADRMLDMGFINDIRKIVAKLPIKRQTLFFSATMPKDIAELADAMLRDPARVAVTPVSSTVERITQRVIQVDHSAKPSLLAQLLKDEPVNRALVFTRTKHGADKVVKGLEKAGIPAQAIHGNKSQNHRERTLAAFRTGEIRTLVATDIAARGIDVDGVSHVVNFDLPNVPETYVHRIGRTARAGADGVAISLVAGADELSYLRDIERLTKTTLPREDRRTPGHRDAAPAGQPQRPGGRPGMQNARANDGGNAAKGPRRRRRSNAKMPALPGNRQEPNRPSQGGGKSGSIQGVAFLHREGRPKNHAHNRNQRPN

SEQ ID NO: 89111 - protein, 575 aa, Serratia marcescens
MISGILVSPGIAFGKALLLKEDDIVINRKKISADQVEQEVSRFLAGRAKGHEQLEAIKTKAGETFGEEKEAIFEGHIMLLEDEELEQEIIALIKDDLASADAAAYTVIEGQAKALEELDDEYLKERAADVRDIGKRLLQNILGMPIVDLGSIQDELILVATDLTPSETAQVNLDKVLGFITDLGGRTSHTSIMARSLELPAIVGTSDVTKQVKNDDYLILDAVNNKIYVNPTADVIDQLIAAQNQYITEKNDLAKLKDLPAITLDGHQVEVCANIGTVRDVAGAERNGAEGVGLYRTEFLFMDRDSLPTEDEQFQAYKAVAEAMGSQAVIVRTMDIGGDKDLPYMNLPKEENPFLGWRAIRIAMDRREILRAQLRAILRASAFGKLRIMFPMIISVEEVRDLRGEIETLKAQLREEGKAFDESIEVGVMVETPAAAVIAHHLAKEVDFFSIGTNDLTQYTLAVDRGNELISHLYNPMSPSVLGLIKQVIDASHAEGKWTGMCGELAGDERATLLLLGMGLDEFSMSAISIPRIKKIIRNTNFEDVKALAAQALAQPTAQDLMNCVNKFIEEKTLC

SEQ ID NO: 89112 - protein, 304 aa, Kluyveromyces lactis
MVAPSQFKQLEKVGNGTYATVYKGLNKTTGVYVALKEVKLDSEEGTPSTAIREISLMKELKHDNIVRLFDVIHTENKLTLVFEFMDNDLKKFMDNRNKGNPHKGLEMDLVKYFQWQLLQGVAFCHENRILHRDLKPQNLLINNRGQLKLGDFGLARAFGIPVNTFSSEVVTLWYRAPDVLMGSRNYCTLIDIWSCGCILAEMIMGKPLFPGSNDEEQLKLIFDTMGTPVEQTWPQVTQLAKYNPLLPPHMPRDLKQLLQNNTEEVLDDNVVDLLHGLLQLNPDARLSAKDALNHPWFAEYNHAN

SEQ ID NO: 89113 - protein, 171 aa, Helicobacter pylori J99
MLDLSYSLERVLQEDPAARNKWEVLLLYPGIHALLCYRLAHALHKRRFYFIARALSQLARFITGIEIHPGAKIGRGLFIDHGMGVVIGETTEIGDDVTIYHGVTLGGTGKFKGKRHPTLGNRVVVGAGAKVLGAICVGDDVRIGANAVVLSDLPTGSTAVGAKAKTITKDR

SEQ ID NO: 89114 - protein, 993 aa, Trichodesmium erythraeum IMS101
MVEQISHTNYETKTQEIAKQLLKATQEKNRSFLAQLQNQMRWDDKLLDWAMASPGLRVQLFRFIDCLPALRSKPEIAAHLQEYLTTQEVELPETLKKLLNFANPDSVPGQLAATTVAPAVETLAHKYIAGENVKQIIKTLEKLRKDKMCFTVDLLGEAVITETEAQLYLDRYLELMTQLSQAANSWSSIPQIDEAEGEKLPRVQVSVKLTAFYSQFDPLDVKGSQERVSDHVRTLLRHAQKLGVAVHFDMEQYTYKDLTIDILKELLMEEEFRNRNDIGVTIQAYLRDSEKDLQGIIEWAKIRGRPVTVRLVKGAYWDQETIKALQHDWPQPVFNDKPETDANFEKLTYMMLENHEYIYSAIGSHNVRSQARAIAIAETLKVPRRCFEMQVLYGMGDKIATILAEKGYRVRVYCPYGDLLPGMAYLIRRLLENTANSSFLKQSLENRPLEELLAAPSINGKTTIHDVVKPVFPNAADSDYANFQQRQQALNTIGQIRLELGKTYLPIINGEYTNTAQIVDSLNPSNSKEVVGKIGLISVEQAEQAIQAAKAAFPSWKKTPVRERTRILRKAADLMEKRRHELAAWMVLEVGKPLNQGNAEVSEAIDFCRYYADEMERLEQGYNYDVAGETDRYYYQPRGISLVISPWNFPLAIPTGMTVSSLVTGNCTLLKPAAVSSVIASKISEILLEAGFPKGVFQFVPGNGSTVGDFMVKHPSVNSITFTGSMEVGCHIYAQAAVLQPRQKHLKRVIAEMGGKNAIIVDESADLDQAVAGVVYSAFGYSGQKCSACSRVVVLATIYDSFVNRLVEATRSLNIGDAEKPSTQVGPVIDEKAQKRIQEYIVKGKQEAEVAIEMSAPKDGYFVGPVIFKDVSPSATIAQEEIFGPVLAVMKADNFTQALEIANGTNFALTGGLYSRTPSHIEQAKAEFEVGNLYINRGITGAIVSRQPFGGFKLSGVGSKAGGPDYLLQFLEPRTITENIQRQGFAPIEGVDN

SEQ ID NO: 89115 - protein, 232 aa, Zea mays
MADGGELQLLGSWYSPYVIRAKVALGLKGLSYEFVEEDLSRKSDLLLKLNPVHRKVPVLVHGGRPVCESLVILQYVDETWAGTGTPLLPADAYDRAMARFWAAYVDDKFYKEWNRLFWSTTAEKAAEALGVVVPVVETLEQAFRECSKGKPFFGGDAVGLVDIALGSFVVWIRVVDEAAGVKLLDEAKFPALTAWAERFLAVDAVKEVMPDAGRLLEHYKGFLAKRSPPAGY

SEQ ID NO: 89116 - protein, 232 aa, Brassica napus
MSSNTSYYRSPFGGTTFTKVFVGGLAWETPTEEMRRYFDQFGEILEAVIITDKTTGKSKGYGFVTFREPDSATRAVADPNPVIDGRKANCYIASFGRPRPSTPRGRGQGGSPSQYQGGGQSGYTGMAAPLQQAATAQLMYPPYGYTYNSEYGYPQALYNTQLQQAQYYQQQMYGGGATSPSSSNIMPSPYYYLQAPCPRPYPHQHHQHYAHHIHQQQQQQRLPSTSSYLIYP

SEQ ID NO: 89117 - protein, 276 aa, Bartonella henselae str. Houston-1
MTDYIEYYKIPLKFNGQIRIFDDYAFDKMRKVGRIAAECLDALTDIIKPGITTQEIDDFVFTFGAERGALPADLNYHGYGHSCCTSINHVVCHGIPNKRPLQEGDIVNVDVTFILDGWHGDSSRMYPVGKIRRAAERLLKITYESLMRGIAAVKPGATTGDIGAAIQRYAESERCSIVRDFCGHGIGQLFHDAPNILHYGNPGEGIELKQGMMFTIEPMINLGKPQVKILSDGWTAVTRDRSLTAQYEHTIGVTNEGCEIFTQSPKNIFYISNSYV

SEQ ID NO: 89118 - protein, 482 aa, Oryza sativa Japonica Group
MAEEEVAAVVGELRGSFRSGRTRAAEWRAAQLRGIVRMVEEREGDISDALHSDLAKPRMESYLHEISLAKAACTFALKGLKNWMKPEKVPAALTTFPSTAQIVSEPLGVVLVISAWNYPFLLSIDPVIGAIAAGNAVVLKPSEIAPATSALFAKLLPEYVDSSCIKVVEGGVPETTALLEQKWDKIFYTGSGNVGRIVMAAAAKHLTPVALELGGKCPAIVDSNTDLHVTMKRLAVGKWGCNNGQACIAPDYVITTKSFAPELVDSLKRVLKRFYGEDPLQSEDLSRIVNSNHFRRLTNLIEDKKVAQKIVYGGQTDEKQLKIAPTVLLDVPLDTTLMAEEIFGPLLPIVTVDKIEDSIQFINSRTKPLAAYLFTKDKKLQEEFVSNVPAGGMLVNDVALHLANPHLPFGGVGDSGIGSYHGKFSFDCFTHKKAVLIRGFGGEATARYPPYTIEKQKILRGLINGSFFALILALLGFPKERR

SEQ ID NO: 89119 - protein, 345 aa, Ostreococcus tauri
MTPDERLRECAKADDHVTFIALCERESSTERGDPTLRDENGAHCLHHAAAANSTTIVDYLLRNGVRWTDVDDDGDCAGQYASGHGHGALASAMMEHAVASEVALGEASMRETRGECRQNEESERYLKTPVRYDGDDKLLDEDGDAVMMSWEEPLMEAHAEALCASAGDVMNVGFGMGIIDGHIAKRTTRSHTIVEAHPDVRAHMMRAGWDEREGVRVEPGRWQDVLPRLAKEGKKYDAIFFDTYGEEYDDMRRFHALLPKLLRKGGIYSYFNGMCPDNIFFHCVYNRVAEIELGRLGFVPPKGRGMFTVHDIDTTDAKIWEGVKRRYWWGDKYFLPTCVFDGDEA

SEQ ID NO: 89120 - protein, 62 aa, Triticum aestivum
MTTSRRVASGKIAVFEKNITKRGSVPETVKKGNDYPVGPIVLGFFVFVVVGSCKSLHLCCYV

SEQ ID NO: 89121 - protein, 210 aa, Ostreococcus tauri
  misc_feature (210)..(210): Xaa can be any naturally occurring amino acid
MGALGMILTHPGDVPSLLRVAMMANRAKRLPRDANLAYCYDVLNKVSRSFAIVIQQLDEELRDAVCVFYLALRALDTVEDDMSIPIDEKLPQLYDFHEYIFDPKYSTECGEKHYRDLMMNYPRVTSVFLKLKKPYRDVIADIARRMGAGMAKFIEKEVMDMSDFDEYCHYVAGLVGIGLSNLWGASKMESEEFIGEEKLSNAMGLFLQKX

SEQ ID NO: 89122 - protein, 350 aa, Clostridium difficile 630
MKSVRFYGIRDTRVEDVDVPKILEKDDVIIKVKVAGICGSDISKYSKTGPHMVGEILGHEFSGEVAQVGKEVRSFKIGDRVAVCPAMPCFECDECKKGLYSRCNNVAIIGNKELGGCFAEYTKVKERNLIKIPDEISYETAAALEPVCIAGHGLFRSEAKVGDTVVVLGTGPIGLFSIQWAKIFGSTKIIAVDVFDEKLDLAKELGADICINAKEKNIVEEIKRLTDGDGADIVIESAGTPLTCGQVLLLAKKGGTVLYAGVPYGDVALTREQFEKIVRSELTVKGTWFGNSFPFPGKEWSAGLYHMQKGDMNVEKLVTHRINLEEAPAYFEKVYKRDIFFGKIMINIDN

SEQ ID NO: 89123 - protein, 756 aa, Saccharophagus degradans 2-40
MLNDLRSIVQEVYAATDLSSVLEIIVRRVKSAMNTEVCSVYLRNETGAYTLMATDGLNREAVGRVTLAKNEGLVGLVAAREEPINLDDAESHPKYQYFAETGEERFSAFLGTPIIHQRQVMGVLVVQQAAKRRFDEGEEAFLITMSAQLAGVIAHAEATGTLRAMGSKSAVRFNGVPGASGVAIGECVVVSPVADLNAVPYATCDNIEEELAFFSRSLAAVREDVKRLGQSLENLLNKEERVLFDAYLGMLDDTSLAREVTEKISMGLAAPYAWSEVILDHVKTFSAMPDAYLRERASDVRDLGSRVLAYLQETTQKELVYPEKTILVGEDLTPSMLAEVPVGQLAGLVSVRGSSNSHIAILARSMGIPTIMGAVDLPFTKLNGREMVVDGYRGSVYIDPGEALLQSYQAILEEDLQLVAGLQSIKNLPCETSDHHRVALWVNTGLLADTMLSIERGAEGVGLYRTEVPFMLRDRFPSEEEQRLVYREQLEAFAPHPVTMRTLDVGGDKSLPYFPIEEENPFLGWRGIRVTLDHPEIFLGQVRAMLKASVGLDNLRIMLPMITNIAEVEIAQMLIHRAYDELLEEGYDVQMPPLGVMIEVPAAVYQAKELAARVDFISVGSNDLTQYLLAVDRNNPRVADLYHSLHPAVLRALRKIVKDAHSQGVPVSICGELAGEPAAALLLVAMGYDVLSMNATNLLKVKSVVRAVTLEQAETLLAEVMSLPDAESINRCLEAAFRHAGLNRMLRPDLGDDANI

SEQ ID NO: 89124 - protein, 572 aa, Nicotiana tabacum
MGNNCFSSSKVSGSNSNTPSTTATATTVNVRRNKANPPSTSTITSTKQEGSHCNKQKVKDNHKSQHQKQQPRNSQQNVKKHNNGRRQKSGVIACGKRTDFGYDKDFDKRFTIGKLLGHGQFGYTYVATHKSNGDRVAVKRIEKNKMVLPIAVEDVKREVKILKALSGHENVVQFNNAFEDDNYVYIVMELCEGGELLDRILAKKDSRYAEKDAAIVVRQMLKEAAQCHLHGLVHRDMKPENFLFKSSKEDSPLKATDFGLSDFIRPGKKFQDIVGSAYYVAPEVLKRRSGPESDEWSIGVITYILLCGRRRFWDKTEDGIFKEVLRNKPDFRRKPWPTISNSAKDFVKKLLVKDPRARLTAAQALSHPWVREGGDASEIPLDISVLSNMRQFVKYSRLKQFALRALASTVDEEELADVRDQFSAIDVDKNGVISLEEMRQALAKDLPWKMKESRVLEILQAIDSNSDGLLDFPEFVAATLHVHQLEEHNSIKWQERSQAAFEEFDVDRDGFITPEELRMHTGLKGSIDPLLEEADIDKDGKISLSEFRRLLRTASISSRMVTSPTVRGSRKS

SEQ ID NO: 89125 - protein, 279 aa, Caulobacter crescentus CB15
MPKHLEVVTSDTETPVWVALRNQAEHAAKAEPALASLLNAVILSHDNLADALTFQLARKLGDQEMRAMTAREFAADAFEDDLSIVEAAEADLKAVFERDPACKGYVQPFLFFKGFLALQTHRVSHWLWNQGRETLAFYLQSRSSEVFQVDINPAAKIGKGVFIDHGTGIVIGETAVVGDDVSMLHGVTLGGTGAERGDRHPKIGKGVLLGAGAKVLGNITVGDYAKVASGSVVLRPVPAHCTAAGVPARLVNCPTCEEPAKTMDHTLAEAVYSTSSYEI

SEQ ID NO: 89126 - protein, 288 aa, Oryza sativa Japonica Group
MAKDIEASAPEGGEFSAKDYTDPPPAPLIDVEELTKWSLYRAVIAEFIATLLFLYITVATVIGYKHQSDATVNTTDAACSGVGILGIAWAFGGMIFILVYCTAGISGGHINPAVTFGLFLARKVSLIRAVLYIIAQCLGAICGVGLVKGFQSSYYARYGGGANELSDGYSKGTGLGAEIIGTFVLVYTVFSATDPKRNARDSHIPVLAPLPIGFAVFMVHLATIPITGTGINPARSLGTAVIYNKDKAWDDQWIFWVGPLIGAAIAAAYHQYVLRASAAKLGSYRSNA

SEQ ID NO: 89127 - protein, 454 aa, Buchnera aphidicola str. Bp (Baizongia pistaciae)
MNLRIKKWLEKLDQFEKILVHMPSIMYCGKLIGINGLVLEVSGLKLPIGTICIVEKNNSILDSDMIEAEVIGFRRNLLLLLLLSNVSDLTADSKVTPKILNGSYYNINKLPVCDKLLGRIVDGLGKPLDNFSKIDSKYNVSLTNVSINPLHREPVTHVLDTGIRSINGLLTIGRGQKIGLFASSGLGKSVLLGMMTRYTQADIVILSLIGERGREVKEFIDSVLTETVLSRSIVISAPSESSVLMQTRGAIYAMRIAEYFRDKNFHVLLIMDSLTRYAMAHREISLSIGELPVSKGYPPSVFSKLFSLIERAGNGKINSGSITAFFTVLTEEEERYDPISESARSILDGHIILSREYAESGHYPAINIENSISRVMPNIVDSSHYSFACHFKKIVSLYQRNRDLINVGAYISGTDPDLDMAITLIPKLNKFLQQGMLEKSNFLDSKKSLYSLFN

SEQ ID NO: 89128 - protein, 509 aa, Acidobacteria bacterium Ellin345
MTFSYNAFTEPAGEHTATHRRAKIVCTIGPACNTEAAMQELMRAGMDVARLNFSHGTHDEHLVVIQRLRKVAAEEQRSICILQDLQGPKIRTGLLKDHKPVMLETGNTVTITPRDIVGDASLLATTFQTLALDVQPGSRILLSDGKIELSVSRIEGADVECHIVNGGELKEHQGINIPGAILSIPALTNKDLEDLAFGLKNGVDAVAISFVRTANDLKQVRNAISEHQGNVFVIAKLEKPQAIEHLEEIFNETDGVMVARGDLGVEVPPEKVPVLQKHIIKRSQSRRIPVITATQMLESMIDNPRPTRAEASDVANAIFDGTDAVMLSGETASGKYPREAVAMMARIITEAESHCLAEGRRRRHEDHKNTISEAVCDAVSHAAEDLDMLAIAIYTESGNTARILSKHRPKPPIYAFSHLDTVINRLNLFWGVHPVQCEPLRSSKEMILYAEQLLLGAHQVAAGDIIGVVAGTRSTSGSTNFMRLHVIGSESEEERPPAENAPPMKKEIR

SEQ ID NO: 89129 - protein, 397 aa, Fusobacterium nucleatum subsp. nucleatum ATCC 25586
MKVYLDNNATTKVDEEVVKAMLPYFSDYYGNPFSLHLFGAETGKAVTEARQTIADILKAKPNEIIFTASGSEADNLAIRGIAKAYKHRGKHIITSTIEHPAVKNTFMDLIEDGFEVTMVPVDENGVMIIDEFKKVLREDTILVSVMHANNEVGSFQPIEEIAKITKERKIILHVDAVQTMGKVEIYPERMGIDLLSFSGHKFHAPKGIGVLYKRDGVRLARIITGGNQEGKRRPGTSNVPYIVGLAKALEISVANMKEEWNREETLRNYFEDEVSKRIPEIKINGKEARRLPGTSSITFKYLEGESMLLNLSLKGIAVSSGSACSSDSLQPSHVLLAMGIPAEFAHGTLRFSLSKYTTKEEIDYTIESLVEIIGKLRELSPLWKIFKDNKLTNEASF

SEQ ID NO: 89130 - protein, 128 aa, Fusobacterium nucleatum subsp. nucleatum ATCC 25586
MKFMQYTEKVMQHFMNPHNVGVIENPDGYGKVGNPSCGDIMEIFIKVDNNIISDVKFRTFGCASAIASSSISTDMIIGKTVEEALKLTNKQVVDELGGLPAVKMHCSVLAEEAIKMAIEDYISKRDGK

SEQ ID NO: 89131 - protein, 328 aa, Rhodopirellula baltica SH 1
MAIEPSELPSLNLSTMNPASSSFVESGDQTSQLAHQLVGRRTLLKNGTLVLAASALTNRRLFAEEVKSDEKAVRVGLITDLHYADKSPAGSRHYRETLGKLEAAGQQFSTDQPDFVVELGDLIDAADSVDVEQGYLKTINKQFSSICDERHYVLGNHCVDTLTKDEFLGGVEQERSYYSFDRQGIHFIVLDACFREDGKSYGRRNFHWTDANISAEELEWLRGDLKASSKPTVVFAHQRLDVSNHHGVKNNADVRRVLEDSGSVVAVFQGHSHQNDLSEIGGIHYCTMAAMVEGSGPESNGYSVMDIQPDGTIEIKGFVRQASYRWDV

SEQ ID NO: 89132 - protein, 490 aa, Photorhabdus luminescens subsp. laumondii TTO1
MTNNVNTELLRQQAYINGQWVDADNQATFKVTNPANGEVIAHVSNMGAAETERAIAAAQQALPAWRTMTAKQRSQILQRWFQLMMANQPALAELLSREQGKSQTEAMGEIAYGASFIEWFAEEGKRTYGETIPSPLPGRRIVTIKQPIGVVAAITPWNFPNAMITRKVGPALAAGCTVILKPASETPLSALALAALAEQAGIPAGVFNVVTGIDAKAIGGAMTQSPIVRKLSFTGSTRVGKLLMAQSADTVKKLSLELGGNAPFIVFDDANIDAAVQGALIAKFRNSGQTCVCANRILVQETIYDTFAERLAQAVNQLQVGPASDAKSQQGPLINQAAVDKVEEHISDAISHGARILAGGKPHALGGLFFEPTVLADVNKSMLISQEETFGPIAPLFKFRDEAEAIHLANETEFGLAAYFYSRDIGRIYRVAEALESGMVGINEGLISNEAAPFGGIKQSGLGREGSRYGIEDYLEVKYLCFGGIEDTGV

SEQ ID NO: 89133 - protein, 491 aa, Escherichia coli
MMSRMAEQQLYIHGGYTSATSGRTFETINPANGNVLATVQAAGREDVDRAVKSAQQGQKIWASMTAMERSRILRRAVDILRERNDELAKLETLDTGKAYSETSTVDIVTGADVLEYYAGLIPALEGSQIPLRETSFVYTRREPLGVVAGIGAWNYPIQIALWKSAPALAAGNAMIFKPSEVTPLTALKLAEIYSEAGLPDGVFNVLPGVGAETGQYLTEHPGIAKVSFTGGVRSGKKVMANSAASSLKEVTMELGGKSPLIVFDDADLDLAADIAMMANFFSSGQVCTNGTRVFVPAKCKAAFEQKILARVEPIRAGDVFDPQTNFGPLVSFPHRDNVLRYIAKGKEEGARVLCGGDVLKGDGFDNGAWVAPTVFTDCSDDMTIVREEIFGPVMSILTYESEDEVIRRANDTDYGLAAGIVTADLNRAHRVIHQLEAGICWINTWGESPAEMPVGGYKHSGIGRENGVMTLQSYTQVKSIQVEMAKFQSIF

SEQ ID NO: 89134 - protein, 488 aa, Photorhabdus luminescens subsp. laumondii TTO1
MTVISHWINGKNISSKTYFETTNPATGEVLAEVASGGQEEVDQAVAAAKAAFPKWADLPMKERARLMRRLGELIDENVPEIAAMETKDTGLPIHQTQNVLIPRASHNFNFFAEICQQMNGRTYPVDDKMLNYTLVQPVGVCALISPWNVPFMTATWKVAPCLALGNTAVLKMSELSPLTANRLGELALEAGIPAGVLNVVQGYGATAGDALVKHHDVRAVSFTGGTATGRQIMKNAGLKKYSMELGGKSPVLIFEDADIERALDAALFTIFSINGERCTAGSRIFIQQSIYPEFIKRFAERANRLRVGDPQDPTTQIGALISKPHWEKVSGYIRLGIEEGATLLAGGPDKPIDLPAHLKDGHFLRPTVLADVDNRMRVAQEEIFGPVACLLPFKDEAEGLRLANDVEYGLASYLWTQDVSKVLRLARNIEAGMVFVNTQNVRDLRQPFGGVKASGTGREGGEYSFEVFAEMKNVCISMGDHPIPRWGV

SEQ ID NO: 89135 - protein, 490 aa, Escherichia coli
MSRMAEQQLYIHGGYTSATSGRTFETINPANGNVLATVQAAGREDVDRAVKSAQQGQKIWASMTAMERSRILRRAVDILRERNDELAKLETLDTGKAYSETSTVDIVTGADVLEYYAGLIPALEGSQIPLRETSFVYTRREPLGVVAGIGAWNYPIQIALWKSAPALAAGNAMIFKPSEVTPLTALKLAEIYSEAGLPDGVFNVLPGVGAETGQYLTEHPGIAKVSFTGGVRSGKKVMANSAASSLKEVTMELGGKSPLIVFDDADLDLAADIAMMANFFSSGQVCTNGTRVFVPAKCKAAFEQKILARVEPIRAGDVFDPQTNFGPLVSFPHRDNVLRYIAKGKEEGARVLCGGDVLKGDGFDNGAWVAPTVFTDCSDDMTIVREEIFGPVMSILTYESEDEVIRRANDTDYGLAAGIVTADLNRAHRVIHQLEAGICWINTWGESPAEMPVGGYKHSGIGRENGVMTLQSYTQVKSIQVEMAKFQSIF

SEQ ID NO: 89136 - protein, 593 aa, Xanthomonas campestris pv. campestris str. 8004
MITSPRRLFPRGLLLLAFVVAPAAWAAQPDAAAATPPPAGTATHPPGAAVASGHALATDAGLQILREGGNAFDAAIAVSSTLAVVEPISSGLGGGGFFLLHDAKTGKDVMLDAREYAPESATSAQFLDKNGGLDRDRSVNGPWSAGIPGLPAALVELAAKHGRLPLTQSLAPAIRIATEGFPVYARMAKGYASRREVMERYPGTREVYLRGGKPIAEGDIFKQPELAHTLTLLGDKGFDGFYKGETAKKLLAGVKQAGGRWTAAELAGYQVKERTPIQFDYRGWKVTTAPPPSSGGIALAAMLQILEGWDLNTLDDAHRTHLVVEAMRRAYRDRTFFLGDPDFVDVPQRVLTSKDYAQGLRATINPDKATPSNLLSGNPTPLEDDETTHFSIIDGEGNRVGATQTVNLLYGSGLIPKGTGVLLNDEMDDFALKPGTPNAFGVMGYAANAPKPGKRMLSSMTPTFMESADKVAVLGTPGGSRIITMVLLGILGYDAGLDAQQVSALPRYHHQWLPDVIEAESNAFSPQTAKALEAMGHALKLPGDTAEGGRGSSHVWGNFQTVEWDKRRNVLSGGSDPRNPVGKAAVQLATPAR

SEQ ID NO: 89137 - protein, 357 aa, Desulfovibrio vulgaris subsp. vulgaris str. Hildenborough
MHMNICLLPGDGIGPEIVAQGTKVLDAVARRFGHTVSTSSALIGGAAIDATGSPLPDATVEACRTSDAVLLGAVGGPKWDDLPSEKRPEKGLLGIRKALGLFANLRPAALFPELAGACLLRADIAAAGLDLVVVRELTGDVYFGQPAGIETRDGLRTGFNTMIYDEDEVRRIARVAFDTARARKRRVCSVDKANVLATSRLWREVVEEVARDYPDVELSHMYVDNAAMQLVRWPAQFDVIVTGNLFGDILSDEAAVITGSIGMLPSASMGSGGPALFEPIHGSAPDIAGQDKANPIATILSVGMMLRLGFGLAAEADAIDAAVRRVLAEGYRTGDIMENGRTLVGTVSMGNLIAERI

SEQ ID NO: 89138 - protein, 501 aa, Centaurium erythraea
MEITDFSTFLLAFLLLSYLLVTGRRLISKKSTGKLPPGPKKFPIVGNLPQLALAGTLPHRAMRDLAKTYGPLMHLRLGEVSQLVVSSPEMAKEVLKTLDPMFASRPDLILADIMLYDNAGLTFAKYGDYWRQLKKIFATELLSAKRVKSFRSLREEETLNTIRWISSNEGKPINMTNTLLNLVFGVLSRATFGKKSPEQDKLVYIVNKAAELATGGNISDLFPSIKFFRLISVVNYKLKSMFAESNRLLDMIMKEHKKGNGSGESKDLVDVLLGYQRENAEFSLTDENIKAVLLDIFIGGTDGSFTTLDWAMSELMRAPTVLKRAQEEVRQAFETDGYIDEEKFEDLKYVTSIIKETLRLHPPAPLLVPRSNDETAHILGYEVPAKSKILVNVWAINRDPRYWEDAESFKPERFLGSSVGYKGTDFHFLTFGAGRRMCPGMVYGYANIVHPLVKLLYYFDWNLPSGIKPEELDMTEEHGLSVKRKADLYLIPSVRNSISHL

SEQ ID NO: 89139 - protein, 530 aa, Physcomitrella patens subsp. patens
METVPVNVRNALAVVVASVIVYSVIKFLRVSVWQPLRLRRIMAKQGVSGPPFRFVRGQFVEMWKFTESFPDALPIDDFANLTPTVTPQNALYYPKYGKIYLYWWGTITRLAVRDPKIVKELMVSNHESLTRLQSESQFLAEVVGKGLLTQVGEKWASERRTLGPFFHQKSLEGMVGAIMEGAATELQKWEQEVEERGGTAELDVEPDLHKISGRIISRTAFGDEFEIGEQIFKFQTLLSQELLKGFRSTAYWLVPGYRNLPTKRNRSMNLYGSQVDALVRGIINARREAVQKGVTSSYGDDLLGRMLTAATEGWSANTKEFNQLAVFNNCKLFYFAGQDTVANAIGFMILMLALYPEWQDRCRQEVTEILGDEQDWRASDISRLKVVGMVFNETLRIFPPASTLTRVAAKDLQLEGLFIPKGMAIEFSLAAMHQDKDYWGDDVGKFNPERFVNGAASACTHPQAFSPFGLGPKFCIGNNFAVMEAKIVLAMMLRRFQLVLSPNYKHHPTSIMVQSPKFGLPIILKALKIT

SEQ ID NO: 89140 - protein, 498 aa, Hypericum androsaemum
MEFLLITQCSLLFVATYLLVNHVILRGRSKNNGSTKLPPGPRPLPIIGNLLALRDKPHKSLAKLARVHGPLVTLKLGQVTTVVVSSPATAREILQKHDATLSNRYIIDAIRAQGHHEAGLAWVPVGPTWRKFRKVCYSHIFTNQKLNSSQHVRQRTIQQLLAEARESCRVGEAMDVGKAAFRAALSSLSISVMSLDLADAASDTAREFKELARCIMNDVGEPNLADYFPVLKRFDPQGVRGRVEISFGRILDLFGSIIADRMEKRGADEDILDTLLTTHDENPELVEINDIKHLLLDLFVAGTETTSSTLEWAMAELLHKPTTMAKAKAELEQIIGKGNSIDQESEVSRLPYLQAVIQETLRLHPAVPLLLPRRAGEEVHVSGFTIPKDAQVLVNVWAMGRDPEVWEDPCSFTPERFLGSSIDVIGTCFELIPFGAGRRICPGLPLAMRMLQMMLGNLLLSFDWKLPDGVTPECMDMEDRFGITLQKAQPLLAIPLSL

SEQ ID NO: 89141 - protein, 450 aa, Gibberella moniliformis
MPLRPHIGLGFPAHAYQKRHVEPHDRSTGYQPKVRITDRYRIIGFISSGTYGRVYKAVGRNGKPVGEFAIKKFKPDKEGEQISYTGISQSAIREMSLCSELHHINVIRLCEIVLEDKCIFMVFEYAEHDLLQIIHHHTQQPRHPIPPATIKSIMFQLLNGCQYLHINWVLHRDLKPANIMVTSSGEVKIGDLGLARRFDKPLHSLFSGDKVVVTIWYRAPELILGSYHYTPAIDMWAVGCIFAELLSLRPIFKGEEAKMDSKKTVPFRRNQMQKIIEIMGVPTKDKWPLLSTMPEYNQLNTLANSMASSHHNHHSHHHPHHHHGHYGSRNPPPPGGSNLEKWYYSTINHTSAPGGTPPLASLGSEGYKLLAGLLEYDPSKRLTAAQALQSPFFSTGDRVSANCFEGCKNEYPCRRVSQDDNDIRTSSLPGTKRSGLPDDSLIRPAKRQKE

SEQ ID NO: 89142 - protein, 214 aa, Glycine max
PAIIFIDEVDSFLGKRRGTDHEAMLNMKTEFMALWDGFTTDQNAQVMVLAATNRPSELDEAILRRLPQAFEIGIPDQRERAEILKVVLKGERVEDNIDFGHIAGLCEGYTGSDLFDLCKKAAYFPIRELLDEEKKGKQSHAPRPLSQLDFEKALATSKKTKVAASEYGGFSLQSPSRWTVPGESGDSQFQAAIHEISKLVVSHMINLQSDSQDP

SEQ ID NO: 89143 - protein, 626 aa, Oryza sativa Japonica Group
MPPHLSSSLFSSSPLPTALLSSLTRRARALLPLPLPLPAASTRRRLPLRRGPLLTRGIMASAAAEAPAPSPSPTAAANSRPRRVLEELSWDDSFVRELPGDPRSDAIPREVLHACYTKVSPSAPVDNPKLVAWSQSVADILDLDHKEFERPDFPQLFSGANPLVGSSPYAQCYGGHQFGSWAGQLGDGRAITLGEVINSRGERWELQLKGCGKTPYSRFADGLAVLRSSIREFLCSEAMHGLGIPTTRALCLVETGKSVVRDMFYDGNSKEEPGAIVCRVAPSFLRFGSYQIHATRDKEDLEIVRHLADYTIRHHYPHLENIKKSEGLSFEAAIGDSPAIDLTSNKYAAWAVEVAERTAFLIARWQGVGFTHGVLNTDNMSVLGLTIDYGPFGFLDAFDPSYTPNTTDLPGKRYCFANQPDVGLWNIAQFTSPLTAAELISKDEANYVMERYGTKFMDEYQSIMTRKLGLPKYNKQLIGKLLNNLAVDKVDYTNFFRLLSNVKADHNIPEKELLVPLKAALLDIGPERKEAWISWVQTYIEELVSSGVPDEERKAAMNSVNPKYVLRNYLCQTAIDAAEQGDYDEVRRLLKVMEHPYDEQPGMEKYARLPPAWAYRPGVCMLSCSS

SEQ ID NO: 89144 - protein, 505 aa, Oryza sativa Japonica Group
MSGGSSPRSRRSSFNSLSRDLELPSEQGCLSVIVLGASGDLAKKKTFPALFHLFAQGFIQSGEVHIFGYARSNLSDDGLRERIRGYLKGASEEHLSDFLQHIKYVSGSYDSGEGFEKLNKEISEYEKSNKSESPRRLFYLALPPSVYPSVCKMIRTYCMNPSGWTRVIVEKPFGKDLDSAEELSAQLGELFDENQLYRIDHYLGKELVQNLLVLRFANRLFLPLWNRDNIDNIQIVFREDFGTDGRGGYFDQYGIIRDIIQNHLLQVFCLVAMEKPVSLKPEHIRDEKVKVLQSVNPIKHDEVVLGQYEGYKDDPTVPDDSNTPTFASVVLRVHNERWEGVPFILKAGKALSSRKAEVRVQFKDVPGDIFKCKRQGRNEFVIRLQPSEAMYMKLTVKKPGLEMATEQSELDLSYGMRYQNVKIPEAYERLILDTIRGDQQHFVRRDELKAAWQIFTPLLHDIDEGKVKSIPYQPGSRGPKEADELSERVGYMQTHGYIWIPPTLA

SEQ ID NO: 89145 - protein, 220 aa, Glycine max
MERSVDYSSEEECTEDYRRGGYHAVRVGDAFNNGRYIVQSKLGWGHFSTVWLAWDTLNSHYVALKIQKSAQHYTEAAMDEIKILKQIAEGDPDDKKCVVKLLDHFKHSGPNGQHVCMVFEFLGDNLLTLIKYSGYRGLPLPMVKEICFHILVGLDYLHRELSVIHTDLKPENVLLLSLINPSKDPRKSGAPLILPNTKDKAVSNNGTNQDNKILNGDPMK

SEQ ID NO: 89146 - protein, 307 aa, Trichodesmium erythraeum IMS101
MSKKLVLMDHDGAVDDFLSTLLLMTMENIQPLGVIVTPADCYIEPAISATRKILDLIGRSDIPVAESTVRGVNPFPVLFRRDSFAVDHFPILNQKENINTILISEPGQNFMVKVLKSAPAPVTLMVTGPLTTVATALDIAPEIESKIQEIVWMGGALNVPGNVSKDMEPGQDMSAEWNAYWDPFAIERVWQTQIPIVLCSLDITNNVPLTSEFSHKLSKQRKYPISDFAGQCYALAISQDYYFWDVLATSYLAHPEFYQLQEWETVVITKGLSQGRIKVENGGRKIMAMETVDKERFYTYILQQWAR

SEQ ID NO: 89147 - protein, 612 aa, Zea mays
MESVVGQLAAPVPEIAIECPTHIFHLAFTPPPVTGALYLGRQRGTDFSNQLMLDRPPRRGFAFIVPSMSMQEPTSAATQLHAAMEASLSLSSLQVAFTAVAAIAALGVAVAVTRYNRRYMGLRLPPGPPGWPVVGNLFQVAFSGKLFIHYIRELRKEYGPILTLRMGERTLVIISSAELAHEALVEKGREFASRPRENTTRNIFSSNKLTVNSAVYGPEWRSLRRNMVSGMLSTSRLREFRHARRRAMDRFVSRMRAEAAASPDGASVWVLRNARFAVFCILLDMTFGLLDLREEHIVRIDAVMKRVLLAVGVRMDDYLPFLRPFFWRHQRRALAVRREQIDTLLPLINRRRAMLRDMQQRQSSSPPPDPSVAAPFSYLDSVLDLRIEGRDDGALTDDELVTLCAELLNGGTDTTATAIEWGMARIVDSPSIQARLHEEVMQQVGDARPVDDKDTDAMPYLQAFVKELLRKHPPTYFSLTHAAVQPGCKLAGYDVPVDANLDIFLPTISEDPKLWDRPTEFDPDRFVSGGETADMTGSAGIRMIPFGAGRRICPGLAMGTTHIALMVARMVQAFEWRAHPSQPQLDFKDKVEFTVVMDRPLLAAVKPRNLAF

SEQ ID NO: 89148 - protein, 416 aa, Haloarcula marismortui ATCC 43049
MSRYIEAGLSDIGTLGEYVAERPNKGFEPARRRAGVSHTTVSGPKLAVAVMAVSAVCCPCGCQCVLVTPLSPRSFTLCAHIIDTMNTLVDGEWRTDAYETTNEDGAFDRQDTTFRDRVEDDPDARFQPEAGRYHLYACRACPWAHRILVARKLLGLEDAITVDYVDPFRGEDGWQFTPEKAGCTPDTVNGSDYLREVYVEADPDATCRVTVPVLWDKQEETIVNNESEEILRMLDTEFDDVSDNDVDLYPEGYQDEVDRIIDDIYEPINNGVYRSGFADSQSAYDEAVEELFDALDHWDTVLEDQRFLAGDRLTEADICLFTTLVRFDEVYHTHFMCNHKLIREYDNLWPYLRDLYQLPGVAETVNMDHITEHYYTTHPDVSPKRIVPMGPDPDFEAVHDRDELPGDLPETLFPTA

SEQ ID NO: 89149 - protein, 137 aa, Methanosarcina barkeri str. Fusaro
MKISVIGSGYVGSVTAACFAEVGHEVVCVDIDKKKMDQINSGIPPIYEEGLGELLQKYAGKSLTATTDYEFAIKNTDISFICVGTPSAEDGSIDLSIVRAATASIGAVLAKKEGYHVVVVKSTVVPETTEKFVLPIP

SEQ ID NO: 89150 - protein, 175 aa, Buchnera aphidicola str. Bp (Baizongia pistaciae)
MTLNTVLSGKNIPEDIYVIIEISAHSNPIKYEVNKDLGLLFVDRFIPVPMFYPCNYGFINKTKSNDGDPLDVLVHTPYPILPGSIIRCKPIGVLNMFDESGEDYKIIAIPHPKVCLEYSSINDICHLSPTLKQQIIHFFKHYKNLENNKWVKIIGWENKKNAEKIILSACEKFHK

SEQ ID NO: 89151 - protein, 309 aa, Methanosarcina barkeri str. Fusaro
MLKAQLCPRQLKNLSFLFLEETSGKIAGKNFGVAMNPEFLREGKAVYDFMHPDKIVVGAIDQKSGDLVSELYRTFKCEVTRTSLSTAEMIKYANNSLLATKISFANEIGNICKRLNVDTYEVMKAVGKDSRISPKFLNSGAGFGGSCFPKDVKALIGKAKEIGYSPVLLESVIGVNEKQPILMTEILQKKIGSLEGKKVAVLGLAFKNDTDDIRESRSIPIIAELLRLGAEVSAYDPMAIENMKRIFPTIEYSGKAKDALEGADACLVMTEWSEFKQLDSEFEVMKEKIVVDGRRIIKAKNIDYEGLCW

SEQ ID NO: 89152 - protein, 295 aa, Methanosarcina barkeri str. Fusaro
MTVKKALIPAAGLGTRFLPATKSMPKEMLPIIDTPVIQYVVEEAIASGIEDIIIITGRGKRAIEDYFDDSPELEMHLAKKHNTELLKLVRNVSSLVDIHYIRQKEPNGLGDAVLRAENHIGDEPFAVLLGDDIIVNNKPCTAQLIDNFEKYGRSTLAVEEVPREKLSSYGIIKGKPLSNSLYVLEDIVEKPSPENAPSNMGAIGRYVFTPEIFDCIKEAGTGVGNEIQLTDGIRVLNRSQMIYACRFKGKRFDTGDRLGYVKSIVDFALENENLREDVLEYLREILAEVKEPSSK

SEQ ID NO: 89153 - protein, 274 aa, Fusobacterium nucleatum subsp. nucleatum ATCC 25586
MDKIYIRDLEFIGYHGLFEEEKKLGQKFFVSLELTTNLREAGLNDDITKTTHYGEVSETVKKIFFQKKYDLIETLAEDIAREVLLNYPLISELKLEIKKPWAPVGIALKDVSVEITRKWNEVYISLGTNMGKKKKNMEKAIKEVANIKDTFIIKESTIIETEPFGYKEQDDFLNSCIGVKTLLAPREILKELLSIEKKMGRERKIKWGPRIIDLDIIFYGKEVIEEDDLVVPHPYMEYREFVLKPLEEIIPNFVHPLLSKRISTLRKELENEKN

SEQ ID NO: 89154 - protein, 334 aa, Haloarcula marismortui ATCC 43049
MSKPVRVGLNGFGRIGRNVFRASLHNDDVEIVGINDVMDDSEIDYFAQYDTVMGELEGASVDDGVLTVEGTDFEAGIFHETDPTQLPWEDLDVDVAFEATGIFRTKEDASQHLDAGADKVLISAPPKGDEPVKQLVYGVNHDEYEGEDVVSNASCTTNSITPVAKVLDEEFGINAGQLTTVHAYTGSQNLMDGPNGKPRRRRAAAENIIPTSTGAAQAATEVLPELEGKLDGMAIRVPVPNGSITEFVVDLDDDVTESDVNAAFEEAAAGDLEGVLGVTSDDVVSSDILGDPYSTQVDLQSTNVVSGMTKILTWYDNEYGFSNRMLDVAEYITE

SEQ ID NO: 89155 - protein, 400 aa, Haloarcula marismortui ATCC 43049
MTFQTLDDLDDGQRVLVRLDLNSPVEDGTVQDNRRFDRHAETVSELVDRGFEVAVLAHQGRPGRDDFVSLAQHAEILADHIDHDVDFVDETYGPQAIHDIADLDGGDVLVLENTRMCDDELPEEDPEVKSQTEFVQTLKDEFDAYINDAYSAAHRSHASLVGFPLVMDAYAGRVMETEYEANTAIAEKEFDGQVTMVVGGTKATDVIDVMTHLDEKVDDFLLGGIAGELFLRAAGYPVGYDIDDANLYDEQWEENSEKIESMLEDHRDQITLAVDLAYEDDGDRAEQAVDDIEEKSVSYLDVGSETVMEYSPVIRDSEAVFVKGALGMFEDERFSVGTAGVLEAIADTDCFSVVGGGDTSRAIEMYGMEEDEFGHVSIAGGAYIRALTGAELVGVEVLQR

SEQ ID NO: 89156 - protein, 587 aa, Streptococcus pyogenes MGAS315
MAVEIIMPKLGVDMQEGEIIEWKKQEGDTVNEGDILLEIMSDKTNMELEAEDSGVLLKITRQAGETVPVTEVIGYIGAEGESVEVSSPAASDVNVARTTEDLEAAGLEVPKAPAQAASAAPKAALADDEYDIIVVGGGPAGYYAAIRGAQLGGKIAIVEKSEFGGTCLNVGCIPTKTYLKNAEILDGIKIAAGRGINLASTNYTIDMDKTVDFKNTVVKTLTGGVQGLLKANKVTIFNGLGQVNPDKTVTIGSQTIKGRNVILATGSKVSRINIPGIDSKLVLTSDDILDLREMPKSLAVMGGGVVGIELGLVWASYGVDVTVIEMADRIIPAMDKEVSLELQKILSKKGMKIKTSVGVSEIVEANNQLTLKLNNGEEVVAEKALLSIGRVPQMNGLENLNLEMDRNRIKVNDYQETSIPGIYAPGDVNGTKMLAHAAYRMGEVAAENAIHGNTTRKANLKYTPAAVYTHPEVAMVGLTEEQAREQYGDVLIGKNSFTGNGRAIASNEAHGFVKVIADAKYHEILGVHIIGPAAAEMINEAATIMESELTVDELLLSIHGHPTFSEVMYEAFADVLGEAIHNPPKRK

SEQ ID NO: 89157 - protein, 137 aa, Triticum aestivum
  misc_feature (50)..(50): Xaa can be any naturally occurring amino acid
  misc_feature (121)..(122): Xaa can be any naturally occurring amino acid
FPIATNFALDNHPCPSPPPTTSARRHRRPATASPGAPRAPPPSGPCAAAXAAGATAGGEATAAVSAVNTSAKRDPVRRHTISVFVADESGMINRIAGVFARRGYNIESLAVGLKKDKALFXXVVSGTDRVLKQVIEQ

SEQ ID NO: 89158 - protein, 235 aa, Oryza sativa Japonica Group
MARIKPKQLLIQSKTKKAPTRISYSTIVTWNLIVILVALSLYATYRHWHHRPMLETEMDLPRAEHVGRSEDSTKTSRPSYAVIDTAKGSITIEIYKDASADVVDRFVSLCKSNHFKGMPFRHVIKNFVIQGGDFDFNGAAQEWILKAKASGENALSPKHEAFMIGTTKNPNNKGFDLFITTAPIPDLNDKLVVFGQVINGQDIVQEIEEVDTDEHYQPKTPIGILNITLKQQALS

SEQ ID NO: 89159 - protein, 449 aa, Centaurium erythraea
MDVIFPLLVAFITWAIASSLTFRRFGRLPPGPFPVPVIGNIHQLGKHPNQSLAKLSKIYGPLMSLKLGTQTAIVASSSTVVREILQKHDQVFSSRTIPSALHAHDHHKFSMALLPASSRWRHLRKITKEQMFSVQRLDESQGLRQDKLKELRDYLHSCCVTGQAVNIGEAAFTTTLNLMSCTLFSVNFASFDSKFSDELKRDICAFVQVIAAPNLADFSPVLRHVDPQGLLKRTKTYMQKVFDSFEDIITKRLQERGTSQQDSLRRHDLLEALLDEMEKNDSAFTINDMKHLILDLFIAGADSTSSTTEWGMAELLHNPEKMEKAKAELNEVIGQKNLVEESDISRLPYLQAVVKEVFRLHPPGPLLVPHKADADVEIDGYVVPKNANVLVNVWALGRDSSSWADPEAFMPERFLDNEIDVKGQHFELIPFGAGRRMCPGLPLSYRMLH

SEQ ID NO: 89160 - protein, 318 aa, Lactococcus lactis subsp. lactis Il1403
MKNIVTARAHTNIALIKYWGKADIALNIPTTSSLSMTLEPFYTTTSVEFTDNESDSLILNSEVADSSRVSQFLEMMRGQYGNFPKVMIQSENHVPTAAGLASSASSFAALTAAMFGLLDLEKDDSEMSRIARRGSGSASRSIFGNFSVWNKGEDHQSSFAESFYNEDIGLSMIVAEISAEKKKMSSTKGMQLAQTAPTYSAWVEKSAIQLEEMKQAILNADIEKVGLVAQDNALGMHEQNRLSNQPFDYFTHETRHVIDFVNQAYQSGLLAFVTIDAGPNVKIITDHATEKVLLAKLQAEFPELTFDIARAGGAYEYL

SEQ ID NO: 89161 - protein, 87 aa, Glycine max
  misc_feature (46)..(46): Xaa can be any naturally occurring amino acid
  misc_feature (72)..(72): Xaa can be any naturally occurring amino acid
SSLRTSLASAASSDKGSPFESTMEERLCAYPRAVAHFPAAVKEFKXRNGWFYSLSKKDAAQGYPDPCPLHSXWLKKRRSAQSLSLQP

SEQ ID NO: 89162 - protein, 363 aa, Sulfitobacter sp. EE-36
MPLIKAAVCHEFGASLKIEDVELRAPEGAEVEVTLDAVAICHSDISFASGGWGGSLPAVYGHEAAGRVSAVGDRVSGVAVGDSVVVTLIRACGSCPNCASGRPVICETPYDGDTGPLKTKDGGKLHQAMASGAFAEKVVVDQAQVVRISADIPKDAASLIACGVITGVGAVVNAAQLRAGQDVVVIGAGGVGLNAIQGARIAGARRIVAVDMSAEKLEIAKEFGATDGILATEDKPWGQLEQAIGRKGVDAVIVTVGAIPAYNDAPKYLAAGGRVVMVGMPHIGDGATYDPGTFAAMGQGTVGSKMGDVVIQRDIPWMVDLYAQGRLKLDELISGRWSLEQINDAIEDTKTGAARRNVILFDR

SEQ ID NO: 89163 - protein, 526 aa, Oryza sativa
MADRSDNELGTTGGLLDLPSLPWDELDDDTEARKNDNVLTHSCTREREGEGERAMAVQAGTPATPISPQVISGAFVQQYYHILHETPDQVYKFYQDASIVGRPDSNGVMKYVSTTADINKIILSMDFSNYLTEIETADAQLSHQDGVLIVVTGSLTSEGICRRFTQSFFLAPQESGGYVVLNDIFRFIVERPPVAISQVSQENENNQNTATLPETAGDGMISEPVAVENNVAEGEVTNSTVDGTSIENNATAAVEPPVQMTKEEPRKISVAAPPPPAQKDVTKKSYASITLTMIALQVKVMKEVSLTPVVKPKPAPKHVVKTVEASEKPSVKSSQTVEITPNDNNDAENNTSNDEQGYSVFVKSLPHNVTVQTVEEEFKKFGAIKPGGIQVRNNKIDRFCFGFIEFESQQSMQAAIEVVVNGVVITRGDNGNAGGGGRYQSGRGGYRGDNFRGRGGGYANSGNYRGGDNFSRRNDLRNRNEFSGRGRGPPPGNGYQNNGFHPARPFQNGNGRFTRVNGPRQTPVAA

SEQ ID NO: 89164 - protein, 1230 aa, Candida albicans
MSILSENNPTPTSITDPNKSSHLHNPELNSGTRVASGPGPGPEAESTPLAPPTEVMNTTSANTSSLSLGSPMHEKIKQFDQDEVDTGETNDRTIESGSGDIDDSQQSHNNNNNNNNNNNESNPESSEGDDEKTQGMPPRMPGTFNVKGLHQGDDSDNEKQYTELTKSINKRTSKDSYSPGTLESPGTLNALETNNVSPAVIEEEQHTSSLEDLSLSLQHQNENARLSAPRSAPPQVPTSKTSSFHDMSSVISSSTSVHKIPSNPTSTRGSHLSSYKSTLDPGKPAQAAAPPPPEIDIDNLLTKSELDSETDTLSSATNSPNLLRNDTLQGIPTRDDENIDDSPRQLSQNTSATSRNTSGTSTSTVVKNSRSGTSKSTSTSTAHNQTAAITPIIPSHNKFHQQVINTNATNSLSSLEPLGVGINSNSSPKSGKKRKSGSKVRGVFSSMFGKNKSTSSSSSSNSGSNSHSQEVNIKISTPFNAKHLAHVGIDDNGSYTGLPIEWERLLSASGITKKEQQQHPQAVMDIVAFYQDTSENPDDAAFKKFHFDNNKSSSSGWSNENTPPATPGGSNSGSGSGGGGAPSSPHRTPPSSIIEKNNVEQKVITPSQSMPTKTESKQSENQHPHEDNATQYTPRTPTSHVQEGQFIPSRPAPKPPSTPLSSMSVSHKTPSSQSLPRSDSQSDIRSSTPKSHQDVSPSKIKIRSISSKSLKSMRSRKSGDKFTHIAPAPPPPSLPSIPKSKSHSASLSSQLRPATNGSTTAPIPASAAFGGENNALPKQRINEFKAHRAPPPPPSAPPAPPVPPAPPANLLSEQTSEIPQQRTAPSQALADVTAPTNIYEIQQTKYQEAQQKLREKKARELEEIQRLREKNERQNRQQETGQNNADTASGGSNIAPPVPVPNKKPPSGSGGGRDAKQAALIAQKKREEKKRKNLQIIAKLKTICNPGDPNELYVDLVKIGQGASGGVFLAHDVRDKSNIVAIKQMNLEQQPKKELIINEILVMKGSSHPNIVNFIDSYLLKGDLWVIMEYMEGGSLTDIVTHSVMTEGQIGVVCRETLKGLKFLHSKGVIHRDIKSDNILLNMDGNIKITDFGFCAQINEINSKRITMVGTPYWMAPEIVSRKEYGPKVDVWSLGIMIIEMLEGEPPYLNETPLRALYLIATNGTPKLKDPESLSYDIRKFLAWCLQVDFNKRADADELLHDNFITECDDVSSLSPLVKIARLKKMSESD

SEQ ID NO: 89165 - protein, 414 aa, Arabidopsis thaliana
MDYRPSDSSGTDDDLPPSHQGRYQRNARPTGNGRPSVLNSAPLSRVHNEMETQIHLIEQEAYSSILRAFKAQSDAITWEKESLITELRKELRVSDEEHRELLSRVNADEMIRRIREWRKANSLQSSVPQLVHDAPSPAVSGSRKKQKTSQSIASLAMGPPSPSLHPSMQPSSSALRRGGPPPGPKTKKPKTSMQYPSTGIAGRPQAGALTNEPGESGSYDPLVGRKVWTKWPDDNQYYEAVITDYNPVEGRHALVYDINSANETWEWVNLKEISPGDIRWEGEDPGISRKGGHPGQGRGTKTMARGGPASNAGGRGRGSMRMQQPKTQNGIGKKALGEIEILHTETLLKEVEKVFGSVNPNPAEVEKAKRVLRDHELALMDAIAKLEEISDGESDDGAGALELQKGVVDGGGKM

SEQ ID NO: 89166 - protein, 264 aa, Streptococcus pyogenes M49 591
  misc_feature (195)..(195): Xaa can be any naturally occurring amino acid
MENMFSLQGKIALITGASYGIGFEIAKAYAQAGATIVFNDIKQELVDRGMAAYRELGIEAHGYVCDVTDEAGIQQMVSQIEDEVGVIDILVNNAGIIRRTPMLEMAAEDFRQVIDIDLNAPFIVSKAVLPSMIAKGHGKIINICSMMSELGRETVSAYAAAKGGLKMLTKNIASEFGEANIQCNGIGPGYIATPXTAPLRERQADGSRHPFDQFIIAKTPAARWGTTEDLAGPAVFLVSDASKFVNGHILYVDGGILAYIGKQP

SEQ ID NO: 89167 - protein, 165 aa, Zea mays
KGKYVVFFFYPLDFTFVCPTEIIAFSDRAEEFKKLNCQVIGASVDSHFCHLAWVNTPKKQGGLGPMNIPLVSDPKRTIAQDYGVLKADEGISFRGLFIIDDKGILRQITVNDLPVGRSVDETSRLVQAFQFTDKHGEVCPAGLIPGSDTIKPDVHKSKEYFSKQK

SEQ ID NO: 89168 - protein, 320 aa, Oryza sativa
MDADRDPIFPVQQMPSLLFPPPPPRPLALDSTSSASSSFVPHHPSITSFPILVLTVLGILTTSVLLLTYYIFVIRCCLNWNSSSSSDTRTAGLISRRRRGAASSSLPAVAEPRGLEEAAIQSLPAFRYRKAIKDTTADSSECAVCISEFQEEERVRLLPSCLHVFHVDCIDTWLQGNANCPLCRAAIATNDSQLPLDQFVRPEVVVIQVITGAEEEGAQAPQQEANTAASDPAVDATSTNQQVSSKKTKNQNAWHVSISKGDECIAVRRDRNVLPLRRSFSMDSLGGAGEVHLQIQNILQRSTHFHGDISDSSSSSTGTL

SEQ ID NO: 89169 - protein, 414 aa, Bartonella henselae str. Houston-1
MENNVQTLSYNVEEIRRDFPLLHRDVYGKRLAYLDSGASAQKPQSVLNAMHNCYRHSYANVHRGIYFLANAATQSYENARETVRIFLNAQTAKEIVFTKNATEAINTVAYGWAMSKLKEGDEIVLTIMEHHSNIIPWHFLREQKGVKLVFVPVDENGVLHIEDFEKAFSERTRLVTLTHMSNILGTVPPVKEIIKQAHQNGIPVLVDGSQGAIHLTVDVQDLDCDWYVFTGHKLYGPTGIGVLYGKEHRLEEMHPFQGGGEMIEDVTIDKVSYNAPPYRFEAGTPPIVEAIGLAAAIDYMQKKDRKAIHAHEMALLTYAHEKLKTVDSLRIYGHSPHKGAIISFAIEGIHAHDIAMFLDRKGVAIRAGTHCAQPLLQRFGLTSICRASLAMYNTCEDIDQLVEALKETRTFFNG

SEQ ID NO: 89170 - protein, 394 aa, Methanosarcina mazei Go1
MFSINSECVISKKSEDIPPFYVMEVLESAQALEAQGRHIIHLEVGEPDFPTAPHICEAACAAIGRGLTKYTHSQGLLALREAIVESYYQKFGVDLDPGQVIVTSGTSPALLMVFMALLEKRDEVIMSNPHYSCYPNFVKHLGGTPVFVYTNETNGFALEPETVRQRLSPNTKAILINSPSNPGGHVMSPENLQGLAAIADERGIPIVSDEIYQGLIYSGEEHSILEYTKNAFVLNGFSKLYAMTGWRLGYIICPPGCVRALQKIHQNFFICANSFVQEAGIAALKGPQEHVTEMVQTYNVRRQYMLKRLIGMGLDVRKEPMGAFYVLADARKYCSDSLELSRRILNEAGVAVTPGIDFGNGAEGYLRFSYANSLENITEGMDRLEAFLEKELEG

SEQ ID NO: 89171 - protein, 273 aa, Arabidopsis thaliana
MSMASIASSSSTTLLSSSRVLLPSKSSLLSPTVSFPRIIPSSSASSSSLCSGFSSLGSLTTNRSASRRNFAVKAQADDLPLVGNKAPDFEAEAVFDQEFIKVKLSEYIGKKYVILFFYPLDFTFVCPTEITAFSDRYEEFEKLNTEVLGVSVDSVFSHLAWVQTDRKSGGLGDLNYPLVSDITKSISKSFGVLIPDQGIALRGLFIIDKEGVIQHSTINNLGIGRSVDETMRTLQALQYVQENPDEVCPAGWKPGEKSMKPDPKLSKEYFSAI

SEQ ID NO: 89172 - protein, 468 aa, Parvularcula bermudensis HTCC2503
MTWVAFFISFVIWFNFAPLTEAVRVTFDLDKSQISTLLILNVALTIPARILIGALTDRFGPQKVYSGLLAFSAVPCLAFAFADNFTQLAIARFALGFVGAGFVVGIRMVSEWFPPNEVGTAEGIYGGWGNFGSAAAAFTLPSIALIFGGDEGWRYAIALTGLVALAYSFVYYRNVSDAPEGSRYFKAKQTRAMEVTSKGDFFLLLIMKAPLQIALGILAWRLERVGLISEPVQYAIWLLLAAYYAFNAWQAYEVNKSVFTEEVPLIHRYKFKQVAALNFLYAATFGSELAVVSMLPLFFAETFGLSPVLAGMVASGYAFMNLVSRPSGGVFSDRFGRRLTMIVLMAGVVVGYLLMAMVGSSWPVFLAVAVAMLCSFFVQAGEGAVFAMVPLIKRRLTGQIAGLTGAYGNVGAVVFLVIYSMVPAAAFFLVLAATALVGLACSFLLEEPRGEIAEINEDGTVTMIAVSA

SEQ ID NO: 89173 - protein, 197 aa, Gossypium gossypioides
VVEHVGLNINGEPFVACHECNFPICKSCFEYDLKEGRKACLRCGSPYDENLLDDVEKATGDQSTMAAHLSKSQDVGIHARHISSVSTLDSEMAEDNGNPIWKNRVESWKEKKNKKKKPATTKVEREAEIPPEQQMEDKPAPDASQPLSTIIPIPKSRLAPYRTVIIMRLIILGLFFHYRVTNPVDSAFGLWLTSVIC

SEQ ID NO: 89174 - protein, 197 aa, Gossypium davidsonii
VVEHVGLNVNGEPFVACHECNFPICKSCFEYDLKEGRKACLRCGSPYDENLLDDVEKATGDQSTMAAHLSKSQDVGIHARHISSVSTLDSEMAEDNGNPIWKNRVESWKEKKNKKKKPATTKVEREAEIPPEQQMEDKPAPDASQPLSTIIPISKSRLAPYRTVIIMRLIILGLFFHYRVTNPVDSAFGLWLTSVIC

SEQ ID NO: 89175 - protein, 838 aa, Xanthomonas campestris pv. campestris str. 8004
MSSPSIAPVTPDLVRLRATARDKDDAIAQAAQLLVAAGCVAPGYDASMRRREGLANTFLGHGLAIPHGVGEDRHLVRRDGIAVLQLPEGVEWNPGQTTRLVVGIAAQSDTHITLLRRLTRLIQDPAQLEALFTTDDPAVIVAALTGDRAPDTSAAPATDLAERFEWTIAYPSGLHARPATRWAETARGFSARAQVRAGDQAADAKSLVGLLQLGLRAGDSITVSAKGSDAPALLKRLRAVMDSLTAQEKADAERAAQRRAAPVIGWTPPQAQPAIVGIGASPGVAIGIVHRLRAAQTEVADQPIGLGDGGVLLHDALTRTRQQLAAIQDDTQRRLGASDAAIFKAQAELLNDTDLITRTCQLMVEGHGVAWSWHQAVEQIASGLAALGNPVLAGRAADLRDVGRRVLAQLDPAAAGAGLTDLPEQPCILLAGDLSPSDTANLDTDCVLGLATAQGGPTSHTAILSRTLGLPALVAAGGQLLDIEDGVTAIIDGSSGRLYINPSEQDLDAARTHIAEQQAIREREAAQRALPAETTDGHHIDIGANVNLPEQVAMALTQGAEGVGLMRTEFLFLERGSTPTEDEQYQTYLAMARALDGRPLIVRALDIGGDKQVAHLELPHEENPFLGVRGARLLLRRPDLLEPQLRALYRAAKDGARLSIMFPMITSVPELISLREICARIRAELDAPELPIGIMIEVPAAAAQADVLARHADFFSIGTNDLTQYVLAIDRQNPELAAEADSLHPAVLRMIRSTIDGARKHDRWVGVCGGLAGDPFGASLLAGLGVQELSMTPNDIPAVKARLRGRALSALQQLAEQALQCETAEQVRALEAQREGQA

SEQ ID NO: 89176 - protein, 126 aa, Oryza sativa
MSEINPKAYPLADEELNKSILDLVQQALNYKQLKKGANEATKALNRGKAELILMAADTEPIEILMHLPLLCEDKNVPYVFVRSKQGLGRACGVSRPVIACSITQNEGSQLKNQIDALKTNIEKLLI

SEQ ID NO: 89177 - protein, 340 aa, Physcomitrella patens subsp. patens
MIHRVQKRRSHTLVSEPCWKSGRILTPFVTTCPLLKREELEAACEDFSNIIGSSPDGVLYKGTLADGTEVAVTSIRMSATDWSAYSELSFRRKVESLARMKHKHLVNLVGYCSEEVPFTRMLVFEYASNGTLSDHLHNPKEMEHLDWPTRMRVIMGAAYGLEYMHHDLTPPCSHLNFDANAIYLTDAYATKIANFGIARMTPGKKDEGYTDEWESSDRHCPGFESNVYNFGVFLLQVISGRPSYCEPVGSTLVDWASPYLADSNLVEQLLDPELKAHNSDELLALCKIVNLCLSNKGYKRPSMRKVSQMMAEALNMTPEALTMKMSPLLWAQLSILDDST

SEQ ID NO: 89178 - protein, 194 aa, Brassica napus
MACTTDFRCLDEGFGGKTAKRKRESQEQAAADADEASMDIDSAHPPSAKRSAVASSEDPDKPVAVAAIGRPTYDGVIAGKVSGRNWKTPRTHRSSGRFVRNKGPDLEEMKRQREIKKAYRERKNELKEEIRSHKVEKRKKKEEREKRKAENVLRTGTKLQKITNPKTLKKIAKSKQRKHLKVIPDEVVNGNKKS

SEQ ID NO: 89179 - protein, 108 aa, Triticum aestivum
  misc_feature (24)..(24): Xaa can be any naturally occurring amino acid
  misc_feature (58)..(58): Xaa can be any naturally occurring amino acid
  misc_feature (95)..(95): Xaa can be any naturally occurring amino acid
PRVRPRVRKMQRAIQAIGSHGSVXKFAVLQHISVVKPAMLPVVFPRFMLVSSAQIEEXSGFESSTVADILKFNGKSAVGSCLWCTTDVSVYYAVXSMTQFNVGALVAV

SEQ ID NO: 89180 - protein, 379 aa, Prochlorococcus marinus str. MIT 9215
MINSFKKNAKLVLSNGIVFPGFYFGASGTAIGEIVFNTGMTGYQEVITDPSYYGQILTFTYPEIGNTGINFEDSESEINVKGIIVRNFSSNNSNWRSKKNFNQWLIDKNIVGLHGIDTRALVKILRSNGSMNGVITSEDKNVESCLKIIHDIPKMEGLNLSKVVSTKKQYLWNSHTRTVFDLRKRYADSSKKLKIVAIDFGIKNSILNRLVSHGCEVLVLSSRSTLKDVLYNKPDGIFFSNGPGDPSSVSEGIDLAKSLIEYGEIPMFGICLGHQIFGLALGGSTFKLPFGHRGLNHPCGKNNKIEITSQNHGFAIDPNSLSKDIVRITHYNLNDNTVAGLEVNNKPIFSVQYHPEAGPGPHDSDYLFKKFVSLMLERC

SEQ ID NO: 89181 - protein, 169 aa, Zea mays
MMSRERKKAAAALQEKLKILRSITHSHALSNTSIIMDASAYIKQLQQKVVRLNQEIACAQDALRHKSSSYPTVSVETLGVQGFLVNVFSDKSCPGLLVSVLEAFDELGLSVLQATASCAADSFRLEAVGGENVVDNVDEHVVSRHTRTRLYLHCIGRPLMCQRAQLDRV

SEQ ID NO: 89182 - protein, 302 aa, Bifidobacterium longum DJO10A
SRSSEGAWRRVIIEKPFGHDLASAKELDSVVSEVFDPSSVFRIDHYLGKETVQNLLALRFANAMYEPIWNANYVDHVQITMAEDIGIGGRAGYYDGIGAARDVIQNHLLQLMALTAMEEPVSFTAKDLTAEKTKVLSAVRLPKDLAANTARGQYAKGWQGSHEVVGYLEEKGIDPKSTTETYAAIRLDIDTRRWAGVPFYLRCGKRLGKRVTEIAVVFKRAPHLPFEQTAVRELGKNAIVIRVQPDEGVTMRFGAKVPGGSTMEVRDVNMDFSYGRSFTENSPEAYERLILDVLLGDPPLFP

SEQ ID NO: 89183 - protein, 419 aa, Triticum aestivum
  misc_feature (162)..(162): Xaa can be any naturally occurring amino acid
  misc_feature (280)..(280): Xaa can be any naturally occurring amino acid
  misc_feature (308)..(308): Xaa can be any naturally occurring amino acid
  misc_feature (326)..(326): Xaa can be any naturally occurring amino acid
  misc_feature (336)..(336): Xaa can be any naturally occurring amino acid
  misc_feature (360)..(360): Xaa can be any naturally occurring amino acid
  misc_feature (373)..(373): Xaa can be any naturally occurring amino acid
  misc_feature (380)..(380): Xaa can be any naturally occurring amino acid
MAATIQSVKARQIFDSRGNPTVEVDVCCSDGTFARAAVPSGASTGVYEALELRDGGSDYLGKGVSKAVDNVNSIIAPALIGKDPTAQTELDNYMVQQLDGTKNEWGWCKQKLGANAILAVSLAVCKAGASVKKIPLYQHIANLAGNKQLVLPVPAFNVINGXGSHAGNKLAMQEFMILPTGAASFKEAMKMGVEVYHNLKSVIKKKYGQDATNVGDEGGFAPNIQENKEGLELLKTAIEKAGYTGKVVIGMDVAASEFYNDKDKTYDLNFKEENNDGSQXKISGDSLKNVYKSFVSEYPIVSIEDPFXQDDWVHYAKMTEECEVEXQIVGDDLLVXNPNRVAKAIREKSCNGPLVKGNQXGFVTGSIEAGKIXKNAGWGXVMTIPGSGRMRANQWGMGVGLATGQNKIGAPAAQNGFQK

SEQ ID NO: 89184 - protein, 197 aa, Gossypium schwendimanii
VVEHVGLNVNGEPFVACHECNFPICKSCFEYDLKEGRKACLRCGSPYDENLLDDVEKATGDQSTMAAHLSKSQDVGIHARHISSVSTLDSEMTEDNGNPIWKNRVESWKEKKNKKKKPATTKVEREAEIPPEQQMEDKPAPDASQPLSTIIPIPKSRLAPYRTVIIMRLIILGLFFHYRVTNPVDSAFGLWLTSVIC

SEQ ID NO: 89185 - protein, 197 aa, Gossypium trilobum
VVEHVGLNVNGEPFVACHECNFPICKSCFEYDLKEGRKACLRCGSPYDENLLDDVEKATGDQSTMAAHLSKSQDVGIHARHISSVSTLDSEMAEDNGNPIWKNRVESWKEKKNKKKKPATTKVEREAEIPPEQQMEDKPAPDASQPLSTIIPIPKSRLAPYRTVIIMRLIILGLFFHYRVTNPVDSAFGLWLTSVIC

SEQ ID NO: 89186 - protein, 475 aa, Methanosarcina barkeri str. Fusaro
MSKLEKLFKERGPIKKIGVLGMGYVGIPSAVLFADAPCFNKVLGFQRNSKSSSYKIGMLNRGESPLKGEEPGLEDLINKVVNAGKFECTPDFSRISELDAVTLAIQTPFANPKDLEPDFSALIEGIRNVGKYLKPGMLVVLESTITPGTTEGMAKQILEEESGLKAGEDFALAHAPERVMVGRLLKNIREHDRIVGGINEASTRRAIELYSPVLTVGKVIPMSATAAEVTKTAENTFRDLQIAAINQLALYCEAMGINVYDVRTGVDSLKGEGITRAILWPGAGVGGHCLTKDTYHLERGVKIGNGQLDYPESADSIYVLARKVNDFMPVHMYNLTVAALKRVGKEMKGSNIAMLGWAFIRDSDDARNTPSEPYRDLCLKAGATVNVHDPYVVNYPGIEISDNLENVIRDVDAVVIFAGHSAYSDIKADWVKKITGKEKPVIVDGRNVIEPDEFISEGFVYKGIGRGDKNEHLLM

SEQ ID NO: 89187 - protein, 644 aa, Rhodopirellula baltica SH 1
MDFLIYLALVPALGVTAQWLAWRTKLPSILLLLLFGICLGHFVVQPDSLLADLTGGDETAGPNILFPLVSLSVAIIMFEGGLTLKLSELRESGSSSLRLCTVGAALAFVGNTLAIHWILGFAWHLSFLLGAILVVTGPTVIGPLLRQVKPSRRVASTLKWEGIVIDPIGAVLAVLVYEEVVLAQSAPHFSSALKSLAITGAIGVGLGVAGGALLTQALRRYWVPDHLHGVTALSLALLLFALSNMIAHESGLIVVTVLGIWLTNQKHFDVEHIIELKENLRTLLIGCLFIVLGSRVNLTDLATIGLPGIGLIFALIFIVRPVSVYLSLLRSPLNYREQTFIAGLAPRGIVAAAVSSVFALSMESRTDLNIPGSDQLATVTFLVIIGTVAVYGIAAAPLARLLKLAEETSRGVLIAGADAWVRDFAAELKAAGIPVLLVDTNYNKISQARMAGLRGECANILNEHAREDLDLAGIGRLLAMTPNDEVNSLALRECRTLFDSSRLYQLTFKSKNTAGRRGLTKNLMGRELFGEGLTFTRLSEMHAAGASLKTTKLTESFLFADFQEKYGEVTTVLCAITSEGALNINTVDAPLVPAAGQTILALVSSTPVPDKHAVKASKKRPDPSLTDDANKDDEASSKDGEANA

SEQ ID NO: 89188 - protein, 366 aa, Debaryomyces hansenii CBS767
MNRFKIDLGKFKFDIKFLGDLFLLTGAGLSMYYIMNHLLNESLGEGSVKNRESKKKGTGVLRRMQATNPELKNVTFNDYEKSLLSCLITPEDISVTFGDIGGLKDIIDELREAVILPLTEPELFAAHLSLVQSPKGVLFYGPPGCGKTMLAKAIAKESGAFFLLIRMSTIMDKWYGESNKIVDAIFSLANKLQPCIVFIDEIDSFLRDRSSNDHEVSSIIKAEFMTLWDGLMSNGRIMVMGATNRREDIDQAFMRRLPKQFPIGRPDASQRRSILNKILKDSKLDEDDFDLEAIVSNTRSFSGSDLKELCREAALNSMREFIRDNYKDGKKLTKDTEPESTPKVRPLRTSDFLKGFSETIPSSTVD

SEQ ID NO: 89189 - protein, 197 aa, Gossypium turneri
VVEHVGLNVNGEPFVACHECNFPICKSCFEYDLKEGRKACLRCGSPYDENLLDDVEKATGDQSTMAAHLSKSQDVGIHARHISSVSTLDSERAEDNGNPIWKNRVESWKEKKNKKKKPATTKVEREAEIPPEQQMEDKPAPDASQPLSTIIPIPKSRLAPYRTVIIMRLIILGLFFHYRVTNPVDSAFGLWLTSVIC

SEQ ID NO: 89190 - protein, 189 aa, Gossypium gossypioides
HVGLNGNGKPFVACHDCNFPICKTCFDYELKEGRKACLRCGNPYDENLLDDAEKASGDRSTLAAHMDKSQDAGIHARHISSVSTLDSEMTEDNGNPIWKNRVESWKETKNKKKKTSIKVEIEAQVPPEQLMEDKPAADAFQPLSTVIPIPKSRLAPYRTVIIMRLIILGLFFHYRVTNPVDSAFALWLT

SEQ ID NO: 89191 - protein, 646 aa, Oryza sativa Japonica Group
MAIPGSFCHPTALQVFVSVQFVFAVLVPHAAGRHHRHGCAPFSCGHLSDVSPPFRRRGDPPECGVASYELTCTDDKPATIQIDNGTYLVMDIKYKDSTFWVIDANISDSRNNCPLPRWNRDFGYYDQMLYERHGEDSRRRSIQAELMPPYQSTTATFVTCSQEILKSNGKYRPVACMSTNSSFVYVLTGMNSDSIGSLEPSCGYLAMTPLGAGDRPLVLENASYADVVKLMRGGFAIRFPYTSRFYVYSSKIKQCIAQSFHCPTDRGCNTTGHVDFEVDCWFILVPLVILTFLARNYWKIRITTDAVEKFLRMQLMNGPTRYAYTDLIAITGHFREKLGQGGYGSVYKGVLLPGNAHVAVKVLGNSNCNGEEFISEVSTIGRIHHINVVHLVGFCSEEIRRALVYEYMPRGSLDKYIFSSERSFSWDKLNEIALGIARGINYLHQGCDMQILHFDIKPHNILLDVNFVPKVADFGLAKLCPRDQSFVPLSALRGTIGYIAPEMISRSFGIISSKSDVYSFGMLLLEMAGGRRNSDMYAENSNQTYFPSWVYDQLTEQQVGVGEIPAGTVANMHELERKLCIIGLHCIQMKSHDRPTMSEVIEMLEGGVVGLQMPPRPFFCDDEPVSLAVNSHQFSSELSEILEEDE

SEQ ID NO: 89192 - protein, 103 aa, Fusobacterium nucleatum subsp. nucleatum ATCC 25586
MAIVKGTKENFDAEVLKASGVVVVDFGANWCGPCKSLVPILDEIVEEDPSKKIVKVDIDEQEELAAQYKIMSVPTLLVFRNGEIIDKSIGLIQKHEVKALFAK

SEQ ID NO: 89193 - protein, 352 aa, Entosiphon sulcatum
MTASSTPSSPCHYTTLGIAKSAQAKEIKAAYRRRALECHPDKNPNGGKEFQRLHRAYETLIDPQLRRDYDNQQEAKLNPPQRRQPHTARTAADSAFQQQYAHYDAHYDHRSTNQFVQNLMKHDKEMERRKQEFAAANGATYHQHAHKPTAQPPGAGTAGTAGGTTDFAQWYKQKQNEWRQAEKAAENANLKREESERMMRAESDLRAQRLRDIEQDLERDKQADVRRRQREEDEERARRAAFEIKRQAALQEIEREEERYQQKFAKLKDKWADTQRNLNTGAATPRETPANAKPQTPAPENVTEEAAVEEALREVRQQREALRRERERMREEEAEARRQVQAVKTGEFADSL

SEQ ID NO: 89194 - protein, 189 aa, Gossypium davidsonii
HVGLNGNGKPFVACHDCNFPICKTCFDYELKEGRKACLRCGNPYDENLLDDAEKASGDRFTIAAHMDKSQDAGIHARHISSVSTLDSEMTEDNGNPIWKNRVESWKEKKNKKKKTSIKVEIEAQVPPEQLMEDKPAADAFQPFSTVIPIPKSRLAPYRTVIIMRLIILGLFFHYRVTNPVDSAFALWLT

SEQ ID NO: 89195 - protein, 152 aa, Glycine max
MTTHFTRCPHTLTYSTVSPTGLSPKDNIGLEPNNNNNGNSHFFISSKMVPNMVLENAIIVFASRGCCMSHVVKRLLLGLGANPAVHEVEESDEVGVVRELEAIVGANNGGNKMQFPAVFIGGKLFGGLDRVMATHISGELIPILKEAGALWL

SEQ ID NO: 89196 - protein, 286 aa, Bradyrhizobium sp. BTAi1
MSKILKIAFQGEPGANSHIAISEAYPTAEAMPCPTFEDALSAISSGEADLGMIPIENSVAGRVADIHHLLPASGLSIIGEWFLPIRHQLMALKGTKLADIKTVESHVHALGQCRRIIRQLGVRPIVAGDTAGSARDVSQRGDRSVAAIASRLAAEIYGLEILAEDIEDEAHNTTRFVVLAREPQWAEQNSGPLVTSFVFRVRNLPAALYKALGGFATNGVNMTKLESYMVDGNFFATQFYADVDGHPEDKGLAFALEELKFFSRELRIVGVYPAHPFRATFSERME

SEQ ID NO: 89197 - protein, 240 aa, Brassica napus
  misc_feature (203)..(203): Xaa can be any naturally occurring amino acid
MAKDGPNWDGLLKWSLSHADGTRPTRQLSEEDRKWFMEAMQSQTLDVVKRMKEITLVMQTPEQVLVEHGVTPDDIEDLLDELQEHVESIDMANDLHSIGGLVPLLGFLKNSHANIRAKAADVVSTIVQNNPRSQELVMEANGLESLLSNFISDTDVHARTQALSAISSLIRHNKPGVTAFKLANGYAGLRDAMASDSVRFQRXKALNLLQYLLQEDDSDRSIAAGLGFPRVMMHLASSDD

SEQ ID NO: 89198 - protein, 236 aa, Entosiphon sulcatum
MAIAEPNRRTPSPHRKWNPGGCVNCGLVHPVEDCPFHMTVCHNCYQPFHRTFECPGPGHTEEAPEPEPDSVVKPSYTEKKVVLVCRACQGPHAIDKCPMIICTRCERSGHTAANCPLPSAECPFPVRDGLCFNCNGPHLARDCPIGQRVCRQCHRPGHCATSCPESPLLCHACGDPGHKAKHCTKNPRGKARGRSPSYSRSRSPKRRRRSRSRSRSRSRSRSRSRSRSRRRSRRHK

SEQ ID NO: 89199 - protein, 171 aa, Escherichia coli
IGVYKDETGKTPVLTSVKKAEQYLLENETTKNYLGIDGIPEFGRCTQELLFGKGSALINDKRARTAQTPGGTGALRVAADFLAKNTSVKRVWVSNPSWPNHKSVFNSAGLEVREYAYYDAENHTLDFNALINSLNEAQAGDVVLFHGCCHNPTGIDPTLEQWQTLAQLSVE

SEQ ID NO: 89200 - protein, 733 aa, Sulfitobacter sp. EE-36
MTDFTMKTDADGVAIITWDVPGKSMNVMSIEGLSELDSIIDTVLSDDAIKGAVITSGKDGSFAGGMDLNLLAKMREDAGDDPAQGLFDGTMKMHALLRKIERAGMDAKTNKGGKPIASALPGTAAGIGLELPLATHRIFVADNPKARIGLPEIMVGIFPGAGGTTRLARKLGAMAASPFLLEGKMVAPAAAKSAGLIDEVVADPVAAAKEWVLNAKDADILKPWDAKGYKMPGGAPYHPAGFMTFVGANAMVNGKTQGAFPAAKALLSAVYEGSLVPFDTALKIEARWFTNILLNPSSSAMIRSLFLNKEALEKGAVRPEGVADQRVKKLGVLGAGMMGAGITLVSVQAGIEVVLIDQTQEAADKGKAYSASFFDKGIARKKSTEEKKAAALDLITATTDLDALKGCDLIIEAVFEDPAVKAEMTKKVEAVIPEDCIFASNTSTLPITELAKASSRADQFIGIHFFSPVEKMALVEIIKGAETGDRAVAKSLDYVRQIRKTPIVVNDARFFYANRCIIPYANEGARMITEGAAPQLVDHAAQLLGFPVGPVQLTDETSIDLGAKIARATKAAMGNAYPASQADDLIFWMEDLGRLGRKANAGFFDYDEKGKRQGYWKGMHDKFPLAEEQPDLRDVQDRLMFVQVLEAVRALEEGVLEDIREGDVGAILGWGFAPWSGGPFSWLDIIGTPYAAERCDQLEAQFGERFKCPDLLREMAEKNQTFYGRFGPDAKAA

SEQ ID NO: 89201 - protein, 55 aa, Schizosaccharomyces pombe
KLGASVAEGLRVIYGGSVNGGNCKEFLKFHDIDGFLVGGASLKPEFHNIVNVHSL

SEQ ID NO: 89202 - protein, 159 aa, Brassica napus
  misc_feature (47)..(47): Xaa can be any naturally occurring amino acid
  misc_feature (78)..(78): Xaa can be any naturally occurring amino acid
MMVDDGGKYKEDKKMNLEESGETWNNMVLKKLLRPARYFDPPDEADXMTDSSCDSSWEQEDANPHRKRCFICASFEHXGEQCSMGHDSCPNDGSVCLRCGDMGHDMSLCKSEYSEDDLKDVRCYACKSFGHMCCGEALSSSSWAVSCYKCGKLGHVGLG

SEQ ID NO: 89203 - protein, 433 aa, Nostoc punctiforme PCC 73102
MSIHEVFMPALSSTMTEGKIVSWVKSPGDKVEKGETVVVVESDKADMDVETFYEGFLAHIIVEAGETAPVGSAIAFIAETEAEIEQAKSLANSGGVAATTTSAPEPIPATASVVTPALASQNGSNHKEGRLVASPRARKLAKELKVDLTTLQGSGPYGRIVAEDVEALSNKGKQPATAPVAPPATVPTSAPIASPAPRTPAPAPVVAAVPGQIVPLTTFQNAVVRNMVATISVPVFRVGYTITTDGLDKLYKQIKSKGVTMTALLAKAVAVTLQKHPLLNASYSDQGIVYHSDINISVAVAMDDGGLITPVLQNADAVDIYSLSRTWKSLVERARAKQLQPQEYNSGTFTLSNLGMFGVDKFDAILPPGQGSILAIGASRPQVVATPDGLFGVRQQMQVNITSDHRIIYGAHAAAFLQDLAKLIETNPQSLTL

SEQ ID NO: 89204 - protein, 228 aa, Salinibacter ruber
HLGRATARTLPVPLMNILNGGEHADNNVDMQEFMIAPAGADSFSEALRTGAEVFHTLASVLQDRDYSTAVGDEGGFAPDLGSNEEAVELILDAIEKAGYTAGSDVFVALDPAAAEMVEDEAYVFWKSDPDTERSSEDMVEYWAEWVDRYPILSIEDAMDEDDWDGWAMLTDAIGDEVQLVGDDLFVTNTKRLTRGVEEGCGNSILIKPNQIGTLTETLNAIETAHTHG

SEQ ID NO: 89205 - protein, 287 aa, Chlamydomonas reinhardtii
YTYTTMISQCGSHQQLRRALELVAEMRSRGIDCNVHTYSALMNVCIKANELDLAQDVYKQMLEEGCSPNLVTYNILIDVEASKRKTTERRRLAVALVRSGIQAEVRTYNTVISACNKSGQPEQALKVYEKMLAAGVKPSATTYTALISAYGKKGQVEKALDIFRDMIRRGCERNVITYSSLISACEKAGRWEMALELFSKMHKENCKPNVVTYNSLIAACSHGGHWEKASELFEQMQTQGCKPDSITYCGLITAYERGGQWRRALKAFEQMQSQGCHPDAAVFNSLM

SEQ ID NO: 89206 - protein, 228 aa, Salinibacter ruber
HLGRATARTLPVPLMNILNGGEHADNNVDMQEFMIAPAGADSFSEALRTGAEVFHTLESVLQDRDYSTAVGDEGGFAPDLGSNEEAVELILDAIEKAGYTAGSDVFVALDPAAAEMVEDEAYVFWKSDPDTERSSEDMVEYWAEWVDRYPILSIEDAMDEDDWDGWAMLTDAIGDEVQLVGDDLFVTNTKRLTRGVEEGCGNSILIKPNQIGTLTETLNAIETAHTHG

SEQ ID NO: 89207 - protein, 228 aa, Triticum aestivum
MGEEANCDAVMEDGNGNDNGKAKENGHATAVVAMPDVKAKAEDAVVAPGDPRLQGISDAIRVVPHFPKLCIMFNDITTLLLRPGVFKDALDMFVERYRGMGIAAVAGIEARGFIFGPAIALAIGAKFIPLRKPKKLPGEVISETYVLEYGTDCLEMHVGAIEPRERVLIVDDLVATGGTLCAAINLLERAGADVVECACLIGLPKFKDFYKLNGKPVYVLVESLEYEK

SEQ ID NO: 89208 - protein, 189 aa, Gossypium schwendimanii
HVGLNGNGKPFVACHDCNFPICKTCFDYELKEGRKACLRCGNPYDENRLDDAEKASGDRSTIAAHMDKSQDAGIHARHISSVSTLDSEMTEDNGNPIWKNRVESWKEKKNKKKKTSIKVEIEAQVPPEQLMEDKPATDAFQPLSTVIPIPKSRLAPYRAVIIMRLIILGLFFHYRVTNPVGSAFALWLT

SEQ ID NO: 89209 - protein, 218 aa, Physcomitrella patens subsp. patens
MASNGVAAVPSKKGSTAVHKATPLNSRIMTTMERRTVAAHPWHDLEIGPAAPEIFNCVVEINRGSKVKYELDKKSGLMKVDRILYSSVVYPHNYGFIPRTLCEDEDPIDVLVIMQEPVMPGSFVRARAIGLMPMIDQGEKDDKIIAVCADDPEYRHFKDINELPPHRLAEIRRFFEDYKKNENKEVTVDNFLGHEAAIQAISHSMDLYASYIVESLRH

SEQ ID NO: 89210 - protein, 492 aa, Corynebacterium glutamicum ATCC 13032
MPSSTINNMTNGDNLAQIGVVGLAVMGSNLARNFARNGNTVAVYNRSTDKTDKLIADHGSEGNFIPSATVEEFVASLEKPRRAIIMVQAGNATDAVINQLADAMDEGDIIIDGGNALYTDTIRREKEISARGLHFVGAGISGGEEGALNGPSIMPGGPAKSYESLGPLLESIAANVDGTPCVTHIGPDGAGHFVKMVHNGIEYADMQVIGEAYHLLRYAAGMQPAEIAEVFKEWNAGDLDSYLIEITAEVLSQVDAETGKPLIDVIVDAAGQKGTGRWTVKAALDLGIATTGIGEAVFARALSGATSQRAAAQGNLPAGVLTDLEALGVDKAQFVEDVRRALYASKLVAYAQGFDEIKAGSDENNWDVDPRDLATIWRGGCIIRAKFLNRIVEAYDANAELESLLLDPYFKSELGDLIDSWRRVIVTATQLGLPIPVFASSLSYYDSLRAERLPAALIQGQRDFFGAHTYKRIDKDGSFHTEWSGDRSEVEA

SEQ ID NO: 89211 - protein, 189 aa, Gossypium trilobum
HVGLNGNGKPFVACHDCNFPICKTCFGYELKEGRKACLRCGNPYDENLLDDAEKASGDRSTIAAHMDKSQDAGIHARHISSVSTLDSEMTEDNGNPIWKNRVESWKEKKSKKKKTSIKVEIEAQVPPEQLMEDKPAADAFQPLSTVIPIPKSRLAPYRTVIIMRLIILGLFFHYRVTNPVDSAFALWLT

SEQ ID NO: 89212 - protein, 189 aa, Gossypium turneri
HVGLNGNGKPFVACHDCNFPICKTCFDYELKEGRKACLRCGNPYDENLLDDAVKASGDRSTIAAHMDKSQDAGIHARHISSVSTLDSEMTEDNGNPIWKNRVESWKEKKNKKKKTSIKVEIEAQVPPEQLMEDKPAADAFQPLSTVIPIPKSRLAPYRTVIIMRLIILGLFFHYRVTNPVDSAFALWLT

SEQ ID NO: 89213 - protein, 239 aa, Colwellia psychrerythraea 34H
MINVKDNLNKVKAQIQQACQQSGRLTPLAELSKQSSPVSLLAVSKTKPTSLVEQAYLAGQHDFGENYLQEAVEKIAELANLPEIVWHFIGPIQSNKTKQIASNFSWVHSVDREKIALRLNQHLTDDNCHDTPLNICLQVNISNEESKSGISIEQVFSLAKIVDSCDKLTLRGLMAVPEKNAPKACYEQMQQLFTQLKKQYPSVDTLSLGMSNDLDNAVAHGSTMVRIGTAIFGARENKI

SEQ ID NO: 89214 - protein, 494 aa, Silicibacter sp. TM1040
MSVDALISTYFANGRLSDLPRDHFIDGRLVPAETGNRMESFDPGRATAFGDFAAGTAVDVDRAVSSAVAGFAIWRDTAPATRCAVLMEAARLMRAEADWLAVIESLDSGKTLAEAYGDVQGSARLFEYYAGAADKLDGRSVNLGNDNAAFTLREPVGVTAHIVPWNYPTSTLVRGIAPALAAGCSAVVKPAETTPYTALMIAELLIRAGLPAGVVNVVTGTGPEAGAPLVRDPRVRHVTFTGSVQTGVGVMQAVAPNVTGLTLELGGKSPLVAFADADAEKVAEGALWAIFSNAGQICSAGSRLVVHRDLHAQVLERLVKKATTLRFGHGLHNPDMGALNSERHQAAISGHVERARARGVEILCGGQATTDPATGKGWFFEPTILDALSADDPAIQQEIFGPVLGVQVFDDEDEALALANGTEFALAAGVYTKDTSTALRMARRIDAGQVTVNDYWAGGIELPFGGNRKSGFGREKGLEGVDAYTRAKAITLAV

SEQ ID NO: 89215 - protein, 458 aa, Lactobacillus sakei subsp. sakei 23K
MDKKQREDSQKHEKFIHYADGSSLEEINNTVAIPKNAGFWKTLMAFMGPGALVAVGYMDPGNWITSIAGGAQFAYTLISVILVSNLIAMLLQAMAARLGIVTGMDLAQMTRAKTGKKMGIFLWIVTELAIMATDIAEIIGSAIALELIFNIPLLWGVLITAFDVLLLLLLMKLGFRKIEAIVATLVAVILFVFLYEVILAQPNMGDVVRGFVPSPRIMTDKKMLFLALGIVGATVMPHNLYLHSSIAQARQYDRDDVAEKRKAIKFTVIDSNIQLTIAFVVNCLLLILGAAMFYGTNSDLGRFVDLFNALQNKEIVGSIASPMLSLLFAVALLASGQNSTITGTLSGQIVMEGFVRMKIPLWARRVITRGLSILPVIIFTVYYHGNEAQVENLLIYSQVFLSIALPVSMIPLTLFTSDEKIMGPFVNRPWVKYTAWFVTIVLTLLNIYLILQTVGLAA

SEQ ID NO: 89216 - protein, 257 aa, Bradyrhizobium sp. BTAi1
MTPNPFNLAGQVAVITGSSRGIGRASAELLAQLGAKVVISSRKAEACEEVANGIRAHGGEAHVIPCNISRRAEVDALIDGAVKQYGQVDILVCNAAVNPYYGPLLDISDEAFDKIMTSNVKSNLWLCAKAIPPMAARGKGSVIIVSSIGGLRGSTVIGAYGISKAADFALCRSLAGEWGPQGVRINCVAPGLIKTDFARALWEDEARLKQRCATTPLRRIGEPHEIAGAVAYLASDASTFMTGQTIVVDGGVTTAAV

SEQ ID NO: 89217 - protein, 315 aa, Gaeumannomyces graminis var. tritici
MTSKDDIRIMGMPPFMIDFLMGGVSAAVSKTAAAPIERIKLLVQNQEEMLKAGRLDRRYDGIMDCFRRTTADEGVMALWRGNTANVIRYFPTQALNFAFRDKFKKMFGYRKEKDGYAKWMAGNLASGGAAGATSLLFVYSLDYARTRLANDNKSAKGGGARQFNGLVDVYRKTLASDGIAGLYRGFGPSVAGIVVYRGLYFGMYDSIKPVVLTGNLETNFLASFALGWCVTTGAGIASYPLDTVRRRMMMTSGEAVKYSSSLDAFRQIVAKEGVKSLFKGAGANILRGVAGAGVLSIYDQLQLIIFGKAFKGGSG

SEQ ID NO: 89218 - protein, 459 aa, Xanthomonas campestris pv. campestris str. 8004
MATETRVASLPSIDAAALAAIEGCALVDLLLPDTNGVLRGKRVTREALDKVYRDGVCLPMSLIATDITGNTVEETGLGYAIGDADRICRPIAGSLRPVPWAPQPMAQLLLAMHTPNGALFEVAPRAVLQRVVQGFAALGLTPVIAVELEFYLFDAMADAQGRPQTPRDAHTGERNTSTQVYALQDLDDHRSFTDAVTAACRQQGIPADTAVAEYAPGQFEINLQHRADAVAACDEALLLKRTIKAIAQQQHLLASFMAKPFAGQAGSGLHVHVSLLDAAGHNVLHGTADAPAAALRHAIAGLQRHADASLLLFAPHANSYRRFVPNAFVPLDASWGFNNRTVALRIPHSDAHNTRIEHRIAGADANPYLVAAAVLAAMLDGLQHPGDPTAPVQGNAYAQATFTPRTWQGAVDAFLRSDFIATQLGTQFQHVFGQQKQLELLDYQALVPDLDYARYLRTV

SEQ ID NO: 89219 - protein, 367 aa, Glycine max
MATSENNSSARPQREAKKRAAAAISQIHGNAAKKKRVVLGDVTNVSSSDVAVSVSKKPVQTHKNVKLEKPAAPVATPEKVEERHDPQLCGPYVSDIYEYLRGMEVDPSKRPLMDYVQKIQRDVNANMRGVLVDWLVEVAEEYKLVSDTLYFSVAYIDRFLSLNILSRQRLQLLGVASMLIASKYEEIKPPEVEDFCYITDNTYSKEEVVNMEAEILKALKFELGGPTVKTFLRRFSRVGQEGVDTSDLQFEFLSCYLAELSLLDYNCIKFLPSLVAASVVFLARFMFSTKTHPWNSALHQLTRYKPADLKECVLNLHDLYLSRRGASLQAVREKYKQHKFKCVATTPSPPEIPLSFFEFEGQILRQL

SEQ ID NO: 89220 - protein, 386 aa, Lactobacillus sakei subsp. sakei 23K
MSTLAIILISTLLAGHLSKRIGMPAVIGQLLVGIILGPALLGVLHENSFIHTFSEIGVVLLMFTAGLESNLTLLKKYFKPSVVVAILGVIVPVGSIYAMSLAFGINQLESLFIGVIFAATSVSISVEVLRELKVLESREGTIILGAAVVDDLLAVIILSVLTSLFGAQLATAAPNQMGLGLTFALQIAFFVVVYFSVKWLVPGVMRLSQRLLVPYANAIMSLVICFVFVWLAEAVDLSTVVGAFFAGIAISQTPYQSEISRHIEPLGYTVFIPVFFVSIGLSMTFADLNRHLVFIIVLTVLAVLAKLLGSGWGAKMMGVPQAGAYTIGAAMISRGEMALIIAQIGYTAKLLSEMYYSAIIFVIILTTILAPFILKSAIKKQLAATK

SEQ ID NO: 89221 - protein, 307 aa, Triticum aestivum
  misc_feature (284)..(284): Xaa can be any naturally occurring amino acid
  misc_feature (289)..(289): Xaa can be any naturally occurring amino acid
MKAYPGDIIEQVCTKKQAGTGPEFPGARRPSRPHKENCTHTHTHTHTHTHTHTARWSEGEREICSEIEELGAIMAWRESYLDLVLIPVGLLFPIVYHMWLWRAVRSCPLRSTIGINAAARRLWVLSMMKDNEKKAVLVVQSLRNVIMGSTLVATTSVLFCTGVAAVLSSTYAVKKPISDAVFGAHGEYMMALKYVALLTAFLLSFLCHTLAICTFNQATFLVNALSHLFALPDGGRHLPVNKEYVLEVLDRGFLLNFVGNRLFFGGVPLLLWIFGPVLACLCSXVMIPXLYNIDMVYIEERKGWRGQ

SEQ ID NO: 89222 - protein, 697 aa, Bradyrhizobium sp. BTAi1
MSEVAKLDRHDIVGIVTIDSPPVNALSAAVRGGILDNVKAAIADPEIKVIVLTCGGRTFIAGADITEFGKPPKPPALNDVLSTIENSPKPVIAAIHGTALGGGLEVALACHYRVATKDAKLGLPEVKLGLLPGAGGTQRLPRAVGPELAVKMIVGGDPIGAAEAHKAGLIEEIVEGPASGAEAFARKVVAENRPLRKLRDDDSKLAAAKADRSIFTNAVAAITKKSRGLEAPFAAADAVGYAIDLPFDEGLKREREGFLKLLTSDQSKAQRYAFFAEREAAKIAGVPEGTKGRKVDRVAIIGAGTMGGGIAMSFANAGIPVTLIETAEEQLKRGMGVMQKNWEATAARGGIPADAPAKRMALIDGKVGLEHVKDADLVIEAVFETMAVKKEVFGKLDQYAKPGAVLASNTSYLNIDAIAAETSRPQDVLGMHFFSPANVMKLCEIVRAEKTAPDALVTAVSIARKIAKVPAVVGVCDGFVGNRMLAQRGKQAEKLLFEGALPQQVDAVVTKFGMPMGPFAMGDLAGLDIGWRSRKDRGIKSEIADALCEAGRFGQKTGKGYYKYEAGSRAPLPDPDVEKLIDETLAKLGLKRRAVSDEEILERMMYPMINEGAKILAEGIAARPSDIDVVWLYGYGWPIYRGGPMYWADSVGLKHIAERLAFYAKETNDPSLEPAPLLKKLADEGKTFASLAQGKAA

SEQ ID NO: 89223 - protein, 752 aa, Glycine max
MSTQKKRPYHIEAFKHRAVGDPKYAEKTWKVLEHAIHEIYNHNASGLSFEELYRNAYNMVLQKFGYRAPPRVSYVGPPPPHKFGEKLYTGLVTTMTSHLKEISQSIESAQGEIFLEELNRKWVDHNKALQMIRDILMYMDRTFIPSNHKTPVHELGLNLWRDVVIHSSKTKARLLDTLLELVLRERNGEVINRGLMRNIIKMLMDLGLPVYQQDFEKHFLDVSANFYCRESQKFIESCDCGDYLKKAERRLNEEMERVSHYLDPRSESKITNVVEKEMIESHMHTLVHMENSGLVSMLVDDKYEDLQRMHNLFRRVPDGLTIVKDVMTSFVRDTGKQLVMDPERLRDPVDFVQRLLDLKDKYDRVITMSFNNDKTFQNALNSSFEYFINLNARSPEFISLFVDDKLRRGLKGVGEEDVEILLDKVMMLFRYLQEKDVFEKYYKQHLAKRLLSGKTISDDAERSLIVKLKTECGYQFTSKLEGMFTDMKTSHDTMQGFYAILGTEMGDSPSLSVQVLTTGSWPTQPSPPCNLPAEILGVCDKFRTYYLGTHNGRRLSWQTNMGTADLKATFGKGQKHELNVSTYQMCVLMLFNSAERLTCKEIEQATAIPMSDLRRCLQSLACVKGKNVLRKEPMSKDIAEDDAFFFNDKFTSKFFKVKIGTVVAQRESEPENLETRQRVEEDRKPQIEAAIVRIMKSRRTLDHNNIVAEVTKQLQSRFLPNPVVIKKRIESLIEREFLERDKVDRKLYRYLA

SEQ ID NO: 89224 - protein, 471 aa, Pseudomonas aeruginosa UCBPP-PA14
MSSVGEQKVQDGSLKRELGERHIRLMALGACIGVGLFLGSAKAIQMAGPAIMISYILGGLAILVIMRALGEMAVHNPVAGSFSQYAKDYLGPLAGFITGWNYWFLWLVTCVAEITAVAVYMGIWFPDVPRWIWALAALASMGTINLIAVRAFGEFEFWFALIKIVTILAMVVVGIGMIAFGFGNDGIATGISNLWAHGGFMPNGIQGVLMSLQMVMFAYLGVEMIGLTAGEARNPTKTIPSAINSVFWRILLFYVGSLFVIMSLYPWNEIGTQGSPFVMTFERMGIKTAAGIINFVVITAALSSCNGGIFSTGRMLYSLAQHRQAPAFFGKASRSGVPRRALILSILALLLGVLLNYLVPEKVFVWVTSIATFGAIWTWAMILLAQLRFRKTLSPAECDKLQYRMWLYPLSSYLALAFLVMVVVLMAFFEDTRIALYIGPPFILLLTVLYYAFNLAPKEPAGTGSVSRAAS

SEQ ID NO: 89225 - protein, 480 aa, Zea mays
MAVSHNVGSKHGVAPLEVSVEAGNGGAAEWLDDDGRPRRTGTFWTASAHIVTAVIGSGVLSLAWAIAQLGWVAGPAAMLLFAFVTYYTATLLAECYRTGDPDTGKRNYTYMDAVRSNLGGAKVAFCGAIQYANLVGVAIGYTIASSISMQAVSRAGCFHKRGHAVPCKSSSNPYMILFGAVQILFSQIPDFDQIWWLSIVAAVMSFTYSAIGLSLGIAQTVANGGFKGSLTGISIGADVTSTQKVWHSLQAFGDIAFAYSFSNILIEIQDTIKAPPPSESKVMQKATRLSVATTTIFYMLCGCMGYAAFGDKAPDNLLTGFGFFEPFWLIDVANVAIVVHLVGAYQVFCQPIFAFVERRAAAAWPDSAFVSQELRVGPFAVSVFRLTWRSSFVCVTTVVAMLLPFFGNVVGFLGAVSFWPLTVYFPVEMYIKQRRVPRGSTKWICLQTLSVACLLVSVAAAAGSIADVIEALKVYHPFSS

SEQ ID NO: 89226 - protein, 303 aa, Arabidopsis thaliana
MDAFEKLEKVGEGTYGKVYRAREKATGKIVALKKTRLHEDEEGVPSTTLREISILRMLARDPHVVRLMDVKQGLSKEGKTVLYLVFEYMDTDVKKFIRSFRSTGKNIPTQTIKSLMYQLCKGMAFCHGHGILHRDLKPHNLLMDPKTMRLKIADLGLARAFTLPMKKYTHEILTLWYRAPEVLLGATHYSTAVDMWSVGCIFAELVTNQAIFQGDSELQQLLHIFKLFGTPNEEMWPGVSTLKNWHEYPQWKPSTLSSAVPNLDEAGVDLLSKMLQYEPAKRISAKMAMEHPYFDDLPEKSSL

SEQ ID NO: 89227 - protein, 236 aa, Triticum aestivum
MDSTADLKGKRPLLQPDDVSAAAAAAAVPDEAEAKPSSSSEEVKEAEPGTEKQEEKPALVLVAEDGVEVCISEPAARMSQMLSHMMEDGCADGRIPTANIHSDILEMVVEYCEKHGPFYDPEASERDRYPFPPFPVELTPTVSSIKPVTYVDPDPHGLKDWDSDFISLDNSTLFEIILAANYLNIEDLLDLGTSAVADKMRGKKPEEIREIFEIENDYTPEQEAEVRKENAWAFEN

SEQ ID NO: 89228 - protein, 509 aa, Vibrio vulnificus YJ016
MSLTQQTGADYLRQILRAPVYEVATVTPLQEMPRLSARIGNNVQIKREDRQPVHSFKLRGAYNMVANLSQAQKDAGVIAASAGNHAQGMALSGTRLGIETTIVMPRTTPDIKVDAVRGFGGKVVLHGSNFDEAKAEAERLSQEKGYTFVPPFDHPLVIAGQGTIGMEMLQQNGHLDHIFVPVGGGGLAAGVAVLVKQLMPEIKVIAVEPEDSACLKAALDAGEPVVLDQVSMFADGVAVKRIGDETFRLCQHYIDDHVTVSSDEICAAVKDIFEDTRAIAEPSGALALAGLKKYAEKHKLKGHNLGTVLSGANTNFHGLRYVSERCELGEKREGLLAVTIPERKGAFFEFCHLIGGRAVTEFNYRYNDDSLANIFVGVRLQNGQEELDGIIRDLREGGYPVVDLSEDEMAKLHVRYMIGGKPSKPLKERLYSFEFPEYPGALLKFLSTLGTHWNISLFNYRNHGADYGRVLCGFELDESDLSRFSAHLRELGYQCKDVTDNPSYRFFLS

SEQ ID NO: 89229 - protein, 141 aa, Oceanobacter sp. RED65
MAVERTLSIVKPDAVGKNVIGEIYSRFEKAGLQIVAAKMIKMDEEMAGGFYAEHKERPFFKDLVGFMTSGPVMVQVLEGEGAVLKNRELMGATNPQEADAGTIRADFAESIDANAVHGSDSTESAAREVSYFFNEEEICPR

SEQ ID NO: 89230 - protein, 308 aa, Pasteurella multocida subsp. multocida str. Pm70
MGKIWVLGDAVVDLIPEGENTYLRCAGGAPANVAVGIARLGATTGFIGRVGDDPLGRFMLNKLQQENVCTQYMHLDPKQRTSTVIVDLKEGERSFTFMVNPSADQFLELSDLPHFNPNDWLHCCSIALINEPSRSSTFAAIHRIKAEGGFFSFDPNLRESLWNSPAEMKTVVNQVVALADVLKFSEEELLFLTDSDTLSDATAKLTQHYPDKLIIVTLGKLGATYYLQGKSQLVSSKKALIPVDTTGAGDAFVSGLLFGISQVKNWQNPTALVEIIKQANACGALATTAKGAMSALPNKQQLDAFLAE

SEQ ID NO: 89231 - protein, 328 aa, Dehalococcoides sp. BAV1
MSIEPEIRETLGKINVAASGRTLANLNLLRDIEIQPDKIKISVASAGLSASSQQILRQDISLCLKPLLNKQTLEIEYISVPLNELNHVKKVVAVMSGKGGVGKSLITGLCAVALNRQGYRVGILDADITGSSIPKMFGANQHLAGNEEAILPAQSRAGISLVSTNLLLTNQDDAVIWRGPLISKMINQFWDDVLWGELDYMVVDLPPGTSDASLTVLQSLPISGILVVFTPQGLVEMVARKAVSMAEKMGKPIIGLVENMAYLKVPELDKKIEVFGTGHGEELAKSIGVPFIGQMPLDPALAALCDSGDIEKYQHPLLDELEGAISRS

SEQ ID NO: 89232 - protein, 392 aa, Fusobacterium nucleatum subsp. nucleatum ATCC 25586
MAKRDYYEVLGIDKSASENDIKKAYRKAAMKYHPDKFANASDAEKKDAEEKFKEINEAYQILSDSQKKQQYDQFGHAAFEQGGAGFGGGFNAGGFDFGDIFGDIFGGGGFGGFEGFSGFGGSSRRSYVEPGNDLRYNLEITLEEAAKGVEKTIKYKRTGKCENCHGTGGEDDKMKTCPTCNGQGTIRTQQRTILGVMQSQSVCPDCHGTGKVPEKKCKHCHGTGTAKETVEKKVNVPAGIDDGQKLKYAGLGEASQNGGPNGDLYVVIRIKSHDIFVRDGENLYCEVPISYSTAVLGGEVEIPTLNGKKMIKVPEGTESGKLLKVKGEGIKSLRGYGQGDIIVKITIETPKKLTDKQKELLQKFEESLNEKNYEQKSSFMKKVKKFFKDIID

SEQ ID NO: 89233 - protein, 237 aa, Brassica napus
  misc_feature (236)..(236): Xaa can be any naturally occurring amino acid
MDEEASSWIRRTKFSHTVSYRLNSSKLASFPLKVNQENVSQLKTRPQKLVSSSSPNVCVVVETEVQTNPVTNKQRSVSPSPQMALPDVFKEARSERKRFSTPHPRRMDSEKGMKVKLSHKDSFEKRRSFNLRSPSVPIRDLSTLRIQERVSKSKKDTGWSKLFDNGSGRRVSAAEASEEYRIDMSKLFFGLRFAHGLYSRLYHGKYEDKAVAVKLITVPDDDENGCLGARLEKQFXK

SEQ ID NO: 89234 - protein, 480 aa, Candidatus Pelagibacter ubique HTCC1002
MYEKFGQFIDGSWSPSSNKETYEVINPATEEVLGHASKATPEDVDRALKSAEKGLAVWKKITPWERSYILRRIADKLREKKDVLAKWMTLENGKPLAEGVGETNGAADIFEWNAEETKRIFGQTIESRFEDTRVHVYYQPVGVVAALSPWNFPLILAARKISTALAAGCSVIIKPDTITPGVVMELVDICRECGVPPGAVNLLSGDPPAIASQLIQSDIIKKISITGSLRVGKLILKQAADKVQRATMELSGHSPFIVFDDADVKKAADMAIAAKFRNNGQVCISPNRFYIHENKKEEFINLFIEKTKKLKIGNGMDPDTQLGPLTTQKRLNETEELVEKTKQEGAKVLLGGKRPAGFNKGFYYEPTIFDDVKDDFTIMKQEPFGPLVPMLSFKSFDEVIERANDNDLGLCSYVCTNSMETAHLASEKLETGSVAVNTGVVAIAEAPFGGIKQSGYGREGGSMAIKDYLNVKYTHMGIKG

SEQ ID NO: 89235 - protein, 304 aa, Salmonella enterica subsp. enterica serovar Paratyphi A str.
MTASLHIILDTDPGIDDAAAIAAALFAPQLDLQLITTVAGNVSVEKTTRNALQLLHFWNSDIPLAQGAATPLLRPLRDAAYVHGESGMEGYDFVDHQRQPLAKPAFISIRDVLMNAPEPMTLVAIGPLTNIALLLMHYPECACNIRRLVLMGGSAGRGNFTPNAEFNIAVDPEAAAHVFRSGIEIVMCGLDVTNQAMLSPDFLNKLPALNRTGKMLHSLFNHYRSGSMRTGVRMHDLCAIAWLVRPELFTLQSCFVAVETQGEYTAGTTVVDIEGRLGQPANAQMALDVDGFRQWVAEVFAYAP

SEQ ID NO: 89236 - protein, 279 aa, Gibberella zeae PH-1
MIFPILQQTSHDQLASGVAFLNDETMRLFLIRHGETVDNVANLYAGSRDSALTAHGVMQAQKLASHLAEHVTIGRIFSSNLSRAVHTAQAILDAQKCAKDLKLVQAPELREKDFGTGEGAKFGSATKHEGSETPQAMRKRIDVFLDEHLPRLHEDSTVCIVAHGIILGTLYKALRDRIPSTSTAPDAAPEGRAESAFARPTWSNTGYVEALITTNASTTDKNVQMRVVKVNSVEHLKGLRKTRGGIGSAKFDAKQKTMDSFFQSVSRKRKIEDEDIVSR

SEQ ID NO: 89237 - protein, 370 aa, Arabidopsis thaliana
MRSEITRETKLLFDLPQDVIEEIFSKVPVTCLRRIRSTCKRLYALLKDRGFIRKHFAKSARQYHALMLKNFRFYSVSFNPNGTEMDVASLFNGERSLIDPYSSSEAIISQAFHCDGLLLCTTKENRLVVLNPFSGQTKWLQPQNRCKIDEAYVLGYDNSDFSNSWRRNLGVTPHGGLGLKIYDFSSNSWKKLDVITPEGCLKSYGVSLKGNAYWVYMSKRRGVNDYSLLSFDFSTESFQHLCVPFHQEADCFGTMALSVVREEHLSLLYQSCETLKVEIWMTKEIDTTFVSWKKFLTVDLEPHLPHLLMFSCRMSFFIDEEKKVAVCCDRDNKVHVVGEDEYRVSSGFYFLDFEGITCCLTVFGYVPRLV

SEQ ID NO: 89238 - protein, 1391 aa, Gibberella zeae PH-1
MSETKDLSSQVQDTTKDTASNEQQSSGAFGSPQRSLPLIVPIAVNYDQSVPRSGVVNDAGDILDDAGKTVGKVADTDNLKNLVGNTVNSAGDVVDSSGDVLGKTLPIGQGKPEEEEDSHDEEKSEYTTQSKDKKSGGLGDAVGSVTSAVGGVTGAVGDTAKSATDTVGETTKGATDAVGDTAKGATDTVGDVTDDVAAKSEATSHATDTKTPAETPKAPGVKDEASDVKDNAPDVKENAPEVKDETIDQTDKINLEDREAPADADDKLKEVAPEPEEAKETTKDVSDEANDIPEKAKDASEEAKDASEEAKEDVTSKVDEQEQDVPKPEEVEEKLQEKTEGAKDEATKSEVPEGDVAKTDAPVDEVPSDEVADDDKSKTASDDLKSVAPGEDAAGVTDEVQSKAAQGEDAAQDKVSEADKAAEDVPEDVKSKTAEAEKAAEDLPEDAQSKTADGEKAVEDLPEDAKDKVEDGEKAAEELPEDAQSKAPEAEQVAGDVADEAKDKAAETEEAVDEKTAEAEEAAKEPLDFSVLKGTTVDKEGNLVNDKGDKIGKIVEGELKQLVGLNCDDQGQIWDKTGKQLGKAEPIPEWDREQKDSSILKGTTVDKEGNLVNDKGHLIGRVIEGEIKQLIGLSSDDQGIIWDRTGKQVGKAEPLPEWERGEQKDYSILKGKTVDKNGNLVDEKGHLFGKVVEGEIKQLIGLSSDDQGTIWDKTGKSVGKAEPLPEWERGEQKDFSILKGAIVDKEGGLTNDKGDTIGKVTEGEIKQLVGLKSDENGKIWRDGKVVGQAEPLPEWERVQKKDRSVLKGSKVNKVGKLVDSNGNIVGKVVEGDLKELLGKRSDENGDIWNDSGEVIGKGEPVSASEREQKSSAPFENFPDAVVESDGRVMYNGEQVGEVIEGNPKELKGSKVDEDGDILDRRGNTVGKAKRWEAPEAEEEKPVDNSALAGKRVNKAGNLVSESGEIYGRVIEGDVQKLVGRMSDRDGNIRSESGDIIGKAELVSEGERGGKKDGPFAELKNCTVAKDGKVVNQAGETVGRLVIGDAKALVGRSVDDDGEIVDSNGNVIGKAERWEEPEKEKSHNPLAGRKVNREGNVVDADGNIIGKLTSGEILDCQGKEVDEDGDVFNQKGSVVGHVSLLEDIPKEEPEEEPTPEPEGETEEERIKREQAEADIKAEKDEAEKNKKLAQQLSYQIEQTLERLRPICKSINDKISAAEAQKPEDRDEEELVRQVKPLIEDGGKLLTETNGIIRGLDPDGRIARNAKQKTSSGEATPEEAHLANLLKELSTEIQTCIDEGKRKLEGMPHAKKEINPLWGLLAEPLFQIVAAVGLLLSGVLGLVGKLLGPILGPLLNGLGLGGLLDGLLGGLGLKKILGSLGLGDVVGTVTGKK

SEQ ID NO: 89239 - protein, 192 aa, Alkalilimnicola ehrlichei MLHE-1
MLLMIDNYDSFTWNLVQYLGELGAEVAVYRNDEIDVAAIRRLAPERIVLSPGPCTPNEAGVSLAVVRELAGTVPILGVCLGHQAIGQAFGGEVVRARQVMHGKTSPIHHNGRGVFRGLDNPLEATRYHSLVVRRETLPECFEITAWTALADGRLDEIMGMRHRELPVEGVQFHPESILTRQGHELLKNFLEG

SEQ ID NO: 89240 - protein, 543 aa, Arabidopsis thaliana
MDFLDNEMLDIEIHDIGSLHHLLHVDCCFRFAFFKLIGLEDKLKLASSLSIFRSIEFIPGEGDDSVLIENDEDDVTGPSRLWNKTILHDIMTSCIIMHNMIIEDERDIDAPIEERVEVPIEEVEMTVLWLEMPLEEILSRLPLKSTRAVRSTCKKWDSLFKNRSFISKAAAAREGESQMVVLMDHNLHLVSFFFGSDTSVEIKGKRICLNDDSDSEQVKISQVFHCEGLLLCILKDDNFSLVVWNPYWGQTRWIKPRCSFEIPQGCDMYRYAIGYDNKRRNHKILRFIDYEFHYPRDNVVLWYEIYDFESDLWTTLDVTTPHWLINCGNRGVTLKGNTYWCAKKRNSDLFLNADHIICFDFTSERFGPLLLLPFSDLDGVVTLACVREEKLAALVCHEDVVEVWITIKIEANEVLWSKFLTVNVDLGDEIPSSLTYGSFFIDEEKKVAMIFDKTLDRGDTVHIMGEAGYGGQVDLGEPVNKRRCPLVCSYVPSLVQIKKPAGFQRKQQSKLEKRQYVRNISKLRALKTQSSWTLSMSLECHQQ

SEQ ID NO: 89241 - protein, 576 aa, Candidatus Pelagibacter ubique HTCC1002
MAIKKKMAGKKKKTAKKSKPKVKKKSKIIKKVKKSVTKKKLHKPIKKNKLKNNNKRERIKMSTETVKGGRSPLLDTSHLNVKFPFKEKYGNFIGGKFVEPKSGKYFDNVSPINNEVICSVPRSDAKDVEAALDAAHAAFPTWGVTSITERSNILLKIADVIEKNLELLATAECLDNGKPIRECMAADLPLVVDHWRYFAGVIRAEEGSVSEISNSEYSYHIPEPLGVVGQIIPWNFPLLMATWKLAPALAAGNCVVLKPAEQTPASILLLMELIGDLLPPGVVNVVSGFGLEAGKPLASSKRIRKIAFTGETTTGRLIMQYASQNLIPITLELGGKSPNVFFEDVMDQDDDFFDKCLEGFAMFTLNQGEVCTCPSRVLIQESIYDKFMERAVARTKAVKQDNPLKMETMIGAQVSLEQMEKIKSYLDLGKKEGAKVLCGGEVANLNSGLEKGNYIQPTIFEGNNSMRVFQEEIFGPVVSVTKFKDEAHALEIANDTLYGLGAGVWTRNGNIAYRMGRGIQAGRVWTNCYHAYPAHAAFGGYKQSGIGRETHKMMLNHYRQVKNLHVSYSEKKLGFF

SEQ ID NO: 89242 - protein, 272 aa, Zea mays
MGKSSKKAAAVAAAPAAVPKGKKREAEEEIEKAVSAKKQKAAPPAKAVPTSKKDAKKSKKQPPPKKAESSSSDSEEDSESEEEVKKVQPKKAPAPKIAKQESSDDDTSDETSESDEEPAKKPAAKPLAAVAKNGSKTVKQESSSDEDSSEDESDDDSDDEPAKKAAAKPLGAVAKNGLKKGKQETSSDETSSDDESDDDVKPAAPLKKTSVAVAQKKKGDSSESDSDDDSDEEVPPKSKAPAATIKKEDSSESESESDSEVEVLVEAEILFQ

SEQ ID NO: 89243 - protein, 368 aa, Zea mays
LHENPVHTPLRHLARRLVQVGVNDVFAVPGDFNLTLLDHLIAEPGLRLVGCCNELNAGYAADGYARARGVGACAVTFTVGGLSVLNAIAGAYSENLPVICIAGGPNSNDYGTNRILHHTIGLPDFSQELRCFQTVTCHQAVVNNLDDAHEQIDTAIATALRESKPVYLSISCNLPGLPHPTFSRDPVPFFLEPSNSWFICQKLRLPEGCGYVFQMQYGSIGWSVGATLGYAQAAKDKRVIACIGDGSFQVTAQDVSTMLRCGQKSIIFFINNGGYTIEVEIHDGPYNVIKNWDYTGLVNAIHNSEGNCWTMKVRTEEQLKEAIATATGAKKDCLCFIEVIVHKDDTSKELLEWGSRVSAANSRPPNPQ

SEQ ID NO: 89244 - protein, 498 aa, Medicago truncatula
MGILSYLCYSLFYLSIFFIIRLLFQSRKFKNLPPGPTSLPIIGNLHHLKRPLNRTFKALTEKYGNVISLWFGSRLVVVVSSLSEFQECFTKNDVVLANRPRFLSGKYIFYNYTTLGSTSYGEHWRNLRRITSLDVLSNHRINNFAPIRRDETQRLIKKLAEDSSTKFAEVELTFRFFDMTFNNIMRMISGKRYYGDDCDISEVQEASQFRDMVSELLQLSGANNKTDFMPLLKFLDFENLEKRVKRIGEKNDVFLSGLLQEQRSKKERTNTMIDHLLNMQESQPEYYTDTIIKGLCLAMLLAGTDSSAVTLEWTMSNILNYPEVLKKVRDEVDTHVGQDRLVDESDLPKLTYLRNVIYETLRLYTPAPLLLPHSTADECIMGGYKVPRDTIVLINAWAIHRDPETWSEATTFKPERFDKKGELEKMIAFGMGRRACPGEGLALRAISMTLALLVQCFDWKRINDEKIDMSERDGFTMTKLLPLKAMCKTRPVVNKVFK

SEQ ID NO: 89245 - protein, 402 aa, Bradyrhizobium japonicum USDA 110
MTIFVPAARVSRIKISPTTAASARVRELKAAGRDIVDMAIGEPDFDTPDHVKTAAHEAIDRGETKYTAVNGTVALRKAIIADYKRRLGLDYADNEICVGGGAKQILFLALMASVEEGAEVIVPAPYWVSYPDMVIANDGKPVIVRCSENQGFKLTAEALEAAITPKTRWLILNAPSNPTGAAYSRADLKAIGDVLLRHPDVLVLSDDIYDQIWYRDEPATTLAAAVPELKDRVLLANGVSKTYAMTGWRIGYAAGPAPLVAAINKLQSQMSSCPSSISQAAAAHALTSDQSFVRDSVKLYKERRDYACARLNAIPGLSCLVPDGAFYLYPGCAGVIGKTTPGGKVIESDLDFVLYLLDDVGVAAVQGAAYGLSPYFRLSIATSMEAIKAACDRIEKACRALR

SEQ ID NO: 89246 - protein, 501 aa, Medicago truncatula
ALFYYSLLSLSFIITIKILLKITSRRLKNLPPGPPTIPIIGNLHHLKHPLHRTFTTLSQTYGDIFSLWFGSRLVVVVSSPSLAHECFTKNDIILANRPRFLTGKYIFYNYTTLGSASYGDHWRNLRRITTIDVLSNNRLNSFLGVRRDETNRLIQKLLKDVVSEGFGFTKVELRPRLTEMTFNAMMRMISGKRYYGDDGDVSDVEEAKQFREIISEMMSLLGANNKGDFLPLLRVVDLDNLEKRCKRIAKRSNAFLEGLIEEHRRGNIHSDGGTMIDHLLKLSESQPEYYSDHLIKGLIQGMLLAGTDTSAVTIEWVMSELLNHPEVLKKAKEELDTQIGKNKLVDEQDLSKLPYLQNIISETLRLHPPAPLLLPHYSSEDCTIGEFNVPKDTIILTNVWGIHRDPKHWNDALSFKPERFEKEEEVNKVMAFGLGRRACPGLSLAQRTVGFTVGLLIQCFEWERESEEKLDMMEGKGITMPMKIPLRAMCKALPIANDVTK

SEQ ID NO: 89247 - protein, 406 aa, Oceanobacter sp. RED65
MAFNVEQVKQDFPILDQEIQGKPLVYLDNGATTQKPKAVLDALKHYYEFDNSNVHRGAHALSDRATVAFENARSTVQQFINAEQSKEIIWTRGTTESINIVAQSYGTEFIDKGDQILVSAMEHHANIVPWQMLCERKGAELKVIPVSESGELDMDAYAELLNDKVKFVSLVHVSNALGTVNPVADVIEQAHAVGAKVLIDGAQAVAHFPVDVQALDADFYVFSAHKLFGPTGVGVLYGKEALLNAMPPVQGGGEMIEKVSFNGTTFQGLPFKFEAGTPNIAGAIGLAAAIEYVNGLDREAMQAHEDDILAYAHEKAEQCEGLKLIGTAKNKAGVLSFLIEGTHPADVGMLLDQQGVAVRTGHHCAMPIMDQYQIPGTARASFSIYNTRADVDALFAAIEKVKMFLL

SEQ ID NO: 89248 - protein, 427 aa, Saccharomyces cerevisiae
MHHNSQSLSSGHIRSPEDENVAPIGNLKHRTGSLSHISSAHPRVALSRVTNIVATNSSNNSISKPKVAPIKERLDSAAIIEEERLDANSVAQRKEADHNDLLTDREQEEPVEDDGESEEDEEEDQEPLLLQHYASDTLVWEHAFRTYYRTTLDPNDDDVYDVVMVAELSNEIFEYMRKLEDLYKPNPYYMDKQPELRWSFRSTLIDWIVQVHEKFQLLPETLYLCINIIDRYLCKEVVPVNKFQLVGAASLFIAAKYEEINCPTIKDFVYMSENCYSRNDLLDAERTILNGLEFELGWPGPMSFLRRISKADDYEHDTRTLAKYLLESTIMDHRLVSAQPSWLAAGAYFLSKIILGQNQWSLAHVYYSNYTQEQILPLATIILENCRYASKRHNAIWRKYSSRRYLHSSQIVAKWIALAEHRVERSN

SEQ ID NO: 89249 - protein, 230 aa, Triticum aestivum
TSLYKKAGWYRSGIPWDIVDPRVRPTPRKRVSGGRRGKISSFLPPRCPAPSKRREMDLMKLMMSDYKVEMVNDGMQEFFVEFRGPTESIYQGGVWKVRVELPDAYPYKSPSIGFINKIYHPNVDEMSGSVCLDVINQTWSPMFDLVNVFEVFLPQLLLYPNPSDPLNGEAAALMMRDRPAYEQKVKEFCEKYAKPEDAGITPEDKSSDEEELSEDEDDSGDEDIVGKPDP

SEQ ID NO: 89250 - protein, 260 aa, Phaseolus vulgaris
MASSAPCASLISSNPNILFSPKFPSSSFSSLSFPNSPNSLFKPLRTSLNPSSPPLRTFVARASSELPLVGNTAPDFEAEAVFDQEFIKVKLSDYIGKKYVILFFYPLDFTFVCPTEITAFSDRYAEFEALNTEILGVSVDSVFSHLAWVQTDRKSGGLGDLNYPLISDVTKSISKSYDVLIPDQGIALRGLFIIDKEGVIQHSTINNLAIGRSVDETKRTLQALQYVQENPDEVCPAGWKPGEKSMKPDPKLSKEYFSAI

SEQ ID NO: 89251 - protein, 505 aa, Corynebacterium glutamicum ATCC 13032
MSSTTSTTSATRQEPLSPTGVLASFRFAFSSPRRFRTEVLAGLVVALALIPESIAFSVLAGVDPKMGLFASCTMAMTIALTGGRPAMISAATGAVALVIAPVVRDHGVEYFLATVILAGIIQIALSLLGVAKLMRFIPRSVMLGFVNALACLVFFAQLPHLIDVPWMVYPLFALGIGIMLFWPKLTSVIPAPLIVIVALTAIVWVFGINIPNVSDQGELPSSLPEFLIPNVPLTLETLKIIGPYALGMSLVGLMESLLTAKLVDDITEVHSNKSREAAGQGIANIITAFLGGMGGCAMIGQTMINVKNSGARTRLSTFLAGGFLLLLVVLLGDVVGKIPMAALVAVMIIVSIDTADWHSLNPRTLKFMPLSETIVMFITIIATLVTGNLAIGVILGVLTAMVMFARRVAHLVSVERTTDNNISTYTVKGQLFWASSNDMVYSFDYSDEAEQIIIDLTAAEIWDASTVATLDSIIHKYAARGKSVEIIGLDGPSRDRLERLSGKLG

SEQ ID NO: 89252 - protein, 387 aa, Pasteurella multocida subsp. multocida str. Pm70
MSVIKMTDLDLSGKRVFIRADLNVPVKDGKVTSDARIRATIPTLKLALEKGAKVMVTSHLGRPTEGEFDEANSLKPVVDYLNANLDVPVRLVRDYLDGVDVNQGEIVVLENVRINKGEKKNDPELGKKYAALCDVFVMDAFGTAHRAQASTYGVAEYAPVACAGPLLAAELDALGKALKEPARPMVAIVGGSKVSTKLEVLNSLSKIADQIIVGGGIANTFIAAAGHNVGKSLYEEDLIPVAKNLAASTDIPVPVDVRVGLEFSETAAATEKAVNEVKDDESIFDIGDKSAEQLAEIIKNAKTILWNGPVGVFEFPNFRKGTEIISHAIANSEGFSIAGGGDTLAAIDLFGIKDKISYISTGGGAFLEFVEGKVLPAVEILEKRANG

SEQ ID NO: 89253 - protein, 400 aa, Bradyrhizobium japonicum USDA 110
MPELANRLKTVKVSASAAMTDKARELRDAGVKIVGLSSGEPDFPTPPHAIEAAHRAALAGDTKYPAQPGTVALRTAVQRKFKRENNLDYALDEILIANGGKQIIFNALFATCNPGDEVVIPAPGWITYADIVLLAEATPVAVPCPENNQFKLRPTDLDAAITPRTKWLILNFPNNPTGAACTRDEMCAIADVMLKYPDVWILTDDIYEHLTYDGFEFCTIAEVEPRLKNRVVTVNGASKAYAMTGWRVGYCGGPKDLIAAMNNVHGQATGGICTLSQAAAVAVLDGPQEFLKERADIYRDRRDLVVKLLNQIPGITCHKPEGAFYVFPNIAGCIGKTTKGGRRLDTDADFISALLEEQHVAAVPGGAYGMSPYFRISYATDTESLKEGCRRIANFCESLR

SEQ ID NO: 89254 - protein, 688 aa, Aspergillus oryzae
MTNLRSLPARARGVPFSRLSARQTNGFSTSSRSYSYADTLPNLKIGAHTRVLFQGFTGRQATANVKESLAWGTKIVGGVKPGVEGEHLGLPVFPSVKAAQEKAKPDASAIYVPGNQTAKAIEEAIEAEIPLVVAVAEHVPIHDVLRIHSMLQTQSKTRLVGANCPGIISAIGKCRVGFQPLPCFSPGKIGIVAKSGTLSYETVASTSRAGLGQSLCISMGGDVLAGTNFVDALKIFENDPDTEGIILVGEIGGTAEIDAAEWIKDYNRRTANPKPIMGLVGGLHAPAGRIMGHAGAWTAVGEPGAHAKYQALERAGAVMVNHPEKFGEGMKTLLNSRPRVQNTTSTNTPNQKRGLHTMRRVTLQKNQRPPVSKQSRSLFIKQFQALDMLKEKSIPINETEPSESDIFLNLTVDRTALSPCVIASTSADFAPSHTSKFPFPYFNTDFSSSDSPIIKSIASHLHLPETTHETLAELVQALWQIFKEKEAYLLEVRVNPSTEGLEVRGARFGFDDAAFRSSGRQKEVHSLRNPAEEVHEEVEAEKDGIVYVKLQGEGSIGTLVNGAGLAMNTVDALTIHGGHCANFLDTGGKATSETVKSSFRIITSDPRVKAIFVNIFGGLTRCDMIAEGIIMAFRDLDMSVPVVVRLRGTNEEEGQKMIAESGLPLHAFDSFEGAAKKVISLAGGKPSN

SEQ ID NO: 89255 - protein, 181 aa, Listeria innocua Clip11262
MAERLVGTQAPRFEMEAVMPNQTFGKVSLEKNIEDDKWTVLFFYPMDFTFVCPTEIVAISARSDEFDALNARIIGASTDTIHSHLAWTNTPIKEGGIGKLTYPLAADTNHQVASDYGVLIEEEGVALRGLFIINPKGEIQYEVVHHNNIGREVDEVLRVLQALQTGGLCPINWQPGEKTIV

SEQ ID NO: 89256 - protein, 769 aa, Xanthomonas campestris pv. campestris str. 8004
MSNDDFKQAALDYHRQQPAGKIKVTATKPMLTQRDLSLAYSPGVAFACEAIVEDATQASELTARGNLVAVITNGTAVLGLGNIGPLASKPVMEGKGVLFQKFAGIDVFDIEINENDPDKLVDIIASLEPTFGGINLEDIKAPECFIVERKLRERMNIPVFHDDQHGTAIIVGAAVLNALVVTGKKIEDVKLATTGMGAAGISCVNMLVSLGLKSENILALDRDGVIHTGRTDLDPDKQRYARDTDKRTLAEIVEGADIFLGLSAAGILKPEMVATMARQPVIFALANPNPEITPEAAKAVRPDCIIGTGRSDYPNQINNVLCFPYLFRGALDVGATGINEDMKIACVKAIAAMARREASDLGAAYGGETPSFGPEYLIPRPLDPRLLVELSSAVAQAAMDSGVATRPIADMAAYRDRLSQFVYRTSLMMKPVYDRARADKQRVVYAEGEEEVVLRAVQNVIDEGLALPILIGRPDVIEARIQRMGLRIRAGEDFEITNIHDDPRFNDYWQYYYALTERRGVTVTAAKELMRSRPTLIAAVMVARGEADAMLSGVVGRFHKKLGYARSVIPLEPRVSSTSAMTGVINQQGVFFFLDTHVQEDPTVEQVVEATLQAAYRLKLFGIEPNIALLSHSNFGSHDSRDALKMREVREALLKRKPELNIDGEMQGDTAWDEALRKQIMPNSTLKGRANLFVLPNLEAANIAYNLVRVFTDGVAIGPILMGISKPVHILTTSATSRRVMNMTAIAAVDAQIRKQRDAEKHNAEKNGG

SEQ ID NO: 89257 - protein, 200 aa, Physcomitrella patens subsp. patens
MDNYEIMEQVGRGAFGSAILVNHKLEKKKYVLKKIRLARQTDRCRRSAHQEMSLVSRVQHPYVVEYKESWVEKGCYVCIVTGYCEGGDMADVIRKAHGQYFSEERLLKWFAQLLLSVDYLHSNHVLHRDLKCSNIFLTKDQDIRLGDFGLAKMLNQDDLASSVVGTPNYMCPELLADIPYGFKSDIWSLGSQLISLFTFC

SEQ ID NO: 89258 - protein, 418 aa, Allium ampeloprasum
MFGRAPKKSDNTKYYEILGVPKNASPDDLKKAYRKAAIKNHPDKGGDPEKFKELAQAYDVLSDPEKREIYDQYGEDALKEGMGGGGGDHDPFDIFQSFFGGGGFGGGGSSRGRRQRRGEDVVHPLKVSLEELYNGTSKKLSLSRNVICSKCNGKGSKSGASMRCASCQGSGMKVSIRQLGPGMIQQMQHPCNDCKGTGEMINDKDRCPLCKGEKVVQEKKVLEVHVEKGMQNGQRITFPGEADEAPDTVTGDIVFVLQQKEHPKFQRKGDDLFYKHTLSLTEALCGFQFVLTHLDGRQLLIKSNPGEVVKPDQFKAINDEGMPMYQRPFMRGKLYIQFLVDFPDSLTPDQCKVIESVLPRSASSQLTDMEIDECEETTMHDVNIEEEMRRKQHQHAQEAYDEDDEGHGGGQRVQCAQQ

SEQ ID NO: 89259 - protein, 192 aa, Oryza sativa Japonica Group
MGSGSGSFLKVVVKNLDVLAGPIVSLAYPLYASVRAIETKSAVDDQQWLTYWVLYSFITLFELTFSPVLEWLPLWSYAKLFFNCWLVLPYFNGAAHVYEHFVRPMVVNQQIVNIWYIPRKDESDRPDDVISAAQRYIEQNGSRAFESLVNKFKASNTRRSILEEVEAERRAKAELEAEARDENPFFNQNYRY

SEQ ID NO: 89260 - protein, 290 aa, Chlamydomonas reinhardtii
MLTSSKASSLAFKRASPTQLRAARMTCNASKQQAWTIVGGGRVGLALADMGPGGDVVVGRGQKIEGPAGSPIVVCTRNDDLQAVVDLTAPERRKDLVFIQNGMLQPWLDARGLGGNTQVLVYFAVAKKGDKPTDGKTDVNPEGLTAAFGPHAQAVADRLHAGGLSCKVLGAADFQRAMLEKLVWISAFMAVGAKHKANVGQVESAHTAEVSDIIQELCAAGAAELGVGLAGGEVARLLAYARSVAHFPTAVKEFPWRNGWFYGLSQKALAAGQPDPCPKHTALLREVGAI

SEQ ID NO: 89261 - protein, 165 aa, Triticum aestivum
  misc_feature (45)..(45): Xaa can be any naturally occurring amino acid
  misc_feature (61)..(61): Xaa can be any naturally occurring amino acid
  misc_feature (73)..(73): Xaa can be any naturally occurring amino acid
  misc_feature (85)..(85): Xaa can be any naturally occurring amino acid
  misc_feature (120)..(120): Xaa can be any naturally occurring amino acid
  misc_feature (130)..(130): Xaa can be any naturally occurring amino acid
  misc_feature (135)..(136): Xaa can be any naturally occurring amino acid
  misc_feature (142)..(142): Xaa can be any naturally occurring amino acid
LQYGFPIVQKFLEGASSIDNHFYSSSFEKNIPVLLGLLSVWNVSXFLGYPARAILPYSQAXLEKLAPHIQQLXSMESNGKGVSIXDGAQLPLETGEMIWVNLGTNGQHTSYQLIHPGRVXPCDLLVLVKXHTCLXXKRETVXTMILSPFLAQPESCLRETPEHFT

SEQ ID NO: 89262 - protein, 382 aa, Salmonella typhi
MIKSALLVLEDGTQFHGRAIGATGSAVGEVVFNTSMTGYQEILTDLPIPPNRHSSYPILVMSAPMKPMKNLSQVHAQGLVIRDLPLIASNFRNTEDLSSLSLKRHNIVAIADIDTRKLTRLLREKGAQNGCIIAGDSPDANVALEKAKAFPGLNGMDLAKEVTTAETYRWTQGSWTLKDGLPEAKSEDDLPFHVVAYDFGAKRNILRMLVDRGCRLTVVPAQTSAEEVLKMNPDGIFLSNGPGDPAPCDYAIEAIKKFLQTDIPVFGICLGHQLLALASGAKTVKMKFGHHGGNHPVKDMDRNVVMITAQNHGFAVDEDSLPANLRVTHKSLFDGHPAGHSPYRQTGRSASRDTRADAGPDDAAPLFDHFIELIKHYRSSAK

SEQ ID NO: 89263 - protein, 499 aa, Medicago truncatula
MTTFYLSLIISLFFLIITLKVFFNTSRKFKNLPPGPQCLPIIGNLHQLKQPLHHTFHTLSQKYGQIFSLWFGSRLVVVVSSLTIAQECFTKNDIVLANRPHFLTGKYIGYNNTTVAQSPYGDHWRNLRRILSIEILSSHRLNSFLEIRRDEIMRLIQKLAQKSYNGFTEVELRPMFSEMTFNTIMRMVSGKRYYGNDCDVSDVEEARLFRGIIKEVVSLGGANNVGDFLGFLRWFDFDGLEKRLKKISKRTDAFLQGLIDEHRFGKRNSNTMIDHLLTQQQSQPEYYTDQIIKGLMVVMLLAGTDTSSVTIEWAMSNLLNHPEIMKKAKNELDTHIGHDRQVDEHDISKLPYLQSIVYETLRLHAAAPLLVPHLSSEDFSLGGYNIPQNTILMVNAWVIHRDPNLWSDPTCFKPERFEKEGEVNKLLSFGLGRRACPGENLSQRTEGLTLGLLIQCFEWKRIGEEKIDMVEAKGITAGKKTSLNAMCKVRHPLKINDVF

SEQ ID NO: 89264 - protein, 382 aa, Salmonella enterica subsp. enterica serovar Paratyphi A str.
MIKSALLVLEDGTQFHGRAIGATGSAVGEVVFNTSMTGYQEILTDPSYSRQIVTLTYPHIGNVGTNEADEESSQVHAQGLVIRDLPLIASNFRNTEDLSSYLKRHNIVAIADIDTRKLTRLLREKGAQNGCIIAGDSPDAKLALEKAKAFPGLNGMDLAKEVTTTETYRWTQGSWTLKDGLPEAKSEDDLPFHVVAYDFGAKRNILRMLVDRGCRLTVVPAQTSAEEVLKMNPDGIFLSNGPGDPAPCDYAIEAIEKFLQTDIPVFGICLGHQLLALASGAKTVKMKFGHHGGNHPVKDMDRNVVMITAQNHGFAVDEDSLPANLRVTHKSLFDGTLQGIHRTDKPAFSFQGHPEASPGPHDAAPLFDHFIELIEQYRQSAK

SEQ ID NO: 89265 - protein, 435 aa, Bordetella bronchiseptica RB50
MPGGRACARLQGFVALQSCGAPAARGLFPPLFLSPFRIPIMRKFSRIERLPPYVFNITGELKMAARRRGEDIIDMSMGNPDGATPQHIVDKLVEASTRPDTHGYSVSKGIPRLRKAICDWYMRRYAVEFDPDSEAIVTIGSKEGLAHLMLATLDRGDTVLVPNPSYPIHIYGAVIAGANIRSVRMTPGIDFFEELERAVRESIPKPKMMILGFPSNPTAQCVDLSFFERVVALAKEHDILVVHDLAYADVCFDGYVAPSIMQVPGARDVAVEFFTMSKSYNMAGWRIGYMVGNRELVGALARIKSYHDYGTFTPIQVASIAALDGPQDCVNEIVAQYQRRRDVLARGLHEAGWNVEIPKASMYIWAQIPEPYRAMGSLEFAKRVLSDAKVAVSPGIGFGEYGDEYVRFALIENEQRTRQAVRGIKDMFRKDGLLK

SEQ ID NO: 89266 - protein, 294 aa, Daucus carota
MDQYEKVEKIGEGTYGVVYKARDRVTNETIALKKIRLEQEDEGVPSTAIREISLLKEMQHENIVRLQDVVHSEKRLYLVFEYLDLDLKKHMDSCPEFAKDPRLIKMFLYQILRGIAYCHSHRVLHRDLKPQNLLIDRRTNALKLADFGLARAFGIPVRTFTHEVVTLWYRAPEILLGSRHYSTPVDVWSVGCIFAEMVNQQPLFPGDSEIDELFKIFRIVGTPNEDTWPGVTALPDFKSAFPKWPSKELGNVVPNLDVAGLNLLKKMLCLDPSRRITARSALEHEYFKDIGIVP

SEQ ID NO: 89267 - protein, 157 aa, Brassica napus
MWFTGGGGGGLRKLCRASATVFENEMSCNSLLVRYMSRERAVNVRKINPKVSIQEAHIISSSLYEVFKKHGPLSVPNTWLRAQEAGVSGLNSKTHMKLMLKWMRGRKMLKLICNQVGSSKKFFHTVLPDDDIQQETPLAATPAATENKKQTSKRRSK

SEQ ID NO: 89268 - protein, 66 aa, Glycine max
  misc_feature (33)..(33): Xaa can be any naturally occurring amino acid
GPLRSLSSQFPSPSNFSFNYLTFCIHKRKLMSXDHTPPFPPSFFSAYTRDGALTSNDDLESIFARG

SEQ ID NO: 89269 - protein, 786 aa, Methanosarcina acetivorans C2A
MEEIQLKVEKAYPIDLGRGIIRLDPAALLKLQLSPGDIVEIRGKKKTTAKVWRADRQDWEQGIVRIDNFIRQNAGVSIGEKVTIKKVEAPEAKKLILALPESMTQGGPELQFGEHANEIIKRHILKRPVFKGDIIPIINSMSQPMTESLTTSQVIPLVAVETDPANTIVLITEATIIELRKKPVQGYEKATRGVTTYEDIGGLGQEIMRVREIIEMPMKHPELFAHLNIEPPKGVILYGPPGTGKTLIAKAVANESGASFHYIAGPEIVGKFYGESEERLRKIFEEATQDAPSVIFIDEIDSIAPKRENVTGEVERRVVAQLLTLLDGMEERGQVVVIGATNRVDAIDPALRRPGRFDREIHIGVPDTKDRYEILQIHTRGMPIEKDDEITPAESEVELEEATEIEAEIEVDEAALEREKKEKTNRYLMYLAEKTQGFVGADLLALVQEAAMRCLRENLPDLDLEKETIPPERLEKIVVTKKNFEDALMEAEPSALREIFVEMPSVGWDGVGGLDEAKNAIIEAVEWPIKNPEKFVKLGIKAPKGILLYGPPGTGKTLIAQAVAKESNANFISVKGPEMFSKWLGESEKAIRETFKKARQVAPCVVFFDEIDSIAAMQGMESTDSRTSERVLNQLLTEMDGLETLKDVVIIAATNRPNLLDPAIMRPGRFDRLVYVGAPDRKGRMKIFKIHTRNTPLAEDVDLENLANITEGYVGADIEAVCREAVMFALRENFDVEAIEMRHFREALKKVKPTINENIAQFYEKIEEQFKGGQRPAETAGYVGYR

SEQ ID NO: 89270 - protein, 491 aa, Oceanobacter sp. RED65
MSDTGINPLKLSQPKIRMLHISWFAFFLTFMVWFNHAPLMGFIKEAFDLTSQEVKALLILNVALTIPARIIIGMLVDRFGPRYVYSGLLFVSSLLCTAFALSQTYEQLALFRFLMGFVGAGFVIGIRLVGEWFPAKEVGIAEGIYGGWGNFGSAASAMLLPTVALIFGGDDGWRYALLSTACLAFVYSFIFFKVARNTPKGSTYFKPKKSGGLQVSNKRDLYFYLAMNVPMYLALAVLTWKLSPANLGLLSEIASWALYIGLALLFVVQTWQILKVNKEHLSQPVPKMQRYKYKQVAVLQWAYFVTFGSELAVVSMLPLFFMETFEGLTAVTAGLLASGFAFMNLVARPGGGWLSDKFGRRKTLSILICGLAVGYLTLSQIDSTWWIPVAVIATMMCSFFVQAGEGAVFAMVPLVKRSLTGQIAGMTGAYGNVGAVIYLTILSFVDYSTFFMVIAASAAFIFIAVQFLEEPEGHVAEINDAGEVELVQIGK

SEQ ID NO: 89271 - protein, 464 aa, Magnaporthe grisea 70-15
MFAPILRRRALQKTSSLRYVTPALTRWYASYPPHTVVKMPALSPTMTAGNIGAWHKKPGDGIAPGDVLVEIETDKAQMDFEFQEEGVLAKVLKETGEKDIAVGNPIAVLVEEGTDVKAFENFTLADAGGEAPASSPPKEEKNVEESSKAASTPTPTPAPEPENTKSAGRLQNALDREPNAEPAAKRLANEKGIKLDGVKGSGKNGKITAEDVKKLGSSGPAAAAAAGPAGALYEDIPISNMRKTIANRLKESVSENPHYFVSSSLSVSKLLKLRQALNSSSEGKYKLRVNDFLIKAIAVASKKVPQVNSSWRDGVIRQFNTVDVSVAVSTPSGLITPIVKAVETKGLESISASVKELAKRARDNKLKSDEYQGGTISISNMGMNTAVERFTAVINPPQAAIVAIGTTKKVAVPVENEDGTTGVEWDDQIVITGSFDHKVVDGAVGAEWMKELKTVVENPLQLLL

SEQ ID NO: 89272 - protein, 433 aa, Pasteurella multocida subsp. multocida str. Pm70
MAKIVKVIGREIIDSRGNPTVEAEVHLEGGFVGLAAAPSGASTGSREALELRDGDKARFLGKGVLKAVAAVNNEIAQALVGKDATNQAEIDQIMIDLDGTENKSKFGANAILAVSLANAKAAAAAKGMPLFAWIAELNGTPGQYSMPLPMMNIINGGEHADNNVDIQEFMIQPVGAKTLKEALRIGAEVFHNLAKVLKGKGLSTAVGDEGGFAPNLESNAAALACIKEAVEKAGYVLGKDVTLAMDCASSEFYNKENGMYEMKGEGKSFTSQEFTHYLEELCKEYPIVSIEDGQDESDWEGFAYQTKVLGDKVQLVGDDLFVTNTKILKEGIEKGIANSILIKFNQIGSLTETLAAIKMAKDAGYTAVISHRSGETEDATIADLAVGTAAGQIKTGSMSRSDRIAKYNQLIRIEEALGDKAPFLGLKAVKGQA

SEQ ID NO: 89273 - protein, 283 aa, Methanosarcina acetivorans C2A
MANCNECGGLMMKIYQVDAFTEKPFSGNPAGVCVLSEKLDEKLMQNIASEMNLSETAFLVKNDDGYDLRWFTPDSEIDLCGHATLASAHILWEKGYLETDLEAKYSTKSGLLTAKINDGWIELNFPALPEEKTELPAELLEALGVEASYVGKNIFDYLVEVESEETVRTMKPDFPKLLEVPARGVIVTAKSNAGEYDFVSRFFAPEIGVWEDPVTGSAHCCLGPYWQKKVEQGRIRCLPGFGTRRRPESKSYRETDFNFREGSDSAGRRIINLKIRGSGKLIQ

SEQ ID NO: 89274 - protein, 501 aa, Oryza sativa Indica Group
MELLLLCTPCVILLLSSLYLLRLFVDARRNLPPGPRPQPLIGNILDLGSQPHRSLARLAGRYGPLMTLRLGTVTTVVASSPGAARDILQRHDAAFSARSVPDAARACGHDGFSMGMLPPSSALWRALRRVCAAELFAPRSLDAHQRLRRDKVRQLVSHVARLARDGAAVDVGRAAFTASLNLLSSTIFSADLADFGDARAESSVGDLRDLISEFTIVVGVPNVSDFFPAVAPLDPQRLRRRVARVFERLQAVFDGHIERRLRDRAAGEPPNNDFLDALLDYRSPEDGRGFDRPTLQFLFTDLFSAGSDTSAVTVEWAMAQLLQNPPAMAKAREELARVIGSKQEIEESDISQLKYLEAVVKETLRLHPPAPFLLPHQAETTTQVGGYTVPKGTRVLVNVWAIGRDSKVWSDPDKFMPERFLQSEVDLRGRDFELIPFGSGRRICPGLPLAVRMVHLMLASLLHRFEWRLLPEVEKNGVDMAEKFGMILELATPLRAVAIPV

SEQ ID NO: 89275 - protein, 500 aa, Oryza sativa Indica Group
MELLLLYAPCVILLVSSLYLLRLFSDARRNLPPGPRPLPLVGNLLELGAKPHRSLARLAERHGPLMTLRLGAVTTIVASSPDAARDILQRHDAAFSTRPVPDIVRACGHDRFAMPWLPPSSPQCRALRKVCSAELFAPRRLDAQQRLRREKARRLVSHVARMAREGAAVDVRRVVFTTLLNMLSCTLFSADLADLDEGRAGSAGELADTVAEFAGTVGVPNVVDYFPAVAAFDPQRLRRRLSRVFTRLFAEFDEQIERRMRERDAGEPPKNDFLDVLLDYRTTEDGRQFDRQTLRSRFTDLFSAGSDTSAVTVEWAMAQLLQSPSSMMKAREELTRVIGSKPEIDESDIDSLEYLQAVVKETFRLHPPAPLLLSHRAETDTEIGGYTVPKGATVMVNIWAIGRDSKVWFEPDKFIPERFLQKEVDFRGRDFELIPFGSGRRICPGLPLAVRMVHLMLASLLHRFEWRLPPEVERNGVNMEEKFGIVMTLATPLQAIATPI

SEQ ID NO: 89276 - protein, 267 aa, Sinorhizobium xinjiangense
HLLRFDSIHGRFPADVKVEGDTIVINNGKPIKVTAVRNPAELPHKDLGVDIAMECTGIFTARDKAAAHLEAGAKRVIVSAPADGADLTVVYGVNHDKLTKDHLVISNASCTTNCLAPVAKVLNDAIGIDHGMMTTIHSYTNDQPSLDQMHKDLYRARAAALSMIPTSTGAAKAVGLVLPELKGKLDGFAMRVPTPNVSVVDLKFVAKRDTTKEEINAAIKAAADGPLKGILGYTLAPNVSIDFNHDPHSSVFHMDQTKVMEGKFVSI

SEQ ID NO: 89277 - protein, 405 aa, Candidatus Pelagibacter ubique HTCC1002
MSIENIKKEFPIFNNKVHNNDLVYLDSANSSQKPQSVIDRVNDFYTNEFSNTGRSVHYLAVAATNLYENTRSSVQKYINAKDKNEIVFTKGATEAINLVANTYGQKFLNEGDEILITELEHHSNYVPWHFLRQSKGIKIEFAEINDDGEITLESIEKKITSKTKLIAITHLSNVTGSVLPVKEITELAHSKGIAVLVDGCQGAPHLKLDMQDIDCDFYAISCHKMYGPTGLGVLYAKKKWLEELPPYQGGGGMIQDVKKDSISYGDLPNKYEAGTMATAQVIAFDQSIKFLEKIGIENMIKHEQELIEYGQEILRKNNSVKLIGNPKHRSAVLSFTIEGVHPHDIATILDEDGVAIRAGHHCCQILHDKLGIPASARASLGVYNTKDDLDQLNNSINNCKKIFNL

SEQ ID NO: 89278 - protein, 266 aa, Bradyrhizobium elkanii
HLLRFDSVHGRFPGTVTVDGDTISLGDNKIKVSAERDPSKLPWKALGVDVALECTGIFTAKDKASAHLTAGAKRVLVSAPADGADATIVYGVNHDTLTKDHLVISNGSCTTNCLAPVAKVLNDTVGIETGFMTTIHAYTGDQPTLDTLHKDLYRGRAAAMSMIPTSTGAAKAIGLVLPELKGKLDGVSVRVPTPNVSVIDLKIVAKRATDVKEINEAMKRASEQQLKGILGYTNAPNVSIDFNHDPHSSTFHMDQTKVQNGNFVRV

SEQ ID NO: 89279 - protein, 266 aa, Bradyrhizobium japonicum
HLLRFDSVHGRFPGTVTVDGDSISLGGSKIKVTAERDPSKLPWKDLGVDIAMECTGIFTSKDKASAHLTAGAKRVLVSAPADGADATIVYGVNHDTLTKDHLVVSNGSCTTNCLAPVAKVLNDLVGIETGFMTTIHAYTGDQPTLDTMHKDLYRGRAAAMSMIPTSTGAAKAIGLVLPELKGKLDGVAIRVPTPNVSVVDLKIIAKRATDAKEINAAMKRASEQQLKGILGYTTAPNVSIDFNHDPHSSTFHEDQTKVQNGTLVRV

SEQ ID NO: 89280 - protein, 642 aa, Bartonella henselae str. Houston-1
MPLPYHTHIFKLEPATKEEVKEGVLDSKALAPISVGSAAAYEVEYFATAAQGKKADDAVAKRDIGKLAYKDKITVNDIKASGQAHENTILSGDGWIQISPLGIGDMSAVTYDPDNVRSNVFSMENMHEGPTKKILTEEERSKLRWLSSTQPTIEKWYKGSEGVYYPISPVDLKNTISYFAISKSFGMLKSVYDPDKIAKDAFDMENMKEGNEHLILTPQERAQIAKIDKIENDVQHAQESAQQGTHTATKAKEAAESVLDTASVAQKNATDAKAIATTAQTAANKAQDVAHSVEKKVDLIQPLAKQDWIDGTKTIDALISPANLMASIKANSLNDNGSNDSGYRKPVEILITESGDIPWPEGVTDETELEIWAWGGGDAGRDSLYGGTGGEGGFGGCCTYVRTRKKFLGKNSVKIGKGGKSRNNPGGDRTVVGQFIIAFGGNNSIKPYQKGVFKGEDATGKDGDYNGKDGFLGGGGGQGAGGTGGEGGRGGRGGDNFLSDGGWGGWGGWSNTGCKGGRGGDGGSSVYGLGGKGGDGGSSVYGGGGGGGTGGEGRGSTSGKGGTGGSSVYGGDGGGDGSYYNGKVGDGGHSMWGGHGGKGALVPKESKVLYGGGGGGYFPGKDATSSSSGDGGDGAVLIKVYL

SEQ ID NO: 89281 - protein, 102 aa, Triticum aestivum
  misc_feature (63)..(63): Xaa can be any naturally occurring amino acid
  misc_feature (66)..(66): Xaa can be any naturally occurring amino acid
  misc_feature (76)..(76): Xaa can be any naturally occurring amino acid
  misc_feature (85)..(85): Xaa can be any naturally occurring amino acid
  misc_feature (88)..(88): Xaa can be any naturally occurring amino acid
  misc_feature (99)..(99): Xaa can be any naturally occurring amino acid
MAEQTFIMIKPDGVQRGLIGEVISRFEKKGFYLKGLKLQNVEKSFAEQHYADLSSKPLLSLGXLEXILSRPVLPMXWERQDVLSXWTXIIWANKPLAPXPDR

SEQ ID NO: 89282 - protein, 542 aa, Rhodopseudomonas palustris CGA009
MPAKKSKQPSAAVTTVKSATLDLLRAFKIDKVFGNPGSTELPFLSDWPDDIDYVLALQEASAVAMADGYAQATRNAGFVNLHSAAGVGNALGNIYSAFKNQTPLVITAGQQARSLLPLQAFLGAERASEFPRPYVKYSVEPARAEDVPAAIARAYYVAMQPPCGPTFVSVPIDDWARPAAPVPPRTITREIGPDRSAMQVLADTLANAKKPALVVGPAIDRAAAVGLMARLAERAKAPVWVSPFSARCSFPERHPLFAGFLPASPGQLSETLGAYDVIVLIGAPVFTFHVEGHAAIFDGASQLFQITDDAEAASVTPLGASIIATMTPALTLLLELLPETKRAAPPARAVPPAPRPAEPMPVEYLLHTLRAAMPESAMLVEEAPSHRPAMQTYMPMPGQDSFATMASGGLGWSLPASVGFALAHPNRRTVCLIGDGSAMYSIQALWTAAQRKLPLTVVVLNNGGYGAMRSFSQVMQVRNVPGLELPGIDFTALAQSLGCDAVRVTRSEELAPALTRALAWDGVSLVEVMLDTSVPMLYARNG

SEQ ID NO: 89283 - protein, 717 aa, Magnetococcus sp. MC-1
MKTPSCVGYYWHWERDDAGVVWLTADQPERSANLLSRGVLEELNTLLLQLEKWAPAALVIQSAKPAGFFAGADIQSFAEMQHLHEAQALIAAGQRVMDRLAQTPYPTLALIHGHCMGGGLELALSCDYRIACQDGNTRIGLPEVQLGIFPAWGGTWRLTRAIGELPAMQMMLNGQLLHPKQALQLGVVHELSPQRLMVRAARDMLSHPPKARRRSLLDRLLSRPTWRWVAAAVMTRQVNKKAPLEHYPAPHALLKHWRLNMADHGQAMLGEQQAVAPLMGSHTTQQLVRLFHLKDRLKGLAKTADGAIPRHVHVVGDGVMGRAIAVWCALQGMQVSLQGLSTELLGRALQEATQLARKKRLDRLATRDLLDRLMPDQRGDGVCHADLVIEAIFEDVTAKQQLYAALEPRMREHALLATNTSAIPLQTLAQGLKRPQQLLGLHFFNPVARMPLVEVVEGPQTSMQALQMGYRFVHAIQRLPLPVKSRPGFLVNRVLMPYLMEAVRMVDEGVDMRRIDKAAMDFGMPMGPLALADAVGLDVCKAVARELVGSVGGGVPQRLLELVSAGQLGRKSGAGFYRYGRGRAKPGSRGRAFMEERDITYRLILPMLNEAAAILQEGVVADADLVDAGMVFGTGFAPFRGGPMAYAARTGEVSIIALFKELEAHFGSRFAPHSGWMAPSLRRWLQEREARHVDASWHRSDTVTANTHPTGPVPHTL

SEQ ID NO: 89284 - protein, 246 aa, Rhodococcus erythropolis
MSYALEGKVAVVTGGGSGIGAACVRQLCALGASVVVADIVFDNATLVAKEFGDRAVAVEVDVARVEDAERMVETAVAHFGGLDIAVNNAGVGVPVKASVGDTGFEEWRRVLDVNLDGAFFCMRAELRRMRKGGSVVNLASVMGAVAAEGSSSYVASKHALVGLTKTAALDYATAGIRVNAVGAGFVDTPLMAGRDPEWLAAVAASHPLGRLAQPDEIASVVAFLASSAASFVTGAFIPVDGGYLAR

SEQ ID NO: 89285 - protein, 178 aa, Oceanobacter sp. RED65
MSFDQIPVGKDAPDDIYVAIEIPANSSPIKYEIDKDMGGALMVDRFMATPMFYPANYGFINNTLADDGDALDVLVITPYPVQAGSVIRCRPVGVLNMTDEAGEDAKLVAVPHSKLTKMYDDIKDINDVPQLLRDQISHFFENYKDLETGKWVKVEGWGDADEARRAIVGGIAAYNGQK

SEQ ID NO: 89286 - protein, 236 aa, Frankia sp. EAN1pec
MNALYQPRHSRSHRPRTGTGIGAGQYGEAPGTAAGPFEDQVFHRLLQNRIVFLGSVVEDTIANAICAKLLLLASDDPSADIHLYINSPGGSVSAGMAIYDTMQYIANDVATVALGFAGSMGQFLLSSGAPGKRFALPHSRVMMHQPSGGIGGTATDIAIQAEQLLFTKRLIQERIAEHTGQPVERIEADSDRDRWFTAEEARDYGLVDRVITRVDQVTPDANSRAAGGGDSRVALR

SEQ ID NO: 89287 - protein, 210 aa, Frankia sp. EAN1pec
MTPAPMAASARYVLPNVVERTPRGEYSMDPYSKLLRERIIFLGTQIDDTSANDVMAQLLFLEGEDPDRDISIYINSPGGSLTALTAIYDTICFVRPEVATVCMGQAASAAAVLLAAGAPGKRVALPNSRIMIHQPSAQGEGQSSDLEIQAREVLRLRALMERMLVEHTGRAEHEIRQDVERDTILTAEQARQYGIVDEVVASRKVRRVPA

SEQ ID NO: 89288 - protein, 397 aa, Solanum tuberosum
MASASLLKSSPVLDKSEFLKGQSLRQPSVSVVRCHPINATSLTVRAASSYADELIKTTKTVASPGRGILAMDESNATCGKRLASIGLENTEANRQAYRTLLVSAPGLGQYISDAILFEETLYQSTVDGRKIVDVLIEQNIVPGIKVDKGLVPLAGSNDESWCQGLDGLASRSAAYYQQGARFAKWRTVVSIPNGPSALAVKEAAWGLARYAAISQDNGLVPIVEPEILLDGEHGIDRTFEVAQKVWAEVFFYLAENNVMFEGILLKPSMVTPGAECKDRATPQQVADYTLNLLKRRIPPAVPGIMFLSGGQSEVEATLNLNAMNQAPNPWHVSFSYARALQNTCLKTWGGQPENVKAAQDTLLVRAKANSLAQLGKYTGEGESDEAKQGMFVKGYVY

SEQ ID NO: 89289 - protein, 518 aa, Frankia sp. EAN1pec
MSLSYATTSPDVDREGPAVGALLDVVGAGIPVPLADGREVPYANLDQAASAPCLRGVAEHVERVLPYSASVHRGTGYSSAVCTALYEGARAAVRTFVGGRPDDVVIFTRNTTDSVNLLARCLPPQPPDPPQPPDPARTSDPGHAEPGGVVVFDLEHHANLLPWRSRPGCRWVPAAPTRADTLRALATALDTAPTSLVAVTGASNVTGEVPPLAEIVRLARAAGARVFVDGAQLVPHRRVDMAALGIDYLAFSGHKLYAPFGAGVLVGRPDWLAAAPPYLAGGGAVREVTNSAVAWADGPARHEAGSPNLLGATAIAAACRLLGALAPRDLHQHEDLLRRRLVDGLRAIEGVTIHSLWADGDDPAAGEAAGGEGPDGILATGPVGVVTFSVAGRDPGFVAAVLSAEHGVGVRAGRFCAHPLLGRLGAEGGAIRASVGISSTSADVDRLLAGLAELVGRGPRQQYRDLGDGGWAPASDGRALPPWVAEHMAAGHVRGRVPAPGHAHDSAGLPAYSSPCGT

SEQ ID NO: 89290 - protein, 175 aa, Thermus thermophilus HB27
MANLKSLPVGDKAPEVVHMVIEVPRGSGNKYEYDPDLGAIKLDRVLPGAQFYPGDYGFIPSTLAEDGDPLDGLVLSTYPLLPGVVVEVRVVGLLLMEDEKGGDAKVIGVVAEDQRLDHIQDIGDVPEGVKQEIQHFFETYKALEAKKGKWVKVTGWRDRKAALEEVRACIARYKG

SEQ ID NO: 89291 - protein, 199 aa, Zea mays
  misc_feature (189)..(189): Xaa can be any naturally occurring amino acid
ALGESRLQPTTTPPCAPASVGVWDTAAGFGPLSALAPQASATPHAAGTAAPASTAPRRGPSHATRGHAARQHAQLRARLPPAACSAPPLLLLGVLQEEKTLGQKFVVDIDAWMDLAAAGESDCIADTVSYTDIYSIAKDVVEGTPRNLLESVAHSIAEATLLKFPQVSAVRVKVGKPHVAVRGVLDYLXVEITRHRKKE

SEQ ID NO: 89292 - protein, 392 aa, Oryza sativa Indica Group
MAATIQSVKARQIFDSRGNPTVEVDICCSDGTFARAAVPSGASTGVYEALELRDGGSDYLGKGVLKAVDNVNSIIGPALIGKDPTEQTVIDNFMVQQLDGTKNEWGWCKQKLGANAILAVSLALCKAGAIIKKIPLYQEFMILPTGASSFKEAMKMGVEVYHNLKSVIKKKYGQDATNVGDEGGFAPNIQENKEGLELLKTAIEKAGYTGKVVIGMDVAASEFYTEEQTYDLNFKEENNDGSQKISGDSLKNVYKSFVSEYPIVSIEDPFDQDDWVHYAKMTEEIGDQVQIVGDDLLVTNPTRVAKAIKDKACNALLLKVNQIGSVTESIEAVKMSKRAGWGVMTSHRSGETEDTFIADLAVGLSTLLRIEEELGAAAVYAGAKFRAPVEPY

SEQ ID NO: 89293 - protein, 75 aa, Fusobacterium nucleatum subsp. nucleatum ATCC 25586
MLDKVKEIIVEQLGVDADQIKPESNFVDDLGADSLDTVELIMSFEEEFGVEIPDTEAEKIKTVQDVINYIEANKK

SEQ ID NO: 89294 - protein, 410 aa, Pinus taeda
MASNIMQRCNVFMSERVKLHAAMLALQFGYAGFHIVSRAALNMGVSKVVFPVYRNILALMLIGPCAYFLEKKERPALTLSFLIQFFLLALCGITGQSRILSLRIVLHIPTFASAIQNSVPAITFIMAAALRLEKVHISRRDGLAKIIGTVACVSGATIITLYKGPPITHIWRPNLEVTASYFKAFQGNDLSAKSENWTLGCIYLLGNCLAWSGWIVLQAPVLKRYPARLSVTSFTCFFGVIQFLIIAAFFETDLEHWKIHSGGELFTILYAGFVASGIAFSVQIWCIDRGGPVFVAVYQPVQTIAVAIMASIILGEQFYLGGIFGAILIIIGLYLVLWGKSEEKRLGLLQAKSSMVPENQPDNMDQSATLIINSSNGIKPNTSSSLTQPLLLDTSYKTVNIPSPSDEPQP

SEQ ID NO: 89295 - protein, 171 aa, Glycine max
IITRMLGIQMAVMMGANLAGEVADGNFCETTIGCNDKAMAPILKELCQADFFRVVVVDDRNTVEICGALKNIVACAAGFTDGLGLGDNTKAAVIRLGLMEMIKFVDTFFPGSKLSTFFESCGVADLITTCYVGRNRRVSEAFVKTGKSIPDLEAEMLNGQKLQGPITAEEL

SEQ ID NO: 89296 - protein, 267 aa, Sinorhizobium medicae
HLLRFDSIHGRFPADVKVEGDSIIINNGKPIKVTAVRNPAELPHKELGVDIAMECTGIFTARDKAAAHLEAGAKRVIVSAPADGADLTVVYGVNHDKLTKDHLVISNASCTTNCLVPVAKVLHDAIGIDHGMMTTIHSYTNDQPSLDQMHKDLYRARAAALSMIPTSTGAAKAVGLVLPELKGKLDGISVRVPTPNVSVVDLKFVAKRETTKEEVNAAIKAAADGPLKGVLGYTLQPNVSIDFNHDPHSSVFHMDQTKVMEGKFVSI

SEQ ID NO: 89297 - protein, 362 aa, Zygosaccharomyces rouxii
MSKNIVVLPGDHAGQEIAQEAIKVLEAISEVSPEAKFNFQHHLIGGAAIDATGSPLPDDALAAAKKADAVLLGAVGGPKWGTGSVRPEQGLLKIRKELQLYANLRPCNFASESLLDLSPLKPQHAKGTDFVVVRELVGGIYFGERKEDEGDGVAWDSEKYTKPEVQRLTRMAAFLALQHNPPLPIWSLDKANVLASSRLWRKTVEETIKNEFPQLKLNHQLIDSAAMILVKSPTQLNGIVLTSNLFGDIISDEASVIPGSLGLLPSASLASLPDTNEAFGLYEPCHGSAPDLPKGKVNPIAMILSAAMMLKLSLNLSKEGEAVEKAVKQVLDSGVRTGDLGGSNSTSEVGDAIAKAVKEILA

SEQ ID NO: 89298 - protein, 267 aa, Ensifer adhaerens
HLLRFDSIHGRFPADVKVEGDAIIINGGKPIKVTAIRNPAELPHKELGVDVAMECTGIFTARDKAALHLEAGAKRVIVSAPAEGADLTVVYGVNHDKLTKDHLVISNASCTTNCLAPVAKVLNDVIGIDHGMMTTIHSYTNDQPSLDQMHKDLYRARAAALSMIPTSTGAAKAVGLVLPELKGKLDGFAMRVPTPNVSVVDLKFVAKRETTKEEINAAIKAAADGPLKGILGYTLAPNVSIDFNHDPHSSVFHMDQTKVMEGKFVSI

SEQ ID NO: 89299 - protein, 573 aa, Streptococcus pyogenes MGAS315
MNKTKQNKTKHSLLCRYGLTSAAALLLTFGGASAVKADGEDAQKRAQIQKREELLSALIDGTSRLENKQFPYPGSTGLDDTYMNSLIQYLQERKQIEDKWRASLLKGIQDHVLDGQDGDRGEAGPAGPRGEAGPAGPRGEAGKDGAKGDRGEAGPAGPRGEAGKDGAKGDRGEAGPAGPRGEAGKDGAKGDRGEAGPAGPRGEAGKDGAKGDRGEAGPAGPRGEAGPAGPRGEAGPAGPRGEAGPAGPRGEAGKDGAKGDRGEAGPAGPRGEAGKDGAKGDRGEAGPAGPRGEAGKDGAKGDRGEAGPAGPRGEAGPAGPRGEAGKDGAKGDRGEAGPAGPRGEAGKDGAKGDRGEAGPAGPRGEAGKDGAKGDRGEAGPAGPRGEAGKDGAKGDRGEAGPAGPRGEAGKDGAKGDRGEAGPAGPRGEAGKDGAKGDRGEAGPAGPRGEAGPAGKDGQPGKPAPKTPEVPQKPDTAPHTPKTPQIPGQSKDVTPAPQNPSNRGLNKPQTQGGNQLAKTPAAHDTHRQLPATGETTNPFFTAAAVAIMTTAGVVAVAKRQENNQSSFCYLTDGK

SEQ ID NO: 89300 - protein, 145 aa, Streptococcus pyogenes MGAS315
METSDELKQRIGELSYEVTQHAATESPFTGEYDDFFEKGIYVDIVSGEVLFSSLDKFNSGCGWPAFSKPIENRMVTNHDDSSYGMRRVEVKSREAGSHLGHVFSDGPKEAGGLRYCINSAALKFIPYDQMEKEGYAQWLTLFDET

SEQ ID NO: 89301 - protein, 267 aa, Sinorhizobium saheli
HLLRFDSVHGRFPADVKVDGDAIVINNGKPIKVTAIRNPAELPHKELGVDIAMECTGIFTARDKAAAHLEAGAKRVIVSAPADGADLTVVYGVNHDKLTKDHLVISNASCTTNCLVPVAKVLHDAIGIDHGMMTTIHSYTNDQPSLDQMHKDLYRARAAALSMIPTSTGAAKAVGLVLPELKGKLDGISVRVPTPNVSVVDLKFVAKRETTKEEINAAIKAAADGPLKGVLGYTLQPNVSTDFNHDPHSSVFHMDQTKVMEGKFVSI

SEQ ID NO: 89302 - protein, 267 aa, Sinorhizobium arboris
HLLRFDSIHGRFPADVKVDGDAIVINNGKPIRVTAIRNPAELPHKDLGVDIAMECTGIFTARDKAAAHLEAGAKRVIVSAPADGADLTVVYGVNHDKLTKDHLVISNASCTTNCLVPVAKVLHDAIGIDHGMMTTIHSYTNDQPSLDQMHKDLYRARAAALSMIPTSTGAAKAVGLVLPELKGKLDGISVRVPTPNVSVVDLKFVAKRETTKEEINAAIKAAADGPLKGVLGYTLQPNVSVDFNHDPHSSVFHMDQTKVMEGKFVSI

SEQ ID NO: 89303 - protein, 861 aa, Oryza sativa Japonica Group
MAKIQPLPAASPSAEWHHGDGGGGGVQGKQAVYTVWMKSLVFNGHGCTVYGSDGRVAFRVDNYGCRGSRDVFFMDTAGTTLIGIQTKSFGMMKRWEASRHHGGEKETTTATVTTPWFRVQRGRGPGGAMATVTLHGGVGMAYRIDGCPSKSEYRISRGGGGGGGGDGEVVAEVARKQTASGVVLGEDVLTLTVGPGADHLLVLGLVVMVDEDTSLKLGLSLFVGNSLDKVGQVSPANYAGDGRVCVGWSMYTSLPRFGVGWLTDDDVVCGVSWWVARAARLRVCADGGANRVFDGMPELLPAEDPDQVRMRYKPDVIKGDMDSIRPEVKEYYSNLGAEIVDESHDQDTTDLHKCVSFITRNPPGSEESNLYILVLGALGGRFDHEMGNINVLYRFSNIRIVLLSDDCSIFLLPKTHSHEIHIERSIEGPHCGLIPMGSPSASTTTTGLRWNLVGKEVDGIEDSVIFRSLQALAVPLIGNACHIFMHGLNSVQIYGAEKLQQALQERPKGKPLLTVSNHVAAMDDPFVIASILPPSVMLEAQKLRWTLCASDRCFTNPILSTFFRSVKVLPVSRGDGIYQKGMDMALSKLNNGGWVHIFPEGSRSKDGGKTVAPAKRGVGRLVMDADSLPVVIPFVHTGMQDIMPVGKRIPRAGKRVIVVVGDPINFNDLIIDNSDETQHISRGILYDKATERIGQRLQELKAEVDRLAAEQKSELQHHHARDTVNYGTRLWQQVDWEAFGMESSMLSPEPSDVQEPLKKAKPVLHLESEHAKPELHLEPEQAKHELHTEQCVPAAPSAEICSNFGVPLFFRQHTDPSELMGFAARGLLKNGRFMEEEGYRELQRQGAMNMFWGSQANNTVL

SEQ ID NO: 89304 - protein, 620 aa, Salmonella enterica subsp. enterica serovar Paratyphi A str.
MDSHTLLQALIYLGSAALIVPIAVRLGLGSVLGYLIAGCIIGPWGLRLVTDAESILHFAEIGVVLMLFVIGLELDPQRLWKLRASVFGGGALQMVVCGGLIGLFCMFLGLRWQVAELIGMTLALSSTAIAMQAMNERNLTVSQVGRSAFAVLLFQDIAAIPLVAMIPLLAASGASTTLGAFALSALKVAGALALVVLLGRYVTRPALRFVARSGLREVFSAVALFLVFGFGLLLEEVGLSMAMGAFLAGVLLASSEYRHALESDIEPFKGLLLGLFFIGVGMSIDFGTLVENPLRILLLLAGFLAIKIVMLWLVARPLGVPAKQRRWFAVLLGQGSEFAFVVFGAAQMADVLEPEWAKALTLAVALSMAATPIFLVLLTRMEKTATGEAREADEIDEEQPRVIVAGFGRFGQIAGRLLLSSGVKMVVLDHDPDHIETLRKFGMKVFYGDATRMDLLESAGAAKAEVLINAIDDPQTNLQLSELVKSHFPHLQIIARARDVDHYIRLRQAGVAMPERETFEGALKSGRQALEALGLGRYEARERADLFRHFNTRMVEEMAKGENDPLSRAAAYKRTSAMLSEIITEDREHLSLIQRHGWQGTAEGKHSGEAADEPEVKPSI

SEQ ID NO: 89305 - protein, 254 aa, Arabidopsis thaliana
MSRSRSRSRSRSRDRFRSRSPRDRRMRSERVSYHDAPSRREREPRRAFSQGNLCNNCKRPGHFARDCSNVSVCNNCGLPGHIAAECTAESRCWNCREPGHVASNCSNEGICHSCGKSGHRARDCSNSDSRAGDLRLCNNCFKQGHLAADCTNDKACKNCRTSGHIARDCRNDPVCNICSISGHVARHCPKGDSNYSDRGSRVRDGGMQRGGLSRMSRDREGVSAMIICHNCGGRGHRAYECPSARVADRGFRRY

SEQ ID NO: 89306 - protein, 519 aa, Oryza sativa
MAIGQPKQERMQLHSIFTKNQPLHTRAPPAGKEANADADMQRLASSRRLLQAALAPVRAQSSLSAAAAAAAPAPENAFAAAPKMPPFDYTPPPYDGPRAEEISRKRAEFLSPSLFHFYDRPLNIVDGKMQYLFDEDGRRYLDAFGGIATVCCGHCHPDVVEAMVNQAKRIQHSTVLYLNHAIADFAEALAAKMPGDLKVVFFTNSGTEANELALMIARLYTGCHDIISLRNGYHGNAAGTMGATAQCNWKFNVVQTGVHHALNPDPYRGAFGSDGEKYARDVQEIIDFGTTGRVGGFISEAIQGVGGIVELAPGYLPAVYNMVRKAGGLCIADEVQAGVARTGSHFWGFESHGVIPDIVTMAKGIGNGIPIGAVVTTPEIAQVLTRRSYFNTFGGNPVSTAGGHAVLKVLEKEKLQENAFVVGSYLKERLNKLKEKHDIIGDVRGKGFLLGVELVTDRQKKTPAKVEIGHVMNHMKDMGVLVGKGGFYGNVFRVTPPLCFTKEDSDFFIEAMDISLSKL

SEQ ID NO: 89307 - protein, 422 aa, Thermus thermophilus HB27
MTTIVGVRAREVLDSRGFPTVEAEVELEGGARGRAMVPSGASTGTHEALELRDGGKRYLGKGVRRAVENVNERIAPELVGMDALDQEGVDRAMLELDGTPNKANLGANAVLAVSLAVARAAAEALGLPLYRYLGGVQGVTLPVPLMNVINGGKHADNRVDFQEFMLVPAGAGSFAEALRIGAEVFHTLKAVLKEKGYSTNVGDEGGFAPDLRSNEEAVELLLLAIERAGYTPGQEVSLALDPATSELYRDGKYHLEGEGKVLSSEEMVAFWEAWVEKYPIRSIEDGLAEDDWEGWRLLTERLGGKVQLVGDDLFVTNPERLRAGIERGVANAILVKVNQIGTLSETLEAIRLAQRSGYRAVISHRSGETEDSFIADLAVAVNAGQIKTGSLSRSDRLAKYNQLLRIEEELGRAARFLGYAAF

SEQ ID NO: 89308 - protein, 386 aa, Oryza sativa Indica Group
MMIHRQSLQHNHTEGEEKPKPDDDSTVASGGKDVGEDDGRIPLPGPPLFYNVSLIMSRRSRCVLLAFGYAYPAYECYKTVELNKPEIEQLIFWCQYWILVALMTVMERFGDFTISWLPFYSEAKLMFFIYLWYPKTKGTTYIYGTFFRPYISQHENEIDRNLLELRARATDVVVLYFQKAATVGQNTFFDVLKYVASQSPSQRSRQQPSQEPQQPKQQQAPVQQQPTQKQAPTVLRRSASIAARQAAMAQQSQDAKTVPSSPKIKRQASTKAAPVASTKLTGAAAPSTPKSDADAPKKNEAAPASLQVPTPATKADVPASEPSAPLPEAEEADKMAIDEADDAVEGTEEGDPVPGETVEERPMEETIRVTRAKLRRRTASEDPAGN

SEQ ID NO: 89309 - protein, 243 aa, Picea sitchensis
MDRYQRVEKPRPETPINENEIRITTQGKMRNYITYATSLLQKEKASAEIILKAMGRAINKTVTIAEIIKRRIAGLHQITSIGSIDITDSWEPLEEGLLPLETTRHVSMITITLSTKELDQTSTGYQPPLPVDQVKPLIEFEYDGEGSPIGGRGRGRGGRSRGRGRGNFMMGGDYNGDGNYIRGRGRGRGRGWGRGRGRGRGYSTIDANQEAGRDRGRGRGRGRGRGYRSDGSIQVAAGPVTAP

SEQ ID NO: 89310 - protein, 474 aa, Thermus thermophilus HB27
MPPFKRTKIVATLGPATDDKEVIRALAEAGADVFRLNFSHGAPEDHRRRVGWVREVAEELGRTLAVLQDLQGPKIRVGRFREGQVLLRPGQRFVLTAEPVEGDEHRVSVSYKGLPEDVSPGQILLLDDGRIRLKVLEVRSPEILTEVEVGGVLSNNKGINIPGADLSIPALSEKDIQDLALGAELGVDWVAVSFVRTRDDLLLARHYLSRYGSKARLMAKIEKPSAVARFEEILEEADGIMVARGDLGVEMPLEEVPIVQKRLILRCIAAGKPVITATQMLESMVQNPSPTRAEASDVANAIFDGTDAVMLSAETAAGAYPVEAVAMMSRIAKAVESSPEFLQKLNVLRPAPTPTTQDAIAQAADDVVEAVGARAIVVFTATGGSARRIARTRPQVPILALTPNPEVRNQLALVWGVYPHLAPDPQDTDDMVRIALREVKALGLAQVGDRVVIAAGVPFGVRGTTNLIRVERVG

SEQ ID NO: 89311 - protein, 615 aa, Thermus thermophilus HB27
MILDKVNSPEDLKRLSLEELLLLAEEIRSEIIRVTAQNGGHLASSLGAVELVLALHRVFDSPRDRILFDVGHQAYAHKLVTGRKDRFHTLRKEGGISGFTKVSESPHDAITAGHASTSLANALGMVLARDLMGEDYHVVAVIGDGALTGGMALAALNKIGELQKRMLIVLNDNEMSISENVGALNKYFKELQIRKWVQDAEKLGKNILERISPQLFGLVDRAKEAAKLLLHQENPFYAWGIRYVGPVDGHDLKGLVHILEHLKALDGPTLLHVVTKKGKGYKVAEADPIYWHGPPGFDPKKPEKVSKGYTWSQAFGDAVTELAHMEPRLFVLTPAMREGSGLVRYSLEHPERYLDVGICEDVAVTTAAGLALRGMKPIVAIYSTFLQRAYDQVIHDVAIENLPVVFAIDRAGIVGADGATHHGVFDIAYLRTVPNLQIAAPKDALELRAMLKKALEVGGPVAIRYPRDNVERAPEGVWPEIAWGKWEVLKEGTEAYILAFGKTLKYALEAAGDDPRVGVVNARFLKPLDREMLRALSRYKLLTVEDHQRMGGFGSAVLEALNEMGLKPEVQVLGLPDRFFEHGAIPSLHRQAGIDAEGIRKALAAMGVAVVHERA

SEQ ID NO: 89312 - protein, 518 aa, Clostridium perfringens str. 13
MSILIVKNMNHGFGDRAIFEDVSFRLLKGEHVGLIGANGEGKSTFMNIITGKLMPDEGDVQWSNKVRVGYMDQHAQLEKGKTIREVLREAFQYLFDMEVEMNGLYERMGEMSEDEMTKALERTATIQDMLDHNGFYMIDAKVEEVAAGLGLRDVGLDKDVTDLSGGQRTKVLLAKLLLETPDILLLDEPTNYLDEEHIAWLKNYLIGYENAFILISHDIPFLNSVVNVIYHVENRALTRYTGDYDNFMRVYEANKKQLEAAYERQQAEIAKLEDFVARNKARVATTGMARARQKKLDKMDRIELAAEKPKPEFNFKQGRTSGKLIFEARDLVIGYDEPLSKPLNIRMERGQKIALVGANGLGKSTLLKSLMGLIKPISGEVETGDYQSIGYFEQEIKEANYNSCIEEVWQEFPGYTQYEVRSALAKCGLTTKHIESSVAVLSGGEQAKVRLCKLINKETNILILDEPTNHLDVEAKDELKRALKEYKGSILLVCHEPEFYRDVVTDVWNCEEWTTKIC

SEQ ID NO: 89313 - protein, 382 aa, Gibberella zeae PH-1
MSRTTTALVAPNLDGQFKLEQVHLYSLQPDEALVEIHASGVCHTDLACASGKLPCGKNAVLGHEGGGVVIETGSSVTNVTTGDKVLLSFSSCGTCPGCVSSHPAYCYEFNLYNFGGRRADGSATMFTMKEGRKRPMHSRFFGQSSFARHTIVHRTSIVKVPQETPLELFAPLGCGIQTGVGAIFNTLNVKPGSSVAVFGVGSVGLAAIMGAKARKAKTIIAIDLQTQRLELAKELGATHVVLGPDQDHIIDSIQDICPPIGVDFAVDCTGVPAIIETMVAALGMRGRAATVGAPGGMATAKIDIMSHLTYGKEYVGCSEGDSNPEVLIPELIDMHSRGELPLEKLVKQYHIEDYEKAFADMASGSVIKPVLTWEGLKRTSHM

SEQ ID NO: 89314 - protein, 267 aa, Sinorhizobium meliloti
HLLRFDSIHGRFPADVKVDGDAIVINNGKPIKVTAIRNPAELPHKELGVDIAMECTGIFTARDKAAAHLEAGAKRVIVSAPADGADLTVVYGVNHDKLTKDHLVISNASCTTNCLVPVAKVLHDAVGIDHGMMTTIHSYTNDQPSLDQMHKDLYRARAAALSMIPTSTGAAKAVGLVLPELKGKLDGISVRVPTPNVSVVDLKFVAKRETTKEEINAAIKAAADGPLKGVLGYTLAPNVSIDFNHDPRSSVFHMDQTKVMEGKFVSI

SEQ ID NO: 89315 - protein, 362 aa, Zygosaccharomyces bailii
MSKNIVVLPGDHVGQEIAQEAIKVLEAISEVSPKAKFNFQHHLIGGSAIDATGSPLPDEALAAAKKADAVLLGAVGGPKWGTGAVRPEQGLLKIRKELQLYANLRPCNFASESLLELSPLKPQHARGTDFIVVRELVGGIYFGQRKEDDGDGVAWDSERYTKPEVQRITRMAAFLALQHNPPLPIWSLDKANVLASSRLWRKTVEETIKNEFPQLTVKHQLIDSAAMILIKNPTQLNGIIITSNMFEDIISDEASVIPGSLGLLPSASLASLPDTNEAFGLYEPCHGSAPDLPKGKVNPVAMILSAAMMLKLSLNMAKEGEALETAVKQVLDSGVRTGDLGGSNSTSEVGDAIAKAVKQILA

SEQ ID NO: 89316 - protein, 446 aa, Zea mays
MASRVASGLLRRRAGATLGLLRSYAHVRSYNSQLSALVSATSECSNLPRRCYYLPNPSPYQVWSRSFASDNGDKFEAVVPFMGESVTDGTLANFLKKPGDRVEADEPIAQIETDKVTIDVASPEAGVIEKLIASEGDTVTPGTKVAIISKSAQPAETHVAPSEEATSKESSPPKVEDKPKVEEKAPKVDPPKMQAPKPTAPSKTSPSEPQLPPKERERRVPMPRLRKRIANRLKDSQNTFAMLSTFNEVDMTNLMKLRSDYKDEFVTKHGVKLGLMSCFVKAAVSALQNQPIVNAVIDGDDIIYRDYVDISVAVGTSKGLVVPVIRDADTMNFADIEKGINNLAKKATEGALSIDDMAGGTFTISNGGVYGSLLSTPIINPPQSSILGMHSIVQRPVVVNGDILARPMMYLALTYDHRLIDGREAVFFLRRIKDVVEDPRRLLLDI

SEQ ID NO: 89317 - protein, 396 aa, Escherichia coli
MFENITAAPADPILGLADLFRADERPGKINLGIGVYKDETGKTPVLTSVKKAEQYLLENETTKNYLGIDGIPEFGRCTQELLFGKGSALINDKRARTAQTPGGTGALRVAADFLAKNTSVKRVWVSNPSHPNHKSVFNSAGLEVREYAYYDAENHTLDFDALINSLNEAQAGDVVLFHGCCHNPTGIDPTLEQWQTLAQLSVEKGWLPLFDFAYQGFARGLEEDAEGLRAFAAMHKELIVASSYSKNFGLYNERVGACTLVAADSETVDRAFSQMKAAIRANYSNPPAHGASVVATILSNDALRAIWEQELTDMRQRIQRMRQLFVNTLQEKGANRDFSFIIKQNGMFSFSGLTKEQVLRLREEFGVYAVASGRVNVAGMTPDNMAPLCEAIVAVL

SEQ ID NO: 89318 - protein, 329 aa, Thermoanaerobacter tengcongensis MB4
MAILVCGGAGYIGSHAVYALLKRNEEVVVVDNLATGHSESVLGGKLYIGDLRDEDFLDKVFSENDIEAVMHFAASSLVGESVENPFKYYENNVCGTLSLLKAMKKHGVKKIVFSSTAAVYGEPERIPIEEEDRTEPTNPYGETKLAIEKMLKWADAAYGIKYVALRYFNVAGALETGEIGEDHSPETHLIPIILQVALGKRDKVMIYGDDYPTKDGTPIRDYIHVMDLVDAHILALEKLRKENKSEVYNLGNGEGFTVKEVIEVARKVTGHPIPAEVTGRRPGDPAVLVASSEKAMKDLGWRPKYASLEEIIKSAWMWHKNHPNGFKRD

SEQ ID NO: 89319 - protein, 368 aa, Ralstonia solanacearum GMI1000
MKTKAAIAWKSGAPLTIEDVDLQGPRAGEVLVEIKATGICHTDYYTLSGADPEGIFPAILGHEGAGVVLDVGAGVTSLKAGDHVIPLYTPECRQCKFCLSRKTNLCQAIRATQGKGLMPDGTSRFSIDGKPIFHYMGTSTFANHIVVPEIALAKIRPDAPFDKVCYIGCGVTTGVGAVVYTAKVEAGANVVVFGLGGIGLNVIQGAKMVGADKIIGVDLNPAREAMARKFGMTHFVNPKEVGNVVDHIIQLTDGGADYSFECIGNTQVMRQALECCHKGWGKSIIIGVAEAGAEISTRPFQLVTGREWKGSAFGGARGRTDVPKIVDWYMEGKLNIDDLITHTLPLERINEGFDLMKRGESIRSVVLY

SEQ ID NO: 89320 - protein, 267 aa, Sinorhizobium terangae
HLLRYDSIHGRFPAEVKVEGDTITVGGGKPIKVTAIKDPATLPHKELGVDIAMECTGIFTARDKAAAHLEAGAKRVIVSAPADGADLTVVYGVNHDKLTKDHLVISNASCTTNCLVPVVKVLNDAVGIDHGFMTTIHSYTNDQPSLDQMHKDLYRARAAALSMIPTSTGAAKAVGLVLPELKGKLDGTSIRVPTPNVSVVDFKFVAKRNTSVEEITNAIKAAANGALKGVLGYTEEPLVSRDFNHDSHSSIFAIDQTKVIEGNFVRI

SEQ ID NO: 89321 - protein, 560 aa, Arabidopsis thaliana
MGSSGDVNWKLADHPKLPKGKTIGLIVLDGWGESDPDQYNCIHKAPTPAMDSLKDGKPDTWRLIKAHGTAVGLPSEDDMGNSEVGHNALGAGRIYAQGAKLVDLALASGKIYEDEGFKYISQSFEKGTVHLIGLLSDGGVHSRLDQVQLLLKGFAERGAKRIRVHILTDGRDVLDGSSVGFVETLEADLAALRSKGVDAQVASGGGRMYVTMDRYENDWSVVKRGWDAQVLGEAPHKFKSALEAVKTLRAEPGANDQYLPPFVIVDDSGKAVGPIVDGDAVVTFNFRADLMVMHAKALEYKDFDKFDRVRVPDIRYAGMLQYDGELKLPSHYLVSPPLIDRTSGEYLAHNGVRTFACSETVKFGHVTFFWNGNRSGYFNEKLEEYVEIPSDSGISFNVQPKMKALEIAEKARNAILSGKFDQVRVNLPNGDMVGHTGDIEATVVACEAADRAVRTILDAIEQVGGIYVVTADHGNAEDMVKRDKSGKPALDKEGNLQILTSHTLKPVPIAIGGPGLSAGVRFRQDIETPGLANVAATVMNLHGFVAPSDYETSLIEVVEK

SEQ ID NO: 89322 - protein, 704 aa, Pseudomonas aeruginosa UCBPP-PA14
MHTFFIAPTGFGVGLTSISLGLLRALERAGLKVGFFKPIAQLHPGDLGPERSSELVARTHGLDTPKPLPLAQVERMLGDGQLDELLEEIISLYQRAAADKDVVIVEGMVPTRHASYAARVNFHLAKSLDAEVILVSAPENETLTELTDRIEIQAQLFGGPRDPKVLGVILNKVRGEADAANAEDGVADFARRLTEHSPLLRDDFRLIGCIPWQDELNAARTRDIADLLSARVINAGDYEQRRVQKIVLCARAVPNTVQLLKPGVLVVTPGDRDDIILAASLAAMNGVPLAGLLLCSDFPPDPRIMELCRGALQGGLPVLSVATGSYDTATNLNRMNKEIPVDDRERAERVTEFVAGHIDFEWLKQRCGTPRELRLSPPAFRYQVVQRAQKAGKRIVLPEGSEPRTVQAAAICQARGIARCVLLAKPDEVQAVAQAQGIVLPEGLEIIDPDLVRQRYVEPMVELRKGKGLNAPMAEQQLEDSVVLATMMLALDEVDGLVSGAIHTTASTIRPALQLIKTAPGYNLVSSVFFMLLPDQVLVYGDCAVNPDPSASDLAEIAVQSAASAQAFGIPARVAMISYSTGDSGSGVDVDKVREATRLAREQRPDLLIDGPLQYDAAAIASVGRQKAPNSPVAGQATVFIFPDLNTGNTTYKAVQRSADCVSVGPMLQGLRKPVNDLSRGALVEDIVYTIALTAIQADAQAPA

SEQ ID NO: 89323 - protein, 442 aa, Burkholderia pseudomallei K96243
MNALADLSRVADAMAARLAIEPAVGMTGKVLEVIGTLVRVVGLEATLGELCELRGASGALIQHAEVVGFTRNVALLSPFGTLGEINRGTRVIGLRRPLSVKVGNGILGRVIDSFGEPIDGRGELDYDALRPVLAAPPNPMSRRMVDASLATGVRIVDGLITLGEGQRMGIFAPAGVGKSTLLGMFARGASCDVNVIALIGERGREVREFVELIMGEDGMARSVVVCATSDRSSIERAKAAYAATAIAEYFRDQGKRVLLMMDSLTRFARAGREIGLAAGEPPARRGFPPSVFAELPRLLERTGMGEHGSITALYTVLAEDDSGSDPIAEEVRGILDGHIILSREIAARNQYPAIDVLGSLSRIMPQVATREHVGAAGRLRQLLAKHREIETLLQLGEYQAGSDPAADEAVAKIDRIRAFLNQRTDEYSPPDATLAALHELAR

SEQ ID NO: 89324 - protein, 264 aa, Triticum aestivum
ECRTLFKDLKFYLSREVPRESLLFIIPAFGGTVSWEGEGAPFDETDQDITHQIVDRPTQSHVFLSRHYVQPQWIFDCVNILKVIPTDDYIVGRVPPPHISPFVDNDKEGHIPDYAVTLEGYKSAGQNQVMPLPGLGDEDLGNSIVEAKSEHNEFAKKKKELEMQEKKYHEELKMEIEGTTFSNLSNKKADSAADVTDEDDETQAAMEQAEKDADDIAKSVVSRKKRGLMEAMKISNDRKKSKVELLKQRKKAAESSASAKAKRR

SEQ ID NO: 89325 - protein, 409 aa, Oryza sativa Japonica Group
MAPRKKKEVFASSQGKQIRFLHYKAETPPQRQEPNRLLLPKRPKPPTSSGPFSPPPPPPPPTRRRPMGSEEEPSQMRRALVDALAGAISGGISRTVTSPLDVIKIRFQVQLEPTTSWGVLRRDVYGPSKYTGLLQASKDILREEGILERKCSSPINVYAIYSYTIHCSTQAENICFWFIQNSPYLICVICPEDHLHLSPYLSYVSGAIAGCAATVGSYPFDLLRTILASQGEPKVYPDMRSAFLDIMKTRGFRGLYAGLTPTLVEIIPYAGLQFGSYDTFKRSMMTWNRYRYSHLNSGSEDDSVSSFQLFLCGFAAGTFSKAACHPLDVVKKRFQIEGLKRHPRYGARIESSTYKGMYHALKEIVAKEGFGGLYKGLFPSLVKSAPAGAVTFVAYEYISDWIGSKAGVE

SEQ ID NO: 89326 - protein, 927 aa, Burkholderia pseudomallei K96243
MHRFETIRQLESNARTYASSFEAVFESGAGALLRDQSGREIIDCLSCAGALPLGHNHPEVNDAIRRFFQSGHVQQALDLSTPAKFEFVKTLFETLPDDWARRAKIQFCSPSGSDAVEAAMKLTRFATGRQTIVAFSGAYHGMTRGALAAMGNLGVKSGLGLGAGDVHFAPYPYRFRCPFGTDGTETDALSVQYLRNLLADPESGVSKPAAVVVEVVQGEGGCIPVSDAWLRALRQLTRAHEIALIIDEVQTGFGRTGSMFAFERAGIRPDVLVLSKAIGGGFPLAVVVYDEVLDVWPRGKHAGTFRGNQIAMVAGKATIEILRRDRLDAHAAQMGALLVDGLREIARAHPEFGDVRGRGLMVGVEIVDPSSDGAPQDGELARAIKLEAFRNGLLVETGGRHGAVLRLLPPLIVNRADISAILERLDASIAQAKRGRGPRGGANHRSDERDGEAARPVAQGRSALPQAEPVKREAERRRGLLKPAFLLLWLGETALDFGSALMSFALAAWIFQKTGSAERFSFAVLSAAIPALLLTPVAGALADRFDRRWVIAGCDVAMAIMIGALAWLLFRGALAPGHLYFFNATSAAIGCIRMPAYRAAVTAIVPRERLTQASGFTGTSQALLRIAAPLIAGYVLADYGLKGIVGLDMLMIAAGSAAIFVALLRAAHAIRGVVGAVDASLIEGVSASFAAAVRYFKSVPMFQGLAAYNMLQESLLLLSSVMLTPLVLSTHSSSTLGLILTYGALGGLAGSLLLLVLRIEARLMSLALFADAVLAMLIALVGFSRSPAAWCAFVFLAYFASSASSACTSALWARKTPREMRGSIFALNTSMNLAAMSIVVLVGGVLCQRLFEPALADGGAWAPTVGAWLGTGKGRGIGLLLVLCGAAGCVASLLALTCTRLRHLDALVPDQTHDDARDLLRNGVAVT

SEQ ID NO: 89327 - protein, 210 aa, Thermus thermophilus HB27
MKEIWYVRHGETEWNAQRRFQGHLDVPLSPVGIGQAFRLAERLSRSRISFDRLYASDLRRARQTAEPLAQVLGLPIATTPLLREIHVGELAGLTRAEAEARFPSFLAEAAKDPWNARRPGGESMADLARRLQAFLEEVPPGRHLVVTHGGVIRAALKLALDLAGDTWRRFHIQNTSITRILYPENAVLTVADAAHLEVWADWLSDEDLKG

SEQ ID NO: 89328 - protein, 125 aa, Magnetococcus sp. MC-1
MKLLSIDDSRTIRRVISGVGAMLGFEVLEAENGMVGLKVLEESSHEVGLILLDWNMPGLNGLEVLKKVKADERFMHIPVMMVTTEGEKDNIIRAIQAGACHYMTKPFSQEEMAGRIMEAIGMGGM

SEQ ID NO: 89329 - protein, 468 aa, Pasteurella multocida subsp. multocida str. Pm70
MKSRMLGDYNKLFRLCKYLREFTPVERAIHNRGETMNEQQLLECDRQHIWHPYAALNADFPLFVVERAEGVYIQLKNGQQLIDGMSSWWSAIHGYNHPRLNHAATQQLSQMSHVMFGGLTHQPAVELAQQLVNILPESLDKIFFADSGSVAVEVAMKMAVQYQHAKGETQRCKFATIRSGYHGDTWHAMSVCDPVTGMHSLFAKGLPVQYFLPQPPVKFGQAWQPEAMQPLQDLLAQHGDEIAGLILEPVVQGAGGMYFYSPEYLVQAKALCEQYGILLIFDEIATGFGRTGKLFACEHANVVPDVMCIGKALTGGYLTLSATITNQTVADVICSGEAKCFMHGPTFMANPLACAVAAESIKLLLASPWQQRIQQIEQQLRQELRQAEALDCVAEVRVLGAIGVIEMKAPVNMASLQPRFVQNGVWVRPFGKLVYLMPPYIISSDQLSQLIHGTIRTLQEEYAHKESL

SEQ ID NO: 89330 - protein, 655 aa, Colwellia psychrerythraea 34H
MSGYFEILAILTCAVFVVWLFRRLNLPAILAYLVAGMLVGQHGLNLVQDQVDYDHFAELGIVFLLFTLGLEFSLPRLMAMRHLVVSVGSLQVGISLLVFIIAGLFFGLSFSEAFVVGSILALSSTAIVIRQLSETGAMKRKSGQLSVAILLFQDVAVVPLLIIIPMLAMDSQSSMVWALMLAMVKGVVVVALLLLIGKWLLPKVFNIIAQVRTDELFVLTTLLVTLLAAAFTQWFGLSMALGAFLAGMMLSESEYKHQLEADIRPYRDILLGLFFITVGMKLDVSLLISSPFSLLGLMLCFMLVKIMVIKILAVKAGESSKDAWASGLMLAQMGEFGFVLIALANQSQILPLDVASMLLGAGVISMAITPFMINNARSWALFLSQEKSPESLDLSQLPENKVLENHVVICGFGRVGQTVSRFLKQDEIDFVAIDVDPLRTQKAREAGEKVLFGSSRQTEVLNAAHLSEAKLVVIAFGDDKQSLEVIQKVRSMNEKVPILVRTRNDDQLDALQAAGANEVVPESLEGSLMLVSQVLSLTGVPFSRIMRRVQRERKNHYNHLHGFFQGEHTDMSPQAIDRIEFAHAILINDNSFSCGKSIESLNLGKMRVNVVALRRGDIECESPGKDTVLQAQDTLIIRGKPRGVEKADHYVQEGK

SEQ ID NO: 89331 - protein, 183 aa, Clostridium perfringens str. 13
MKNNDSKISKYISLILRHKPEEIGLKLDEHGYLGVLDLIEGLNKSYKGFSMDDLERIVREDSKGRYSFNEDKSKIRANQGHSIKVDLGLEAIKPPKVLYHGTGRKYIESILKNGLIKKERQYVHLSKDIETASIVGKRHGDLVILEVDSESMFKDGIKFYLSKNNVWLCDYVKVEYIKEISLL

SEQ ID NO: 89332 - protein, 503 aa, Pseudomonas putida KT2440
MRYPMKDSSDTHPNHLPDSCYGLFIDNQWVTAEYGETLDIINPANGKILTNIPNATAADVDRAVQAAQRAFVTWRTTSPAERANALLKIADLLEADADRFAVLETLDVGKPIRESRSVDIPLAIDHFRYFAGVIRSQSDEAVMLDEQTLSIALSEPLGVVGQVIPWNFPLLMAAWKIAPAIAAGNTVVIKPSELTPVTILELAKIFAKVLPAGVVNIVTGLGTTVGQALLDHPDLRKLAFTGSTRVGELVANAAAKKIIPATLELGGKSANIVFPDANWDKAVEGAVLAILWNQGQVCESGARLFVHESIYERFLAELKHKFEAVRVGDPLNPDTMMGAQVSKTQMERILGYVDIAKEEGAEVLIGGGRLTGADYDAGFFIQPTILVGVRNDMRVAYEEIFGPVLCVIPFKDEAEVIAMANDSEYGLAGAVWTQDINRALRVARAVETGRMWVNTYHEIPAHAPFGGYKKSGLGRETHKSMLEAYSQKKNIYVSLNEAPLGLF

SEQ ID NO: 89333 - protein, 396 aa, Escherichia coli
MFENITAAPADPILGLADLFRADERPGKINLGIGVYKDETGKTPVLTSVKKAEQYLLENETTKNYLGIDGIPEFGRCTQELLFGKGSALINDKRARTAQTPGGTGALRVAADFLAKNTSVKRVWVSNPSWPNHKSVFNSAGLEVREYAYYDAENHTLDFDALINSLNEAQAGDVVLFHGCCHNPTGIDPTLEQWQTLAQLSVEKGWLPLFDFARQGFARGLEEDAEGLRAFAAMHKELIVASSYSKNFGLYNERVGACTLVAADSETVDRAFSQMKAAIRANYSNPPAHGASVVATILSNDALRAIWEQELTDMRQRIQRMRQLFVNTLQEKGANRDFSFIIKQNGMFSFSGLTKEQVLRLREEFGVYAVASGAVNVAGMTPDNMAPLCEAIVAVL

SEQ ID NO: 89334 - protein, 405 aa, Picea sitchensis
MGKMCEESVNHVNQMFPKVDTLSFNGEGCVVPLKTAGKVITCRAAIAWGPKQPLVIEEVQVDPPQAMEVRIKITHTSLCQSDVTFSIHGDESLQAFPCIFGHEGAGIVESVGEGVTDIKEGDHVIPLFIGECGDCACCKSNKTNLCEKFNIVRNDVKEPRFSIRGKAVHHFMNTSTFSEFTVVDSKCVAKINPETPLDKACLFGCGITTGVGAALYTADIEPGSTVAIFGLGTVGLAVAEGARIRGASKIIGVDTNPNKFIKAKALGVTECINPKDHEKPIQEVITEKSEGGVDYSFECIGNTDVLYQAFLATRPALGLTVLLGVDISPRKISLHPIDLFSGRRIVATTFGGVKGKTQLPYLVEMFMNKEIRVEEFITHELPFSEINRAFELLLEGSCLRCVLHL

SEQ ID NO: 89335 - protein, 162 aa, delta proteobacterium MLMS-1
MRLELLLLGKTRQDYLARGIDDFSRRLRRYVELEIKVIKPPKPPGAAGRQGGGAERELIREEGRLLLSRLTPGSCLVALDAGGRQLDSPGLADLLERWQQQGKSRLSFVLGGHLGLDSAVLERAELVLALSRLTFTHEMARLLLLEQLYRAWTIQQGGNYHK

SEQ ID NO: 89336 - protein, 308 aa, Triticum aestivum
  misc_feature (130)..(130): Xaa can be any naturally occurring amino acid
  misc_feature (212)..(212): Xaa can be any naturally occurring amino acid
  misc_feature (221)..(221): Xaa can be any naturally occurring amino acid
  misc_feature (229)..(229): Xaa can be any naturally occurring amino acid
  misc_feature (252)..(252): Xaa can be any naturally occurring amino acid
  misc_feature (263)..(263): Xaa can be any naturally occurring amino acid
EVFQEGGRRIPDVAPGRLAEAQPGEGENFLSYNPLPGTPRLTTAAMACAFSASTVSTAAALVASPKPAGAPQCLSFPRAIAGAAARPSRLAAASSRTARARSFVARASAEYDLPLVGNKAPDFAAEAVVXQEVINVKLSDYIGKKYVILFFYPLDFTFVCPTEITAFSDRHEESEKINTEILRVPVDSVVSHLAWVQTERKSGGLGDLKYPXLVSDVTKSXSKSFGVLXPDPGIALRGLFIMDKEGVIQHSXLTPLVSGRSVXETLGTLPALQYVQENPDEVCPAGWKPGEKSMKPDPKGSKEYFAAI

SEQ ID NO: 89337 - protein, 119 aa, Streptococcus pyogenes MGAS315
MDKIVLEGCRFYGYHGAFKEEQTLGQIFLVDLELSVDLQAASLSDQLTDTVHYGIVFDSVRQLVEGGKFILIERLAGAICEQLFNEFPPIEAIKVAIKKENPPIAGHYKAVGIELERQR

SEQ ID NO: 89338 - protein, 266 aa, Mesorhizobium mediterraneum
HLLRFDSVHGRFPHEVTVDGDQITVGTEKFKVTAIKDPTQLPWRELGIDIALECTGIFTARDKAAAHLTAGAKRVLVSAPAEGADLTVVYGINHDKLTKDHIVISNASCTTNCLAPLAAVLHEAVGIEKGMMTTIHSYTGDQPTLDTMHKDLYRARAAALSQIPTSTGAAKAIGLVLPDLKGKLDGISIRVPTPNVSVVDFKFIAKRPTTVQEINEAVIAASKGKLKGILAVTHHPNVSIDFNHDPHSSIMALDQTKVMDGNFVSV

SEQ ID NO: 89339 - protein, 167 aa, Lactococcus lactis subsp. lactis Il1403
MRLERKIKMKIKLVVVGKLKEKYLKDGIAEYVKRMGTMLPLEIIELADEKIPDNASEKEAEALKKREGEKILSRIQAGDQLAILAIQGKLMSSEEVADFVKKAEVYGTGNLVFVIGGSLGLSKEVYQRSDLQISFGRMTLPHQLMRLVLVEQIYRAQMINRGSAYHK

SEQ ID NO: 89340 - protein, 469 aa, Thermoanaerobacter tengcongensis MB4
MNEIGLIGLAVMGQNLALNIARKGYSVSVFNRTSEKTKEFLEERVKNEKIEGYHDIKSFVESLKKPRKIILMVKAGKPVDDVIQELLPYLEKGDLIIDGGNSYFKDTSRRIKELKEKGILYLGMGVSGGEAGALHGPSLMPGGSIEAYEMVKDVLLKIAAQTESGPCCTYVGNDSAGHFVKMVHNGIEYAIMQAISEVYDIMRKILKFSPEEIGDVFERWNNGELNSFLMEISFKIMRYKDEETGKHLVDLILDEAEQKGTGKWTSQTALDLGIPTPSLSLAVEARSLSFFKEDRVKLSGKVKKTYPDVKLDKEKVIKDLENALLFSVFTSFSQGLWLIHEASKTFEYNIDLPEVLRIWKGGCIIRAKILDFLREILNENKENVNLLDSDKSISFLMDKLDSIRYVTNLAKEFYIPTLVLSSSLDYFLSMVEGNLPANLIQAQRDFFGAHTYRRIDKEGIFHTEWEPID

SEQ ID NO: 89341 - protein, 445 aa, Glycine max
MAKVCWPYFDPEYENFSNRMNPPRVSVDNASCHDCTLIKIDSVNKPGILLEVVQILTDLDFVITKAYISSDGGWFMDVFHVTDQQGKKITDSKTIDLIEKALGPKSKSTEGVKNWPSKHVGVHSVGDYTAIELIGRDRPGLLSEISAVLANLHFNVFAAEVWTHNRRIACVLYVNDATNQVADDPKRLSLMEEQLNNILRGCDGEKVARTSFSMGSTHMDRRLHQMLFADRDYESYAVAREVDSPPSLRPRITIERCEEKGYSVVSVKCKDRAKLMFDIVCTLTDMQYVVFHATVSSDGPYALQEYFIRHMDGCTLDTQGEKERVIQCIEAAIRRRVSEGVSLELCAKDRVGLLSEVTRILRENGLSVCRAGVSTRGEQALNVFYVRDASGNPVDMKTMEALCKEIGKTMMVDVKRVPSNTKAPETRGWAKTSFFFGNLLERFLT

SEQ ID NO: 89342 - protein, 437 aa, Methanosarcina mazei Go1
MRPMASELTTFVLIFGTLLFVFGLFSRKIEGTVVTIQMIFLAAGILLSPIGLNLISLSPRSGLVLGVIKVALVLTFFSDASLIGLHSLFLKERLSVRLLFLGLSLTICLGTVFAALLFADITFIDAILLGIILAPTDASLAQKVVEERQVPTLIRNGLIIESGLNDGAVMPLFIFVVALEAVEKLNRPLGTFLAIALEQIGFGIFVGIIIGLVGGWLFSRAFKAGSMSEVYYRTEFVALALISWLVADGVGGNGFIAAFIAGLATRIEDRQVTEEEVILLPRAEGNVLNLAVLFILGVMSAEYLPLVDLKIFAYAVLSLTVVRMVPVTISLIGSHLNIKTGLFMGWFGPRGLASIVLMLITVERIEGIRVSGTIGLAVITTVIISVFAHGITAGPVSNWYARIIATLPPDAPEKESVEELTALQGIETTENIHKEPY

SEQ ID NO: 89343 - protein, 252 aa, Pasteurella multocida subsp. multocida str. Pm70
MKKSNLFVLTLGALALTACTSPLKKEETHTHWGYTGHESPEHWAELSPKFRICGEGKNQTPIDIKHTIDGKLAPIKLDYRPSNVEIVNNGHTIQVDFKEASNRMQLNGKTFTLKQFHFHVPSENLIRGKSFPMEAHFVHADNEGNLAVLGVLYVLSSENQRLAPIWQNFPQKAGEKYTLSTAFDPATLIPKKRDYYRFSGSLTTPPCSEGVNWLVLKHYDNISQSQVEAFATLMKGHNNRPVQPINARVIVE

SEQ ID NO: 89344 - protein, 248 aa, Bradyrhizobium japonicum USDA 110
MVLLEGKVAVITGAGSGIGAAIARLFAVEGAKVLLGDLAEGGAALAAGLAADGHAAGFQHVDVTDEASVAELMQAAVTLFGRLDILVANAGIPERKSPIHELDLVDWRRVIDVDLTGVAICNKFAAGIMRATGGGAIVNMASILAHVGQENSNAYSAAKAAVVNLTRSVALTYALQGIRANCVSPGYVDTPLLAKLPEATRQAMLVRQPIGRLARPGEIAEVVAFLASDKASIITGACVNADGGYTAI

SEQ ID NO: 89345 - protein, 358 aa, Candida glabrata CBS 138
MFRTVQRRGMASMAKELVLPKKYGGRYTVTLIPGDGVGKEITDSVVSIFEAENIPVDWERVDISTSDNIQDVSQAVESLKRNKIGLKGIWHTSADIADHGSFNVALRKQLDMFAHVAFFKSVPGVKTKIPNVDLVVIRENTEGEYSGLEHESVPGVVESLKIITKAKSERIARFAFDFAKKYNRKSVCAVHKANIMKMGDGLFRNTVTEIGANEYPDIQTSSIIVDNASMQAVAKPHQFDVMVTPSMYGTIIGNIGAALIGGPGLVAGAHYGREHAVFEPGSQHVGLDIKGKNVANPTAMILSSTLMLQHLGLTESAKRIAKATHDVISLGQVTTKDIGGSASTTEFTEAIIKRLGEL

SEQ ID NO: 89346 - protein, 663 aa, Brassica oleracea var. acephala
MATDSAMFASSRRRQSPSLEAFLSPVDLSDVPLLRTLSSTSSEIVSCFSNARFSFQRRNTRSLIRKVQVIAVLLQHLAPESSLDPTAVLCFKELYLLLHHSKFLLRYCAHSSKLWLLLQSPSLSSFFHDLSKDYSTLLDVLLPAESLCLNDDVREQVQLLHMQHYVDDNNDETLRNRLYSFLDEFENGSVPNSEELSFFFFEKLGIKDPTSYRDEIEFLEEKIKTYGCDLEPTRSVINGFVDITRYVMFLLFKIEDSNEIKKQRKGLISEEIENTFTTLPKDFICSISLNIMNDPVVIVSTGQTYDRSSIARWIHQEGRSTCPKTGQKLVDLSFVPNLALRHLTTLWCQVNGLSHDSPPPKESLPKVFQTRASTEANKAAISILVRNLAHGSELAAGEIRVLTRTVTETRTLIVEAGAIPYLRSLLKSENAVAQENAVASIFNLSIDEANRSLIMEEHDCLEPIMSVLVSGLTMRAKEIATAALYTLSSVHDYKKTIANADGCIESLALVLRNGTVRGKKDAVYALHSLWLHPDNCSLVVKRGGVSALVGALGEESVAEKVACVLGVMATESLGAESIGREETVVTGLMELMRCGRPLGKEKAIATLLQLCTLGGAVVTEKVVKTPALAVLTRKLLLTGTDRAKRKAVSLSKVCKGCDQKTQR

SEQ ID NO: 89347 - protein, 269 aa, Colwellia psychrerythraea 34H
MFSRIKEDINSVFDRDPAARTSFEVILNYPGLHAIWIHRLSYRLWCADWKLIARTISTFSRWLTGIEIHPGAKLGRRVFIDHGMGIVIGETAEVGNDVTLYHGVTLGGTSWKAGKRHPTLEDNVVIGAGAQVLGPITIGKGGKVGSNSVVVKDLPANATAVGIPGRIVPDKHSKDENQQREEVAKKYGFDAYAVSHDNPDPVAKAIGRLLDHMHLMDDRVSELCKEINTLGGDICPKNLPELRVGEFVEDEKAAAERRENKVASFDPEI

SEQ ID NO: 89348 - protein, 500 aa, Colwellia psychrerythraea 34H
MSITEVPLIINGEKVRSQTTEWLDVLNPATQEVVARVPIATAEEIELAVQSAQTAFKTWSKTSLTNRMRIMVNFAHLVRENTQELAELVTLEHGKTLPDAEGEVGRALEAIENASSVTRLQLGDMGNNVATGVDTYTLHKPLGVGLGITAFNFPLMLAAFMFPPAIACGNTFVLKPSEQAPSSTVRFVELAIEAGLPAGVINVVHGGPDAVNALIEHEHVKAVSFIGSTHVGTHIYNHASKHGKRAQSMMGAKNHMVIMPDANKDRAINDLLGSAFGAAGQRCMANPVTILVGKSRDWLPEIVERAKLMKVGPGSQRDADLGPVVSPQAKKRIISLLDSGVEQGATMLIDGRNCQVEGYPNGNFVGPTLFTNVTTDMDIYTQEIFGPALCVLEAETLEEAIAIINANPNGNGTSIFTSSGWNARLFENEIDVGQVGINVPIPVPVAFFSFTGSRASKLGDLGPNGKQTVSFWTQTKSVTARWFEPDHEDGLNVHTTISMK

SEQ ID NO: 89349 - protein, 331 aa, Capsella grandiflora
RTYAWVANRDHPISSSDGTLKISGINLVLLNQSNITVWSTNLTRAVRSPVVAELLGNGNFVLRDSKSNGKDRFFWQSFDYPTDTLLPHMKLGFDLKTKNNRFLTSWRNAYDPSSGSFAYELQIPKNGLPEFFMLRSGGPALRSGSWDGFRLSGIPEMQRWSFLNIVYNFTENKEDVAFTYSITTPNVYAKLTMKFDGFLELSSWDPEMLEWNVFWVSSTTDCDTYMGCTAYSFCDLNTTPKCNCIKGFEPQGGTMDNRSTECVRKTPLECNGDGFFGLKNMKLPYTSGAIVDKSIGLKECEERCSGDCNCTAYANTNLQDGGSGCVMWTSE

SEQ ID NO: 89350 - protein, 143 aa, Thermus thermophilus HB27
MTVRQVLVHKGGGVHAIHPEATVLDALRKLAEHDIGALLVMEGERLLGIFTERDYARKLVLLGRFSKDTKVREVMTTDVPTVAPEASLEEAMRLMTERRTRHLPVVEGERVVGVVSIGDLVKAIITHQGMLIAELSRYVSENR

SEQ ID NO: 89351 - protein, 397 aa, Kluyveromyces lactis NRRL Y-1140
MPNKNIDIKTINSDVELSQFTLQPVEPVYREETFSGSDEPITVGQEVGSSNATTTTPSSSSRLVSKRHLPRVKILGTGGTIASKGGKASDTAGYHVDLTIHELLEAIPDITDVCEIEYEQLCNFDSKEIGLAELYKIYTGVCDSLQKFDGIVITHGTDTLAETTFFIESTIDAGQVPIVFVGSMRPSTSISADGPMNLYQAICIAANRESRGRGVLISLNDQISAGYYITKTNANSLDSFNVRQGYLGNFVNNEIHYYYPPVKPIGCHKFKLNLEDDLQLPAVCILYAHQCFSPELVEMAAERYDGIVIATMGAGSLSTPVNEMCMRLKVPIVYSKRSMDGMIPVANLPLPPSDPSSTIIASGYLNPEKSRILLQLCLKQQYNMEKIRTVFKGVYGG

SEQ ID NO: 89352 - protein, 241 aa, Ustilago maydis 521
MFDSIEDAVADIRAGKFVVVLDDEDRENEGDLIISASLCTTQQMAWFIQHTSGFICIALTPDRIAQLEIPMMVPNNTEKNKTAYTVTVDYKHGTTTGISAHDRALTSRQLADESLSAQADDFTRPGHMNPLRYTQGGVRVRMGHTEASVDLCKLAGLPPAGLLCELVDPDDEDGGIASRDACLKFAKKWGLKVTTIEMLKKYREQKEGELAHDDRQRLADDQVRGVKIDVQKVVPPTTTAA

SEQ ID NO: 89353 - protein, 87 aa, Oryza sativa
MALSLMASRATTVCPLQGLKSTAGMPVARRSGNSSLCNVSNGGRIRCMQAWPIEDIKKFETLCYLSPITVEDLLKHIEYLLRSKWVP

SEQ ID NO: 89354 - protein, 304 aa, Thermus thermophilus HB27
MRVEGAIGKTPVVRLAKVVEPDMAEVWVKLEGLNPGGSIKDRPAWYMIKDAEERGILRPGSGQVIVEPTSGNTGIGLAMIAASRGYRLILTMPAQMSEERKRVLKAFGAELVLTDPERRMLAAREEALRLKEELGAFMPDQFKNPANVRAHYETTGPELYEALEGRIDAFVYGSGTGGTITGVGRYLKERIPHVKVIAVEPARSNVLSGGKMGPHQFQGMGPGFIPENLDLSLLDGVIQVWEEDAFPLARRLAREEGLFLGMSSGGIVWAALQVARELGPGKRVACISPDGGWKYLSTPLYAEP

SEQ ID NO: 89355 - protein, 267 aa, Sinorhizobium medicae
HLLRFDSIHGRFPADVKVEGDSIIINNGKPIKVTAVRNPAELPHKELGVDIAMECTGIFTARDKAAAHLEAGAKRVIVSAPADGADLTVVYGVNHDKLTKDHLVISNASCTTNCLVPVAKVLHDAIGIDHGMMTTIHSYTNDQPSLDQMHKDLYRARAAALSMIPTSTGAAKAVGLVLPELKGKLDGISVRVPTPNVSVVDLKFVAKRETTKEEVNAAIKAAADGPLKGVLGYTLQPNVSIDFNHDPHSSVFHMDQTKVMKGKFVSI

SEQ ID NO: 89356 - protein, 168 aa, Avena agadiriana
VMASSATSVAPFQGLKSTAGLPVSRRSNAGLGSVSNGGRIRCMQVWPIEGIKKFETLSYLPPLSEEALLKQIDFLIRSKWVPCLEFSKVGFIFREYGSTPGYYDGRYWTMWKLPMFGCTDASQVIKEVEEVKKEYPDAYVRIIGFDNIRQVQCVSFIAFKPPGCEESG

SEQ ID NO: 89357 - protein, 658 aa, Bacillus anthracis str. Sterne
MIEKYKHGKVKKLFEVKTLILLQVNALSKLYGAETILANIKLEVQTKDRIALVGRNGAGKSTLLKIIAGELSHDGGEIIKPKDVSMGYLAQNTGLETSLTIWDEMLTVFTHLQQMETKLRRLEQEMGKEENFSNEATYERLLADYDQLQLDYKDQGGYQYEADIRSILSGLGFPVETHQTTISTLSGGQKTRLALGKLLLTKPDLLILDEPTNHLDIETLTWLEQYLQGYPGAILIVSHDRYFLDKLVTQVYEISNKESRRFVGNYSKYLDLKSALYEQEMKRYEKQQDEIAKLEDFVQKNIARASTTKRAQSRRKQLDRMELLTRPLGDSKSASFHFDIEKQSGNDVLQVKDATIGYDKDPIIEHVTMRLTRGDSVALVGPNGIGKSTLLKSIVNKLPLLHGDVSFGSNVSVGYYDQEQANLTSSKRVLNELWDEYPLQPEKEIRTILGNFLFTGDDVLKPVSSLSGGQKARLALAKLMMQKSNLLILDEPTNHLDLNSKEILENALIDYPGTLLFVSHDRYFINRVTTTVIELSTEGAQEYLGDYDYYVEKKNEMIERAELEQEDETPVQKTVAQEKLNYLEEKERKKLERQRTRKIEELEQNIVQFEEEIATLEDQLCLPEIYADYEKASEITTKKQTLQEQLDACMAEWEELHV

SEQ ID NO: 89358 - protein, 267 aa, Sinorhizobium kostiense
HLLRFDSIHGRFPADVKVEGDAIVINNGKPIKVTAVRNPAELPHKELGVDIAMECTGIFTARDKAAAHLEAGAKRVIVSAPADGADLTVVYGVNHDKLTKDHLVISNASCTTNCLAPVAKVLNDAIGIDHGMMTTIHSYTNDQPSLDQMHKDLYRARAAALSMIPTSTGAAKAVGLVLPELKGKLDGFAMRVPTPNVSVVDLKFVAKRETTKEEVNAAIKAAAEGPLKGILGYTLAPNVSIDFNHDPHSSVFHMDQTKVMEGKFVSI

SEQ ID NO: 89359 - protein, 187 aa, Burkholderia sp. 383
MPIINTQIKPFKATAYHNGDFVPVSEENFKGKWSVVVFYPADFTFVCPTELGDLADRYAEFQKLGVEIYGVSTDTHFTHKAWHDTSDTIGKIKYPMIGDPTLTLSRNFDVLIEEEGMALRGTFVINPEGEIKLCEIHDNGIGRDAGELLRKVQAAQYIAAHPGEVCPAKWTPGAETLTPSLDLIGKI

SEQ ID NO: 89360 - protein, 235 aa, Emiliania huxleyi
MKRVLVGVGKALRDTGQAVERMGMRAQDNWIFQEKICRHRALMNLFDQRPKLRPSVFVAPNASLIGNVSVMDESSIWYGAVVRGDQSPVDIGGKSSIGDRSVVLSASVNPTGFAAKTSIGDWVTVGQGCVLRGCTVDNFAVVGDGCVIGEGALVETHGVLEAGSVLPAGGLVPRGEVHGGNPAAFVRKLEKDEIAAIEKKAEDVSMSAKKHADEFLAYSNTYQLREQLGTAAGKI

SEQ ID NO: 89361 - protein, 345 aa, Vitis vinifera
MDKRLRLLFILFIIRLPTLVLGECACDEEDEDRDRDKALRYKIAAIASILVGGTIGVCIPIIGKKIPALQPEKNVFFVIKAFAAGVILATGFIHVLPDAFESLTSPCLSENPWANFPFTGFVAMLSAIGTLMVDSLSTSYYTRSHLKNSLPVLGDEEKVGEHEGQVYVHTHATHGHTSADEVGSDLIRHRVISQVLELGIVAHSVIIGISLGASESPQTIKPLVAALTFHQFFEGMGLGSCIVQAKFKSRAATIMGLFFSLTTPVGIGIGIGISQVYDENSSTALIIEGIFNAASAGILIYMALVDLLAADFMSPKMQTNEMLKVMANISLLLGAGCMSLIAKWA

SEQ ID NO: 89362 - protein, 239 aa, Oryza sativa
MKLNISYPANGSQKLIDIEDERKLRVFMDRRMGQEVPGDSVGDEFKGYVFKITGGNDKQGFPMKQGVMHPTRVRLLLADGHSCYRARRTGERKRKSVRGCIVAADLAVLALAIVKQGDADIPGLTDTVHPKRLGPKRATKIRRFFGLSKEDDVRKFVIRREVQPKAEGAKPYTKAPRIQRLVTPQRLQHKRHRIALKRRQAEASKDAANEYAQLMHKRVHEEKAKKEEIRKRRASSMHK

SEQ ID NO: 89363 - protein, 259 aa, Xylella fastidiosa Ann-1
MVAVNLKTKEEIEQMRIAGRLAATVLDVVAPYVKPGVTTAELDQICHNYIVTVQGAIPANLGYRGFPKTICTSVNNVICHGIPSDAKVLKDSDIINIDVTVIKDGWHGDTSRMYYVGNPSVMARRLVETTYEAMWRGIRAVKPGATLGDIGHAIQTYAENERFSVVREYCGHGIGKVYHDNPQVLHYGRPGEGLVLESGMTFTIEPMINEGTRHHKVLPDGWTVVTKDRKLSAQWEHMIAVTEDGVDVLTLSPNDIGST

SEQ ID NO: 89364 - protein, 432 aa, uncultured Acidobacteria bacterium
MAEFQRTNTVSQPLIVREVLPSGLRLITEQMPHVRSVSIGVWLARGARHEPPEHGGIAHFVEHMLFKGTESRSAEDIAQAIDSIGGQMDAFTAKEYAGYYLKVLDEHLPFAVEVLSDIVMNPAFSDDDIEKEKKVILEEIKMVEDTPDDLVHELFTENFWADHPLGRPILGTRETVESLAQENLRRYFGGAYSAPHLIVSAVGNIEHARVLQLIANAFERLPTTAIAIDGQPPRKTTSVLVRNKELEQSHVCLGTHGYQQDHEDRFASYVLNTVLGGSMSSRLFQNVREKRGLAYAVFSGLVAYRDTGSLTIYAGCANEAVGELIDVVVAELRRMRIEPLSDAELTRARDHLKGSLMLGLESTSSRMSNLARQEIYFERQFGLDETLAGIGRVTRDDVQRVAADLLANDALSATVLGAVNGLEIPRERISLG

SEQ ID NO: 89365 - protein, 351 aa, Vitis vinifera
MDKLLRLLFILFLITLPTLVLGDCTCDKDDGDRDKNKALRYKIAAIIAILAGGAIGVCIPILGKTIPALHPEKNVFFIIKAFAAGVILATGFIHVLPDAFENLTSPCLSENPWGNFPFTGFVAMVSAIGTLMVDACATSYYSRSHFKKAQQAVGDEEKAGEHEGHVHVHTHGTHGHAHGSASSAEEMGSAELIRHRVISQVLELGIVVHSVIIGISLGASESPKTIKPLVAALTFHQFFEGMGLGGCIVQAKFKLRAAAIMALFFSLTTPVGIAIGIGISNVYDENSSTALIVEGIFNAASAGILVYMALVDLLAADFMNPRMQGNGRLQVGANISLLVGAGCMSLLAKWA

SEQ ID NO: 89366 - protein, 267 aa, Ensifer adhaerens
HLLRFDSIHGRFPADVKVEGDAIIINGGKPIKVTAIRNPAELPHKELGVDVAMECTGIFTARDKAAAHLEAGAKRVIVSAPAEGADLTVVYGVNHDKLTKDHLVISNASCTTNCLAPVAKVLNDVIGIDHGMMTTIHSYTNDQPSLDQMHKDLYRARAAALSMIPTSTGAAKAVGLVLPELKGKLDGFAMRVPTPNVSVVDLKFVAKRETTKEEINAAIKAAADGPLKGILGYTLAPNVSIDFNHDPHSSVFHMDQTKVMEGRFVSI

SEQ ID NO: 89367 - protein, 338 aa, Ralstonia solanacearum GMI1000
MYSAHDVRVENVPDATIVEPTDAIVRVTQACICGSDLWPYRAMEPSETGQSMGHEAIGVVEAIGSGVNKIKVGDVVIMPFAYSDGRCEFCHEGLQTACVHGGFFGYGGFNGAQAEALRIPQADGTLYALPGGVDSALMASLLTLSDVMGTGHHAARVARVRPGTSAAVIGDGAVGLCGVIAAKRLGAERIILMGRHPDRIALAQAFGATDIVSERGEEAIERVRALTGGHGVHSVLECVGTDQSMQTAANIARPGGAVGRVGVPHYNAIPADTTFFKNVIVGGGPAPVRAYIDDLLPDVLDGKIQPGRVFDRVIGLDEVPDGYRAMDERQAIKVMINL

SEQ ID NO: 89368 - protein, 363 aa, Salmonella enterica subsp. enterica serovar Paratyphi A str.
MSKNYHIAVLPGDGIGPEVMAQALKVMDAVRSRFDMRITTSRYDVGGIAIDNHGHPLPKATVEGCEQADAILFGSVGGPKWENLPPESQPERGALLPLRKHFKLFSNLRPAKLYQGLEAFCPLRADIAANGFDILCVRELTGGIYFGQPKGREGSGQYEKAFDTEVYHRFEIERIARIAFESARKRRRKVTSIDKANVLQSSILWREIVNDVAKTYPDVELAHMYIDNATMQLIKDPSQFDVLLCSNLFGDILSDECAMITGSMGMLPSASLNEQGFGLYEPAGGSAPDIAGKNIANPIAQILSLALLLRYSLDANDAATAIEQAINRALEEGVRTGDLARGAAAVSTDEMGDIIARYVAEGV

SEQ ID NO: 89369 - protein, 320 aa, Pseudomonas aeruginosa UCBPP-PA14
MPFSLASLQQAAAIVHQSLPPTPQIRWPLLCEALGCEVWMKHENHLPVGAFKLRGGLVYFHHLAHQGERPAGVISATRGNHGQSVAFSASRYGIQPIIVVPHGNSREKNAAMRSLGAELIEHGEDFQASREYAAERARHEGLHLIPAFHPWLVAGVASYSLELFAALADLDEVYVPIGMGSGICGLIAARDALGLKTRIVGVVSAHAPAYALSFEAGTAISHPVDTRLADGMACSTPDPSALEMILAGADRLVRVSDREIGAAMRLCFTSTHNVAEGAGVAALAAAWQERERLKGLKVGLILSGANVDREVFAEQLAAGD

SEQ ID NO: 89370 - protein, 444 aa, Burkholderia sp. 383
MTTVFHRAPRATLPVAVAGDGIEIIDSTGKRYIDACGGAAVSCLGHSNQRVIDAIKRQAQQLAYAHTSFFTTDVAEELADRLVAAAPAGLEHVYFVSGGSEAVEAALKLARQYFVEKGEPQRRHFIARRQSYHGNTLGALAIGGNAWRREPFLPLLIEAHHVSPCFAYRDQQAGETDEAYAQRLADELEQKIVELGADNVAAFVAETVVGATAGAVPPVRTYLKKIRAVCDKYGVLLILDEIMSGMGRTGYLYACDEDGVAPDLLTIAKGLGAGYQPIGATLVSDRIYRTIVDGSGFFQHGHTYLGHATACAAALEVQRVIAEEKLLDNVKARGEQLRASLRDHYGAHPHIGDVRGRGLFVGVELVRDRDSKATFDPALKLHAAVKREAMQRGLMVYPMGGTIDGVHGDHILVAPPFICTAQQIDTIVERLSGAIGAALASAGA

SEQ ID NO: 89371 - protein, 488 aa, Zea mays
MGSKSVDEVLDAAAGVHCSALRLDGPNVQFSASSEEEPTTSGLENGHQEPFVIGVAGGASSGKSTVCKMIIDQLRDQRVVAVTQESFYYGLTDEELVHVHDYNFDHPDAFHTELLLSCMQNLKHGKAVDIPNYNFKTYKSVPNARKVNPSDVIILEGILVFHDSRLRDLMNMKIFVDTDADVRLTRRIRRDTIDKGRDIKAVLDQYSKFVKPAFEDFILPTKKYADIIIPRGGDNDVAIDLIVQHIRTKLGQHDLCKIHPNLYVIQTTYQIRGMHTIIRDAATATHDFIFYADRLIRLVVEHGLGHLPFQEKQVITPTGSVYTGVEFSKRLCGVSVIRSGESMENALRACCKGIKIGKILIHREGDNGQQLIYQNLPKDIANRHVLLLDPILGTGNSAVQAISLLLKKGVQEANIIFLNLISAPQGVHVVSKRFPRVKIVTSEIEFGLNDDFRVVPGMGEFGDRYFGTDDYQSSTPFFCDDKNRVRLL

SEQ ID NO: 89372 - protein, 212 aa, Brassica napus
  misc_feature (157)..(157): Xaa can be any naturally occurring amino acid
  misc_feature (191)..(191): Xaa can be any naturally occurring amino acid
  misc_feature (204)..(204): Xaa can be any naturally occurring amino acid
GCMLSDKGPWKNPDILKMVLHGGAHRAKQVVKVLNSEGKVIAYAKPSYPWIKGSDTSTAESGSEAEDVVVSPKAIKNYSHLRLTPVREEAKIGSGETSFAGSLAGYDEYVPMVDKAVDATWKVKPTTTINRVQSKGVLVTPNVPKENESFSARVLVXFMAIVMAILAFFRTVSNRVVTKQLPPPPPKIEGXAAAREEEAELLNXVLKKLTEL

SEQ ID NO: 89373 - protein, 617 aa, Lactobacillus rhamnosus
MAFSKETRTQTIDQLKQTELDLLIVGGGITGAGVAIQAAASGLKTGLIEMQDFAEGTSSRSTKLVHGGIRYLKTFDVGVVADTVKERAVVQGIAPHIPRPFPMLLPVYQEAGSTFDMFSIKIAMDLYDRLANVEGSQYANYTVTKDEILQREPHLAADGLQGGGVYLDFVNNDARLVIENIKEAAELGGLMASRVQAIGVLHDDAGQVNGLQVKDLLDGSVFDIHAKLVINTTGPWSDKFKALDQAEDQTPTLRPTKGVHLVVDGSRLPVPQPTYMDTGLNDGRMFFVVPREGKTYFGTTDTDYHGDFNHPQVEQADVDYLLKVINKRYPQSHITLDDIEASWAGLRPLIANNGSSDYNGGGANTGKVSDDSFEALIRVVDDYEDNQATRADVEHAISRLETAHAEAALSPSQVSRGSSLRQADDGMITLSGGKITDYRKMAAGALALIRRLLAEHFATETRTVDSKKLQVSGGHFDPTNVDDTIAFYTRIGIDAGLPEKDAADLANRFGSNVSRVVTYTDGQAAPGLSLKETMSLRYSINEEMTLTPVDYLLRRTNAILFHAETLNELKQPVVDEMARLLGWDDATKAQQLADLNQAIRESQLADLKKTPASTNPA

SEQ ID NO: 89374 - protein, 479 aa, Oryza sativa Japonica Group
MAHRLLLPTNPLLPPGTGTATPRRRPVAATVRAALATSAEEARAATGAEVVRSIRARQIVDSRGNPTVEVDLVAGDGRLHRSAVPSGASTGIYEALELRDGDGAAYGGKGVLNAVRNINEVIAPKLVGVDVRNQSDVDAIMLDIDGTPNKSKLGANAILGVSLSVCRAGAGAKEVPLYKHIQELAGTKELVMPVPAFNVINGGSHAGNNLAMQEFMLLPVGASSFSEALRMGSEVYHALKGIIKAKYGQDACNVGDEGGFAPNVQDNREGLVLLMDAIEKAGYSGKIKIGMDVAASEFLTKDGSYDLNFKNQPNDGAHVLSAQRLCDLYKEFVKDFPIVSIEDPFDQDDWSSWASLQSSVNIQIVGDDLLVTNPKRIAEAIGKKACNALLLKVNQIGTVTESIQAALDSKAAGWGVMVSHRSGETEDNFIADLAVGLASGQIKTGAPCRSERLAKYNQLLRIEMELGNVRYAGEAFRSP

SEQ ID NO: 89375 - protein, 346 aa, Arabidopsis thaliana
MVVPKEGLVVMDKESVSSASSDSHLRLQPHFPDFTIPVKDFFKSREAREFLSGALAGAMTKAVLAPLETIRTRMIVGVGSRSIPGSFLEVVQKQGWQGLWAGNEINMIRIIPTQAIELGTFEWVKRAMTSAQVKLKKIEDAKIEIGDFSFSPSISWISPVAVAGASAGIASTLVCHPLEVLKDRLTVSPEIYPSLSLAIPRIFRADGIRGFYAGLGPTLVGMLPYSTCYYFMYDKMKTSYCKSKNKKALSRPEMLVLGALAGLTASTISFPLEVARKRLMVGALKGECPPNMAAAIAEVVKKEGVMGLYRGWGASCLKVMPSSGITWVFYEAWKDILLAANTKPLI

SEQ ID NO: 89376 - protein, 164 aa, Salmonella enterica subsp. enterica serovar Paratyphi A str.
MMRRILSVLLENESGALSRVIGLFSQRGYNIESLTVAPTDDPTLSRMTIQTVGDEKVLEQIEKQLHKLVDVLRVSELGQGAHVEREIMLVKIQASGYGREEVKRNTEIFRGQIIDVTPTLYTVQLAGTSDKLDAFLASLRDVAKIVEVARSGVVGLSRGDKIMR

SEQ ID NO: 89377 - protein, 141 aa, Triticum aestivum
  misc_feature (99)..(99): Xaa can be any naturally occurring amino acid
EISEIRAHERLRLFTEVVDLPSGKVTFNILHKCELCSRDGSAVMIPGQGTPVTGEPIQKGEMSRLMVCDCRVYVPIELAFGNGWQYESVHGTPFAFDLXEGECDEYDEKGEFPVILCKRQSALRVVKNQVFHGKVRLFSRS

SEQ ID NO: 89378 - protein, 367 aa, Azoarcus sp. BH72
MAKGMILAAGQGTRVRPLTKYLPKPMVPILGKPVLEYLIEHLARYGVDEIMINVAYNHYKIEDYFGDGHRWGVQIGYSYEGVREHGEVVPRPLGSAGGMRKIQDFSGFFDQTTLVVCGDAIVDLDIRAALDEHRLKGALASVITLEVPREQVQNYGVVVADGDGRVLSFQEKPSPEAALSTHASTGIYVLEPEVIDLVPPGEAFDIGSQLFPMLVEKSLPFFAQKRFFNWIDIGRLSDYWSVLQRVLRGEVAQMDMPGREVRPGVWVGLNTSIAWESVQIVGPVHIGSGVRIEPGASVIGPSWIGHGSHLRPGARVERSILFPYTRIGEGQRFIDKIVSPQYCVDRSGETLYVGDDTAALRWGDARG

SEQ ID NO: 89379 - protein, 242 aa, Pasteurella multocida subsp. multocida str. Pm70
MQGKIALVTGATRGIGRAIAEELSAKGAFVIGTATSEKGAESISAYLGEKGKGLVLNVSDLASIETTLEKIKADFGEIDILVNNAGITRDNLLMRMKDEEWFDIMQTNLTSVYHLSKAMLRSMMKKRFGRIITIGSVVGSMGNPGQTNYCAAKAGLIGFSKALAKEVASRGITVNVVAPGFIATDMTDVLTEEQKAGILSQVPAGRLGDPKDIAKAVAFLASDDAGYITGTTLHVNGGMYTN

SEQ ID NO: 89380 - protein, 478 aa, Pseudomonas syringae pv. phaseolicola 1448A
MSQKFDVVVIGAGPGGYVAAIKAAQLGLKTACIEKYQDKEGKLALGGTCLNVGCIPSKALLDSSWKFYEAKNGFSVHGISTSEVNIDVPAMIGRKSTIVKGLTGGVASLFKANGVTTLQGHGKLLAGKKVELTAADGTVEIIEADHVILASGSRPIDIPPAPVDQKVIVDSTGALEFQQVPQRLGVIGAGVIGLELGSVWARLGAQVTVLEALDKFIPAADEAVSKEALKTFTKQGLDIKLGARVTGSKVEGEEVVVSYTDAAGEQSITFDRLIVAVGRRPVTTDLLASDSGVDLDERGFIYVDDYCTTSVPGVYAIGDVVRGLMLAHKASEEGIMVVERIKGHKAQMNYNLIPSVIYTHPEIAWVGKTEQTLKAEGVEVNVGTFPFAASGRAMAANDTGGFVKIIADAKTDRVLGVHVIGPSAAELVQQGAIAMEFGSSAEDIGMMVFSHPTLSEALHEAALAVNGGAIHIQNRKKR

SEQ ID NO: 89381 - protein, 421 aa, Moorella thermoacetica ATCC 39073
MYQKEILENGIRIVSEEIPFVNSVALGVWVRTGSRNEDEDNQGVSHFLEHLLFKGTTRRTARQIAEELEAVGGVINAFTTKEYTCFYSRVLAEHLDLAIDVLSDMFFNSLLAPEDIEKEKRVILEEIKMYEDSPDELIHDLFARTIWPGHPLGRAILGTYETVAALNRDLIYRYYQEQYNCANIVLAAAGKFNTSELIVKLEASFGRQRRPGKAAQFHPPVNRAATSMQVKDTEQVQICLGVPGLAQDDPAIYAVQALNNILGGGLSSRLFQLIREERALAYSVYSYHAGFGDSGLFTVYAGTSPDNYRQVVQLVLEELASLKNNGVTEEELKRTKDQIRGNLLLGQESVSQRMSRLGKTEVSFGRVITAEEVIERLNQVTRDDVQALAQRLFRPEYLSLTALGPEVEPLDLAAIASSAGL

SEQ ID NO: 89382 - protein, 440 aa, Azoarcus sp. BH72
MKITVIGTGYVGLVSGACLADVGNEVLCLDVDPAKIRILEEGAIPIHEPGLLEIVRRNVEAGRLSFTTDPVKAAQHGLVQFIAVGTPPDEDGSADLQYVLAAARNIGRHLDGYRVVVDKSTVPVGTADKVRAAIADELAARGSSEAFSVVSNPEFLKEGAAVDDFMRPDRIVIGADDERAIELMRQLYAPFQRKHDKLVFMDVRSAELTKYAANAMLATRISFMNELANLAESLGADIELVRQGIGSDPRIGWHFLYAGCGYGGSCFPKDVKALIRTAAEQGTALRVLTAVEEANEVQKHVLIDKIVRRFGTDLSGRRFALWGLAFKPDTDDMREAPSRVVVEELLARGASVTAYDPVAMGEAERIFGDEPRISYAGRPKSALEGADALVILTEWKEFRSPDFEAIRSRLRTPVVFDGRNIYEPSVLRAAGIEYHGIGRP

SEQ ID NO: 89383 - protein, 328 aa, Capsella grandiflora
RTYAWVANRDNPLSSSIGTLKILDSNLMLLDQSDTTVWSTNLTGAVSSSVVAELLSNGNFVLRDAKTNDPDVFLWQSFDFPTDTLLPHMKLGWDLKTGRHRSLKSWRSLYDPSSGDLSYKLETRGLPDFFIWKTDVRVYRSGPWDGIRFSGIPEMPRWNFIVNNFTENREEITYSYRVTDHNTYSRLILSSSGVLQQFTWSPNEQEWSMFWTSPKDLCDTYRKCGPYSYCDTNTSPMCNCIRGFRPKFPQAWILRDGSSGCVRKTRLSCGRDRFVQLNNMKMPDTMQAVLDRRIGAKECRKRCFRDCNCTGFTNIRNGGWGCVIWTVE

SEQ ID NO: 89384 - protein, 620 aa, Desulfitobacterium hafniense DCB-2
MSILYCRSCGVDVSGEALFRQVTFAVEKGEKVGLVGPNGAGKTTLLRACLGEHPLESGEVFLTGTWGYLPQNPLVEDQGTVWESMLAERADLIEMKEQLHVLEERMAHTADEKVFAQYSALTERFETMGGYALEAQVRKILSGLGLTKETEHPIQHLSGGQKTRLALSKLLLRSPEFLILDEPTNHLDMDALEWLEGFLKGYDGAILVVSHDRYFLDHVVQKVLHLEKGGLKSYPGNYSEYELQRAVEETTLVREAERVSKKIARLEEYIRRYKAGIKSKQARGRESQLQKIKPVEVNKTPKSLHISLATGRRSGDRTLMLEDVSVEFPGRRLFHGVDVELRRGDRVALLGENGIGKTSLLKAIKGSLPYQGEIRLGANVKLGYYSQEHEELHGKGSIMDEIRGDTDLLDPEIRSLLARFGFVGEEVFKPVSVLSGGEKSRLALAKLFLSQGNLLLLDEPTNHLDTRMRDVLEEALQDYDGTLLVVSHDRYFLDRVVNKIARLTPEGLKIYEGDYSMYKAQVQEEEAASTGGSASSGTAVGTRPHEQSKETEREARRRQRKAQQLEAQIAELEEEIQSLEEQMAAVTSNYEKALELHKLFEEKKVLLDSTMMEWLEITEE

SEQ ID NO: 89385 - protein, 76 aa, Pasteurella multocida subsp. multocida str. Pm70
MSIEERVKKIIVEQLGVKEDEVKPEASFVEDLGADSLDTVELVMALEEEFDIEIPDEEAEKITTVQSAIDYVQNNQ

SEQ ID NO: 89386 - protein, 220 aa, Colwellia psychrerythraea 34H
MFNSQITSQRSSQVSSQSSATGIESALVPMVVEQTAKGERSYDIYSRLLKERVIFLCGQVEDHMANLIIAQLLFLESESPDKDIYLYINSPGGSVTAGMAIYDTMKFIKPNISTVCIGQAASMGAFLLSGGEKGKRYCLPNARVMIHQPLGGFQGQASDFEIHAKEILFIKDKLNKLMAEHTGQTLDKVSQDTDRDNFLSAEAAVEYGLVDSILEQRNDK

SEQ ID NO: 89387 - protein, 326 aa, Capsella grandiflora
RTYAWVANRDTPLSDSVGTLKISKGNLVIFDHSNIPIWSTKTIGDVRSPIVAELLDTGNLVLRYSNKNSREFLWQSFDFPTDTLLPEMKLGWDRKTGLNRLLRSYESSNDPTSGSFSYKLEIGAYSEFFMLADNSPVYRSGPWNGIQFIGMPEMRKSDYVVYNFTESDEEVSFTFQMTNQNTYSRLTLNHEGEFARFTWIPTSSQWSLSWSSPKDQCDVYDLCGPYSYCDINTSPNCNCIQGFVPKYPEWKLIDGAGGCVRRIPLDCRKDRFLPLKQTKLPDTKTVIVDRKIGRKDCKKRCLKNCNCTAYANTDIGGRGCVMWIGE

SEQ ID NO: 89388 - protein, 329 aa, Capsella grandiflora
RTYAWVANRDNPLSNSAGTLKISGINLVLLNQSNISVWSTNLTGAMRSPVVAELLSNGNFVLKDSKTNGKGGLLWQSFDYPTDTLLPHMKLGLDLKTKNNRFLTSWKNSYDPSSGSLLYKLEMLGLPEFFMWRSGGLVFRSGPWDGFRFGGIPEMERWKFVNIVYNFTENKEEIAFTYRVTTPNVYARMMMNFDGFLTTMTWIPDTLEWNIVWQTSADSCDVYMSCTPNSYCDPNERPYCNCIKGFEPRSGALDNTYTECIRKTQLRCNGDGFFWLRNMKLPDTSGAIVDKRIGLKECEDRCIEDCNCTAFANTNVQDGGSGCVLWTSE

SEQ ID NO: 89389 - protein, 1244 aa, Magnetococcus sp. MC-1
MGNVAGISHRILNWLRYCCFVGLFQRQLRTEPENIVIVTCENCDARFDVDPQLLGSKGRKLKCSQCHHIFFQAPPEPKSAQPPASEQPGLEDESTAQDNDTESRDYAEFAFEESPLEEVDLDEIEKLTAQATLDMALEATRDKRQEPSFDEDTQVDEDAVIEPSLEEVDVDQMIQAATALPTEPEAASEAEEELEAEEELEAEEEPEAEEEPEAEEEPEAEEEPEAEEELEAEEEPEAEEEPEAEEESEAEEESEAEEEPEAEEESEVEEAPEVEEELELEEEAEEEPEAEEEAAPEAEEEAAPEVEEEPEVEEELELEEEAEEESEAEEESEAEEEAAPEAEEEAAPEAEEEAAPEAEEEAAPEAEEEAAPEVEEEPEVEEELELEEEAEEAPEAEEAPEIEEELEAEEELEAEEELEAEEELEAEEELEAEEELEAEEELEAEEELEAEEELEAEEELEAEEELEAEEELEAEEELEAEEELEAEEELEAEEEPEAEEAPEIEEELEAEEESEAEEVPEIEEELEAEEEPEVEEEPEVEEEPEVEEEPEVEEEPEVEEEPEVEEEPEVEEEPEVEEEPEVEEELELEEEAEEAPEVEEELELEEEAEEEAAPEVEEEPEAEEESEAEEEAAPEVEEELELEEEAEEEPEAEEELEAEEEPEAEEEPEAEEEPEAEEEPEAEEEPEAEEEPEAEEEPEAEEEPEAEEEPEAEDAFALDVDEQVPAADFADDGDFLSESALQEEQDKLLDVDDFNAATMVEPASLVEEDELDLAEVMENAERTADEAFNPSAMAEPDLLESELQLEDVEAEVVEEGGAELTLEGEEQAAFADLLTEEDDLSALADDALDLDDDDDVTVLADPPAMDLEGLVDAVESDHEVAFEDESVEAFAPLGDDLPNDLDDLTELVNEPGGELMLDDDLAALAPSPVMQERLVPADGMDELSALASDDQDEINLDLPESNDLSLGDLGEAESWSPDDELLEPEDETILAVPDSDETIEELDFPEPDIPQPKEEIIELDYGQQEEEPFDLSSSPDDEDEDLEWANTATPAKEKGGLGGLLGWGVAAMMLLAVIGAWFGKDYLSRGGATNRVDDFTLDGVEVKWRESDHGVLLIVEGSMTNQMNRRSARRPMMARVTLLDENNRNLNSVSVIPERIIPERAMNLNPNNMARIITKQGDIETRFNKMNPKQPVKFQAIFMDPPMEAVRYRIDFDATPEAEWEKQKKARSQAIKNREGTTTFMGNF

SEQ ID NO: 89390 - protein, 376 aa, Thermus thermophilus HB27
MSRVPEPSVFLVVDEAKRKARERGVGLIDLSIGSTDLPPPEAPLKALAEALNDPTTYGYCLKSCTLPFLEEAARWYEGRYGVGLDPRREALALIGSQEGLAHLLLALTEPEDLLLLPEVAYPSYFGAARVASLRTFLIPLREDGLADLKAVPEGVWREAKVLLLNYPNNPTGAVADWGYFEEALGLARKHGLWLVHDNPYVDQVYEGEAPSPLALPGAKERVVELFSLSKSYNLAGFRLGFALGSEEALARLERVKGVIDFNQYAGILRMGVEALKTPKEVVRGYARVYRERALGMAEALKGALSLLPPRATMYLWGRLPEGVDDLEFGLRLVERGVALAPGRGFGPGGKGFVRIALVRPLEELLEAAKRIREALD

SEQ ID NO: 89391 - protein, 332 aa, Capsella grandiflora
RTYAWVANRDNPLSSFAGSLRFSGINLVLLNQSNISVWSTNVTGAVRSAVVAELLSNGNFVLRDSNTNGKDGLLWQSFDYPTDTLLPHMKLGLDLKTGHNRVLTSWKNSYDPSRGFYLFQLQIPGLPEFFLWKSDFLWFRSGPWDGIRFSGIPDMQQWLNFNFVYNFTENKEEVAYTYRVTTPNTYSRLTLNSEGILQLFTWLPETLEWNMVWMSYLAACDLYRVCSRYSYCDMNTSPRCNCINGFGPKNPHKWLLEGGIGECVRKTQLSCRGDKFVQLKNMKLPDSTGVIVDRRIELKECEGRCKINCNCTAYANTDIQNGGSGCVIWTSA

SEQ ID NO: 89392 - protein, 168 aa, Avena strigosa
VMASSATSVAPFQGLKSTAGLPVSRRSNAGLGSVSNGGRIRCMQVWPIEGIKKFETLSYLPPLSEEALLKQIDFLIRSKWVPCLEFSKVGFIFREHGSTPGYYDGRYWTMWKLPMFGCTDASQVIKEVEEVKKKYPDAYVRIIGFVNIRQVQCVSFIAFKPPGCEESG

SEQ ID NO: 89393 - protein, 286 aa, Mycobacterium smegmatis str. MC2 155
MGAARVCVVGSINADLTFTVANLPRPGQTVLASSLASAPGGKGGNQAVAAARAGAATSLVAAVGDDAAAESLRAHLRANGVDEDAVVSLAGPSGSAAIVVDAAGENHIVVAPGANALLDVDAPAARAAIGSADVVLLQLEISPTTAIAAAQQARDAGALVMLNASPVGTAAHHLLALSHLTDVVVVNETEAAEWHWPVRHLVITRGARGASYVSDDERFDVPALRVRAVDTTGAGDVFAGVLAAGWPAGHEHALQRACAAGALATLVRGAGDCAPSAADIDAVLTP

SEQ ID NO: 89394 - protein, 331 aa, Capsella grandiflora
RTYAWVANRDKPLYNSAGTLKISGINLVLLDQSNITVWSTNLTGAETSPVVAELLPNGNFVLRGSKGNGKDGFFWQSFDYPTDTLLPHMKLGLDLKTENNRFLTSWKNAYDPSSGSFSYKLEVPISGLPEFFLWRNGGPVIRSGAWDGFRFTGIPEMQNWKLINIVSNFTDNKEDVAFTYRVTTPNVYAKLTMKFDGFLELSTWDPEMSEWNVFWVSSSGDCDTYMWCTTNSVCDTNTTPSCNCIKGFELEGGTWDSVSSECVRNTQLNCNGDGFSLLKNMKMPYTKGAIVDKRIGLKECGKRCIEDCNCTAYANTNIQDGGSGCVMWTSQ

SEQ ID NO: 89395 - protein, 168 aa, Avena clauda
VMASSATSVAPFQELKSTAGLPVSRRSNAGLGSVSNGGRIRCMQVWPIEGIKKFETLSYLPPLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESG

SEQ ID NO: 89396 - protein, 157 aa, Thermus thermophilus HB27
MKPKTLSPILTAKGVRLAIAVGRFNERVTKLLLEGALEAYARLGGDPAEVLVAWVPGSFELPLVAKRLAQRPDVDAVVALGAVIRGETPHFEYVAGQAASGLMQAMLQTEKPIVFGVLTTNTPEEAQERAGGKAGNKGAEAVFTAIEMVRLLEAISR

SEQ ID NO: 89397 - protein, 314 aa, Moorella thermoacetica ATCC 39073
MNDLAGSLKGRDFLSLKDFSREEIFYLLDLADDLKAKLKKREPHPLLAGKTLGMIFTKRSTRTRVSFEVGMYQLGGYPLFLTKDDLQLGRGETIADTARVLSRYLDGIMIRTYSHREVEELAEYASIPVINGLTDFLHPTQALADIMTIREWKGKLQGLNLTFIGDGNNVAHSLMYGGAKVGLNVTIACPSGYEPMPQVVEEARRIAAGNGCQIAVTNNIKEAAEGADILYTDVWASMGQEDEAEKRRQAFRKYQINSELLKLAKPDAMVLHCLPAHRGEEITDEVMDGPQSAVFDEAENRLHAHKAIMVALMG

SEQ ID NO: 89398 - protein, 343 aa, Exiguobacterium sibiricum 255-15
MTYVFVAITLTIVYLLPRFLKTIPAPLIAIIVLTIAAIYLNVDLRTVGDLGTIQRSLPSFFLPDVPLNFETLQIIFPYSLALAIVGLLESLLTATIVDDMTGTESEKNKEARGQGIANFITGFSGGMAGCAMIGQSVINVKSGGRGRLSTLIAGLFLMFLIIVLGNWVVQIPMPVLVGIMIMVSIGTFDWSSFTYLRKAPKADAFVMLATVSIVVATHDLSIGVMAGVVLSALFFVAKVSKIKIKQQITSGKTVYTVKGPLFFASVDHFIASFDYEGTNQQIRIDFSSTQIWDDSAVGAIDKVMLRLMANQNKVELIGLNPESKKLIDRLAVHQDPIPKISTH

SEQ ID NO: 89399 - protein, 366 aa, Aspergillus nidulans FGSC A4
MSHSQGNSIEPFSEQEHRGDTDIDKKPKNRRPANTAFRQQRLKAWQPILTPKSVLPLFFIVGVIFAPIDCKDATTDAVSIPDDKFKYTFKSSFDQRPSWQRFRNDNGEDHCRLMFDIPDTIGPPVFMYYRLTNFYQNHRRYVKSLDMDQLKGKAVKNATINGGSCDPLKLDENGKAYYPCGLIANSMFNDTINNPILVNGRGGDPETYNMTKKGIAWDSDKELIKKTEYEPGAVVPPPNWRERYPNYDSGIPNLHEDEDFMVWMRTAALPTFSKLSRRNDNESMQSGRYRLDIKDPFPVTDYGGTKSILISTRSVLGGRNPFMGIAYVVVGGVCVLLGAMFTIAHLVRPSSAIATGRDDRNGAHSR

SEQ ID NO: 89400 - protein, 168 aa, Avena clauda
VMASSATTVAPFQGLKSTAGLPVSRRSASSLGNVSNGGRIRCMQVWPIEGIKKFETLSYLPPLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESG

SEQ ID NO: 89401 - protein, 244 aa, Oryza sativa
  misc_feature (145)..(145): Xaa can be any naturally occurring amino acid
  misc_feature (197)..(197): Xaa can be any naturally occurring amino acid
  misc_feature (220)..(220): Xaa can be any naturally occurring amino acid
MAGKDDDVKVLGLVMSPFAIRVCIALKLKGVSYEYIEEDLANKSELLLSSNPVHKKIPVLIHGGKPVSESLVIVQYVDEAWAPSPTSPSILPADPYDRAVARFWAAYVDDKMVPGMVGVLRAATEEERAAKADETLAAMAQLEKXAFAEVAAKNGKPFFGGDTVGYVDLALGCNLHFLEAIRRLHGVALVDARQDPXLLAAWAERFVEVEAAKGVVPDAXDDAVEFARKVQARVAAAAASTAAK

SEQ ID NO: 89402 - protein, 402 aa, Moorella thermoacetica ATCC 39073
MDNAAIVSRGEKYVMRTYGRYPMALVRGEGARVWDADGKEYLDFVSGLAVNSLGHCHPRVVEAIREQAGRLIHCSNLYWIEPQVELARLLVENSALDKVFFCNSGAEANEAAIKLARKYAKEHRGPESYEIITMRRSFHGRTLATLTATGQEKFHHGFAPLPPGFRYAPFNDLSSLRAAVGPRTCAVMLEPVQGEGGVYAANKDYLQAVRALCDDEGLLLIFDEVQCGLGRTGYLFAYQYYEVEPDILTLAKALAGGVPIGAMLAKERAASAFAPGDHASTFGGNPLATAAGVAAFKALLQEGLVENARVLGQYFYQQLEGLVREFPQLIEVRGRGLLLGVEIDGPAGEVVAACQERGLLINSLHGHVLRFLPPLIVTREDIDRAVTILKEALHEVLGQGQK

SEQ ID NO: 89403 - protein, 296 aa, Moorella thermoacetica ATCC 39073
MTLSPLEKTGILIEALPYIRQFYGKTVVIKYGGHAMVNCELKKAVMQDAVLMHLVGMRPVIVHGGGPEITSMLGRLGKQSQFIQGQRVTDAETMEIVEMVLVGKINKEIVANIHRYGGKAIGLCGKDGHLIEARKQVAHIQKDGEEMDLDLGYVGQVERVNPGIIETVIAEGYIPVVAPIGVGPEGESYNINADLVAGELAVALQADKLVLLTDVEGILADRDDPASLISSLEVGRVPELIQQGVIAGGMIPKVNCCIRALEGGVKKTHIIDGRIPHSILLEVFTDTGVGTMVVPG

SEQ ID NO: 89404 - protein, 168 aa, Avena sterilis subsp. ludoviciana
VMASSATSVAPFQGLKSTAGLPVSRRSNAGLGSVSNGGRIRCMQVWPIEGIKKFETLSYLPPLTEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESG

SEQ ID NO: 89405 - protein, 258 aa, Synechococcus sp. RS9917
MTSLCLQDKVIVVTGGNSGIGKAIVETVGGLGAKVVIDYRSHPERTEELIEEVGELGGQAIGVQADVSKLEDLQRLIDTAVSTFGRVDVMVNNAGIETRTSILDTTPEDFDKVMNVNLRGVFFATQYAAKQMIKQGTGGRIINISSVHEDWPMPNNTPYCVAKGGVRMLTRTAGVELAGKGVTIVNVGPGAVATPINDSTMNNPELLAKLNAAIPMGRMAQPEEIASVVAFLASNGASYMTATSLFADGGIMMSSPGL

SEQ ID NO: 89406 - protein, 485 aa, Corynebacterium glutamicum ATCC 13032
MLASFRFAFSSPRRFRTEVLAGLVVALALIPESIAFSVLAGVDPKMGLFASCTMAMTIALTGGRPAMISAATGAVALVIAPVVRDHGVEYFLATVILAGIIQIALSLLGVAKLMRFIPRSVMLGFVNALACLVFFAQLPHLIDVPWMVYPLFALGIGIMLFWPKLTSVIPAPLIVIVALTAIVWVFGINIPNVSDQGELPSSLPEFLIPNVPLTLETLKIIGPYALGMSLVGLMESLLTAKLVDDITEVHSNKSREAAGQGIANIITAFLGGMGGCAMIGQTMINVKNSGARTRLSTFLAGGFLLLLVVLLGDVVGKIPMAALVAVMIIVSIDTADWHSLNPRTLKFMPLSETIVMFITIIATLVTGNLAIGVILGVLTAMVMFARRVAHLVSVERTTDNNISTYTVKGQLFWASSNDMVYSFDYSDEAEQIIIDLTAAEIWDASTVATLDSIIHKYAARGKSVEIIGLDGPSRDRLERLSGKLG

SEQ ID NO: 89407 - protein, 413 aa, Photobacterium profundum SS9
MLFTPNAVRPAFPALHQTVNNKPVYFFDGPGGSQVPQPVLDAMVGYLGHYNSNLGGSFFSSSVTVSLMQEARISAQALLGAASPNNIIFGANMTSLTFQLSRAISRDWQADDEVIVTALDHYSNVSSWQQAAEDKGVIVHQVRVNEDDCTLDYDHFESLLSDKTRLVAVTYASNTTGSLVDVKRLINAAHAVNAQVYVDAVHYTPHGLVDVQDLGCDFLVCSAYKFFGPHVGIAYIALQWLQTLQPYKVEPATDEGPGRFETGTQSFEALAGFVAAVDYLAQWGDQDASLRQRLLASFVQYQEHEKALSHHFLSKLAEFDNVSLYGINSPNRLSERTPTFAIRIDDVMPSDVAAHLGENNMCVWNGHFYAQGLCKQLGVMDNGGVIRIGLMYYNTIDEIDSLFTELAPFLIKK

SEQ ID NO: 89408 - protein, 477 aa, Arabidopsis thaliana
  misc_feature (311)..(311): Xaa can be any naturally occurring amino acid
MDKSSLVSDFLSFLNASPTAFHAVDESKRRLLKAGYEQISERDDWKLEAGKKYFFTRNYSTIVAFAIGHKYVAGNGFHIIGAHTDSPCLKLKPVSKITKGGCLEVGVQTYGGGLWYTWFDRDLTVAGRVILKEEKAGSVSYSHRLVRIEDPIMRIPTLAIHLDRNVNTEGFKPNTQTHLVPVLATAIKAELNKTPAENGEHDEGKKCAETSSKSKHHPLLMEIIANALGCKPEEICDFELQACDTQPSILAGAAKEFIFSGRLDNLCMSFCSLKALIDATSSGSDLEDESGIRMVALFDHEEVGSNSAQGXGSPVMIDAMSHITSCFSSDTKVLKKAIQKSLLVSADMAHALHPNFMDKHEENHQPKMHGGLVIKHNANQRYATNAVTSFVFREIAEKHNLPVQDFVVRNDMGCGSTIGPILASSVGIRTVDVGAPQLSMHSIREMCAADDVKHSYEHFKAFFQEFTHLDAKLTIDV

SEQ ID NO: 89409 - protein, 288 aa, Arabidopsis thaliana
MEIKVKAKDVESTMMSTKEEDEIKKMKECVVIQKADEEVTKGQETMKILDGSRQNQDETRQADSKNIDSPSSSSLEMKKKLEIDQKFTSQNEENTKKEEEKKKETNNNNLSNMKHKKTSSHVWDCGSTLYDSFELNSFKRQLDSAISASSARTMSMSHLPDRRIPSLSSLSPEYSPPLPPPPTTSSSSSSGGKKHSNKISRSLQRFLKSVFKPKQHQSLTTPSSPVYKAVGHGGGDKDRYYVVYDKSGSLTTIPESTEKEVSPEINSLVRKTVSERFPASRVVGISCA

SEQ ID NO: 89410 - protein, 393 aa, Bordetella bronchiseptica RB50
MSSALANIYARLPVSFTHGRGVWLWDTGERRYLDALAGIGVSCLGHGHPGLVAAISEQAARLIHTSNIYEVPQQAALARRLAELSGMSEVLFSNSGSEANEAAIKLARYYGYKQGNTHAHIITMDSSWHGRTLATLAATGSDKARQGFGPMPSGFIQVPYNDLPAIRAAGEAEPRVTAVLLEVLQGEGGIRPSDMAFLRGVRQLCTERGWLLMIDEVQSGIGRTGKWFAHQWADIRPDVMTLAKGLAGGVPIGAMLAAGPAAGVFAPGSHGTTFGGGPLACAAGLAVIDAIEQEGLLANAHEVGAHLHAALASELAGVPGIIEVRGRGLMLGIELDRPCGILATRAMEAGLLINVTRERVVRLLPPLILSGEEADQIVRILVPLIKQFLAQQQ

SEQ ID NO: 89411 - protein, 181 aa, Brassica napus
MASSMLSSAAVVTSPAQATMVAPFTGLKSSSAFPVTRKANNDITSIASNGGRVSCMKVWPPVGKKKFETLSYLPDLTEVELGKEVDYLLRNKWIPCVEFELEHGFVYREHGSTPGYYDGRYWTMWKLPLFGCTDSAQVLKEVQECKTEYPNAFIRIIGFDNNRQVQCISFIAYKPPSFTGA

SEQ ID NO: 89412 - protein, 413 aa, Moorella thermoacetica ATCC 39073
MKVLVQKFGGTSVASPEQRLVVTGHIERACRVGYQVVVVVSAMGRRGAPYATDTLLELLGDNEVEPRERDLLLACGEVISGVVLTGLLKSKDLPAVFLTGGQAGIITDAQFGDARILRVEPRRIQSYLDQGRVVVVAGFQGVTESGEVTTLGRGGSDTTAVALGVALGAEAVEIFTDVDGVKTADPHIVSDARTLSTITYNEVCQMAYEGAKVIHPRAVEIARQKNIPLRIKSTFNDGPGTLVVAWQPGVTGVHISRDRVITGITHMDGLTQLRVSLPSGEGAGEVFPLLAQNNISVDFINIFPGELVFTVKSEVARQARELIEGLGLKVTARPGCAKVATVGAGMRGVPGVMATIVTALEREGIKILQSADSYTSIWCLVDRKDMERAVQTLHREFKLNDGKTGEVKVYAVG

SEQ ID NO: 89413 - protein, 475 aa, Colwellia psychrerythraea 34H
MSKNVYQFIDVKRIDPAKKSISERKINFVEIYQPMGNEQSAGQADRCLDCGNPYCEWKCPVHNYIPQWLELVTENRIFEAADLCHETNSLPEMCGRVCPQDRLCESACTLNDEFGAVTIGNIEKHITDTAIAQGWKPNLSHVVKTGKRVAVIGAGPAGIGCADVLTRNGVDVVVYDRHAQIGGLLTFGIPSFKLEKSVIQTRREILEGMGIEFRLNINVGTDISFKDISDEYDAVFLGLGTYTDMSGGFDNEGAQGVYNALDFLIGNTQNLMGFTKADNAQVKPYVNFKDKKVIVLGGGDTAMDCVRTSIRQDATSVTCAYRRDEANMPGSPREVQNAKEEGVNFEFNLQPLDIAVNEQGVAIGVKFVKTQLGSPDANGRRNPEPIADSEFIMEADAVVIAFGFLPSPPQWMVDAGVELDSRGRVVAVDSSDFALQTSKQNVFAGGDMVLGSDLVVTAIDQGQKAAMGILDYVTQ

SEQ ID NO: 89414 - protein, 707 aa, Oryza sativa Japonica Group
MGKSSKKSAVEVAPTSVSVSEGKSGKKGKRNAEDEIEKAVSAKKQKTVREKVVPSKEEAKKVKKQPPPKKVESSSSEEDSSESEEEVKAQPKKTVQPKKAAQPAKEESSDDSSDDSSSDDEPAKKPVARPNKAALSTNSSSSDDSSDESLSDDEPVKKPAAPLKKPVALATNGSKKVETDSSSSDSSSDEESDEDDKKTAAPVKKPSVAAIQKKTQESDSSDSDSDSESDEDVPTKAPAVAKKKEESSESSDSESDSDSDDEAAAVKKEEESSDSSDSDSESESDSDEPAKPTIPAKRPLTKDTKKGQSKDESEDSSDESSEESGDEPPQKKIKDSTTSGTTKPSPKATKKEISSDDESDEDDSSDESSDEDVKQKQTQAKKQAPVAQESSSSDESSEEDSDMESDEPAKTPQKKETAVSVGSNKSATKPGQEEPKTPASNQNQATGSKTLFVGNLPYNVEQEQVKQFFQEAGEVVDIRFSTFEDGNFRGFGHVEFATAEAAKKALELAGHDLMGRPVRLDLARERGAYTPGSGRDNSSFKKPAQSSGNTIFIKGFDTSLDIHQIRNSLEEHFGSCGEITRVSIPKDYETGASKGMAYMDFADNGSLSKAYELNGSDLGGYSLYVDEARPRPDNNREGGFSGGRDFNSSGRGGRRGGRGDGSRGRGDRGRGRGFGRGDRGHGGRGTPFKQSAGTPSAGKKTTFGDDD

SEQ ID NO: 89415 - protein, 416 aa, Methanosarcina acetivorans C2A
MLRVMTSRNFLTIDDFDIRGKTILLRVDMNSPMDTQGHILDDMRIKSHIATLKDLESAKVVLLAHQSRPGKKDFTTMKPHAHLLSRYLGKQVTYVDDIFGTFAKTHIASMEDGDVIMLENVRFYSEESLERTPAEQANTYMVKKLAPFVDIFLNDAFAVAHRSHLSVVGFTEVLPSGAGRVMEKELVSLDRGVKGGERPSIFVLGGAKVDDSLRVTENVLTSGGADRVLLTGVVANVALAASGVNIGKVNMDFIKSQGYENQIEKARGLLAKFKDRIGLPKDVALNDNRERVEVHISELNSDSLPINDIGLETIVDYTNEIQNSKTVVLNGPAGVSEIEDFALGTHEIIKAAIKSDFSIIGGGHISVEVAHLGLEHRFSHISTGGGACIDYLAGEKLPGVESLKAAYIKYQEAKKL

SEQ ID NO: 89416 - protein, 331 aa, Clostridium perfringens str. 13
MAVNLKGRSFLTLKDFTPAEIRYLLDLSHDLKAKKRAGILGDSLKGKNVVLLFEKTSTRTRCAFECGAAEEGAHVTFLTNSQMGKKESIEDTAKVLGRMYDGIEFRGFKQSTVEELAKHAGVPVWNGLTDADHPTQILADFLTIEEHAHKPLSEIKLVFTGDTRNNMSYALMYGAAKMGMHFVALGPDSLKPDEDILKEMQEYSKETGATIEFSSNVDEAVKGADVIYTDIWVSMGEDESLYPERVKLLTPYKVTREMMNKTGNKNTLFMHCLPSFHDEDTEVCKDMMDRLGLDIREVEDEVFRSKNSVVFDEAENRMHTIKAVMVATAGR

SEQ ID NO: 89417 - protein, 478 aa, Clostridium perfringens str. 13
MAEQHNEPKKLGFAQLAALIVGSMIGGGAFNLPSDMARGAGTGAVIIGWIITGIGMIALAFVYQSLANRKPELTGGVYSYAKAGFGEYIGFNSAWGYWLSAWIGNVSYSVLLFGAVGYFLPMFGAGNNVASIIGASVLLWAFTLLILNGVSGAALINLITTIAKLVPIFLFIVISLFMFNFDKFTFQFWGTSDLGGIVTQVKSTMLVTLWCFIGIEGAVVVSGRAKKQSDVGKATVLGLIGTLIIYMLITLMALGVMDRVKLSGLENPSMAYVLEFAVGKWGAVLINLGLIISLFGSLLGWALLAAEIPYVAAKDGVLPKVFAKLNKKGTPSGSLIITNLLVQAFLILTLVASSTYQALYSVASTAILVPYLLSAMYGFKLALTGETYDKNPTGRTRDKIFGGIATVYAIWLCYAAGLKYLLLCFILYAVGIIFFYIGKKQNNKDAEVFVGKEKILAIIVLVIAIIAIVMLFNGTITI

SEQ ID NO: 89418 - protein, 215 aa, Picea sitchensis
MDDYTVQVCNLSTKATVKDVKQFFSYSGTIKKAKLERSGQWEQVAFVTFKEPYASETAVLLTGATIIDQRVRIVQWEGSEEALNRWKKQMMELQEEGDTQGLSSFIPSAGQAVNVVTTMLSKGYTLGKDALSKAYELDQKYQVIDTAATNLTSFGKFVGEKSKAALIVAGQAACSAGTAVVNSSYFSSGALMVSGALDKAAKAAADLGTRGNTTT

SEQ ID NO: 89419 - protein, 521 aa, Aspergillus oryzae
MSTAEELLRDFESDDEDFQAGEGVEEDVDEEQQHLQKAGSEVTNEFEVALSTGDELTRLHKLLRDHYSVRFPELETLVTSPIDYAKTVAILKNGPLNDIKALSSSADNMVGEPLKSILDGPSLMVVSVEGTTTRGREMTESELKVVLDTCERILKLDRERRALTESIQSRITQIAPNLAALIGPETAAQFLNQTGGLRELAKIPACNLGAQGNKRTEGLGFATNIGVRSRGFLYNSPLIQEVPDDLKRQAIRIVSAKMVLATRADVSNFSPDGSLGEDLKQQCFTRLEKLTEPPPNSGVKALPAPDDKPARKRGGRRARKAKEAVAMTDMRKAQNRMAFGKEEAEVGYGTGEGTVGLGMLGQQNDGRIRSTQIDNRTRAKLSKSNKGWGTATPASGTASSLRAFSSGVGGTASVLQAKGLRSSGIGTSLGGSGTASTIAFTPVQGLELVDPKVQAELSRKRKAEEDRWFKSGTFTQVGGSQSNNNSSQKDNGGFKVPPIPPQKKVDTGEGKMGPPPLPLKR

SEQ ID NO: 89420 - protein, 564 aa, Candida glabrata CBS 138
MTEITLGRYLFERLHQIHIDTIFGLPGDFNLTLLDKIYEVEGLRWAGNANELNAAYAADGYARLKGMACLLTTFGVGELSALNGIAGSYAEHVGVLHVVGVPSTVSRAKQLLLHHTLGNGDFDAFHRMSSVISETTFIVSDPQTAPAEIDRCIRVCYLTQRPVYLGIPANMFDSKVSSKLLDTPIDLALRPNLPDAEREVLDEIITMIKASKRPIILADACTSRHDVKKETKRLIEVTQFPSFTTPMGKGSIDEDTPRFGGVYVGNLSDPEVKTFVEESDLVLSVGALLSDFNTGSFSYSLNTRNVIEFHSDHMKIRNATFPGVQMKFVLEKLLEELPAVVKGRTDNRVVPRQKEPSTTLNGKDAIKQEWMWKHVGKFLQEGDVVVTETGTSGFGIVESKFPRNTVGISQVLWGSIGYALGSTVGAAFAAQEIDPKKRVILFIGDGSLQLTVQELSTAARWGLTPYIFVLNNNGYTIERLIHGETQGYNDIQSWDHSLILPAFGAKNYENKRVATYGEWNDMVNDKQFNKNDKLRMIEVMLPTMDGPENLKKQAKLTASINAKN

SEQ ID NO: 89421 - protein, 313 aa, Ustilago maydis 521
MTKGETIKCKAAVAWEAGKPMSIEEVEVEPPRAGEVRVQVTHTGLCHTDAYTLSGSDPEGAFPAILGHEGAGIVESVGEGVDHVKEGDSVILLYTAECRQCKFCKSGKTNLCQAVRATQGQGVMPDKTKRFSCRGKQLFHFMGCSTFSQYTVVSQYSLVAIDPKAPRDKTCLLGCGVTTGWGAATHTAKVEKGSTVAVFGIGCVGLAVITGAVDAGAGRIIAIDTNDQKESWAKKFGATEFINPTKLGDKDIVSHLVDITDGGLDYTFDCTGNVKVMRSALEACHKGWGNRYAPLPTGYRSQVARLRFRRCQG

SEQ ID NO: 89422 - protein, 591 aa, Aspergillus oryzae
MGLPFWGDREKDAGISVREHNASQESTIQDGSVKYTAAEGINSTSVTYQDASGAPVETDSPLGYSVSFWTSLCLNINQMVGTGIFSTPATILKGVGSVGLSMIYWFIGYLLAQSTLAVYLELASYFPSRSGSEVVYLEQAFPKPDYFFPTTFAVKHVVFSFGSSNAIVFAEYIFGIAGSGYTNWQLKGVAVAAYTVATLIVSSSTKWSLRVVVWFGFIKIATLVLISIAGLVVLGGHTKVEDPMINWHDAWKGTSSASAYGATNAMIKLIFSYSGYTNAFSVVNEIKNPIKTLRWSAPFSLLLVTSLYILVNVAYFSAASREEILNSKQIAAGVFFQKIFGTNGASRALNVLICISAFGNLMAVMVSYSRMLRETGRQGVLPWPKFWTSTKPFGTPLGPYLVQWSITVIMILAPPAGDAFNFVVDLSVYPSSIFNFLLVVGLLLIRRRRSKLNLPRPEYKSWAIAIGFALLANLYLLAAPWYPPTGGANGGDVSFWYGTYLVVGIGLLVACGVYYYVWIKLLPKYKGYEFRQTVLEFDDGSVAHNLVKVPVAELARWDVEHDAVGRLRHRTTYQSSTATDEDKSSEQKNVS

SEQ ID NO: 89423 - protein, 253 aa, Picea sitchensis
MPFRGVAIGRPEEVTHPTALKAALAELISTLIFVFAGEGSGMAFAKLTSDASTTPAGLVAVALAHGLGLFVAVAVGANISGGHVNPAVTFGALVGGHITLLRGILYWIAQLIGATVACLLLKYTTGGLSTSAFSLSSGVGVGNALVFEIVMTFGLVYTVYATAIDPKKGTLGTIAPICIGFIVGANILAGGAFDGASMNPARAFGPALVSWTWENHWIYWVGPLLGGGLAGVIYELFMISNEPTHERLSSEDY

SEQ ID NO: 89424 - protein, 491 aa, Escherichia coli
MTEPHVAVLSQVQQFLDRQHGLYIDGRPGPAQSEKRLAIFDPATGQEIASTADANEADVDNAVMSAWRAFVSRRWAGRLPAERERILLRFADLVEQHSEELAQLETLEQGKSIAISRAFEVGCTLNWMRYTAGLTTKIAGKTLDLSIPLPQGARYQAWTRKEPVGVVAGIVPWNFPLMIGMWKVMPALAAGCSIVIKPSETTPLTMLRVAELASEAGIPDGVFNVVTGSGAVCGAALTSHPHVAKISFTGSTATGKGIARTAADHLTRVTLELGGKNPAIVLKDADPQWVIEGLMTGSFLNQGQVCAASSRIYIEAPLFDTLVSGFEQAVKSLQVGPGMSPVAQINPLVSRAHCDKVCSFLDDAQAQQAELIRGSNGPAGEGYYVAPTLVVNPDAKLRLTREEVFGPVVNLVRVADGEEALQLANDTEYGLTASVWTQNLSQALEYSDRLQAGTVWVNSHTLIDANLPFGGMKQSGTGRDFGPPLAGRAGC

SEQ ID NO: 89425 - protein, 223 aa, Triticum aestivum
MAPAKWLMHWHPNPGVTLNTQILSEACGCAESLGGTKDGRWKTSIIFYRPMTRDGAGGAQQNLPPDVPRELLGVALHERPGLYFSILRNQRLVLQADAAFSQVMEKLQSFKARVNLNFEGFQYQLGDFCLRIGKCVPNNTETLRGIMMEVEYYPLSSIEKSRAIMVDFFDIWQETLAKKSLPGRFIHVESNFAEYGLSDHYSFQHTAVQYATCLQQLMAAVRA

SEQ ID NO: 89426 - protein, 211 aa, Dehalococcoides sp. BAV1
MLSDSSKKIKKEVEAINSEFKTIVGCGEAKCPKLKRLRLASTPDITLTVMIEIPKGSRNKYEYDKERKVIKFDRMLFSAVHYPSDYGFIVDTLAEDGDPLDALVLVWEPTFPGCMIETKPVGLFKMYDEKGPDAKLLCVPIGDPHFNFIRDLSDVPPHLLKEIFHFFNIYKELESKKTGVEGWEDRESAIKTYWESHQRYLDTLKDTKQEK

SEQ ID NO: 89427 - protein, 302 aa, Clostridium perfringens str. 13
MKYYNDIRDLIGNTPILKLNNISTKEGVNIYAKIEGTSPGGSCKDRVGIYMVEKAEKEGKLKPGSTIIEATAGNTGIGIALAAINKGYKIIFIVPDKFSIEKQKIMKALGAEIINTPKEEGMEGAINLANSLLSEIPNSLSLNQFKNEANPLAHYETTGRELYDGLDGEIDYFVAGAGSGGTISGVLKFLKENISEVKGILADPVGSIIGGGQCGTYKIEGIGNNFIPETMDMSLVDDVIKVNDEEAFDAVKLLAKKEGLIVGSSSGAAFAAVLKLAEKIEKGNIVTIFPDRGDRYFSTDLF

SEQ ID NO: 89428 - protein, 168 aa, Avena maroccana
VMASSATSVAPFQGLKSTAGLPVSRRSNAGLGSVSNGGRIRCMQVWPIEGIKKFETLSYLPPLSEEALLKQIDFLIRSKWVPCLEFSKVGFIFREHGSTPGYYDGRYWTMWKLPMFGCTDASQVIREVEEVKKEYPDAYVRIIGFDNIRQVQCVSFIAFKPPGCEESG

SEQ ID NO: 89429 - protein, 314 aa, Mycobacterium smegmatis str. MC2 155
MPIDPIAQKMLDDAKASGRPNAHLLPVPTARENFENTFAALQKPDVHRVTDVAIETRDGAVIPGRLYVPAEGDDLPLTVYYHGGGWLLGSVDSHDAATRLLAKASGSAVLSVGYRLAPESRFPTAVNDAIDAVEWARAFGATLGVDTSRLAVAGDSAGGNLAAAVALHYRDAGEPVIRHQLLVYPVTTTDLTKGMDPEYDGVMLERDELQWHQDNYLPGPDAASDPRVNVLGADLHGLPEATVILAECDPIRPQGELYLQALKDAGVPVESHLTPGQVHGFFGLDEIFPAATAAMTFAGQRLASALAVAGQSTR

SEQ ID NO: 89430 - protein, 141 aa, Nepenthes distillatoria
  misc_feature (48)..(48): Xaa can be any naturally occurring amino acid
  misc_feature (96)..(96): Xaa can be any naturally occurring amino acid
CLDKAAVVSDKEIKCEDFSNPWRLCTVTQVEELKILIRMFPIWATGIXFSAIYAQMSTMFVEQGEVMDRTIGSFTIPAASLSMFDTISVIFWVPVXDKILVPLARKFTGKQRGFSELQRMGIGLFISILSMAAAALVEMKR

SEQ ID NO: 89431 - protein, 267 aa, Rhizobium galegae
HLLRYDSIHGKFPASVEVSGDTIIVGGGKPIKVTAIKDPATLPHRELGVDIALECTGIFTARDKAAAHLTAGAKRVIVSAPADGADLTVVFGVNHDQLTREHLVISNASCTTNCLVPVVKVLDDAIGIDHGFMTTIHSYTGDQPTLDTMHKDLYRARAAALSMIPTSTGAAKAVGLVLPHLKGKLDGTSIRVPTPNVSVVDFKFVAKKTTTVAEVNEAIKAASNGALKGILGYTEEPLVSRDFNHDSHSSIFAIDQTKVLEGNFVRI

SEQ ID NO: 89432 - protein, 845 aa, Methanothermobacter thermautotrophicus str. Delta H
MDIQGLLERLKPFIIIVLLFSVVFYIRAEASNIGGVPADAKKFYEDADGLPYFSEMDSYYNYRLTMNYLTKGIMGDTLVDGKPYDLHSYYPPGRPVDYPPLIVYVTSAAYRVLNFFGDFSLKEVAFWMGAFIGSLCVIPAYLFVRRITNDYGGFAAALIVGLVPTYVAHTYAGFFDTDMFNFVLPLFVFWFFTEGMLASSMRGKVGYALAAAVSILVFSAAWVGYIFYLAVLIVFVAAYLVISRYILGEKPAGEFEGKLDWLIHQRELFPLLILIIAGGVLVGVFGGFSSLAGAVGGLIGATQIQATAQTTAYPNVYVSVSELQVPEFITTGAGNIFLPGQNTIVGGVGGLLVFIIGVLGVGALVWKYRQPEVVVEESENRPRAGKKSKFMRKKRAAVASEEMRHRYLLYAVLMAVWLIMSGYAVTKGSRFIPTFAMPLGLSAGIFTGFLVEYLRVRFTTTSSLALIVFVAAVAMVMPFGVSVAVKLLAGVLAAGFIYSVKKPEIRAPFMMVLVVLAAVAPSVSGAHSITTSVAPGTDDGMWNSMQWVKKNTSRDTVVMSWWDFGHLFAVAADRPVTFDGGSQNTPRAYWIGKALTTSNETLSRGILTMLSTSGDLAYETLDNYTDDSGKTAEILTATLGLPREEARAVMTGRYGLSDKEADSVLRYSHPAKPKPFVLVLSSDMLGKAPWWTYFGTWDFKKKTGSRYGYYPSLASSKPQVVNNTTVIQTVNTMVDQNNVLGTIIEKKANTTNATIAVGNNMTVQKINPHRLTIIEGDLLVKNEVVDSDAQLSLIVIGSGNQYTTIIMNRELEDSVFTKLFLLGGFNQTSFKFLHQEPGVLLWTAA

SEQ ID NO: 89433 - protein, 267 aa, Rhizobium giardinii
HLLRYDSIHGKFPADVKVEGDTIIVAGGKPIKVTAIKDPATLPHGAMGVDIALECTGIFTAREKAALHLQAGAKRVIVSAPADGADLTVVFGVNHNALTKEHLVISNASCTTNCLVPVVKTLDDVVGIDHGFMTTIHSYTGDQPTLDTMHKDLYRARAAALSMIPTSTGAAKAVGLVLPHLKGKLDGTSIRVPTPNVSVVDFKFVAKRDTTVAEINGAIKAASDGALKGILGYTDEPLVSRDFNHDSHSSIFANDQTKVLEGKFVRI

SEQ ID NO: 89434 - protein, 267 aa, Rhizobium gallicum
HLVRYDSIHGRFPAAVKVEGDTIVVANGRPIKVTAIKDPATLPHRELGVDIAMECTGIFTARDKAAAHLTAGAKRVLISAPADGADLTVVYGVNHDQLTKEHMVISNASCTTNCLVPVVKVLNDAVGIDHGFMTTIHSYTNDQPSLDQMHKDLYRARAAALSMIPTSTGAAKAVGLVLPELKGKLDGTSIRVPTPNVSVVDFKFVAKKATTVQEINEAIKAAANGKLKGVLGYTEEPLVSRDFNHDSQSSIFAIDQTKVMEGNFVRI

SEQ ID NO: 89435 - protein, 267 aa, Rhizobium huautlense
HLLRYDSIHNKFPAEVKVEGDTIIVGGGKPIKVTAVKDPATLPHKELGVDIALECTGIFTARDKAAAHLTAGAKRVIVSAPADGADLTVVYGVNHDQLTKDHLVISNASCTTNCLVPVVKVLDDAVGIDHGFMTTIHSYTGDQPTLDTMHKDLYRARAAALSMIPTSTGAAKAVGLVLPHLKGKLDGTSIRVPTPNVSVVDFKFVAKKTTSAAEINEAIKAASNGKLKGILGYTDEPLVSRDFNHDSHSSIFAIDQTKVLEGNFVRI

SEQ ID NO: 89436 - protein, 483 aa, Candidatus Pelagibacter ubique HTCC1002
MTIGWHFDNSYSRLPKTFKENINPVAVNAPEILILNKDLANKLDLDFSNINDDDLSKIFSGNILPEGSNSIAQAYAGHQFGHFTMLGDGRAVLIGEHLTKNNERFDIQFKGSGRTPFSRSGDGRAVLGPMLREYIISEAMHFLKIPTTRSLAVVKTGEDVVREQISQGAILTRVALGHLRVGTFQYIAAKQNISDLEILINYTIEKYYPNIKSSKNKALDLLNVLIEKQTQLVIDWMRVGFIHGVMNTDNMSISGETIDYGPCAFMDVYDPKTVFSSIDQLGRYAYENQPKITKWNLTRFAECLIPLISANEDEAIKLATEALDKFEQNYETKWLNMMRDKLGLYGEDKEDKNLIMELLNWMYEKKADYTNTFIFLMNKTIKNSEIYDNADFNLWKTKWMKRLVMFGNTHNKSMDLMSSSNPMVIPRNHKIEEALTLANNGDLTLFNKLIEILKNPYQVNENDLELMSPAPHSHVKYQTFCGT

SEQ ID NO: 89437 - protein, 267 aa, Rhizobium leguminosarum
HLLRYDSIHGRFPATVKVEGDSIIVGNGKPIKVTAIKDPATLPHRELGVDIAMECTGIFTARDKAAAHLTAGAKRVIVSAPADGADLTVVFGVNHDQLTKEHLVISNASCTTNCLVPVVKVLDDAVGIDHGFMTTIHSYTGDQPTLDTMHKDLYRARAAALSMIPTSTGAAKAVGLVLPHLKGKLDGTSIRVPTPNVSVVDFKFVAKKATSVGEINEAIQAAANGKLKGILGYTDEPLVSRDFNHDSHSSIFATDQTKVMEGSFVRV

SEQ ID NO: 89438 - protein, 253 aa, Candidatus Pelagibacter ubique HTCC1002
MEDKKVIWITGASSGIGKALAIKFAENGWMVAASARRENLLNELKKINQNIFPFPLDVTEVDACKLVAKDIIKQFNNIDICVFGTGMHDPKSEKKFNLDKIREIMEVNYFGTMNSINSIYDYFSEKKNGQISIISSVAGYRGLPAAGAYCASKSALTSFAESLNFDMRMKNVRVSLISPGFIKTPMTDQNDFPMPMIKTPEFAADEIYKGLVIKKGFEIHFPKAFTYFLKFLQMLPSSLYFKLVARGMKKIDY

SEQ ID NO: 89439 - protein, 251 aa, Populus trichocarpa
MEPNSEITKEKYGVDISSIREAQVRIDPYIHKTPVFTSGSLNDMCRRKLFFKCECFQKGGAFKFRGACNAIFSLNKDQADKGVVTHSSGNHAAALALAADLRDIPAYVVIPNNAPNCKIQNVIRYSGQITYSQPTLQSRETTTTKIMQETGAVLIHPYNDVRIISGQGTIALELLEQAPEIDTIIVPISGGGLISGVALAAKSINPSIRILAAEPCGANDAALSKAAGEIVKLPETNTIADGLRASLGSLT

SEQ ID NO: 89440 - protein, 294 aa, Lactobacillus gasseri
MKGIILAGGSGTRLYPLTLVTSKQLLPVYDKPMIYYPLSTLMLAGIKDILVISTPADTPRFKELLGDGSQFGINLSYKVQPTPDGLAQAFTLGKDFINGEPCAMVLGDNIFYGNGFTDLLKNAAEDAQKGKATVFGYYVNDPERFGVVDFDENGKAVSIEEKPEQPKSNYAVTGLYFYPAGVSEKAAQVKPSARGEVEITSLNDMYLQDDNLGVQLLGRGYAWLDTGTMQSLVDASNYVKMIEERQGVSVSAPEEIAYVHGWNDKDQLLEAAKHYGKSPYGKHLKSVAEGKVRY

SEQ ID NO: 89441 - protein, 353 aa, Candida albicans SC5314
MSTSMDLQPYTKLSQPYIQTSLTEVTNILPTKPPCRIFFKNELEQPSGSFKLRGIGHLVHKSIENALKNHSNKTIHVFASSGGNAGLAAAYSAQFYKVKCTVVLPIISKPVVQEKLKSYGARIVLFGNTINEADQHLKNLMSSIDLDSIYPVYCHPFNNPLIWNGHSSLVDEVSQQLDSKDRKLLKGMVCSFGGGGLYNGIYQGMVKNQIRGDILLIETLQAPTLTQSLEADEVITLKSVNSLATSLACSYTTEQSLKYYKDQSLVKSQVELIDDIDSLRACVAFEKCFGKVVEPACGAAMAVVYNKIDLLYKNFKHLQPEDIVVIVVCGGSCTTGSDLKGFEKMIQKSEIKL

SEQ ID NO: 89442 - protein, 172 aa, Moorella thermoacetica ATCC 39073
MTLANRVTMLRLMLVPLFVFFILRPWGPGYYLAAGLFLLAAATDGLDGYLARRRAEVSGLGKLLDPLVDKLLVTTALVLLVQMHLVPGWAVVLIIGREFLISGLRQVAAGEGLILAASYWGKIKTFAQVIAVVALLVGIPWALLILYGALALTLISGFHYFFLNRELLYRLG

SEQ ID NO: 89443 - protein, 500 aa, Azoarcus sp. BH72
MTLYPDQLISPATRAFLARPKRMLIGAEWSAAVSGETLAVLDPATGQAFATVPAGGAADIDRAVAAARRAFESGEWPKMRPVDRERLLLKFADLIEANAQELAEIEALDNGKPVMMARHVDVALVVDFLRYMAGWATKIEGSTMDVSVPLMRDRELFGFTRREPVGVVGAIIPWNFPLLMAAWKVGPALTSGCTMVLKPAEETPLTALRFAELALEAGYPAGVLNVVTGHGDTAGAALASHKGIEKVAFTGSTEIGKLVGKAAIDNMTRVSLELGGKSPVIVLDDADPAMAAAGAAQAIFFNQGQVCTAGSRLFIHKSRFEKVVEGLSGIAASMKLGPGIDPSTQIGPLVSAVQQQRVLGYIESGLAEGARAATGGGAGGEAGYFVKPTVLVNAHDAMKVVREEIFGPVVVAMPYEDLDEVAHRANDTPYGLAASIWSNDLTRVHRLIPKIKAGTVWVNCHNILDNAMPFGGYKQSGIGREMGRAVLDMYTESKSVIMAL

SEQ ID NO: 89444 - protein, 479 aa, Candida glabrata CBS 138
MSDIESEADLLADLDNDFEDNEISDGGDELEDKSIEDLDVTEAYDFKNQHYEANDEDQIIVDNSAKTLKDLVKYLGAKSNVDHKGLQTEIVNLETIKHLIAISSNEPEIIKTLNEIQQYCKVISEKCYFELTEIYEDKFSELKSILRLPHQYAQCISLLEQGLELEQVVLRFEELCSTSRELIMVLNMSLRADYKGNYKLTDTNKKSLHKLTSIIFEAHDIIRFVSVEIANRIGEIAPNLCALLGTNTASLLVSHTGGLLQLSKIPSCNIANIGKKNTKDHNILNFSNPGGYIFQNELVQNQPIENHKQMMRMLSSKVSLAARVDAGLKTGDKNNKLGKQWRVEIEEKIKKIRAPPNISDVKALPIPEDKPKKKRAGRKFRKYKEQFKLSGTRQLQNRMVFGKQEATIYDTFGDEVGLGMTSQRKNGLAISTTGSSFGVKKPQYIQKKLKDSKRSTQEYIDALADRIDEHANLIKPNGS

SEQ ID NO: 89445 - protein, 164 aa, Zea mays
MASPSSSSFPSRKALSKIACRRLQKELTEWQVNPPAGFEHRVTDNLQRWVVDVAGAPGTLYTGETYKLQVDFSEHYPMEAPQVIFLHPAPMHPHIYSNGHICLDILYDSWSPAMTVSSICISILSMLSSSPAKQRPADNDRYVRNCRNGRSPKETTWWFHDDTV

SEQ ID NO: 89446 - protein, 132 aa, Scenedesmus obliquus
MSTVNEIIEKLKTLTLLEASELVSQIEETFGVDASAPVGGGVMMAAMPAAGGADAAPKEEEKTLFDVVLEEIPADKKVGIYKVVRNIANIAVNQVKEFTGTLPKALKESVSKEEAEAAKQQLEDAGAKVKIV

SEQ ID NO: 89447 - protein, 391 aa, Triticum aestivum
MLACALQTMGSSCSRPHSVNEAEAADNTRSADIDRRILQETKADQHVHKLLLLGAGESGKSTIFKQIKLLFRTGFDEAELKGYTPVIHANVFQTIKILYDGAKELAQLETESSKNVISPDNQEIGEKLSEIGGRLDYPLLNKELVQDVRKLWEDPAIQETYSCGSVLQVPDCAHYFMENLDRLAEPDYIPTKEDVLHARVRTNGVVEIQFSPLGESKRGGEVYRLYDVGGQRNERRKWIHLFEGVDAAIFCAAISEYDQLLFEDGTQNRMMETKELFDWVLKQRCFEKTSFMLFLNKFDIFEREIQKVPLTVCEWFKDYEPIAPGKVQDVEHAYEFVKKKFEEVYFQSSKPERVDRVFKIYRTTALDQKLVKKTFKLIDESMRRSREGTGT

SEQ ID NO: 89448 - protein, 261 aa, Zea mays
MSSRSPPPKDRRMRTERTSYRGAPYRRDSRHGPSRFRNDLCNNCKRPGHFARECPSVAVCHTCGLPGHIAAECSSKGTCWNCKEPGHMANSCPNEGICRNCGKSGHIARDCTAPPVPPGEVILCSNCYKPGHFREECTNEKACNNCRQSGHIARNCTNDPVCNLCNVAGHLARQCPKSDTLGERGGPPPFHGVGAPFRGVGVPFRGGLSDVICRACNQIGHASRDCMAGAFMICHNCGGRGHTAYECPSVSLIERFPPRRF

SEQ ID NO: 89449 - protein, 296 aa, Triticum aestivum
ELVQKHVDDNADITLSCAPVGESRASEYGLVKFDSSGRVVQFSEKPKGDDLEAMKVDTSFLNFAIDDPAKYPYIASMGVYVFKRDVLLNLLKSRYAELHDFGSEILPRALHDHNVQAYVFTDYWEDIGTIRSFFDANMSLCEQPPKFEFYDPKTPFFTSPRYLPPTKSDKCRIKEAIILHGCFLRECKIEHSIIGVPSRLNSGSELKNAMMMGADSYETEDEISRLMSEGKVPIGVGENTKISNCIIDMNARIGRDVVISNKEGVQEADRPEEGYYIRSGIVVIQKNATIKDGTVV

SEQ ID NO: 89450 - protein, 398 aa, Arabidopsis thaliana
MAIISETSDDGSHGGVPNKKPEELHKNPKEDDHQEEEVENHPPIPRQIPQALIRRTVALIKRCHYPSLSLLSKAFRIVISSPELHQTRSSLNLTEPVLYALIGFPPHSFPNWFILNHNITRNIPLRLSAIGSLPPMNPGSAVVTIGYKMYVIGGLIGPNNPVKTVFVIDCRVHTCNYLPTMHRARYRAVAEVINGKIYVIGGCEKRYDDWIEVFDVVTGIWSTVPDRSHFMSSLPGGGFVTSVVMQNKIYILDATCGLVYDPIDGTWESGELGTTLKSYWYKPCCVIEDLLYSFDPYCLQGSPINVYDPNVMVWTPMMGTGIRAFPDLDYFECKMANFGGKLMVFGATYNNPVTDTWCIEMALIKGETGPILGMIDSMVPVLRSVYSPYIDLCRSVTF

SEQ ID NO: 89451 - protein, 217 aa, Moorella thermoacetica ATCC 39073
MEQNRFLKVKNLRIYDISMPIYPGMPVYKNRAEKQPQTEITRNYENGVRETRWLLDTHTGTHIDAPAHVIPGGGTTADLDLSCLIGSCRVLDLTAVNDRITAGDLAGQPVRIGDFILLKTKNSWAAGNEVDFIYLDAGAAAHLAKAGVRGVGLDALGMERDQPDYPTHRTLLERGIIIIEGLRLREVPPGAYQMLALPLRLLGAEASPARVVLLDRE

SEQ ID NO: 89452 - protein, 349 aa, Xanthomonas campestris pv. campestris str. 8004
MRLGRRQGVGCVRYIVVVALCLAALFFSSRVSAACVQLEAPTSSHNGDWSCADQGEAFAKVSSFPVPADLAKCAMKAVRAVASGPGFSQRMTYPGNTCGIGYELDIGTGSAQFPEASTCAKRPAQSGWINPTAPTPSDVCNDGCYYTYSVDPGNPKGYSYTPSGATCTTDDAAPPIDDGGDGSDGDGGGDGGGDGGGDGGGDGGGDGGGDGGGDGGGDGGGDGGGDGDGDGDGDGDTPGDGDGTTPGDGEGGEGAPMSELYKKSGKTVESVLSKFNTQVRATPMVGGITDFMTVPSGGSCPVFSLGASKWWNAMTINFHCGGDFLAFLRAAGWVILAIAAYAALRIAVT

SEQ ID NO: 89453 - protein, 228 aa, Nepenthes mapuluensis
  misc_feature (1)..(2): Xaa can be any naturally occurring amino acid
  misc_feature (6)..(7): Xaa can be any naturally occurring amino acid
  misc_feature (9)..(9): Xaa can be any naturally occurring amino acid
  misc_feature (18)..(18): Xaa can be any naturally occurring amino acid
  misc_feature (32)..(32): Xaa can be any naturally occurring amino acid
  misc_feature (48)..(48): Xaa can be any naturally occurring amino acid
  misc_feature (59)..(59): Xaa can be any naturally occurring amino acid
XXGWAXXFXIPAISMGIXITSFFSGTALYRLXKPGGSPLTRMCQVLVXSFRKSRLALPXDSSLLYETSDKNSVIEGSRKLEHTNELKCLDKAAVVSDKEIKCEDFSNPWRLCTVTQIEELKILIRMFPIWATGIIFSAIYAQMSTMFVEQGEVMDRTIGSFTIPAASLSMFDTISVIFWVPVYDKILVPLARKFTGKQRGFSELQRMGIGLFISILSMAAAALVEMKR

SEQ ID NO: 89454 - protein, 504 aa, Moorella thermoacetica ATCC 39073
MAPDRLDNSLLVIFGGTGDLARRKLYPALFNLFVDGFLPPALGVIAVGRCGFTRDSFRQEILLPSLETFSRRAASLDAYFEPFATRLHYFRTDIYDPEGYTRLGQFLVELEEAAGSRGNRIFYLAVAPEHFGPVIRSLKETGLVPARGWQRVVIEKPFGHDLPSATELNRQLREAFSEEEIYRIDHYLGKEMIQNIMVIRFANTFFEPVWNNKYIDHVQITSAETVGVENRGGYYDRAGALRDMVQNHLLQLVTLVAMEPPASLATEAIRDEKVKVLRSLKPLDAAAVSKNAIRGQYGAGEIDGQMVPPYRQEKEVAPDSTTETFVALKLFIDNFRWAGVPFYLRTGKRLPLKVTEIILQFKSLPDILYFKEYGELRPNLLVIRVQPLEGVYVQLNAKRPGNNNYIVPIRLDFCQNCEVGVNSPEAYERLLYDVMRGDPTLFTRWDEVEAAWKFVDPISAAWAAQGQPQFPNYAAGQWGPPAAQRLLICDARRWWEENGAESIS

SEQ ID NO: 89455 - protein, 181 aa, Methanothermobacter thermautotrophicus str. Delta H
MTDVDIKIENIVASATLGKSIDLQTVAEALENVDFNREQFPGLVYKLKEPKTAALIFGSGKLVCTGAKSIEDSKRAIKLTVDMMRTMDPDIPEEFEIKIQNIVASANLGKPLNLEAVALGLENTEYEPEQFPGLVYRLDDPKVVLLLFGSGKVVCTGAKSAEDAKLGVEKTKARLAELDLI

SEQ ID NO: 89456 - protein, 449 aa, Lactobacillus plantarum WCFS1
MISQNHRLDQQLIEREDHYMATAARINYYDLVIDHAHGALLTDVDGNQYIDLLASASAINVGHTHPRVVKAIQEQAAKLIHYTPAYFHHQPEQRLAERLAKSAPGTDNEVVFGNSGSDANDAIIKFARAYTNRQYIVAYTDAYHGSTYGSMSLSGVSLNMVRKMGPLLPGIVHVPYPDCYRTLPHETEHELALRYFEAFKAPFDSYLPAEETACVIIEPIQGDGGIRKAPAEYVQLVYDFCHQHGILFAVDEVNQGMGRTGKMWSIQNFPGIRPDLMSVGKSLASGLPLSAVIGRREVMESLAAPAHTFTTAANPVCCAAALATIDVLADEQLVARSANYGRYAKEQFLALQQRHPKIGQVRMYGLNGGIELVTDRQSQQPDPDFASDVIYAAFERGVVMITLKGNILRFQPPLVITKTQLDTALTVLDEAMAAAEQGLVKRPQGKIGW

SEQ ID NO: 89457 - protein, 499 aa, Lactobacillus plantarum WCFS1
MQRLLKRLTLKEDPSIYEDKDSHLARVLTVKDFLALGVGTIVSTSIFTLPGVVAANHAGPAVVFSFIVAAVVAGLVAFAYAEMAAAMPFAGSAYSWINVMFGEFFGWIAGWALLAEYFIALAFVGSGLSANLRGLLSPLGLTLPKALSNTFGTDGGVVDLIAVLVIALVSLLLSRGISKASRVENVLVVLKVLAVLTFIVVGATAIHVQNYVPFIPKYHLNADGSAFGGWQGIYAGVSMIFLAYIGFDSIAANSAEAKNPGKTMPRGILGSLVIAVVLFVAVALVLVGMFKYSSYANNAEPVGWALRQAGHPIVASVIQAIAVLGMFTALIGMTLAGSRLIYSFGRDGMLPKWLGKLHRNQPNNALLVLTIVAIIIGAFCPFAFLAQLISAGTLIAFMFVSLGIYALRRREGVDIAVPAFKMPFYPVLPAIAFLGALFVFMGLDIQAKLYAGVWFIVGLVIYFSYGMRHSYLAEKRLSETDTAAKSASKVADSTVEERD

SEQ ID NO: 89458 - protein, 224 aa, Nepenthes madagascariensis
  misc_feature (13)..(13): Xaa can be any naturally occurring amino acid
  misc_feature (32)..(32): Xaa can be any naturally occurring amino acid
  misc_feature (51)..(51): Xaa can be any naturally occurring amino acid
  misc_feature (62)..(62): Xaa can be any naturally occurring amino acid
  misc_feature (107)..(107): Xaa can be any naturally occurring amino acid
  misc_feature (131)..(131): Xaa can be any naturally occurring amino acid
  misc_feature (136)..(136): Xaa can be any naturally occurring amino acid
  misc_feature (157)..(157): Xaa can be any naturally occurring amino acid
  misc_feature (213)..(213): Xaa can be any naturally occurring amino acid
NLGWALGFGIPAXSMGIAIASFFSGTALYRLXKPGGSPLTRMCQVLVASFXKSKLTLPEDSXLLYETSDKNSVIEGSRKLEHTDELRCLDKAAVLSDKEIKCEDFSXPWRLCTVTQVEELKILIRMFPIWXTGIVXSAIYAQMSTMFVEQGEVMDRXIGSFTIPAASISTFDTISVIFWVPVYDKILVPLARKFTGKQRGFSELQRMGIGLFXSILSMAAAALV

SEQ ID NO: 89459 - protein, 235 aa, Nepenthes khasiana
  misc_feature (7)..(7): Xaa can be any naturally occurring amino acid
  misc_feature (9)..(9): Xaa can be any naturally occurring amino acid
  misc_feature (32)..(32): Xaa can be any naturally occurring amino acid
  misc_feature (37)..(37): Xaa can be any naturally occurring amino acid
  misc_feature (39)..(39): Xaa can be any naturally occurring amino acid
  misc_feature (44)..(44): Xaa can be any naturally occurring amino acid
  misc_feature (69)..(69): Xaa can be any naturally occurring amino acid
LIVWVQXNXGWALGFGIPAISMGIAIASFFSXTALYXLXKPGGXPLTRMCQVLVPSFRKSKLALPEDSXLLYETSDKNSAIEGSRKLEHTDELRCLDKAAVLSDKEIKCDDFSNPWRLCTVTQVEELKILIRMFPIWATGIVFSAIYAQMSTMFVEQGEVMDRTVGSFTIPAASLSTCDTISVIFWVPVYDKILVPLARKFTGKQRGFSELQRMGIGLFISILSMAAAALVEMKR

SEQ ID NO: 89460 - protein, 402 aa, Xanthomonas campestris pv. campestris str. 8004
MQRSFWRSGHTPTLFASFLYFDLSFMVWYLLGPLQVPIAQALGLDTQQRALMVAVPILCGAVLRLVLGMLADRIGAKRAGVVAQLAVIASLFGAWQLGVHSMGQVLLLGVLLGIAGASFAVALPLASRWYPPEHQCTAMGIAGAGNSGTVLAALFAPMLALAFGYQNVFGLACIPLVLTLLVFVLIAREAPIPVARKRWADYGRVLVGNRDAWRFMFFYSVTFGGFSGFASALPGYFHDQFGFDARTAGWATAACVLAGSVMRPLGGVIADRVGGTRALLAVYLLVATLVGIAGFGAGGATITLGLFVLTLLCLGAGNGAVFQLVPQRFGQDIGVMTGLIGMAGGVGGFALAAGLGVLKQHTGSYAIGMWLFAAFALGGWALLAGVKTQWRSEWSTAGAARV

SEQ ID NO: 89461 - protein, 502 aa, Aspergillus fumigatus
MPTLGGLLKKRRTKDSHTLSKELESSSSPAAAQTQTSPNSADHDHHYQHYDQTHHHQHSASSNPSNNSATPSAAQPHRSSNDNPNRSSGTDQKSEGQTASMQFAVTQPHPSTHHNPRLHHLQQQQQQQQQQQQQQQQQQPQQQSHTSRLHNILHPSHHASSQASTEGHAHSQQANQTEARTTKGKYSLDDFTIQRTLGTGSFGRVHLVQSKHNHRFYAIKVLKKAQVVKMKQVEHTNDERRMLNRVRHPFLITLWGTWQDARNLYMVMDFVEGGELFSLLRKSQRFPNPVAKFYAAEVTLALEYLHSQQIIYRDLKPENLLLDRHGHLKITDFGFAKEVPDITWTLCGTPDYLAPEVVSSKGYNKSVDWWSLGILIFEMLCGFTPFWDSGSPVKIYENILRGRVKYPPYLHPDAVDLLSQLITADLTKRLGNLHGGSEDVKNHPWFAEVTWDRLARKDIDAPYVPPIRGGQGDASQYDRYPEETEQYGQQGEDVHGHLFPDF

SEQ ID NO: 89462 - protein, 584 aa, Aspergillus nidulans FGSC A4
MASQFSKADMGAGLSLAELPKSNVFTSKLPPDPAFDTPEASHKAQRERLYPRTVKGAAFTFVRPETTEDPELLGVSPRAMKDLGLKPGEENTAQFKAVVAGNEFYWDEENGGVYPWAQCYGVVLAFRHEGTEAEHQQRAISLFESTNPSTNVRYEVQLKGAGRTPYSRFADGKAVLRSSIHVVAISNTCIFGTFDLPHSRGDRNMVRKLATYVAEDVFNGWESLPGAVSVGKDQQADSVEDPPRGLLGDKIQDHHGVEENRFARLYREIARRNAKTVAAWQAYGFMNGVLNTDNTSVYGLSLDYGPFAFMDNFDPQYTPNHDDHMLRYSYKNQPSVIWWNLVRLGECLGELIGAGPQVDDENFVKQGVTEDAAPALIKRAETIIERTGDEYRTVFLNQYKCLMSKRLGLRTQKESDFQELYSELLDTLEALELDFNHFFRRLSSVPIVDLETEAGRKDIAHIFFHIEGHGGIGYTEDSARERIAKWLDRWRQRVLEDWGTEADADIKRQEAMKKVNPKFVPRGWILEEVIERVERRGDRDILGRVMNMALNPFNEEWGLNREEEERFCGDVPRFQRAMMCSCSS

SEQ ID NO: 89463 - protein, 268 aa, Rhizobium undicola
HLLRYDSIHGRFPADVKVEGDSIVINGGKPIKVTAVKDPATLPHKELGVDIAMECTGIFTARDKAAAHLTAGAKRVIVSAPADGADLTVVYGVNHDQLTKDHLVISNASCTTNCLAPVAKVLNDAVGIDHGFMTTIHSYTNDQPSLDQMHKDLYRARAAALSMIPTSTGAAKAVGLVLPELKGKLDGTSVRVPTPNVSVVDLKFVAKRATTVQEINDAIKAAATNGPLKGVLGFTEEPLVSRDFNHDAHSSIFAIDQTKVLEGTFVRI

SEQ ID NO: 89464 - protein, 223 aa, Nepenthes pilosa
  misc_feature (223)..(223): Xaa can be any naturally occurring amino acid
LGWALGFGIPAISMGIAIASFFSGTALYRLQKPGGSPLTRMCQVLVASFRKSKLALPEDSNLLYETSDGNSVIEGSRKLEHTNELKCLDKAAVVSDKEIKCEDFSNPWRLCTVTQIEELKILIRMFPIWATGIIFSAIYAQMSTMFVEQGEVMDRTIGSFTIPAASLSMFDTISVIFWVPVYDKILVPLARKFTGKQRGFSELQRMGIGLFIAILSMAAAALX

SEQ ID NO: 89465 - protein, 176 aa, Aspergillus nidulans FGSC A4
MSFGGRVCFNCGEATHQARDCPKKGTPTCYNCGVLDRLGQGHVSRECTVAPKEKSCYRCGAVGHISRECPQAGENERPAGGQECYKCGRVGHIARNCSQGGSYGGGFGGGYGGRQQTCYSCGGFGHMARDCTQGQKCYNCGETGHVSRDCPTEAKGERVCYQCKQPGHIQSACPNN

SEQ ID NO: 89466 - protein, 267 aa, Agrobacterium tumefaciens
HLLRYDSIHGKFPADVKVEGDTIIVGGGKPIKVTAVRDPATLPHKELGVDIALECTGIFTARDKAAAHLTAGAKRVIVSAPADGADLTVVFGVNDDQLTKDHLVISNASCTTNCLVPVVKVLDDVVGIDHGFMTTIHSYTGDQPTLDTMHKDLYRARAAALSMIPTSTGAAKAVGLVLPHLKGKLDGTSIRVPTPNVSVVDFKFIAKRDTTVEEINEAIKSAANGKLKGILGYTEEPLVSRDFNHDSHSSIFAIDQTKVMEGKFVRV

SEQ ID NO: 89467 - protein, 312 aa, Zea mays
MASKYVARVPSPWWAPQRRLVGSWVSVCSVKCGALGGRDVVCAAVSFRPCIDIHKGKVKQIVGSTLRDSSNDGMELVTNFESDKSPAEFAKSYKEDELLGGHVIMLGSDPASQAAALEALHAYPGGLQVGGGINLQNAMSYLNEGASHVIVTSYVLSDGKMNIERLTKLVELVGKQRLVLDLSCRKKDGRYTIVTDRWQKFSDVFVDEPALEYLAAFVDEFLVHGVDVEGKRLGIDEELVELLGHHSPIPVTYAGGVSTMDDLERIKKAGKSRVDVTVGSALDIFGGDLPYKDVVLWHKKQSMVGQVSRNMW

SEQ ID NO: 89468 - protein, 503 aa, Burkholderia sp. 383
MTHNSERPADPAGGADSRHADPDAMFASHEAGYAKQLKPRHVQMIAMGGAIGTGLFLGAGGRLQHAGPALALVYLVCGVFAFLIMRALGELVMHRPTSGSFVSYAREFMGERASFVAGWMYYLNWATTGIVDITAVAIYMKYWAVFTDVPQWVFALGALGIVSVMNMIGVKVFGEMEFWFSIVKVGTLAVFLAVGAVFLASGHPVAGQMPGLHLVADHGGIFPHGILPAVLIVQGVVFAYASIELVGVAAGETADARKVLPKAINSVMWRIALFYVGSVVLLTMLLPWTAYSAHESPFVTFFSKLGVPYVGTVMNVVVLTAALSSLNSGLYSTGRVLRSLAMGGSAPRFVSRMNARGAPYGGILITVAINAIGVPLNYIVPAQAFEIVLNMASLGIITTWGFIVMCQILFRRAVDRGELKAVSFRMPGAPFTSWLTLAFLVGVLVLMAFDYPGGTWTIATIPVVVLALVVGWKLAKRGAAREQVADARASAATHAVADPARGA

SEQ ID NO: 89469 - protein, 234 aa, Nepenthes insignis
  misc_feature (12)..(12): Xaa can be any naturally occurring amino acid
  misc_feature (15)..(15): Xaa can be any naturally occurring amino acid
  misc_feature (219)..(220): Xaa can be any naturally occurring amino acid
IVWVQENLGWAXGFXIPAISMGIAIASFFSGTALYRLQKPGGSPLTRMCQVLVASFRKSKLALPEDSNLLYETSDENSVIEGSRKLEHTNELKCLDKAAVVSDKEIKCEDFSNPWRLCTVTQIEELKILIRMFPIWATGIVFSAIYAQMSTMFVEQGEVMDRTIGSFTIPAASLSMFDTISVIFWVPVYDKILVPLARKFTGKQRGFSELQRMGIGLFXXILSMAAAALVEMKR

SEQ ID NO: 89470 - protein, 267 aa, Agrobacterium rhizogenes
HLLRYDSIHGKFPAEVKVEGDTIIVGGGKPIKVTAIKDPATLPHRDLGVDIAMECTGIFTSRDKAAAHLTAGAKRVIISAPADGADLTVVFGVNHDQLTKEHLVISNASCTTNCLVPVVKVLDDAVGIDHGFMTTIHSYTGDQPTLDTMHKDLYRARAAALSMIPTSTGAAKAVGLVLPHLKGKLDGTSIRVPTPNVSVVDFKFVAKKATTVGEINEAIKAASNGKLKGILGYTDEPLVSRDFNHDSHSSIFATDQTKVMEGNFVRI

SEQ ID NO: 89471 - protein, 267 aa, Agrobacterium rubi
HLLRYDSIHGKFPADVKVEGDTIIVAGGKPIKVTAVRDPAQLPHKELGVDIALECTGIFVARDKAAAHLTAGAKRVIISAPAEGADLTVVFGVNHDQLTKDHLVISNASCTTNCLVPVVKVLDDLVGIDHGFMTTIHSYTGDQPTLDTMHKDLYRARAAALSMIPTSTGAAKAVGLVLPHLKGKLDGTSIRVPTPNVSVVDFKFVAKKATTVEEINNAIKSASNGALKGILGYTDEPLVSRDFNHDSHSSIFATDQTKVMEGNFVRI

SEQ ID NO: 89472 - protein, 266 aa, Agrobacterium vitis
HLLRYDSVHGRFPSTVKVEGDSIIIDGRAPIKVTAVRDPKDLPWSNVDIALECTGIFTAKEKASLHLANGSKRVLVSAPADGADKTIVYGVNHNTLTKDDLVVSNASCTTNCLAPVAYVLQKLVGIESGYMTTIHSYTGDQPTLDTMHKDLHRARAAALSMIPTSTGAAKAVGLVLPELKGKLDGSAIRVPTPNVSVVDLKFIPGRTVTKEEINAAIKAASEGELKGILGYTEEPLVSIDFNHDSHSSTFSGDQTKVMDGGKLVRI

SEQ ID NO: 89473 - protein, 441 aa, Corynebacterium glutamicum ATCC 13032
MDSHCGFGGPRCFQEFGYPCSMHVTDDFLSFIALSPSSYHAAAAVERRLLHEGFIRQEDTDEWDARPGGHVTVRGGAVVAWWVPEDASPDSGFRIIGSHTDSPGFKLKPRGDLSSHGWQQAGVEVYGGPILPSWLDRELALAGRIVLADGSVKLVNTGPILRIPHVAIHLDRTVNSQLTLNPQRHLQPVFAVGEPDVSILDVIAGAAVVDPADIVSHDLITVATQDAEVFGAHGDFLASGRLDNLSSVHPSMTALIAASQSDDTGSDILVLAAFDHEEVGSNSTSGAGGPLLEDVLNRTARALGADEDERRRMFNRSTMVSADAAHSIHPNFPEKHDQANYPIIGKGPVLKVNANQRYTSDAVTSGMWIRACQIAGVPHQVFAGNNDVPCGSTIGPISATRLGIDSVDVGIPLLSMHSAREMAGVKDLMWFEQALEAYLVN

SEQ ID NO: 89474 - protein, 675 aa, Zea mays
  misc_feature (113)..(113): Xaa can be any naturally occurring amino acid
  misc_feature (139)..(139): Xaa can be any naturally occurring amino acid
MPMSDSSLRALTVLFVLAALVSDVEGRHDRPVNCPHFSCGGFSNISYPFRRQGDPSGCGVQSYELLCTDTDATIRIGSGTYKVLSINSTYSHFWVVDANLDIQSSCPLPRWDXMLVGSISTHIVGGLSSAMIISILLLXYIYSGWAIFVNCSQPIENNDTDIFQIYEPVSCLSNSSFIYLVTDYWYDGHVPAGTLEPSCGYLAMTPLGGPGMPVPRNTSYPDVVKFMRSGFALRFPFSIGSYPTIRECLAENMRTFHKEPRNSTGIRQQILDILTFETLWFCFIEQLGSTNNRVKSVLINIIVRRIPFVLWGLKSAHVICRFVLMPLAVFVFLAYKYWKTRITIDAVEKFLRMHHMLVPMRYAYTNIIAITAHFRDKLGQGGYGTVYKGVLQPGEVNVAVKMLGNSNCNGEEFISEVATIGKIHHVNVVHLIGFCSEENIRALIYEFMPRGSLDKYIFSSEKSFSWDKLNEIALGIARGLNYLHHGCDMQIVHFDIKPHNILLDSNFVPKVADFGLAKLFPRGDSFVPLSAMRGTIGYIAPEMVSRSFGVISSKSDVYSFGMLLLEMTGGRRNADPHAGSSSQAYYPSFVYRQLSQGDANMISEGVDMHELEKKLCIIGLWCIQMKPQDRPTMSEVIEMLEAGVDGIQMPPRPYFCDEEGESSYSTISELDPIEE

SEQ ID NO: 89475 - protein, 472 aa, Bacillus cereus ATCC 10987
MNHLRGGSEVANKELKRGLEARHIQMIALGGTIGVGLFMGSASTIKWTGPSVMLAYAIAGIFIFFIMRAMGEMLYMEPSTGSFATFGHKYIHPLAGYMTAWSNWFQWVIVGMSEIIAVGAYMQYWFPDLPAWIPGVIAMVILGAANLISVKSFGEFEFWFAMIKIVTILLMIIAGFGLIFFGIGNGGEAIGISNLWSNGGFFTGGFSGFFFALSLVVGAYQGVELIGITAGEAKDPKKTLTRAIQSTIWRILIFYIGAIFVIVTVYPWDQLSTIGSPFVATFAKVGITAAAGLINFVVITAAMSGCNSGIYSAGRMLYTLGVNGQAPKYFTKLSGNGVPLFGTVGVIIGLAIGVVLSYIAPKNLFVYVYSASVLPGMVPWFVILISQINFRKEKGAEMKDHPFKMPFAPVTNYLTIAFLIMVLIGMWFNDDTRISLIVGIIFLAIVTISFYAFGIGKRTPLDVQNDQEISSK

SEQ ID NO: 89476 - protein, 251 aa, Candida albicans SC5314
MHTFYLPFILSLSMPPKKKSSKTIYKFPQSFHDLPKSLSKNYYQPEPESIINDQIIIIKNFFNKDLCNELIKSFETQLNMETTPLIKSKEYAARFNDRSSMNDLLSANILWQYLQKILLDNPYNDEDLKEINQIFQDAVGLNPQLRVYRYTRGHHFGKHYDDSVICPIPPQGTKKGYTTWTLLIYLTGDEEFKGGGTIFYPEIKNIKPLNIHPNKGMALLHKHGDDCLKHEAEMVANGAKWVLRSDVVFPI

SEQ ID NO: 89477 - protein, 323 aa, Photobacterium profundum SS9
MKRIAIIGECMIELNGAPFGTMQQAYGGDSLNTAVYMARTAGQSVEIDYISALGTDTISNGMISRWQQEGINTDYVLRDKTRQPGLYLIQLDDQGERTFLYWRNQSAARYLVRHPNFAQVELHLQTVDMVYVSGISLAVLPAEDRQQLVTLLGQLSSNGVEIAFDSNYRPALWESADEARKCYKQILSFTNLALVTDDDEETLWGDTSSQATLGRLQSTGVKKAVLKMGPKGCLYTDFTTDKPELIGTTPVETVIDTTSAGDSFNAGFLSGYLTDKTPREAALQGHQLAGTVIQHKGAIIPCYATEAMDFNIHSTASTTTTKL

SEQ ID NO: 89478 - protein, 339 aa, Brassica napus
MADKKIKIGINGFGRIGRLVARVILQRSDVELVAVNDPFITTEYMTYMFKYDSVHGQWKHNELKVKDEKTLLFGEKPVTVFGIRNPEDIPWGEAGADFVVESTGVFTDKDKAAAHLKGGAKKVVISAPSKDAPMFVVGVNEHEYKSDLNIVSNASCTTNCLAPLAKVINDRFGIVEGLMTTVHSITATQKTVDGPSMKDWRGGRAASFNIIPSSTGAAKAVGKVLPQLNGKLTGMSFRVPTVDVSVVDLTVRLEKAATYDEIEKAIKEESEDKLKGILGYTEDDVVSTDFVGDNRSSIFDAKAGIALSDNFVKLVSWYDNEWGYSTRVVDLIIHMSKAA

SEQ ID NO: 89479 - protein, 220 aa, Magnetospirillum magnetotacticum MS-1
EGEYSNAGGRMFPGTEREFAVQESVFTRHGVDRVLTFAFDLARSRPKRHLTSATKSNGISITMPFWDERVRAVAESYPDVRWDQYHIDILTAHFVLNPDRFDVVVASNLFGDILSDLGPACTGTIGIAPSGNINPERRYPSVFEPVHGSAPDIAGQGVANPIGQIWSGAMMLEHLGEREAAAEIVAGIERVLTEKALRTRDLGGTADTQTCGRAVEQALG

SEQ ID NO: 89480 - protein, 402 aa, Bordetella parapertussis 12822
MPATLTDELVAVLRARTPGAQGAFIHFNHAGASLPSAGTLQAIEAHLRLEATQGPMEAGVRAREQAERARLLAARLLNAQPAEVALTTGNSAGWGAAFAALGPWRAGDRILVARHEWSGNLAAMRLAAQRAGATIETIASDESGAVDPGALQAMLDERVRLIALTWLPANGGLVNPAAAVGRIARRHGIAYFVDAAQAVGQLPIDVAEVGCDVLSGTGRKALRGPRGTGLLYVRQAFLERLAPAWVDTWSAPLGEDGCPIVRGDAARFESAENSVALRCGLAHALHEALELDIASIRARIDAVATRLRTRLAALDGITLLDQGRVRSGLIAFDVAGWQADAVQRELARQGIALGCNGVAYTPLDMQARGLRQIARASVSYLTTEAEIDALLDALAALARRTP

SEQ ID NO: 89481 - protein, 395 aa, Rhizobium leguminosarum bv. viciae 3841
MFEKLTAQPADSLLALIKAFQADPRGYKVDLGVGVYRDEQGRTPVMRAVKLAEKQLLETQDSKRYLGPEGDLNFVNLLKPIIFGATHNAGNVVGIQTPGGSGALRLGAELIASATPGAKVWLGTPSWPNHAPIFESARLTVKDYRFVDLAKQQIDFDRVLEALDAAQAGDVILLHGCCHNPTGIDFDIQQWKQIAAKLVERKLLPFIDLAYQGLGDGLEADAEPTRLILEAVDEALVAYSCDKNFGLYRERVGALYLVSRNADQLKIADGNMASLARVNWSMPPDHGAAIVRVILESAELTQIWKQELVEMCARVNGNRAALAASHPELGFIANQRGLFSNLAMSKETAVALCHKHGIYMADSGRMNLAGMQPSDAAAIVKALSAEGTLSTRSAA

SEQ ID NO: 89482 - protein, 264 aa, Prosthecochloris aestuarii DSM 271
MIKDNHAYKDRFSVQAAEYRRFRPTYPLELFGYLSSLTREHTAAWDCATGNGQSAVALASHYSKVIATDASSSQIQQAIRHENVDYHTAPAHNNDIDDSSIDLVTVAQAVHWFSHRQFYDEVSRVLKPDGVIAVWAYHLPLVNPETDKLVECLYATVLRPFWEDEIRHIETGYRDLPFPFIKLQTPQFSMKANWNLREFAGYLETWSATAAYRQKNGRSPVEDMMQPLQKAWENPESKKSLSWPLILMAGRLKEENMPSSSRKK

SEQ ID NO: 89483 - protein, 275 aa, Picea sitchensis
MEMEGEDYEEHPPAPLLDSLELKLWSFYRAVIAEFVATLLFLYITMTTVVENKQSKGTCGGVGLLGEAWAFGGMIFVLVYCISGISGGHVNPAVTFALFLARKVSLPRAVLYVVAQCLGAVCGTALVKGIQGSFYASNGGGSNSVSPGYSKGSALLAEIIGTFVLVYTVFSATDPKRKARDSHVPVLAPLPIGFAVFLVYLATNSITGTGINPARSFGPAVIYGHKKPLDDLWIFWVGPLIGAAVATAYHRYLLRAGAFGSKNLGSLRSHPASAI

SEQ ID NO: 89484 - protein, 448 aa, Lactobacillus plantarum WCFS1
MKETSKTTAGLPKLSSNKIWMMSLGFLGVQMAFTLQSSQMSRIFQTLGADPNNLGWFFILPPLAGLIVQPIIGSLSDRTWAPRLGGRRLPYLILGTVVAAIVMLLLPNSGSFGFGYASMAALVFGAITVAFLDLSSNVAMQPFKMMVGDMVNDDQKSYAYGIQSFLLNTGAVIAAIFPFLLTLFGVANTASKGVIPNSVIWSFYIGAAILVVSTIITIARVREYDPVTYAKYHGIDESANKSGGNWLALLKKAPKVFWLVALVQFFCWMAFQYLWTYSTGAMAANVWHTTNASSAGYQAAGNWYGILSAVQSVAAVVWSYVLAKVPNNRHKLGYALSLLLGAIGFFSIFFIHSQSALVVSFILVGMAWAAMNTYPLTMVTNALSGEHMGTYLGLFNGSICLPQIVASLLSFALYPLFGNSQANMFIFAGIVLAVGAGTVGLIKETYKN

SEQ ID NO: 89485 - protein, 365 aa, Aspergillus oryzae
MAEKEVPLTAVKVDALVVMKIIKHSSQSFPTTATGSIVGMDVDGTLEITNSFPFPVVEMPADSHFDNAAPNPAAAAPRAKANVAYQAEMIRMLREVNVDANNVGWYTSANMGNFVNMNVIENQFFYQKEMNERTVALVHDVSRSAQGSLSLRAFRLSSKFMTAFKENKFTSEELQKSSLRHQDIFVELPVEIHNSHLITTFIHQLQCPSQSTPTDLPPSLAALEKSSFVKDSVLAPNFDNLSLSIDPFLEKNCDLLLDSIETHHTETNNFQYYQRSLAREQAKITAWQAKRKAENASRAALKQPLLPEDEYQRLFKLPQEPSRLETMLNTRQVEQYSRQIDSFVSATTGKMFAVKGNLLPGETAK

SEQ ID NO: 89486 - protein, 296 aa, Zea mays
MGKDGIQYAVVDAFTAEPFKGNPAAVCLLEDAAKAADERWMQSVAAEFNISETAFLLREKSSAAGAVPLFQLRWFTPVAEVELCGHATLASAHFLFTSVLAEHEKLVEFSTKSGILTAKKVPAPQSTGVSGEGKLFIELDFPTIDLVDCHPSELPAIPDTLNGASIVSVHKSTTAGDLIVELSSGKEVADIIPNIHEIEKCSGRGIIVTGPAPAGSGYDFFTRFFCPKFGIDEDPVCGSAHCVLAPYWGGKLGKHKLIAFQASPRSGILYLELEATGRRVRIQGEAVSVMTGTLLA

SEQ ID NO: 89487 - protein, 235 aa, Nepenthes villosa
  misc_feature (39)..(39): Xaa can be any naturally occurring amino acid
LIVWVQENLGWALGFGIPAISMGIAIASFFSGTALYRLXKPGGSPLTRMCQVLVASFRKSKLALPEDSNLLYETSDENSVIEGSRKLEHTNELKCLDKAAVVSDKEIKREDFSNPWRLCTVTQIEELKILIRMFPIWATGIVFSAIYAQMSTMFVEQGEVMDRTIGSFTIPAASLSMFDTISVIFWVPVYDKILVPLARKFTGKQRGFSELQRMGIGLFISILSMAAAALVEMKR

SEQ ID NO: 89488 - protein, 325 aa, Lactobacillus plantarum WCFS1
MKTVTAKAHTNIALVKYWGKKDAALMLPQNGSISLTLDHFYTQTSVTFDEHLDTDQIYFNHQHLPTGKSARISQFLDLIRQRSGQTNYATVKTENHVPTSAGLASSASGFAALAGAASRAAGLQLDAADLSRLARRGSGSATRSIFGGFVEWHAGHDDQSSYAEVLQDPVDWDIQMIAVVLKATKKTISSTDGMARVVATSPYYPAWITTAETDLKRMRQAIADRDLTTVGQIAETNAMRMHALNLSAEPAFNYFTADTLTAIQAVNDLRSHGINCYYTLDAGPNVKIICAGQDTDTIMTGLQQHFDADQLIVAKPGPGITITEK

SEQ ID NO: 89489 - protein, 470 aa, Pseudomonas putida KT2440
MDATSTTTTAKSGHESKLSASLKSRHLTMMSIAGVIGGALFVGSGSVIHSAGPAAVLAYLAGGILVVLIMRMLGEMATSSPDTGSFSTYADRAIGRWAGFTIGWLYWWYWVILMAWEAYVAGKILHGFFPDVSVNVFVLATTLLLITVNFFNVKHYGEFEFWFALIKVIAIVCFLIVCTAAVMNIWQFGEVRGISHLTAEGFMPNGITTVIGALLGVMFAFLGAEIVTIAASEAKDPAAQIVKATNSVVWRVCLFYVGSIFLIVCLVPWNDPHLGVSGYGAYRRTLELLGVPYAELLMNFVVLTSVSSCLISGHYTASRMLFSLAQRGDAPSFFKITRAGTGVPVYAIMGSCAVAVVCALINFSETLRPKDVLDTLMNTTGMIALLVYLVIAFSQLRMRRKLIAEGKEVRLKMWLFPWLTYLVIAFIVAALVTMAFMPDYQILVISTGIAAAVVVAMGVVHQIRSGSKQH

SEQ ID NO: 89490 - protein, 732 aa, Methanothermobacter thermautotrophicus str. Delta H
MGCMTKKEIKLKVAEALAQQDVGRGIARVDPACMEKLGLSDGDIIEIEGKKLTAATVVSSQSDIGLGIIRIDGYLRKNAGASIGEEVTVRRADVKDAQKVVLAPVDQEVIIRGDIRSAFLNRVLVKGDIIVSGIRQHISGGGLFDEFFRDFMDISPLGEIKLAVVSTSPAGVVRVTPSTQVEMQQKPVDVSKLEGVKNLVDVTYEDIGGLKEEVKKVREMIEIPLKRPELFERLGITPPKGVLMHGPPGTGKTLLAKAVANESDAHFIAINGPEIMSKYVGGSEERLREFFEEAEENAPSIIFIDEIDAIAPKREDVSGEVERRIVAQLLTLMDGLKSRGQVVVIGATNRPDALDPALRRPGRFDREIEIGVPDREERKEILQIHTRGMPLADDVDLDELAEITHGFVGADLESLCKESAMRVLRRVLPEIKADEEIPKEVLKKMVVTRADFKDALKEIQPSALREVLVQVPNVSWDDIGGLEGAKQELREAVEWPLKYPDRFKKFGIRPPKGILLHGSPGTGKTLLAKAVANESQANFIAVKGPELLSKWVGESEKGVREVFRKARQTAPTVIFFDEIDSIASVRSGSTADSGVTQRVVNQLLTEIDGLEELQDVAVIAATNRPDILDPALLRPGRFDRHVKVEDPDKEARLAIFRVHTKDMPLADDVDLEKLAEKTEGYVGADIEAVCREAAMLTLRDNMDAEEVSMKYFLEAMEKVKPKGGVEEQVQYH

SEQ ID NO: 89491 - protein, 235 aa, Nepenthes clipeata
  misc_feature (7)..(7): Xaa can be any naturally occurring amino acid
  misc_feature (39)..(39): Xaa can be any naturally occurring amino acid
  misc_feature (138)..(138): Xaa can be any naturally occurring amino acid
LIVWVQXNLGWALGFGIPAISMGIAIASFFSGTALYRLXKPGGSPLTRMCQVLVASFRKSKLALPEDSNLLYETSDENSVIEGSRKLEHTNELKCLDKAAVVSDKEIKREDFSNPWRLCTVTQIEELKILIRMFPIWXTGIVFSAIYAQMSTMFVEQGEVMDRTIGSFTIPAASLSMFDTISVIFWVPVYDKILVPLARKFTGKQRGFSELQRMGIGLFISILSMAAAALVEMKR

SEQ ID NO: 89492 - protein, 707 aa, Moorella thermoacetica ATCC 39073
MGEVVFSTWGGKVVDHRGGPSGGGPSWAGEFGGRQLKAFIGWDGLVVTDPAVDLLAALQAYYQAVQGESCGRCVPCRVGTRVIYNVLVRIAGGEGLPSDLDLLRRVAWIVRDGSLCELGQAGAKAVLDFLDYYSEALRPFLEDSGRVAGGQRRPGPGGRVQVLASGRVLVGNDRGKGAAAASPAAGLTYKPFVTAPCLKRCPAHLDIPAYIDAIKDGRYEESLAIIRQRTALAGVLGRVCVHPCEENCRRGNVDEPLAIRGLKRFVADYEVKRGRRPVAVCGGNLFTGPWRPAGQAGGEETTAVTSGKKVAIIGAGPAGLSAAYQLAGRGYKVTIFEALPVAGGMLAVGIPSYRLPRDILAGEIEAIKALGVTINLNTRVGVDVTMDQLQRDYDAVFIATGLHASSRMGVAGEDEGYGGFIPGVKFLRDLNLDRCPSLEGKVVAVVGGGNVAMDCARSALRRGAREVHLIYRRSRAEMPAHATEVRDAEAEGVIYHFLVNPTALVAEKGNIKGMQCVRMKLGEPDDSGRRRPVPVPGTEFFLPCDIVVPAIGQAADLSFLDGRIEVGKRGTISVDPVTLATSVPGVFAGGDIVLGARTVVEAVAQGNRAAVSIDQYLRQGTTSPTVEDELDAWLEKVGVYDPEEDVGIYGGRPRQAERVAPLAERVKDFREVEGGFDFYAGRAEAERCLRCYRVGMMVLAGEGESNG

SEQ ID NO: 89493 - protein, 368 aa, Thermus thermophilus
  misc_feature (1)..(1): Xaa can be any naturally occurring amino acid
  misc_feature (317)..(317): Xaa can be any naturally occurring amino acid
XLAVGIVGLPNVGKSTLFNALTRANALAANYPFATIDKNVGVVPLEDERLYALQRTFAKGERVPPVVPTHVEFVDIAGLVKGAHKGEGLGNQFLAHIREVAAIAHVLRCFPDPDVVHVMGRVDPLEDAEVVETELLLADLATLERRLERLRKEARADRERLPLLEAAEGLYVHLQEGKPARTFPPSEAVARFLKETPLLTAKPVIYVANVAEEDLPDGRGNPQVEAVRRKALEEGAEVVVVSARLEAELAELSGEEARELLAAYGLQESGLQRLARAGYRALDLLTFFTAGEKEVRAWTVRRGTKAPRAAGEIHSDXERGFIRAEVIPWDKLVEAGGWARAKERGWVRLEGKDYEVQDGDVIYVLFNA

SEQ ID NO: 89494 - protein, 267 aa, Rhizobium tropici
HLLRYDSIHGRFPAEVKVEGDSIIVGGGKPIKVTAIKDPATLPHRDLGVDIAMECTGIFTARDKAAAHLTAGAKRVIVSAPADGADLTVVFGVNHDQLTKEHLVISNASCTTNCLVPVVKVLDDAVGIDHGFMTTIHSYTGDQPTLDTMHKDLYRARAAALSMIPTSTGAAKAVGLVLPHLKGKLDGTSIRVPTPNVSVVDFKFVSKKATTVGEINEAIKAASNGKLKGILGYTDEPLVSRDFNHDSHSSIFATDQTKVMEGNFVRV

SEQ ID NO: 89495 - protein, 217 aa, Legionella pneumophila subsp. pneumophila str. Philadelphia 1
MTFQILPSLLSADVTRLGEEVDTVMKAGADFIHFDVMDNHYVPNLTFGPAFCDALIKKFPNLPIDVHLMTTPVDTLIEAFAKAGAKRISIHPDATIHLDRSLQLINNLGCEAGLVLNPATSIDTLTWCAHNLKFVLVMTVNPGFGGQKLIPEVIPKLSKIRQQHPNLDLCVDGGVTPQNIASLAHAGANQFVAGSAIFNSSNYSETIKRMREQLASI

SEQ ID NO: 89496 - protein, 406 aa, Exiguobacterium sibiricum 255-15
MDHLIFEVGTALILVAIAALLANKLNFSIIPFLIVLGMIVGPHAPTIGILDFKFIESAEFISFLGRIGVLFLLFYLGLEFSIGKLIRSGKSIVTSGTIYLSINFTGGLLYGFIAGFPLYEVLIIAGIITISSSAIVAKVLVDLRRTGNTETELILGIIMFEDIFLAVYLSVLSGLLLGDGTTLLSSVTSILIALGYMLLFFVIARKATPLLNRMLKIASDEVFIIVVFAALFFVAGFSETIHVAEAIGALLLGLVFSETDQGERIEHLVVPFRDFFGAIFFFSFGLSIDPTMLLDAVWLALGAVVITIVGNYVAGMIAGRRAGLSHKASSNIGLTIVSRGEFSIIVANLGIAGGLMDILSPFSALYVLILAILGPLMTKESKRIYNFMNGIFKWTEPKPKKTKPKA

SEQ ID NO: 89497 - protein, 235 aa, Nepenthes gymnamphora
  misc_feature (7)..(7): Xaa can be any naturally occurring amino acid
  misc_feature (39)..(39): Xaa can be any naturally occurring amino acid
  misc_feature (138)..(138): Xaa can be any naturally occurring amino acid
LIVWVQXNLGWALGFGIPAISMGIAIASFFSGTALYRLXKPGGSPLTRMCQVLVASFRKSKLALPEDSNLLYETSDENSVIEGSRKLEHTNELKCLDKAAVVSDKEIKCEDFSNPWRLCTVTQIEELKILIRMFPIWXTGIVFSAIYAQMSTMFVEQGEVMDRTIGSFTIPAASLSMFDTISVIFWVPVYDKILVPLARKFTGKQRGFSELQRMGIGLFISILSMAAAALVEMKR

SEQ ID NO: 89498 - protein, 605 aa, Burkholderia sp. 383
MSEQSTSLRASANGPQDMTPSEAFVETLAANGVTDMFGIMGSAFMDAMDIFAPAGIRLIPVVHEQGAGHMADGYARVSGRHGVVIGQNGPGISNCVTAIAAAYWAHSPVVIVTPEAGTMGIGLGGFQEANQLPMFQEFTKYQGHVTHPARMAEFTARCFDRAQAEMGPTQLNIPRDYFYGKVKVEIPQPRRLDRGAGGEQSLDDAAALIAQAKFPVIISGGGVVMADAIEECKALAERLGAPVVNSYLHNDSFPANHPLWCGPLGYQGSKAAMKLLSRADVVIALGSRLGPFGTLPQHGMDYWPKDAKIIQIDADHKMLGLVKKISVGICGDAKAAAVALTQRLEGRTLACDGSRGDRADQIATEKAAWEKELDDWTHERDAYSLDMIEEQKHEKPFSGGQYLHPRQVLRELEKAMPEDVMVSTDIGNINSVANSYLRFNKPRSFFAAMSWGNCGYAFPTIIGAKVAAPHRPAVSYAGDGAWGMSLMETMTCVRHNIPVTAVVFHNRQWGAEKKNQVDFYNRRFVAGELDNQSFAEIARAMGAEGITVDRLEDVGPALKRAIDMQMNEGKTTIIEIMCTRELGDPFRRDALSKPVRTLDKYKDYV

SEQ ID NO: 89499 - protein, 235 aa, Nepenthes sumatrana
  misc_feature (39)..(39): Xaa can be any naturally occurring amino acid
  misc_feature (138)..(138): Xaa can be any naturally occurring amino acid
LIVWAQENLGWALGFGIPAISMGIAIASFFSGTALYRLXKPGGSPLTRMCQVLVASFRKSKLALPEDSNLLYETSDGNSVIEGSRKLEHTNELKCLDKAAVVSDKEIKCEDFSNPWRLCTVTQIEELKILIRMFPIWXTGIVFSAIYAQMSTMFVEQGEVMDRTIGSFTIPAASLSMFDTISVIFWVPVYDKILVPLARKFTGKQRGFSELQRMGIGLFISILSMAAAALVEMKR

SEQ ID NO: 89500 - protein, 344 aa, Burkholderia sp. 383
MKALDRILDAARRQPMRIALCEADDPRVLQAAARATHDGIARIVLVGNRAAIHAAAARDAIDLDGMTLVDPATAAQRDAYADTLHALRKNKGMTADAARDAVLDPLCHANLMVRLGDADGSVAGAVHATADVVRAAIQLIGVDPAFRIVSSFFLMMLCEPFHTIKGGLIFSDCALVVDPDANQLAEIAMAAADSAHALLGEAPRVAMLSFSTSGSAHHAAVDKVTAATAHVRERRPTLAIDGDVQLDAAIVAEIAERKIAHSQVGGHANVLVFPSLEAGNIGYKLAERIGRAKAVGPLLQGLRRPANDLSRGCSADDVYHVIAATTVQAQAAAQRAATGEAAHA

SEQ ID NO: 89501 - protein, 368 aa, Mycobacterium smegmatis str. MC2 155
MSLNLGIVGLPNVGKSTLFNALTRNDVLAANYPFATIEPNEGVVPLPDPRLDKLAELFGSEKTVPAPVTFVDIAGIVKGASEGAGLGNKFLANIRECDAICQVVRVFNDDDVVHVDGRVDPRSDIEVIETELILADMQTLEKAVPRLEKEARNNKERKPVLEAAVAAQAVLDSGKTLFAGAAAAGIDVTLLRELNLMTTKPFLYVFNADESVLTDEARQAELREMVAPADAVFLDAKIEAELLELDDESAAELLESIGQTERGLDALARAGFHTLKLQTYLTAGPKEARAWTIHQGDTAPKAAGVIHSDFEKGFIKAEVVSFDDLVEAGSMAAAKAAGKVRMEGKDYVMADGDVVEFRHGGTSGSGKK

SEQ ID NO: 89502 - protein, 528 aa, Artemisia annua
MILVTDFKDKIYYTMINYWSWWWEVDNESDNVARTILTILVPILVLLWYKWTVSYTKKPRSRLPPGPYGLPVIGYLPFLSSNLHERFTEMSHKYGPIFSLYLGSKLNVVVNSIDLAKVVARDLDQTFANRNPPVTAITVTYGLLDIAWSNNNTHWRNTRKLLVSQVLSNANLDACQGFRTDEVRKTVGHVYAKIGEIVDINEISFETELNVVTNMLWGRNESGSLLEGFREVELKMLELLGAPNISDFIPMLSWFDLQGRKREMQKQHERLDRILDNVIKARMEGVLHDDGKKDFLQIMLELKDQKDGPTSLNMVQIKALLFDILTASTDTTSTMVEWVMAEILHNPDVMRRVQEELTIVIGMNNIVEESHLQKLVYLDAVVKETFRVHPPLPLLIQRCPNESFTVGGYTIPKGSIVYINVMAIHHDPKNWINPLEFKPERFLNGKWDYNGYNLKYLPFGSGRRICPGIPLGEKMLMYILASLLHSFEWSLPKEEELELSEEFGFVTKKRRPLIAIPSQRLPEASLYS

SEQ ID NO: 89503 - protein, 473 aa, Artemisia annua
  misc_feature (68)..(68): Xaa can be any naturally occurring amino acid
MELYTTSLLFIVSFSTIIFLLFRRNSAFWRSINTPPGSTGLPLIGETFQIISAYKTENPEPFIDARVXKYGSVFTTHVFGERTVFSADVEINKFILQNEGRLFESSYPGSIANLVGKHSLLLMRGGLHRRMHSLTMSFANSTIIKDHLLADIDRLVRLNLDSWTGRILLMDEAKKITFELTLKQLLSIEPCEWSENLRKEYMLVIEGFFCIPLPFFSLTYRRAIQARKRVTEALHLVVRERRIEREKGVKKNDMLAALFDSDGDEENFYDDEIVDFLVSLLVAGYDTTSTTMTLAVKYLTDTPSALAQLKEEHDAIRAKKGASVALEWDDYKSMPFTQCVVNETLRLSNIISGVFRRAITDVKIKDYTIPKGAKVFTSLRAVHLDQDNFEDARVFNPWRWQKTSDSASFMPFGGGPRRCPGHELARVALSVFLHHLITHFSWKPAEEDKVVFFPTTRTQKRYPIIVEQRNVVG

SEQ ID NO: 89504 - protein, 474 aa, Vitis vinifera
MIFRNLVRSTLRNTQAVSYKNHVAAARSLQEHLVRAPVLARWNSTEASMQREDAETELKNAKEFKGHDMLAPFTAGWQASDTNPLVIEKSKGAYVWDINGKKYLDSLAGLWCTALGGSEPRLVAAAIAQLNTLPFYHSFWNRTTKPSLDLAKELLNTFTATKMGKAFFTNSGSEANDTQVKLVWYYNNALGRPNKKKFIAREKSYHGSTLISASLSGLPALHQKFDLPAPFVLHTDCPHYWRYHLPGESEEEFSTRLANNLENLILKEGPETIAAFIAEPVMGAGGVIPPPATYFDKIQPILKKYDILFIADEVICAFGRLGTMFGCDKYGMKPDLVSMAKALSSAYMPIGAVLVSPEISDVIDSQSNKLGVFSHGFTYSGHPVSCAVALEALKIYKERNIAEVVQRISPKFQNGLKAFSDSPIIGEIRGTGLILGTEFTDNKSPNDVFPPEWGKCIFWSTVPEAWDASTCCRG

SEQ ID NO: 89505 - protein, 535 aa, Cryptococcus neoformans var. neoformans B-3501A
MPDPAPFWLCHECGAQMRPVTVDGTPHCASCNGEFIEILDPEVNPDPDYELPPPPPTRPGQQTPSRFDPHFLSNFPPPPQSEGSSSPARQRDTNNTGNFLSSLFSMLGTGSRQGSEETPRRPPPSFHGEPSASQRNGQSQNTDRPGMRTYAFNFGNARGSVTIGSFGSNLGRQGYRMNNDPTSPSGNLFNDPDPFRADPFDARFRPPGDGNRDINGDMPLPLGANEALQLIAALLDGNPPPNMGNLGDFATSDADFMRILQETFMEAAGPQGPVPANETVIEGLPRFTFDSGSLAKSQFRDCPVCKDDFEIGNEVMLIPCGHIYHPDCLVPWLRQNGTCPVCRFSLVSEDEQPNNQRTTNVGTEHTRNAEEERPATPTIPAAVSNFFRNLFGGSESQPPTPRAAAGGGHGSNASQDPHSSVNVVSESTISADASSRHSPTIHGATRREQVQQCDEVASEGSSNDSLVRVYPEHSSGETHGDDATNGEAGRIAEQEQQVASRDRLADRVNRDFNERWQRLRREREEDDTVYHPDLD

SEQ ID NO: 89506 - protein, 483 aa, Vitis vinifera
MKHLHPAPALAKCSSTETSLQKEDSATKNAKGFKGHDMLSPFTTGWQSTNLDPLLIERSEGPYVYDSNGRKYLDALAGLWCTALGGSEPRLIAAATAQLNTLPFYHSFWNHASKPSLDLAKELLNTFTATKMGKVFFTSSGSEANDTQVKLVWYYNNALGRPNKKKFIALEKSYHGTTFISASLSGLPVLHQGFDLPSPFVFHTDCPHYWRFHLPGETEEEFSTRLANNLEKLILKQGPETIAAFIAEPLMGAGGVIPPPTTYYEKIQAILKKYDILFIADEVICAFGRLGAMFGCDKYGIKPDLVSIAKAFSSGYMPIGAVLVSPEISEVIHSHSNKLGSFAHGFTFSGHPVSCAVALEVLKIYRERNIIEQVQSLSPRFQDGIRAFSDSPIIGEIRGTGLLIGIEFTDNKSPNDSFPPEWGKGGGIFWSRHGMIVRSAGNIIVLSPPLIISPEEVEKIISICEKALKATEERVKELKSQEK

SEQ ID NO: 89507 - protein, 330 aa, Physcomitrella patens subsp. patens
LVVCFGELLIDFVPTVGGLSLSDAPAFKKAPGGAPANVAVGIAKLGGNSAFVGKVGDDEFGYMLVEVLKENRVETQGCRFDPNARTALAFVTLREDGEREFMFYRNPSADMLFTKEELDVDILKQASILHYGSISLITEPSRSTHMEALRIAKEAGCLLSYDPNLRLPLWPSPEAAKVMIKSIWDQADIIKVSDEEVIFLTGGDPTEDENNMRMFHLRCKLMLVTEGAEGSRYYTQVFKGEVGGIKVQVVDTTGAGDAFCAGLLSLIVKDPAIIDDEPRLREALYFANACGAITTTERGAIPSMPDKDTVLRMISKVTAVLLKVIEHLIL

SEQ ID NO: 89508 - protein, 264 aa, Populus trichocarpa
MAIPCPPFIGSEKLSIESGAMSPSSPSPLILTQDELKKIAAYKAVEFVQSGMVLGLGTGSTAKHAVDRIADLLHQGKLKNIIGIPTSTKTHQQAVSLGIPLSDLDSHPVVDLAIDGADEVDSNLNLVKGRGGSLLREKMIESACKKFIVIVDQSKLVAHVGASGAMPVEVVPFCWKFSQDRLQNLFDYAGCVAKLRTDNGGEKIFVTDNGNYIVDLFFKKDIGDLKVASDAILRLAGVVEHGMFLDMATTVIVAGELGITIKDK

SEQ ID NO: 89509 - protein, 151 aa, Legionella pneumophila
MDLFRKKDIKGSPDNESHLAKCLSVFDLTFLGVGAIIGAGIFVLTGIVAATISGPAVIFSYVVAGFACAFAALSYAELAASIGGCGSAYGYAYAGFGELIAWIVGWDLLLEYSIGVSAVSIGWSGYANDFLMALKIFIPTHLLHGPVDGGI

SEQ ID NO: 89510 - protein, 653 aa, Prosthecochloris aestuarii DSM 271
MATVSLTLNGKTITADAHVSILEAAKSNGVIIPTLCFHQELSALGSCWMCIVELKGKNRFVPACSTRVTSGMDIETDNPELHAMRRKTLERLIDQHCGDCLGPCETACPAGCDIPGYTAAIARGDDREAIRIIKETVPLAASLGRICPAPCEDACRRHGVDDPVSICALKRFAADKDIASAEPFVPERKKASGKKVAVIGAGPAGLTAAYYLLRNGHDVTVFDANDTPGGMLYYGIPRFRLPATILEADIAPLRAMGGEIVLNTVLGRDISLKELKKNGFDATYIAVGAAKASTMGIAGEELPGVVSGIGFLRDIASGKAVRTGKRVVVVGGGNTAVDAARTALRTGAESVTIIYRRTREEMPANQAEIEEALAEGIALQCLAAPSAITSCESGLEMTALKMLQGEPDESGRRRPVALNGSEFSLFADTIIAAIGQYVDPEIQTATGLQLSQKGTFKTDSATCMTEQEGVFAGGDCVIGADIAINAIEQGKRAADAIDSFLNAVTSRNEKKPFNSTYGPRDNAPETFLMRAKPIKRASMQELQGPERTSTFREVALGLDEEQARLEAQRCLRCSCTTKNNCSLRRLASRYEVSSAQCDVETHDNAYITRGNGIRFEREKCVDCGICVRTIEEYGPEELRSTILIERCPTGALS

SEQ ID NO: 89511 - protein, 301 aa, Azoarcus sp. BH72
MVYRVGAPRFHELSVAQARHSFQKLQYAFRPDVPAVASVTEVPMARADGSALLARYYRPLQAGPHEALPLLLYFHGGGWCVGDVESYDVLCRELANAAGCAVLSVDYRLAPEHPFPAAVHDARFAVEWAREQAGLLDIDPARIALAGDSAGGNLSIVTALAMRDEGAVPARCLALVYPSTEIASGRPSRERYAEGYFLDRESLQWFFERYLPEGGSEDWRASPMRADSLVGLPPMLLVSAECDPLVDDCTAFAARVRAEGGTVDEVCVPGMVHGFLTLGKYFPEAGQTVRLLAETLKARLA

SEQ ID NO: 89512 - protein, 172 aa, Erythrobacter sp. NAP1
MRIADRTEFASKAPPLTCTPDTIVFDAVTQMAEKNFGSIFVTDPDNRVLGVMTERDIFRRVIGASRDPKTTPVSEVMTTEVRAAHKDDQILDWMQIMSNERFRRLPIVDEDKRLIAVMSQGDFVGYTWPQLLGQVGQMAQATLGPRFNQLAIAGGIAVYTIILVIVLLYATR

SEQ ID NO: 89513 - protein, 510 aa, Burkholderia sp. 383
MPRAHDCRARLPHPIHRTEEHLMGKATGFLEFERRHEAYEAPLTRVKHYKEFVAALTDADAKVQGARCMDCGIPFCNNGCPVNNIIPDFNDLVYRQDWQQAIEVLHSTNNFPEFTGRICPAPCEAACTLGINNDPVGIKSIEHAIIDKAWAEGWVKPLPAEHKTGKKVAVVGSGPAGLAAAQQLARAGHDVTVFEKNDRVGGLLRYGIPDFKLEKWLIDRRMRQMEAEGVTFRTSVFIGKDPLPESIGSLAKETISPETLKEEFDAVVIAGGSETPRDLPVPGRELAGVHYAMDFLPQQNRVNAGDKLVDQLLAKGKHVIVIGGGDTGSDCVGTSNRHGAKQVTQFELLPQPPEEENKPLVWPYWPIKLRTSSSHDEGCERDWAVATKRLEGKNGKVEKLIAVRVEWKDGKMQEVPGSEFEMKADLVLLAMGFTQPAAPVLEAFGVAKDARGNARAATEGDRSYYTSVDKVFAAGDMRRGQSLVVWAIREGRQCARSVDAYLMGHSNLPR

SEQ ID NO: 89514 - protein, 131 aa, Glycine max
MAGRGKTLGSGVAKKATSRSSKAGLQFPVGRIARFLKNGKYAERVGAGAPVYLAAVLEYLAAEVLELAGNAARDNKKTRIVPRHIQLAVRNDEELSKLLGDVTIANGGVMPNIHNLLLPKKAGGASKPSGD

SEQ ID NO: 89515 - protein, 401 aa, Lactobacillus plantarum WCFS1
MYMELSRKVMQVQPSATLKISATAKQMMADGVDVINLGIGEPDFQTPDNIKQAAIDSIQNGQASFYTPATGLPALKQAISQRIEADHHYHFDPNQIVVTDGAKMALFTLFQVILNPDDEVLLPVPYWVSYSEQVKLAGGVPVEVSTDEQLRFTTADLEAQRTPKTKALVLNSPQNPSGLVFSRAELTAIVNWAVEHDVLVIADEIYEKLLYNGNEFTSVLELDDANMDHVVLINGVSKAYSMTGWRIGYAAGPQTIMAKMGVVLGHAASNPAAVSQYAAIEAFSGDQSSVETMRQGFEARLNELYPLIERLPGFKMPAGKPAGAFYLFPDITEALRLTGYADAPAFVTAVLLEAHVGLVPGEAFGMPGCLRLSYATDIDSLREAHRRLQKFMTEKIAEQAK

SEQ ID NO: 89516 - protein, 251 aa, Xanthomonas campestris pv. vesicatoria str. 85-10
MRRKIVAGNWKLHGSRAFATELVAKVAAHMPLEGVEVVILPPLPYLGDLIEDFEAHHLSFGAQDVSSNEKGAYTGEVSASMLVDVGAGYGLVGHSERRQYHHESSELVARKFAAAIHAGLIPVLCVGESLEQREAGQTEAILRAQLDPVLALVGSAGFAGAVLAYEPIWAIGTGRTATPEQAQAVHAFLRGEVAKADARIADSLPILYGGSVKPDNAGELFAQPDVDGGLVGGASLVAEDFLAIARAAAAC

SEQ ID NO: 89517 - protein, 471 aa, Exiguobacterium sibiricum 255-15
MIEQNVINGVWYDTEETIPVFNPATKELLGHVPSSTADDAQRAVDAASTAFVDWSERTADDRADKIDAWYRLIQEHRDELADIMTREQGKPFIEARGEIDYGNQYVRWYAEEARRIYGETIPASVPGKRLFVEKEPVGVVAAITPWNFPAAMITRKLAPALAAGCTVVLKPSEETPYTALRLVELAIEAGIPAGAINVLTGDAATISGVWQADSRVRKITFTGSTAVGKLIMRQAADTMKKLSLELGGHAPFIVTENADLDKAVQGAIRSKFRNGGQACVATNRFYVQASVLDTFTEKFVAEVKRLKVGNGLDADSTIGPLINAKAVAKVKAHIDDAVAKGATILTGGTIDDSVGYFVEPTVLGNVTEDMICMQEETFGPLAPISVFETLDEVIERANNTPYGLAAYAFSEKIDEALRLGKKLEYGIVGLNDGAPSAAQAPFGGYKESGLGREGGVYGIEDYLEVKYLSLG

SEQ ID NO: 89518 - protein, 305 aa, Triticum aestivum
  misc_feature (117)..(117): Xaa can be any naturally occurring amino acid
  misc_feature (260)..(260): Xaa can be any naturally occurring amino acid
  misc_feature (271)..(271): Xaa can be any naturally occurring amino acid
  misc_feature (281)..(281): Xaa can be any naturally occurring amino acid
  misc_feature (286)..(286): Xaa can be any naturally occurring amino acid
  misc_feature (290)..(290): Xaa can be any naturally occurring amino acid
  misc_feature (302)..(302): Xaa can be any naturally occurring amino acid
MVKICCIGAGYVGGPTMAVIAVKCPAIEVVVVDISKPRIDAWNSDKLPIYEPGLDEVVKACRGRNLFFSTDVEKHVAEADIIFVSVNTPTKTRGLGAGKAADLTYWESAARMIADVXKSDKIVVEKSTVPVKTAEAIEKILTHNSKGINYQILSNPEFLAEGTAIEDLFKPDRVLIGGRETPEGRKAVQALKDVYAHWVPEDRILTTNLWSAELSKLAANAFLAQRISSVNAISALCEATGANVTEVAYAVGKDTRIGPXFLNASVGSGGXCFQEDILNLXVYICXCNGXPEVGNYWEQVIXIND

SEQ ID NO: 89519 - protein, 235 aa, Nepenthes lavicola
  misc_feature (39)..(39): Xaa can be any naturally occurring amino acid
LIVWVQENLGWALGFGIPAISMGIAIASFFSGTALYRLXKPGGSPLTRMCQVLVASFRKSKLALPEDSNLLYETSDENSVIEGSRKLEHTNELKCLDKAAVVSDKEIKYEDFSNPWRLCTVTQIEELKILIRMFPIWATGIVFSAIYAQMSTMFVEQGEVMDRTIGSFTIPAASLSMFDTISVIFWVPVYDKILVPLARKFTGKQRGFSELQRMGIGLFISILSMAAAALVEMKR

SEQ ID NO: 89520 - protein, 473 aa, Burkholderia sp. 383
MQPSNQSDLKCGLKQRHMTMIALGGVIGAGLFVGSGVVIQQTGPAAILSFLITGGLVVLVMRMLGEMACAMPAVGSFYEYARLAFGNWRGPGKMAGFLTGWMYWYFWVIVVALEAVAGAKLIQFWLPDTPAWIISLALLVVLTLTNLISVGSYGEFEFWFSSIKVGAIIVFLFLGGLYVLGLWPASMHTTSVLPTLLGHGGFMPLGIGPVMSGAVAATGFYFGAEIVTIAAAEAKEPAKAVAKATNSVITRVLVFYVGSVALVVALVPWNSHQMATPYVSALEVMGLPAAANVMNAIVLTAVLSALNSGLYAASRMLFALTRHGDAPAALAKVNKRGVPVRAILLGTVFGYVSVVMSYVSPDTVFAFLVNSYGTVALFVYVLIAFSQLRLRKRLDPVAASKLRVKMWAYPYLTWVAIIGMVGILVAMAFIPDQRKPLWLGVASLGVLVVAYGLTRRSRREHLDDSELLAYPPR

SEQ ID NO: 89521 - protein, 461 aa, Mycobacterium smegmatis str. MC2 155
MEHYDLAIIGTGSGNSIVDDRYAGKKVAICEQGTFGGTCLNVGCIPTKMFVYAAEVAHSVRTSARYGVDAHIDKVRWPDIVERVFGRIDPIAAGGEDYRRSDPNITVYSSHTRFGPKTDDGRYTLRTESGEEFTSDQVVIAAGSRTYIPPAVVDCGVKYHTSDDIMRIPELPTDLVIIGGGFVSAEFAHVFSALGVHVTIVVRGDGLLTHCDETICHRFNEIAATKWDIRTHENVIGSHQDGDRIVLELDDGKTVAADTLLVATGRVPNGDLLDAELAGVEVDEDGRVIVDQYQRTTARGVFALGDVSSDYQLKHVANHEARVVKENLLRDWDDTASLVASDHRFVPSAVFTDPQVATVGLTEAEARAAGHDIVVKVQNYGDTAYGWAMEDTTGIAKLIGERGTGKLLGAHILGHQASSIIQPLIQAMSLGQTAQEIARGQYWIHPALPEVIENALLGLQE

SEQ ID NO: 89522 - protein, 133 aa, Triticum aestivum
  misc_feature (5)..(5): Xaa can be any naturally occurring amino acid
  misc_feature (11)..(11): Xaa can be any naturally occurring amino acid
  misc_feature (24)..(24): Xaa can be any naturally occurring amino acid
  misc_feature (28)..(28): Xaa can be any naturally occurring amino acid
  misc_feature (37)..(37): Xaa can be any naturally occurring amino acid
  misc_feature (47)..(47): Xaa can be any naturally occurring amino acid
  misc_feature (54)..(54): Xaa can be any naturally occurring amino acid
  misc_feature (71)..(71): Xaa can be any naturally occurring amino acid
  misc_feature (74)..(74): Xaa can be any naturally occurring amino acid
  misc_feature (78)..(78): Xaa can be any naturally occurring amino acid
  misc_feature (88)..(88): Xaa can be any naturally occurring amino acid
  misc_feature (94)..(94): Xaa can be any naturally occurring amino acid
  misc_feature (98)..(98): Xaa can be any naturally occurring amino acid
MGPTXMASSGXSVAPFQGLKSTAXLPVXSRRSNGASXSASVSNGGRXRCMQVWXIEGIKKFETLSYLPPLXTEXLLKXVDYLIRSKWXVPCLEXFNKXGFIFREHNASPGYYDGRYWTMWELPMFGCTGRHTR

SEQ ID NO: 89523 - protein, 255 aa, Exiguobacterium sibiricum 255-15
MYLPSFQLDQKTVLVTGAGRGIGRALAIGMAEAGADVLLVARTESDLQETAKQIEQLGRRAFVLTCDVTDRTQVQATVDRAYTYVDRIDVLVNNAGMNIRSKALDVTEDEWETIQQTNLKSAFLFSQEIGRRMQDTGGSILNIASVAGHVALRTGVVYATTKAALIQMTKVLALEWGPKNIRVNAIGPWYFKTPLTEPLLADPAYLQDIVDVTPLGRVGELTELVGPAVFLASDAGTYVTGQTLFVDGGMTIKGF

SEQ ID NO: 89524 - protein, 235 aa, Nepenthes adnata
  misc_feature (138)..(138): Xaa can be any naturally occurring amino acid
  misc_feature (220)..(220): Xaa can be any naturally occurring amino acid
LIVWVQENLGWALGFGIPAISMGIAIASFFSGTALYRLQKPGGSPLTRMCQVLVASFRKSKLALPEDSNLLYETSDQNSVIEGSRKLEHTNELKCLDKAAVVSDKEIKCEDFSNPWRLCTVTQIEELKILIRMFPIWXTGIVFSAIYAQISTMFVEQGEVMDRTIGSFTIPAASLSMFDTISVIFWVPVYDKILVPLARKFTGKQRGFSELQRMGIGLFXSILSMAAAALVEMKR

SEQ ID NO: 89525 - protein, 1254 aa, Coprinopsis cinerea okayama7#130
MPLPSQLSQLQHPHKQPSDGSPTSATSTSLTPASSNNTSSSPLNELSFELADSIQMVVQTLLQVSPPQVLDITKEQFSACSLSVPTSSMSAMFTVMKNINYLSANMPTYFDEMSAPDSKLPGKRPAQSADTYTEFDIGEMLQCIGDSLGGTAAQVGVDMVIFHGDVSLKHVNVVGDEAALSYAISHVIRQVLNIAERGDTVELGLLLTPTLQTQAESSSSMPDIPLQCTIRVSHKFAFPERLPNDPYGPEPQQVRQHPNFSSLLLRRILRHTSGSIKGDLPPPENFSTGRTVELAFPLRRPRSTQAKTPNERANSEEPQFAHDPTLRQLVSFAETLKGKKVTLHASPKACFAQHLTSYLTAWGMDVTHVSPDGDTDGTSTAEQTPAADGAPATGEGPNNPDPVSFVFIDDDVDVLKERLLAQRSGFNPFTGSQALSKKRPTLANLHRPRSTVNVPHNTGITKPANGSNVIMHFTSLANYKHLKDVVQSMMAGFSAATIPLPEVMIIPKPAGPRRFLTALHTAATKPSVDLPFIPIATSPLSPGLATGTFFGSYSGNTEQQPHSKINASQPVSPTKPLRPTGSRTNSERSLTSSRESESSLSQVTPSPLSLPENVEYFDKAAASKLGSNPSSGIVVKSPDGQTGILFRPKTKVPRSPQERDKGQLVVPSRRSSRSSPNGNAEGLPSFGTMYSATQSAASSPVTKPKGQNGAASESSLLHPLDKDRIAAATLAGHPPPPLSAPLGTPVSTVATPVKSSDSKTPASKGTSPTGSPRPQEAAAAMRRRQHLRKASSDKDATTTTTTPLGKKGKAPDNSIIPPISVLIVDDNPINQTILSTFMKRKRISYDIANNGEEAVTKWRVGNFHLILMDIQMPIMDGIQATKEIRRMEKANALAGYPPLTPNGEGQRTPSDTSSVASRATASPYRSSVIIVALTASSLQSDRDAALAAGCNDFLTKPVSLLWLNNKIIEWGSIKALQVWADLRPDVNRMNTGQAAQARAVADRLQVPKKKTASPPPRRSSSLNKEEGAAALALASPAGVPLKESALGQFTSEPKSLLAKIEGGKEISPSRTPSGDRTSSSTETRPSRTSSVDSTTDDESINESNTSRSPTDDEPPRNPLTEPPLEDDMNPAIPTEPPDTSDLPTPKRLETIDEDPIPPIVANVATAGQHESSLTPTLNDPRCHREDYVKAKRKDDHGRNGQTPATASEDAATEPPPSDSATNPTSTSDTESDPSPPTPAPSDPAPPLAETDPDR

SEQ ID NO: 89526 - protein, 332 aa, Coxiella burnetii RSA 493
MEPFKHPIAILGAGSWGTALALVLARKGQKVRLWSYESDHVDEMQAEGVNNRYLPNYPFPETLKAYCDLKASLEGVTDILIVVPSFAFHEVITRMKPLIDAKTRIAWGTKGLAKGSRLLHEVVATELGQVPMAVISGPSLATEVAANLPTAVSLASNNSQFSKDLIERLHGQRFRVYKNDDMIGVELCGSVKNILAIATGISDGLKLGSNARAALITRGLTEMGRLVSVFGGKQETLTGLAGLGDLVLTCTDNQSRNRRFGLALGEGVDKKEAQQAIGQAIEGLYNTDQVHALAQKHAIEMPLTFQVHRILHEDLDPQQAVQELLERSPKAE

SEQ ID NO: 89527 - protein, 107 aa, Gymnadenia conopsea
MARGSSQSQTTSSAGGAGRPATAGPRGTPAAAAGMRRRRLGGVGGGGSSGNFSGGASGSNMLRFYTDDAPGLKMSPTVVLVMSLCFIGFVTALHVFGKLYRYKSGGS

SEQ ID NO: 89528 - protein, 235 aa, Populus trichocarpa
MESGKKAEAGPSTTTRGGFDEKLERKRETSETPPAVAAAIDDDEEDDGDAVDNGVPVAGFVPGPLLSLKEQIEKDKEDDSLRRWKEKLLGCVESDLNGQLEPEVKFHSIGIISDDIGEINTPLPVDESQSGHPLFALREGSRYQLKLTFSVLHNIVSGLAYSNTVWKGGIQVDQSKGMLGTFAPQREPYVHTLEEDTTPSGVLARGTYSAKLKFEDDDRRCHMELKYSFEIKKRR

SEQ ID NO: 89529 - protein, 397 aa, Vitis vinifera
MDGQDLLKDEIVSEQLTRNIQFFGLEFQQKVTASYVVIIGLGGVGSHAASMLLRSGVGRLLLVDFDQVSLSSLNRHAVATREDVGIPKAQCLKKHFSAIFPECQIDARVLLYDASSEEDILSGHPDFVLDCIDNIDTKVALLAACVRRGLKVLSATGAGARADPTRIRVADLRESTNDPLSRSVRHRLRKDYGIEGGIPVVFSLEKPKVKLLPFKGSNGEEENPSDYQIVPGFRVRIIPVLGTIPAIFGQIMASYVVTQLAGFQVHTEPVVNLDTDHYHILHQRLIEHEELLYGTAMQVQVDVAEVMYIVKDLWRGRSAREQSIEHVGRGMWRSVNELMLVRWDQRKPASVSNLILLKFKEADEHESRTLDDIKEKEPEYFNRVTSVLKRAELDFGL

SEQ ID NO: 89530 - protein, 729 aa, Yersinia pseudotuberculosis IP 32953
MLYQSETLQLHWLENGIAELVFDAPGSVNKLDTKTVANLGEALNVLEKQSELKGLLLRSAKTALIVGADITEFLSLFNAPPEKLHQWLVFANTIFNRLEDLPVPTISAINGYALGGGCECILATDFRIASPEARIGLPETKLGIMPGFGGSVRLPRLLGADSALEIIATGKDVTANDALKIGLVDAVVDPEKLVGSALTMLKQAIDGKLDWQAARRPKLEPLKLNPTEAAMCFTIAKGRVMQVAGKHYPAPLTAVKTIEAAAKFGRTEALNLETNSFVPLAGSNEARALVGIFLNDQYVKAQAKKLSKGVAAPKLAAVLGAGIMGGGIAYQSALKSVPVIMKDINENSLDLGMNEAAKLLNKQLERGKVDGLKMASILATIRPTLDYAGIERAQVIVEAVVENPKVKAAVLAEVEALIGEDTVLASNTSTIPIDQLAKSLKRPENFCGMHFFNPVHQMPLVEIIRGAKTSDKTLAAVVAYATQMGKTPIVVNDCPGFFVNRVLFPYLAGFGMLVRDGGDFHQIDKVMEKQFGWPMGPAYLLDVVGIDTAHHAQAVMAAGFPERMNKDYRDAVDVMFDNQRFGQKNGQGFYRYTQDAKGKPRKENDEQVDKLLAEISQPLQEFSDEDIIARTMIPMINEVVRCLEEGIIASAAEGDMALVYGLGFPPFHGGVFRYLDTLGSANYVEMAQRYAHLGALYHVPAGLRAKAEHNESYYPVAAALLDVSTNQPA

SEQ ID NO: 89531 - protein, 94 aa, Rhizobium leguminosarum bv. viciae 3841
MTGEAVLAPFKVEFAKQGRTIDVTSDQTVLSCAKKAGIKIPSSCSNGLCGTCKSKLVSGTINMHHNGGIRQREIDAGFFLPCCSKPLTDLIIER

SEQ ID NO: 89532 - protein, 321 aa, Bacillus cereus ATCC 10987
MKALCFEQFGNPDVLQYKELNDPIINPNEILVRTKAIGLNFADIYRRRGDYHLAGNPPYILGYEGAGIVEKVGADVTNIKPGDRIAFADVPFANAELVAVPSKKAIPLPDSISFETAASVLLQGLTAHYLTKDSYEIKQGDIALVHAAAGGVGQLLIQIIKLLGGKVIGLTSAKEKAQIATLSGADHVFLYTEAWPAKVLEITNGTGVNVVYESVGSTLEESFSATKTGGTVVFYGMAGGNPAPVDPRMLMDTSKTLTGGDLWNVLTTFEERKKRSTQLFDWIASGKLNIASPTTFSLQDGARAHELLESRKSTGKILLIP

SEQ ID NO: 89533 - protein, 431 aa, Zea mays
MTTVSRALGSAFAGFTRAPAVAQTATTLPSPYGSSALHQHWRWSRACRTRRFSSGRAARISMSLRAGIVGLPNVGKSTLFNAIVENGKAQAANFPFCTISPNVGVVAIPDPRLQVLSKLSKSQQTVPTSIELVDIAGLVKGASKGEGLGNQFLSNIREVDSILQVVRCFEDDDIVHVNGKVDPRSDIDVINLELIFSDLEQIEKRLDKLNKSKTKDTQVKVKEQAEKSGLEKIQQALMEGKPARSVDLAEHEKEAIKHLYLLTMKPVIYVANVTESDLAEPDSNSHVKEVAKAASDLQSGMVTISAQVEAELAELPLEERVEYLKSLGVAESGLGNLVKATYNLLGLRTYFTTGDKETKAWTILSGMTAPQAAGVIHSDFQKGFIRAETVSYDDFVAAGSLGVAREKGLLRLEGKDYVVQEGDVMLFRFNV

SEQ ID NO: 89534 - protein, 249 aa, Prosthecochloris aestuarii DSM 271
MANKAETSPNRPQETAKSLFRTKSHASIQHMFDEVAPTYDFLNHLLSLGIDNYWRAFAAAKAKKLIGANPAPDILDVATGTGDLAKEMSKLQGARVTGMDLSPEMLAIAEKKYPQIRFVQGYAEKLNFDTASFDIVSAGFGARNFEDLTKGLKEFHRVLKPGGHALIIEPMIPRNPVMKKLYLIYFKKVLPKIASMVSKSSFAYDYLPHSVESFPQDKEFTAILKSAGFQSAEFIPMTFETSILYIAKK

SEQ ID NO: 89535 - protein, 393 aa, Candida albicans SC5314
MSSSIKVNSVTEKPVATVGSFFNGLRVSPEVEFDLYKHKKRDDYVLHGETDTLDYNGTSNNENEYVVAVFDPNSKSVELYKTPYISTKVTAKKNRVYKGPKVKSAGIRNVTQRNALGEAFGTKKAKSAITNLEKNRIDSEKLQDIEMDIVDTVKESTRDLPAQEDGVDRPAPLANVDATNVEDIYPLENIIPEKDWQYLRVSSILTAENPLEKLPFTKSEFIAKQLPILISQKNTEKLQMLFYASLLLGVYENRRVKDKQSLMTRLQNIPSEILVDGILDRFAISRATKFGKSKDKSFTIDPYHEDKLLTYLFILLLHINNFTVELVPLSKDLKLKNTRLVGLFRALGAIIKSATVGEAEALGIPKSAVGTYKIATLKVPFKLPELTRRGKRR

SEQ ID NO: 89536 - protein, 309 aa, Salmonella typhimurium LT2
MKTAGNLIVLGSINADHILNLESFPTPGETVTGSHYQVAFGGKGANQAVAAGRSGANIAFIACTGDDDIGDSIRKQLVSDRIDIAPVSVIKGESTGVALIFVNGEGENVIGIHAGANAALSPALVDAQRERIAQADALLMQLESPLESVLAAAKIAHQHHTTVALNPAPARELPDELLALVDIITPNETEAEKLTGVRVENDDDAAKAAQVLHDKGIRTVLITLGSRGVWASVDGEGRRVPGFSVEAVDTIAAGDTFNGAFITAILEETPLPEAIRFAHAAAAIAVTRKGAQPSVPWREEIEAFLHQQG

SEQ ID NO: 89537 - protein, 286 aa, Zea mays
  misc_feature (214)..(214): Xaa can be any naturally occurring amino acid
MAAPPVQPVPTAAAAAVNGDAFRLGFVGAGNLAESIARGVAASGVLPASAIRTAPHRRPERGEAFASFGACLLQTNAHVVDDSDVIVISVKPQIVKQVLLQLRPRLSEKKLLVSIAAGIKMQDLQDWSGQRRIIRVMPNTPSAVGQAASVMCLGEMATQDDENRVRKLFSAIGKVWTAEEKYFDAVTGLSGSGPAYIFLAIEAMADGGVAAGLXPRDLALGLASQTVLGAATMVSQTGKHPGQLKDQVTSPAGTTIAGIQELEKGAFRGTLISAVVAAAKRCRELS

SEQ ID NO: 89538 - protein, 369 aa, Candida glabrata CBS 138
MSFFQRNSAAGNTTSTVMATEKDLQNEIVINNPADDSISDIAFSPQHDFLFSVSSWDGKVRIWDAQNGVPQGKAQYEHNGPVLCTRWSLDGARIASGGCDNTVKLYDVASGQSQQIGSHNDAVKSLRFVQCGPTNTECLVTGSWDKTIKFWDTRQPQPITTIAMPERVYTMDNKQQLLVVGTAERHIAIINLANPTTIFKSSQSPLKWQTRVVACYNEGDGYAIGSVEGRCAIKYVDDEAQKKSGFSFKCHRQTQPNRAAGSSSQSLVYPVNSIAFHPIYGTFVTAGGDGSFHFWDKNQRHRLKGFPSMQGSIPVCNFNRNGSILAYAVSYDWHQGHMGNRPDYPNVIRLHPTTDEEVKEKKKKTTFGR

SEQ ID NO: 89539 - protein, 196 aa, Methanothermobacter thermautotrophicus str. Delta H
MVVILIIDNYDSFTHNLYQLAGEILRDEGMDEEIMVLRNDEARISDLRALDPEKIIISPGPGNPSRRSDFGVCMDVIGEFTDRPLLGVCLGHQGIFHAFGGRVDQGEPVHGKIVEVFHDGSELFRDVPNPFRATRYHSLVCRPEDTPADIEVTAVTSDEIIMAIKHREYPVYGLQFHPESAGTPSGRTVIRNFLRM

SEQ ID NO: 89540 - protein, 235 aa, Nepenthes hamata
  misc_feature (3)..(4): Xaa can be any naturally occurring amino acid
  misc_feature (6)..(7): Xaa can be any naturally occurring amino acid
  misc_feature (10)..(11): Xaa can be any naturally occurring amino acid
  misc_feature (15)..(17): Xaa can be any naturally occurring amino acid
  misc_feature (19)..(20): Xaa can be any naturally occurring amino acid
  misc_feature (22)..(24): Xaa can be any naturally occurring amino acid
  misc_feature (26)..(26): Xaa can be any naturally occurring amino acid
  misc_feature (28)..(31): Xaa can be any naturally occurring amino acid
  misc_feature (33)..(34): Xaa can be any naturally occurring amino acid
  misc_feature (37)..(39): Xaa can be any naturally occurring amino acid
  misc_feature (47)..(48): Xaa can be any naturally occurring amino acid
  misc_feature (55)..(55): Xaa can be any naturally occurring amino acid
  misc_feature (58)..(58): Xaa can be any naturally occurring amino acid
  misc_feature (69)..(69): Xaa can be any naturally occurring amino acid
LIXXVXXNLXXALGXXXPXXSXXXAXAXXXXGXXLYXXXRPGGSPLXXMCQVLVXSFXKSKLALPEDSXLLYETSDKNSAIEGSRKLEHTDELRCLDKAAVVSDKEIKCEDFSNPWRLCTVTQIEELKILIRMFPIWATGIVFSAIYAQMSTMFVEQGEVMDRTIGSFTIPAASLSMFDTISVIFWVPVYDKILVPLARKFTGKQRGFSELQRMGIGLFISILSMAAAALVEMKR

SEQ ID NO: 89541 - protein, 235 aa, Nepenthes glabrata
  misc_feature (138)..(138): Xaa can be any naturally occurring amino acid
LIVWVQENLGWALGFGIPAISMGIAIASFFSGTTLYRLQRPGGSPLTRMCQVLVASFRKSKLALPEDSSLLYETSDKNSAIEGSRKLEHTDELRCLDKAAVVSDKEIKCEDFSNPWRLCTVTQIEELKILIRMFPIWXTGIVFSAIYAQMSTMFVEQGEVMDRTIGSFTIPAASLSMFDTISVIFWVPVYDKILVPLARKFTGKQRGFSELQRMGIGLFISILSMAAAALVEMKR

SEQ ID NO: 89542 - protein, 111 aa, Chlamydia trachomatis
IEESGADLIHIDVMDGHFVPNITFGPGVVAAINRSTELFLEVHAMIYTPFEFVEAFVKAGADRIIVHFEAAENIKEIISYIQKCGVQAGVAFSPETSIEFVTSFIPLCDVI

SEQ ID NO: 89543 - protein, 1822 aa, Chloroflexus aurantiacus
MIDTAPLAPPRAPRSNPIRDRVDWEAQRAAALADPGAFHGAIARTVIHWYDPQHHCWIRFNESSQRWEGLDAATGAPVTVDYPADYQPWQQAFDDSEAPFYRWFSGGLTNACFNEVDRHVTMGYGDEVAYYFEGDRWDNSLNNGRGGPVVQETITRRRLLVEVVKAAQVLRDLGLKKGDRIALNMPNIMPQIYYTEAAKRLGILYTPVFGGFSDKTLSDRIHNAGARVVITSDGAYRNAQVVPYKEAYTDQALDKYIPVETAQAIVAQTLATLPLTESQRQTIITEVEAALAGEITVERSDVMRGVGSALAKLRDLDASVQAKVRTVLAQALVESPPRVEAVVVVRHTGQEILWNEGRDRWSHDLLDAALAKILANARAAGFDVHSENDLLNLPDDQLIRALYASIPCEPVDAEYPMFIIYTSGSTGKPKGVIHVHGGYVAGVVHTLRVSFDAEPGDTIYVIADPGWITGQSYMLTATMAGRLTGVIAEGSPLFPSAGRYASIIERYGVQIFKAGVTFLKTVMSNPQNVEDVRLYDMHSLRVATFCAEPVSPAVQQFGMQIMTPQYINSYWATEHGGIVWTHFYGNQDFPLRPDAHTYPLPWVMGDVWVAETDESGTTRYRVADFDEKGEIVITAPYPYLTRTLWGDVPGFEAYLRGEIPLRAWKGDAERFVKTYWRRGPNGEWGYIQGDFAIKYPDGSFTLHGRSDDVINVSGHRMGTEEIEGAILRDRQITPDSPVGNCIVVGAPHREKGLTPVAFIQPAPGRHLTGADRRRLDELVRTEKGAVSVPEDYIEVSAFPETRSGKYMRRFLRNMMLDEPLGDTTTLRNPEVLEEIAAKIAEWKRRQRMAEEQQIIERYRYFRIEYHPPTASAGKLAVVTVTNPPVNALNERALDELNTIVDHLARRQDVAAIVFTGQGARSFVAGADIRQLLEEIHTVEEAMALPNNAHLAFRKIERMNKPCIAAINGVALGGGLEFAMACHYRVADVYAEFGQPEINLRLLPGYGGTQRLPRLLYKRNNGTGLLRALEMILGGRSVPADEALELGLIDAIATGDQDSLSLACALARAAIGADGQLIESAAVTQAFRHRHEQLDEWRKPDPRFADDELRSIIAHPRIERIIRQAHTVGRDAAVHRALDAIRYGIIHGFEAGLEHEAKLFAEAVVDPNGGKRGIREFLDRQSAPLPTRRPLITPEQEQLLRDQKELLPVGSPFFPGVDRIPKWQYAQAVIRDPDTGAAAHGDPIVAEKQIIVPVERPRANQALIYVLASEVNFNDIWAITGIPVSRFDEHDRDWHVTGSGGIGLIVALGEEARREGRLKVGDLVAIYSGQSDLLSPLMGLDPMAADFVIQGNDTPDGSHQQFMLAQAPQCLPIPTDMSIEAAGSYILNLGTIYRALFTTLQIKAGRTIFIEGAATGTGLDAARSAARNGLRVIGMVSSSSRASTLLAAGAHGAINRKDPEVADCFTRVPEDPSAWAAWEAAGQPLLAMFRAQNDGRLADYVVSHAGETAFPRSFQLLGEPRDGHIPTLTFYGATSGYHFTFLGKPGSASPTEMLRRANLRAGEAVLIYYGVGSDDLVDTGGLEAIEAARQMGARIVVVTVSDAQREFVLSLGFGAALRGVVSLAELKRRFGDEFEWPRTMPPLPNARQDPQGLKEAVRRFNDLVFKPLGSAVGVFLRSADNPRGYPDLIIERAAHDALAVSAMLIKPFTGRIVYFEDIGGRRYSFFAPQIWVRQRRIYMPTAQIFGTHLSNAYEILRLNDEISAGLLTITEPAVVPWDELPEAHQAMWENRHTAATYVVNHALPRLGLKNRDELYEAWTAGER

SEQ ID NO: 89544 - protein, 86 aa, Glycine max
MASSMISSPAVTTVNRAGAGMVAPFTGLKSMAGFPTRNTNSDITCVASNGGRVRWVRVWPPIGEREWESVCSLPNVPDRAVRGDVQ

SEQ ID NO: 89545 - protein, 352 aa, Triticum aestivum
MERRALLKTALLACLLVVCSGRVPMVIQQPSTTIYNSTLAKTLVEYAAAIYTADLTQLFTWTCDRCGDLIEGFEMMDIIVDVENCLEAYVGFASDINAVIVVFRGTQENSIQNWIEDLLWKQLDLDYPGMPEAMVHRGFYSAYHNTTIRDGIVSGIQKTRKLHGDVPIMVTGHSMGAAMASFCALDLVVNYGLDDVKLMTFGQPRVGNAAFASYFKRYLPHAIRVTNANDIVPHLPPYFSFFPQKAYHHFPREVWVHDVGLGSLVYTVEQICDDSGEDPACSRSVSGNSIQDHITYLGVSMHAEAWSSCRIVMDYAELRYKMDLHGNVVLSKQQQQQQQPGLSDQRRRHSAQ

SEQ ID NO: 89546 - protein, 235 aa, Nepenthes albomarginata
  misc_feature (208)..(208): Xaa can be any naturally occurring amino acid
LIVWVQENLGWALGFGIPAISMGIAIASFFSGTALYRLQKPGGSPLTRMCQVLVASFRKSKLALPEDSNLLYETSDENSVIEGSRKLEHTNELKCLDKAAVVSDKEIKREDFSNPWRLCTVTQIEELKILIRMFPIWATGIVFSAIYAQMSTMFVEQGEVMDRTIGSFTIPAASLSMFDTISVIFWVPVYDKILVPLARKFTGKQRGXSELQRMGIGLFISILSMAAAGLVEMKR

SEQ ID NO: 89547 - protein, 261 aa, Zea mays
  misc_feature (132)..(132): Xaa can be any naturally occurring amino acid
MPPAAAALLRCAPAVPFAARSSAVSRSGMARRLVAASAAAGRLAPAYRGLLLDAGGTLLQVARPVAETYASIGRRYGVTKTKKRIMEGFKRAFSAPWPKTLRYQGDGRPFWRIVVAEATDCTDGDYFEEVYXYYAHGDAWRLPTGADAALRELKDAGVKLAVVSNFDTRLRELLKDLNVSEMFDAIVVSSEVGYEKPSPGVFNIALDQIGVEASKAIHVGDDETADMAGANATGLECWLWGKDVTTFSEIQERILTTDGPQ

SEQ ID NO: 89548 - protein, 353 aa, Arabidopsis thaliana
MEAKKVTEEEEETWRREIVTSVMRLVSTRLPQTDLISLLLVSPWLYRTLISYPSIWLTINLREMTNAGDRLLAALSLPRYRQVKHINLEFAQGVVDSHLKLVKTECPDALLSLEWLNLNVCQKISDNGIEAITSICPKLKVFSIYWNVRVTDAGIRNLVKNCRHITDLNLSGCKSLTDKSMQLVAESYPDLESLNITRCVKITDDGLLQVLQKCFSLQTLNLYALSGFTDKAYMKISLLADLRFLDICGAQNISDEGIGHIAKCNKLGSLNLTWCVRITDAGVNTIANSCTSLEFLSLFGIVGVTDRCLETLSQTCSTTLTTLDVNGCTGIKRRSREELLQMFPRLTCFKVHS

SEQ ID NO: 89549 - protein, 385 aa, Bacillus cereus ATCC 10987
MKKAIKFCLIATLSTAIVSGCSFEGNNENAKGKEGEKVEIQKTVGKYTMPDEKDKHEGTWLQWPHEYTYGEEYKQEVEPIWVKMASALTEGEKVHIVAYDEEEKERINKLLIDKGLNMDKIDFFIAPTDDVWARDSGPIFVYDNNKNLKILDPAFNGWGKKTPYKNDARIRENVSKQAGIERIDWGKFVLEGGAIELDSNGTALLTRSAVTNKNRNPDLSEKEIEKYISDLGVTNFIWLDGVPNLDITDFHIDGFAKFHNKSTIVTMKEDDLAEWGLSNKDMDTLLDAKNALGKKYKYEYLPLSKEKVVLENGKTLDYKGSYINYYIGNTVVLVPNYNDPNDKIANDTIQKLYPDRKVVGIDVRELYKNGGMIHCVTQQQPIALK

SEQ ID NO: 89550 - protein, 482 aa, Prosthecochloris aestuarii DSM 271
MDNKTITTKQRLAIPRQEMPAQDPLKRTQNFKEVNLGYSPEAAIKEAMRCIQCKDPVCIKGCPVNIKIDEFIHLVAEGDFLGAARKIKEDNVLPAICGRVCPQEDQCEKECVLGNKHKPVAIGHLERFVADYERESGNIKTPEVRPATGKKIAVIGSGPAGLSCANDLAQLGHSVVVFEALHELGGVLMYGVPEFRLPKEIVRTEIDVLKKMGVEFQSDVVVGRSVTIDELIEEEGFDAAFIGVGAGLPWFMGIPGENLVGVLSANEFLTRVNLMKAYDFPESDTPVFDCKGKSIAVFGGGNTAMDAVRTAKRLGAEHAYIVYRRSEAEMPARVEEIHHAKEEGIEFLLLQSPVEFIGNDEHWLTGVKCLKMELGEPDDSGRRRPVAIEGSEYVLPIDMAVISIGNGSNPLIGQTTPDIEFSKRDTIVVDINTMGTSKENVYAGGDIVTGGATVILAMGAGRTAAKAIDEKLMGKSRGFDEW

SEQ ID NO: 89551 - protein, 331 aa, Helicobacter hepaticus ATCC 51449
MSFIDTIKTQARKNKKTIVLPETSDSRTIEAAVKILNEDFAELILIGEQEQILSTYQDNAQVLKKATFLHSSDTALLDELIELLVKLRAHKGMDKSKAREILVNDNLYFGAALVKAGRADGMVAGAIHATSDVLRAALQIVGTAPDSKLVSSFFVMVVPQCDYGLNGTFVFSDCGLCQNPSAEELAHIALSSAKSFASIMHEEPMVAMLSHSTYGSAKHPDVDKVVEATKIAKSLDKNLKVDGELQLDAAIVPSVGASKAKGSNVAGKANVLVFPDLDAGNIGYKLVQRFAKAEAYGPITQGMGAPINDLSRGCSADDIVGVVALTALQAK

SEQ ID NO: 89552 - protein, 136 aa, Triticum aestivum
  misc_feature (19)..(19): Xaa can be any naturally occurring amino acid
FWYSASTVHNGNVTCTYPXLLSSIFLGAFYIILAIYVMFVGGQMLSLVINKGLRRRIYMLIFATMILLPRATLLGLSVVSWPGETAHETLVFTSFLVLMLAAMAGIVILVYFPVADAFAIVDQGNIEMQTDQETIL

SEQ ID NO: 89553 - protein, 339 aa, Rhizobium leguminosarum bv. viciae 3841
MSLLEKFERYQLTFGPTPIEHLPRLTAALGGKVDIYAKRDDCNSGLAMGGNKLRKLEYIVPDAIASGADTLVSIGGVQSNHTRMVAATAAKIGMKCVVIQEKWVPHYDAVYDRVGNILMTKLMGADSRLVEDGFDIGIRKSWEDAIQSVEDAGGKPYAIPAGASVHKFGGLGYVGFAEEVAAQEKDLGFIFDYIIVCVVTGSTQGGMIVGFAALNRADRVIGIDASGTLQQTRDQVRKIVDATSELVNLGRSVREDEIVINPDYAYPAYGVPSEETNEAIRLAARTEAMITDPVYEGKSMQGMIDLARKGFFSEGSKVLYAHLGGAPALNGYSYYYKDG

SEQ ID NO: 89554 - protein, 244 aa, uncultured bacterium
MSIFARMNDDIRSVMERDPAARTRLEVVLCYPGLWAVWLHRISSKLWGGGLRLPARMISQVGRFLTGVDIHPGAKLGRRLFIDHATGVVIGETAIVGDDVTMYQGVTLGGTGKQHGKRHPTICDRVFIGNNANVLGNITVGENSRVGAGSVVLNDVPPNSTVVGVPAHIVYSNGQRVLITDPHEIKDPLSDALIALSARVEELEERLGAHERWMPPFAEEEAERTAYRAELDQARVYVSMGEGI

SEQ ID NO: 89555 - protein, 317 aa, Actinidia deliciosa
TFPVIDMEKLTGKERSPTMEKINDACENWGFFELMNHGISHELMDTVERLTKEHYKKCMEQRFKEMVATKGLEAVQSEIDDLDWESTFFLRHLPVSNISEIPDLEQDHRKAMKEFAEKLEKLAEQLLDLLCENLGLEKGYLKKAFSGSKGPTFGTKVSNYPPCPLPELIKGLRAHTDAGGIILLFQDNKVSGLQLLKEGEWIDVPPMKHSIVINIGDQLEVITNGKYKSVMHRVIAQTDGNRMSIASFYNPGSDAVIYPAPALVDKEEDQQKQVYPKFVFEDYMKLYAGLKFQAKEPRFEAMKAMESAVKLGPISTI

SEQ ID NO: 89556 - protein, 267 aa, Bordetella parapertussis 12822
MHADTAQDAPDAAARYPRADSVADFEHNLAAVRARMAAACQRAGRDPAGVRLLPVSKTVDEARIRMSYAAGCRELGENKVQEAYRKWEAMADLADLRWSVIGHLQTNKAKLVARFAAEFQALDSVRLAEALERRLQAEGRALDVYVQVNTSGEASKYGLHPDEAAAFIRQLPSYGALRVRGLMTLAVLSADAARVRQLRTLRDRLRQEAPAGVSLDELSMGMSGDYEIAIEEGATVVRVGQAIYGARALPNDYYWPDSGAADRAEDE

SEQ ID NO: 89557 - protein, 316 aa, Zea mays
MAPVDLTPKQPRKAYGGDGGAYYEWSPADLPMLGVASIGAAKLSLAAGGLALPSYSDSAKVAYVLQGTGTCGIVLPEATKEKVVAVKEGDALALPFGVVTWWHNGPAAPTPLTADAAALVSSQPASGIVRASSSPLPAPSPRDREGVALNCLEAPLDVDIPGGGRVVVLNTANLPLVKEVGLGADLVRIDAHSMCSPGFSCDSAYQVTYIVRGSGRVQVVGPDGVRVLETRVEGGFLFIVPRFHVVSKIADASGMEWFSIITTPNPIFSHLAGKTSVWKAISAEVLQASFNTTPEMEKLFRSKRLDSEIFFAPPSN

SEQ ID NO: 89558 - protein, 1292 aa, Oryza sativa Japonica Group
MSGLDLREMLSSAARRHTWRRSGWGAEWGGGDDARSAALPARCPPPPPPRRPAAAGGRGDEGSGGVRGRGEEGTSRGGSGARREDAAGTGRNAVAVVAGGSATSGAERVAARAEDGRRSMDGPTLELSEMMLHAAQPWRSRCTQRDVRPGAVPPRPVAADGRGEGTSTVRGRVLEGTTRGGGRGGGMEREREVVAPARNAVAVAGDLATHGGERVAGPLVAKEKRNGGGELGTKRGLEKRAPLPPPKRRVVSAKRQFPPDFGRDSAVPLGRGRGRGGGVRPSDGAPARAVLGEKVASAGNGDSMANVHHHAVMDTVLMKSSHASDENLVAFKVGSPENGAEGAARGKGAHNGELLGKREVLAQAVNLLPMRRTVSATHRFTAGCGRDAAAPLARREEGKVGSGLEVMPVDVGGGVSKEVMATDGSKHSVNQCTANIVGAVGVLDGTVQYQELEEGEVADEAYCDVESQKVVGCDSFDDSAGERHEGVVPVTFAVTEVLTSHAYDEMMQIKALQEGGSDAAQETEHDLPMGGKCETILPDASPKCSFGGPSNEIVHGKRVLGSHGMKGEVPSLAIEDHGGIAQIDQELEDVEMTTGEYRVQDAQIATHVIPHESTTGRHEGGLCASAAAEDVKVMNKYKGTLPKGAAKSSMNIATGVFGDGIMRSKILSTARKVVKPPVRASHKPPLNTLHRPFSTNSASFGHKKLKVKRPDQSKDIPMKIASTSGLAGKDNLIDEKALSLEDDDILKALVVHDGKLEVYLNVPSCVQLHRQHGSGNADDRSKIRMLCRRFQFICRALLHAVEQGSLKIRRVDLAADKIIRKLPGFTKPGPTVGNVNGVEVGDEFMYRVELALVGLHRPYQGGIDTTDYNGVLVAISIVCSGGYPDELSSSGELIYTGSGGKPAGKKKDEDQKLERGNLALKNCIETKTPVRVIHGFKGQNREDNSHSRAKQILTFTYDGLYLVVDCWTEGLKGSRIFKYKLQRIPGQPELPLHIAKGLRRSLSRPGLCIADISQGKEMDPICVINDVSNVHPTSFQYISRIKYPSWLTKRHPQHHGCDCSDGCIDSTKCFCAVKNGGKIPFNSNGAIVHDKPLIFECGPSCRCHSSCHNRVSQKGMKIHLEVFRTANKGWGVRSLRSISSGSFICEYVGILLTDKEADKRTNDEYLFDISHNCDDEDCSKGRPSTISSLNSSGGCSQTMEDVCFTIDASEYGNIGRFINHSCSPNLYAQNVLWDHDDQRVPHIMFFAAENIPPLQELTYDYNYKIGEVRDLNGRVKVKDCHCGSPQCCGRLY

SEQ ID NO: 89559 - protein, 432 aa, Magnaporthe grisea 70-15
MANWAKVSGPNGHTGPAGAGITNGNGNRSRSYHDDDENTPLILRPGSSPAIPAWRRFLWDCHRTPGDDSSNIVVKALANTWHVTKISLLSSPVNILMVFVPVGIIAGVMHWSPAWVFTLNFLAIIPLAAILSFATEEISVKLGETLGGLINATFGNAVELIVSVIALKQGQIEVVQASMLGSILSNLLLVMGMCFLLGGWFNMYEEGTDVGMEQAFASGTAQTTCSLLTLAAAAMIIPATNLFSVDTHESSENGDIEAIDATEPNAIKDEDEDEEEHMTWWAAGIVLVAVTVVISFSADYLVESIEPIVETGVLSRSFIGLILIPIVGNAAEHVTACVVAVRNKMDLAMGVAIGSSIQIALLVTPALVITAWVALDDTPMSLRFDTFQTVAFALSVLVVTYTVQDGKSNYLEGAMLLGLYIIIALAFYATPI

SEQ ID NO: 89560 - protein, 235 aa, Nepenthes boschiana
  misc_feature (7)..(7): Xaa can be any naturally occurring amino acid
  misc_feature (77)..(77): Xaa can be any naturally occurring amino acid
  misc_feature (109)..(109): Xaa can be any naturally occurring amino acid
  misc_feature (185)..(185): Xaa can be any naturally occurring amino acid
  misc_feature (208)..(208): Xaa can be any naturally occurring amino acid
  misc_feature (220)..(220): Xaa can be any naturally occurring amino acid
LIVWVQXNLGWALGFGIPAISMGIAIASFFSGTALYRLQKPGGSPLTRMCQVLVASFRKSKLALPEDSNLLYETSDXNSVIEGSRKLEHTNELKCLDKAAVVSDKEIKXEDFSNPWRLCTVTQIEELKILIRMFPIWATGIVFSAIYAQMSTMFVEQGEVMDRTIGSFTIPAASLSMFDTISVIXWVPVYDKILVPLARKFTGKQRGXSELQRMGIGLFXSILSMAAAALVEMKR

SEQ ID NO: 89561 - protein, 460 aa, Vibrio cholerae
MKICPVVLSGGVGSRLWPLSREHFPKQCLILTDLLSSLLQQTLVRTIHLNVQSPLVVCNDDHRFLIAQQLQDMGVKGAKVMLEPVGRNTAPAVALAAFEVLQSDNEDVLMLVLPADHVIRDTAAFEKAIAQAKVLAEAGGLVTFGITPMRAETGYGYIKAGQDSCVEKFVEKPDLATAQSYLESGDYLWNSGMFLFQASQYLAELTQHRPAMYAAVESAYGNRTEDLDFIRIGTEAFTACPSESIDYAIMEPTQNAKVVPYNGDWSDIGAWDALHDYCEKDSNHIVLVGDVMAESTTNSLVRAESRLVATVGVNNLVVIETADAVLIMDKDQSQDVKKIVSRIKAEGRQEHMHHTTVHRPWGTYQTVDLGDRHQVKRIMVKPGEKLSVQMHHHRAEHWVVVSGTAKVQNGEREILLTENESTYIPVGVVHALENPGKIPLELIEVQSGSYLGEDDIVRFS

SEQ ID NO: 89562 - protein, 235 aa, Nepenthes burbidgeae
  misc_feature (39)..(39): Xaa can be any naturally occurring amino acid
  misc_feature (138)..(138): Xaa can be any naturally occurring amino acid
  misc_feature (211)..(211): Xaa can be any naturally occurring amino acid
LIVWVQENLGWALGFGIPAISMGIAIASFFSGTALYRLXKPGGSPLTRMCQVLVASFRKSKLALPEDSNLLYETSDENSVIEGSRKLEHTNELKCLDKAAVVSDKEIKREDFSNPWRLCTVTQIEELKILIRMFPIWXTGIVFSAIYAQMSTMFVEQGEVMDRTIGSFTIPAASLSMFDTISVIFWVPVYDKILVPLARKFTGKQRGFSEXQRMGIGLFIAILSMAAAALVEMKR

SEQ ID NO: 89563 - protein, 111 aa, Chlamydia trachomatis
IEESGADLIHIDVMDGHFVPNITFGPGVVAAINRSTELFLEVHAMIYTPFEFVEAFVKAGADRIIVHFEAAENIKEIVSYIQKCGVQAGVAFSPETSIEFVTSFIPLCDVI

SEQ ID NO: 89564 - protein, 244 aa, Coccidioides immitis RS
MSESRQELLAWLNNLLQLNITKVEQCGTGAAYCQVYDSIFMDVPMSRVKFNVNTEYAYIQNFKVLQNTFTRHQIDRPVPVEALVKCRMQDNLEFLQFTKRFWDQNYPGGDYDAVGRRKASGAPLASSTSRPGTTSATGARRGATPTTAARPRVGGGVSANTAALTQEINSQKEAIAGLEKERDFYFAKLRDIELLLQQAVEADPELEKDEDSLIKHIQAILYSTEEGFEIPADAEAVGEELETF

SEQ ID NO: 89565 - protein, 187 aa, Desulfococcus oleovorans Hxd3
MNISSIGGMLTNPNVLTASRIAATPVIVVLLMLPSNRVTAFLAALVFSAAAITDYFDGFLARKYGQVSNLGKAMDPLADKFLVSAAFIMLAAAGRVPGWVACIIVIREIGITGLRNVMVGAGQDISASRLGKFKTGFQIAAIIPLLLHYPYFGIDLHLLGTWLLWVAVVLTVWSGADYVIKARPFLQ

SEQ ID NO: 89566 - protein, 111 aa, Chlamydia trachomatis
IEESGADFIHIDVMDGHFVPNITFGPGVVAAINRSTELFLEVHAMIYTPFEFVEAFVKAGADRIIVHFEAAENIKEIVSYIQKCGVQAGVAFSPETSIEFVTSFIPLCDVI

SEQ ID NO: 89567 - protein, 327 aa, Coprinopsis cinerea okayama7#130
MASAAPQQASASPLPAWIADKNYQPPPGTLGNLTMTQLHCLDKLKKELKEEGKFVEERMDDPTLLRFCRARKFDYPAVKTMLLDFEQWRKDFGVDELTKNFDFKEKEEVNKYYPQYYHKTDKDGRPIYIEQLGKLDINALYKITTPERQIQRLVYEYEKSLSTRVKVCSYTAKHPVETFCTILDLGGVSLASFARVRDFVSQAASIGQNRYPETMGKFYIINAPWAFTMVWAVIKPWLDPVTVAKIQILGSSYRDELLKQIPIENLPKEFGGLCDCPGGCSLSDAGPWNDQNVDDVLAAFEKLVNGQTEEKEGEEKKEGEAPAAAAA

SEQ ID NO: 89568 - protein, 519 aa, Coxiella burnetii RSA 493
MTQADNQNPKPMVLIILDGFGESDETTHNAIKEANTPTLDKLFRHYPHTLLEASGRAVGLPDGQMGNSEVGHLHIGGGRKVPQDLTRIDAAIASGEFYENPALIEALEKAKALNKAVHILGLLSPGGVHSRDNQIAALVELAHRCGIKKIYLHAILDGRDTPPKSALLSIEKITDQFHAYGNGKIASLIGRYYAMDRDKRWDRTEKAYDLLTQGTAQFHALTAKEGLMLAYEQGNTDEFVSPTSIHRHNETPITIEDGDVVVFMNFRADRARQLTYAFLDDHFTAFNRQVRPKLSAFVTLTAYAKDIHAAVAFPPLELHNTLGEYLSARGYRQLRIAETEKYAHVTYFLNGGQEAPFNGEDRLLIPSPKVATYDLQPEMSAVEMTNKLVEIIQNDDYDLIVCNFANPDMVGHTGDETATREAIQVIDDCLKRIITALQSVGGEALITADHGNAEKMFDEKTNQPHTAHTSNLVPLIYVGREAQFCKEVGALDDVAPTLLYLMGLEKPREMTGRNLITLK

SEQ ID NO: 89569 - protein, 254 aa, Photobacterium profundum SS9
MLIGTLMLWGRLVDGLYSPWDKDDAVARKVCETLGDDSYRAPIVLEGGSIHVDGEGTLYTTEECLLHPSRNPDLTREEIEDVLKVTLSIEKVIWIPQGLYNDETNGHVDNLIHVVRPGEIALTWCDDETDPQYLISRKAMDVLLTETDAKGRQIKIHKLPMPGPLYISEDEANGVDVSEGMERVPGERLAGSYANYLISNEHIIYPLLDEKHDKDVAMLLAKLYPNYEVTGVNAREILLGGGNIHCITQQIPKV

SEQ ID NO: 89570 - protein, 289 aa, Populus trichocarpa
MNRRNTENLVENLLGDFEYEVQAPYLLYRNQSQEVNGIWFYNRRECEDVANLFTRILNAYSKVPAKPKVASGKSEYEELEAVPNMSVFEGPLEPSSTASAANDSTEDSSFENFFSTAMNIGSTASSVANSRQPYQPSPTIPLSSHTPSVVMPSPLVPQIPSLPLSSLSTSKTIHGTPDPISSGSHVTNLVKPSFFAPLSSSSVLLPPPISSPLTSAPALQPPLNLQRPYGTPMLQPFPPPTPPPSLTPSSTATTPLISRDKVRDALLMLIQDDQFIDMFHQALLKVHHP

SEQ ID NO: 89571 - protein, 342 aa, Legionella pneumophila subsp. pneumophila str. Philadelphia 1
MTMKSLVKAKKEPGIWMQDIPVPEYGVNDVLIKIKRTAICGTDIHIYSWDEWAQATIPVPMTVGHEFYGEIVEVGKEVQGLKVGQRVSGEGHITCGFCRNCRAGKRHLCRNTLGVGVNRPGCFAEYLALPATNVIALPDNITEEQAAILDPFGNAAHCALAFDVVGEDVLITGAGPIGIMAAAIVRHIGARHVVITDVNDHRLELARQMGVSRAVNVKYQKLSDVANELGMLEGFDVGLEMSGNPMALNDMMKAMNHGGHVALLGIPPQETPIDWNQVIFKGLVIKGIYGREMFETWYKMIAMLQSGLNISPVITHNFPVDEYQHAFQIMASGQSGKVILNW

SEQ ID NO: 89572 - protein, 348 aa, Photobacterium profundum SS9
MKMPSSSATDLNKEGLRHFLKTQDYSKKELNDILELMAMLKQARHDNALPQLFKGKSVAMIFEQPSTRTRVSFETAATMLGGHALFLSPKDIHLGGKESLEDTARVLSRMVDVIMARVDDHSTVAGLAEQATVPVINGLCDWLHPTQIMADLFTMLEHLPEGKTLSDLTVAFVGDATNVASSLMFACTKFGMTFKHICPERFKAPQKWIDIALDNCETSNGKLVITDNTDEVAGCDIIVADSFYWFGQEDEKDIRLSTFIPDYVVTESMMEKAGPDAMFMHCLPANDQRECTREVMESPRSVIFDEAENRLTAQMALLVYFTHNHIKQPSQETLAEHKMKIESFLKAL

SEQ ID NO: 89573 - protein, 235 aa, Helicobacter hepaticus ATCC 51449
MTIIAGNFKANLTRIQVATFAKELDSILTDMQTSSHLQVDIFPSHTALLTNNFKHFHIGAQNAYFAQNGGFTGEIGLSQLQEFNINRLIIGHSERRTLFGENQDFINKKFRFYAEAGFEIYYCIGEPLSMRQKGKNALKDFLGAQLDGIDITYPKLIIAYEPIWAIGTGESATLEQIESTHSMLATFTSAPLLYGGSVNPTNAREILCTPYVNGVLVGSASLNIQSFTDIIRASK

SEQ ID NO: 89574 - protein, 333 aa, Photobacterium profundum SS9
MSFNLRNRNFLKLLDFTGKEIEHLIALAQDLKHAKYAGTEQQKLKGKNIALIFEKTSTRTRCAFEVAAHDQGAHVTYIGGGSQMGHKESTKDTARVLGRFYDGIEYRGFGQDVVETLGEHAGVPVWNGLTDEWHPTQIIADWMTMLEHGNGKRLNQMKLAYMGDAKNNMGNSLMVGAAKVGMEIRLVGPKAYWPDPALVAECNELCKISGGKIVITDNVQEGVDSVDFIYGDVWVSMGEPEELWATRINDLAPYQVNMSVITATQNPAVKYMHCLPAFHNDETRVGKKIEEKFNMKGLEVTEDVFESSYTICFDEAENRMHSIKAIMVATLGD

SEQ ID NO: 89575 - protein, 514 aa, Salmonella typhimurium LT2
MAESQPLSVAPEGAEYLRAVLRAPVYEAAQVTPLQKMEKLSSRLDNVILVKREDRQPVHSFKLRGAYAMMAGLTEEQKAHGVITASAGNHAQGVAFSSARLGVKSLIVMPKATADIKVDAVRGFGGEVLLHGANFDEAKAKAIELAQQQGFTWVPPFDHPMVIAGQGTLALELLQQDSHLDRVFVPVGGGGLAAGVAVLIKQLMPQIKVIAVEAEDSACLKAALEAGHPVDLPRVGLFAEGVAVKRIGDETFRLCQEYLDDIITVDSDAICAAMKDLFEDVRAVAEPSGALALAGMKKYIAQHNIRGERLAHVLSGANVNFHGLRYVSERCELGEQREALLAVTIPEEKGSFLKFCQLLGGRMVTEFNYRFADAKNACIFVGVRVSQGLEERKEIITQLCDGGYSVVDLSDDEMAKLHVRYMVGGRPSKPLQERLYSFEFPESPGALLKFLHTLGTHWNISLFHYRSHGTDYGRVLAAFELGDHEPDFETRLHELGYECHDESNNPAFRFFLAG

SEQ ID NO: 89576 - protein, 285 aa, Streptomyces coelicolor A3(2)
MSGQSLLVPGELSPTRSVPGNIRRPEYVGKPAPTPYTGPEVQTPETVEAMRVAGRIAARAMEEAAKHIAPGVTTDALDRVAHEYMCDHGAYPSTLGYRGYPKSLCSSVNEVICHGIPDSTVLRDGDIVNLDVTAYIGGVHGDNNATYLVGEVDEESRLLVERTRESLTRAIKAVKPGRQINIIGRVIESYAKRFGYGVVRDFTGHGINTSFHSGLIVPHYDSPHATTVIQPGMTFTIEPMLTLGTHEYDMWDDGWTVVTKDRRRTAQFEHTLVVTDSGAEILTLP

SEQ ID NO: 89577 - protein, 347 aa, Arabidopsis thaliana
MVRLDLPWDLVDEILSRLPATSLGRLRFTCKRWNALFKDPEFITKQFHKAAKQDLVLMLSNFGVYSMSTNLKEIPNNIEIAQVFHCNGLLLCSTEEGNKTKLVVVNPCTGQTRWIEPRTDYNYNHDIALGYGNNSTKKSYDSYKILRITYGCKLVEIFELKSNSWRVLSKVHPNVEKHYYGGVSFKGNTYWLSYTKFNILSFDFTTETFRSVPLPFLYQDGFVTLALSVVREEQLLLLRSRFDMGQVGIWMCNKIDTETVLSWSKSFTLEFDSLRDLPVMSILRIFIEEDKKVIVVDCDDRWKENMIYIVGKNGFKKLSYEKDRSNLWRLPFFFSYVPSLVGLYPPM

SEQ ID NO: 89578 - protein, 579 aa, Zea mays
  misc_feature (512)..(512): Xaa can be any naturally occurring amino acid
  misc_feature (568)..(568): Xaa can be any naturally occurring amino acid
MDQYEVLEQIGKGAFGSALLVRHKLERKKYVLKKIRLARQTDRTRRSAHQEMQLIANVRNPFIVEHKDSWVDKGCYVCIVIGYCEGGDMAEAIKRANDTHFSEEKLCQWLVQLLMALDYLHAHHILHRDVKCSNIFLTRDQNIRLGDFGLAKILTADDLAFSIVGTPSYMCPELLADIPYGTKSDIWSLGCCMYEMAALKPAFRAFVSSENAFIDCLSAVCARYLIKWLSTKVTSRYAKPYQQDYQVDSITFANKIFWCIPYVLQLHLKSHLSRSIVPVHQSPSEKRMTFAAEPVCRSKGRRNSLGSERMIAAFSKPSPDRSSVSSIRSVKDDYTATQSVRELSVDESMVEVASKPVASRTSDVMRTPKATPWKMMTTLRNRLEAPQASYDRTSHTHRGFSRTPVDKRNSRVARRASLPLPVFETPKQRSSMSVLERLESPDVSVNSPRIDRIAEFPLASCEDPLFSTVKPPTPASASASATPPFVDRSITKDKCTAQTLRSAAHDGGNGRXSDGGGLSSGRTTATAASSGGTSGSLQPKGRFDTTSYQQRAEALEGLLEFSAQLLQXQERYEELGVLL

SEQ ID NO: 89579 - protein, 327 aa, Halobacterium sp. NRC-1
MKDSILDAIGTPLVRLTAPEGATIAAKLEGFNPAGSAKDRPAREMVLAAERAGEIQPGDQLVEATSGNTGIGLALTAAARGYDLTIVMPASMSTERKQLLRAYGADLELVDAGMETANQVADRVAADTGAFRVGQFENPANPRAHYRTTAEEILDQVEGREIDALVAGVGTGGTITGTATRLREAHPEMSVVAVEPEANAVLSTGESGDDDFQGMGPGFVSDNLDRELIDTVETVAVDAAEAETRRLAREEGVLVGQSSGAAALAATRTAERIADPSLDCPDVSFDADAVGDPDAIADGGDGPDDCPLVVTILPDTGERYLSAGVFD

SEQ ID NO: 89580 - protein, 401 aa, Ustilago maydis 521
MSRVTQSRQQTEANAKILRALVKSADNKVCVDCKKNDPRWASWNLGCFLCIRCSGIHRSMGTHISKVKSIDLDIWTPEQMDSVQKWGNRRCNLYWEAHLKAGHVPADHKIESFIRSKYESRRWAKDGPPPSDPSVLDGGAEAAPSAVAAASTSSLAAARSAASANSASAAKKPVPAIDLLDDPSPSPAPAAPAAPVAPVASTTKQPSAAAATAPTKASVGGGGGIFELDWHEPSASTPATSATTSATTSATTSATTSATTSSSAKDKNDIMSLFAAKPAAASSAPALRVSGNTGFGEFASLASPSIGSAGAGAATGIAGLNSSFGSLDLSSSATRASNSAAFVGTGSNPWSSNTTPSHPPSKNGAGALFDTQDVWGSARTSATLPSKPKDDAFADIWGDFK

SEQ ID NO: 89581 - protein, 228 aa, Nepenthes stenophylla
  misc_feature (4)..(4): Xaa can be any naturally occurring amino acid
  misc_feature (6)..(6): Xaa can be any naturally occurring amino acid
  misc_feature (8)..(8): Xaa can be any naturally occurring amino acid
  misc_feature (14)..(14): Xaa can be any naturally occurring amino acid
  misc_feature (22)..(22): Xaa can be any naturally occurring amino acid
  misc_feature (30)..(33): Xaa can be any naturally occurring amino acid
  misc_feature (42)..(42): Xaa can be any naturally occurring amino acid
  misc_feature (106)..(106): Xaa can be any naturally occurring amino acid
  misc_feature (113)..(113): Xaa can be any naturally occurring amino acid
  misc_feature (131)..(131): Xaa can be any naturally occurring amino acid
  misc_feature (178)..(178): Xaa can be any naturally occurring amino acid
  misc_feature (181)..(181): Xaa can be any naturally occurring amino acid
  misc_feature (187)..(187): Xaa can be any naturally occurring amino acid
  misc_feature (190)..(190): Xaa can be any naturally occurring amino acid
  misc_feature (194)..(194): Xaa can be any naturally occurring amino acid
  misc_feature (196)..(203): Xaa can be any naturally occurring amino acid
  misc_feature (218)..(218): Xaa can be any naturally occurring amino acid
  misc_feature (220)..(220): Xaa can be any naturally occurring amino acid
  misc_feature (224)..(224): Xaa can be any naturally occurring amino acid
NVGXAXGXGIPAIXMGIAIASXFSGTALYXXXXPGGSPLTRXCQVLVASFRKSKLALPEDSNLLYETSDENSVIEGSRKLEHTNELKCLDKAGVVSDKEIKREDFXNPWRLCXVTQIEELKILIRMFPIWXTGIVFSAIYAQMSTMFVEQGEVMDRTIGSFTIPADSLSMFDTISVIXWVXVYDKIXVPXARKXTXXXXXXXXLQRMGIGLFISILSXAXAALXEMKR

SEQ ID NO: 89582 - protein, 541 aa, Desulfitobacterium hafniense DCB-2
MASTDLSFKIAAAEEEFEQIHRLNYKTFVKEIPQHEVNSQERLVDPFHQENTYCIALHRGKLMGMLACRDKRPFSIDRKLADLDSYLPPYSSICEIRLLAVEKEVRGTRVLLGLMSLLFEHCQKKGYDLAVISGTVRQLKLYNHLGFKPFGPLVGTAAASYQPMYMTREQMSQKLIELFKAFQSKDGRRDSVNFLPGPVKLRREVQEALGRPPRSHRSEEFLAVMARIKEQLAQWLKVHYVQILLGSGTLANDVVGAYLRTALGQKKGLVLSNGEFGNRLLDQARRAGLNFEDYSIPWGKGFDYEDIEKHLSKGEGSIQWLWAVHLETSTGVLNDLPRLKALCHRQRIPLAVDCVSSIGAVPVDLSGVYLATGVSGKALCSYPGLSFVFYNQALEGGRLPRYMDLGLYQQSEGVPFTQSSNLIYALEQALHYAAERELCINQRQGEWLRAKLQELGFQVLALPEDAAPNILTLVLPREVPSLECGELLEEEGYVLSYRSAYLFQRNWVQICLMGEYEPEQIYAFPEMLAECMKKCGLRKGK

SEQ ID NO: 89583 - protein, 360 aa, Lactobacillus plantarum WCFS1
MADRYLILEDGSAYLGEGFGSPAVSTGEIVVNTSMTGYQEIITNQIYHNQIVAFTQPTIGSYGINHDSYESILPTVKGVVVRDVASISTNRQRRWSLDQYLKQQNIPGISHIDTRHLAKQLRASGPMKASIVDVADAHAFDQLGATVLTNQQVAAVATPKPFPNPGTGLNVVVIDFGLKHGILRELSKRACNVTVLPYTATTEEILNLDPDGVILSTGPGKPQDLPVSVTEMIKNIQNRVPLFAIGLGHELFAMANGAQIMKLSPEHHGANHPIREVITNQIIYAAQGQGFAVDADTVDRNKLITTFVDLIDGTIQGLRLRDFPAFSVQFFPDGAPGPTETRDIFDEFVESMQQARGPIW

SEQ ID NO: 89584 - protein, 235 aa, Nepenthes thorelii
  misc_feature (7)..(7): Xaa can be any naturally occurring amino acid
  misc_feature (39)..(39): Xaa can be any naturally occurring amino acid
LIVWVQXNLGWALGFGIPAISMGIAIASFFSGTALYRLXKPGGSPLTRMCQVLVASFRKSKLALPEDSNLLYETSDENSVIEGSRKLEHTNELKCLDKAAVVSDKEIKFEDFSNPWRLCTVTQIEELKILIRMFPIWATGIVFSAIYAQMSTMFVEQGEVMDRTIGSFTIPAASLSMFDTISVIFWVPVYDKILVPLARKFTGKQRGFSELQRMGIGLFISILSMAAAALVEMKR

SEQ ID NO: 89585 - protein, 234 aa, Nepenthes tobaica
  misc_feature (1)..(3): Xaa can be any naturally occurring amino acid
  misc_feature (16)..(16): Xaa can be any naturally occurring amino acid
  misc_feature (19)..(19): Xaa can be any naturally occurring amino acid
  misc_feature (25)..(27): Xaa can be any naturally occurring amino acid
  misc_feature (37)..(38): Xaa can be any naturally occurring amino acid
  misc_feature (53)..(53): Xaa can be any naturally occurring amino acid
  misc_feature (58)..(58): Xaa can be any naturally occurring amino acid
  misc_feature (65)..(66): Xaa can be any naturally occurring amino acid
  misc_feature (68)..(69): Xaa can be any naturally occurring amino acid
  misc_feature (76)..(77): Xaa can be any naturally occurring amino acid
  misc_feature (84)..(84): Xaa can be any naturally occurring amino acid
  misc_feature (135)..(135): Xaa can be any naturally occurring amino acid
  misc_feature (137)..(137): Xaa can be any naturally occurring amino acid
  misc_feature (193)..(193): Xaa can be any naturally occurring amino acid
  misc_feature (198)..(198): Xaa can be any naturally occurring amino acid
  misc_feature (201)..(201): Xaa can be any naturally occurring amino acid
  misc_feature (203)..(203): Xaa can be any naturally occurring amino acid
  misc_feature (207)..(207): Xaa can be any naturally occurring amino acid
  misc_feature (218)..(218): Xaa can be any naturally occurring amino acid
  misc_feature (220)..(220): Xaa can be any naturally occurring amino acid
  misc_feature (224)..(225): Xaa can be any naturally occurring amino acid
  misc_feature (233)..(233): Xaa can be any naturally occurring amino acid
XXXVQENLGWALGFGXPAXSMGIAXXXFFSGTALYTXXKPGGSPLTRMCQVLXASFRXSKLALPXXRXXLYETSDXXSVIEGSXKLEHTNELKCLDKAAVVSDKEIKCEDFSNPWRLCTVTQIEELKILIRMFPXWXTGIVFSAIYAQMSTMFVEQGEVMDRTIGSFTIPAGSLSMFDTISVIFWVPVYDKIXVPLAXKFXGXQRGXSELQRMGIGLXIXILSXXAAALVEMXR

SEQ ID NO: 89586 - protein, 235 aa, Nepenthes densiflora
  misc_feature (55)..(55): Xaa can be any naturally occurring amino acid
  misc_feature (138)..(138): Xaa can be any naturally occurring amino acid
  misc_feature (185)..(185): Xaa can be any naturally occurring amino acid
  misc_feature (220)..(220): Xaa can be any naturally occurring amino acid
LIVWVQENLGWALGFGIPAISMGIAIASFFSGTALYRLQKPGGSPLTRMCQVLVXSFRKSKLALPEDSNLLYETSDENSVIEGSRKLEHTNELKCLDKAAVVSDKEIKYEDFSNPWRLCTVTQIEELKILIRMFPIWXTGIVFSAIYAQMSTMFVEQGEVMDRTIGSFTIPAASLSMFDTISVIXWVPVYDKILVPLARKFTGKQRGFSELQRMGIGLFXSILSMAAAALVEMKR

SEQ ID NO: 89587 - protein, 508 aa, Burkholderia sp. 383
MNAAVPQTTLALPTAKLLIDGAFVESQSTEWGDIVNPATQEVIGRVPFATLDEVDAAIASAQRAFQTWKTTPIGARLRIMLKFQDLVRRNLERIAHTLTAEQGKTLPDAQGDIFRGLEVVEHACSIGTLQQGEFAENVAGGVDTYTLRQPIGVCAGITPFNFPGMIPLWMFPMAIVCGNTFVLKPSEQDPLSTMQLVELAIEAGVPQGVLNVVHGGKTVVDRLCTHPDIKAISFVGSTRVGTHVYNLGSQHGKRVQSMMGAKNHAVVLPDAHREQSINALVGAGFGAAGQRCMATSVVVLVGKARDWLPELVEKAKALKVNAGAEAGTDVGPVVSKAAKERILSLIDQGVKEGATLLLDGRDVKVPGYEQGNFVGPTIFSGVTTDMSIYTEEIFGPVVVVLEADTLDEAIALVNRNPMGNGVGLFTQSGAAARKFQSEIDIGQVGINIPIPVPVPYFSFTGSRGSKLGDLGPYGKQVVQFYTQTKTVTARWFDDDATAGGVNTTIALR

SEQ ID NO: 89588 - protein, 235 aa, Nepenthes diatas
  misc_feature (7)..(7): Xaa can be any naturally occurring amino acid
  misc_feature (39)..(39): Xaa can be any naturally occurring amino acid
  misc_feature (55)..(55): Xaa can be any naturally occurring amino acid
  misc_feature (136)..(136): Xaa can be any naturally occurring amino acid
  misc_feature (138)..(138): Xaa can be any naturally occurring amino acid
  misc_feature (220)..(221): Xaa can be any naturally occurring amino acid
LIVWVQXNIGWALGFGIPAISMGIAIASFFSGTALYRLXKPGGSPLTRMCQVLVXSFRKSKLALPEDSNLLYETSDGNSVIEGSRKLEHTNELKCLDKAAVVSDKEIKCEDFSNPWRLCTVTQIEELKILIRMFPXWXTGMVFSAIYAQMSTMFVEQGEVMDRTIGSFTIPAASLSMFDTISVIFWVPVYDKILVPLARKFTGKQRGFSELQRMGIGLFXXILSMAAAALVEMKR

SEQ ID NO: 89589 - protein, 82 aa, Brassica napus
  misc_feature (19)..(19): Xaa can be any naturally occurring amino acid
MTMAVPKEGFVAMVKDSVXSAPSESPLPLQPQFPDFTIPVKDFFKSREAREFLSGALAGAMTKAVLAPLETIRTRMIVGVGS

SEQ ID NO: 89590 - protein, 551 aa, Oryza sativa
MEKAAGFLSSLLGGGEEVPPEPAATVRSILIYPIKSCRGISVPQAPITSTGFRWDRQWVVVNSKGRAYTQRVEPKLALVEVEMPPEAFAEEWRPTADSYLVGRAPGMDPLKIPLSAEQAIINDVSVWEWSGSAYDEGAEAAEWFSSYFGNPSRLVRFKEGSEIRPTNPDYAQGYKIMFTDCFPFLMASQGSLDALNEVLKEPVPMNRFRPNILVDGCHPYSEDLWKTIKINKLTFQGVKLCNRCKVPTINQENGILGTEPTETLLTFRSDEVLRPSHKNKRQVYFGQNLVCKESLSAKGKGRIIKNAEFLGIIVNFMLQQGLRKCGSGEAPPEPEPAAAATVKSIVVYPIKSCRGISVPQAAITSTGRAFTQRVEPKLALIEVEMPQEAFTEWQPTPDSHMVIRAPGLDPLKIPLGAKRATVDDVSIWEWSGSAQTNPDYAQASEIRETNPDYAQGYKVLFADDFPFLLASQVPTINQDNGIPGEEPTEALQALRSDEVLRPSHKNKRRVYFGQNLVCKESLSAKDEGRIIKVGDPVYVLESFPSSDEVPA

SEQ ID NO: 89591 - protein, 488 aa, Bacillus cereus ATCC 10987
MTKNNEAGWNLDNSYATLPHSFYTEIPPTPVSSPELVKLNHSLAISLGFNPEELKKETEIAIFAGNALPEGAHPLAQAYAGHQFGHFNMLGDGRALLIGEQITPSGKRFDIQLKGSGPTPYSRRGDGRAALGPMLREYIISEAMYALDIPTTRSLAVVTTGEPTYRETKLPGAILTRVASSHIRVGTFQYAAARGSIEDLQSLADYTIKRHYPEIEDPENRYTALLQEVIKKQASLIAKWQLVGFIHGVMNTDNITISGETIDYGPCAFMDHYDQGTVFSSIDTQGRYAYGNQPYMAAWDLARLAESLIPILHEDEEEALKIAQDEISKFSVQYENLWFLGMKKKLGLFSNEEQDHSLIEQLLKMMEKYKADYTNTFRSLTLNTLENTPLFDSSEFKEWYKLWQSRLERQDESKENAYEMMKNNNPSIIPRNHRVEEALEAAVTNGDYSVMEKLLEALANPYAYATDQEEYCVTPAPTNRPYRTFCGT

SEQ ID NO: 89592 - protein, 88 aa, Actinidia deliciosa
VLDRDTLKTLVRFTNDKNIHLVCDEIYAATVFNQPGFISIAEIIEEELYCNRDLIHIVYSLSKDLGFPGFRVGIVYSYNDQVTSCARK

SEQ ID NO: 89593 - protein, 320 aa, Oryza sativa Japonica Group
MAASASAPPHSLLLAAVALAALASVAAARDENGVYDPCSDTRIQRGDGFSFGIAFATLGAFYSGGSVQLSPCDRRLSLASSGQLAVFRPKVDEISLLTINTTTGFNPNSHFSVTYCHVGPFLHPDIPVEGIGPGFLRANSLHSDIEALFCGYWLCKYATYEYFGDFVILYCGEGSLLVFLSPATAGGYMVAFAGRKYAARSVPTFVSNSSYTVSSFTLVLEFNKGRLQNLHWKKDGCGACAKSSSLVCIGKQTCAFRTQSCKSQGPVDCSIGIQLAFSGTDKHESVLNSWYEVSNLRQYSLYGLYSNLKDTLSGQFNKFF

SEQ ID NO: 89594 - protein, 222 aa, Helicobacter hepaticus ATCC 51449
MVQVIESRFMSSASHLDNAPPPNASEIVFLGRSNVGKSTLINTLLNKPLAKSSSTPGKTQLINFFASVWVWHNQRLPLTFIDLPGFGYAKVSKTIKKEWERHLLNFLFMRQSIKLFLHLVDARHTDLAIDTSVATMLEQICRGDQCILRIYTKADKLNQSALNALYKRVYIQKNKVQGVDTDDTHTQSLLFSAISKNHRKMVSLTHLREEIVKYTLGLENGI

SEQ ID NO: 89595 - protein, 515 aa, Yarrowia lipolytica
MIYTANSSPSTNLQWLSTLNTDDIPTKNYRKSSIIGTIGPNTNSAEMISKLRQAGLNIVRMNFSHGSYEYHQSVIENARESEQQFQGRPLAIALDTKGPEIRTGVTKDDKDWDVKAGHVMLFSTNPKYKDQCDDKIMYIDYTNIVKQIDIGKIIFVDDGVLSFKVLEKIDGETLKVETLNNGKISSRKGVNLPGTDVDLPALSEKDKADLKFGVEHGVDMIFASFVRTANDVQAIRDVLGEKGKGIQVISKIENQQGVNNFDEILKETDGVMVARGDLGIEIPAPQVFIAQKQLIAKCNLAGKPVICATQMLDSMTYNPRPTRAEVSDVGNAVLDGADCVMLSGETAKGTYPIESVKMMHETCLVAEKAIAYAPLFNEMRTLTVRPTETVETIAISAVSASFEQQARAIIVLSTSGTSARLCSKYRPNCPILMVTRNAQAARFSHLYRGVYPFIYHKARASNPAEWQHDVEERLKWGMDEAVALGILNKGDVVVAIQGWTGGLGHTNTLRVLECV

SEQ ID NO: 89596 - protein, 630 aa, Pseudomonas syringae pv. phaseolicola 1448A
MPTTFKEIPRERPVTPLLDRADTPHGLRRLGEAELETLADELRLELLYSVGQTGGHFGAGLGVIELTIALHYVFDTPDDRLVWDVGHQAYPHKILTGRRARMSTLRQKDGVAAFPRRSESEYDTFGVGHSSTSISAALGMAIASRLQGSERKSIAVIGDGALTAGMAFEALNHAPEVAANMLVILNDNDMSISRNVGGLSNYLAKILSSRTYSSMREGSKKVLSRLPGAWEIARRTEEYAKGMLVPGTLFEELGWNYIGPIDGHDLPTLIATLRNMRDLKGPQFLHVVTKKGKGFAPAEVDPIGYHAITKLEPLNAPAAPKKISAPKYSAVFGQWICDMAEADSRLVGITPAMKEGSDLVAFSERFPERYFDVAIAEQHAVTLAAGMACEGSKPVVAIYSTFLQRGYDQLVHDVAVQNLDVLFAIDRAGLVGEDGPTHAGSFDLSYLRCIPGMVVMTPSDENELRKLLNTGYLHTGPAAVRYPRGTGPDALIETGLDPVEIGKGVVRRQGQGVAILVFGVQLADALVVAEKLDATVIDMRFVKPLDEALVSEAAANHELLVTLEENAVMGGAGAAVSEFLARANILKSVLHLGLPDTYVEHAKPAQMLAECGLDAQGIEAAINERLALIG

SEQ ID NO: 89597 - protein, 472 aa, Mycobacterium avium subsp. paratuberculosis K-10
MSRRGKIVCTLGPATNSDELILALVEAGMDVARLNFSHGDYADHKAAYERVRVASDATGRAVGVLADLQGPKIRLGRFATGPTYWADGETVRITVADCEGSHDRVSTTYKQLAQDAAVGDRVLVDDGKVGLVVDGIEGDDVICTVVEGGPVSNNKGISLPGMNVSAPALSDKDIEDLTFALELGVDLVALSFVRSPSDVELVHEVMDRVGRRVPVIAKLEKPEAVDNLEAIVLAFDAIMVARGDLGVELPLEEVPLVQKRAIQMARENAKPVIVATQMLDSMIENSRPTRAEASDVANAVLDGADAVMLSGETSVGKYPLAAVRTMARIICAVEDNSTAAPPLTHVPRTKRGVISYAARDIGERLDAKALVAFTQSGDTVKRLARLHTPLPLLAFTAWPEVRSQLAMTWGTETFIVPMMTSTDGMIRQVDKSLLELGRYRRGDLVVIVAGAPPGTVGSTNLIHVHRIGEDDV

SEQ ID NO: 89598 - protein, 446 aa, Physcomitrella patens subsp. patens
SEDEGSGEYRRGGYHAVRIGDWFHNGRYVVHRKLGWGHFSTVWLAWDTHGKKYVALKVQKSAQHYTEAAQDEITILKQIAEGDPGDCRGVVKLLDHFKHTGPNGTHVCMVFEYLGDNLLTLIKAYNYRGLPLHMVKQLAREILIGLDYLHRQLSIIHTDLKPENVLLFSPLDPTKDPRNSDYVPPVFPSPGEKPQTPSRVDKAPPPSLSKNQKKKAKRNAKKASGNGNDRERENADMDSRDGSGDVCDEQSNAKEEDPPSVSDAPKSGRISSLSEDLSRLDLRCKIVDLGNACWTYKQFTADIQTRQYRCPEVLLGSKYSTPADIWSFACIVFELATGDVLFDPRSGDDFDRDEDHLALMMELLGRMPRKVALSGRHSRDYFNRHGDLRHIRRLQYWPLDNVLIEKYDFSEQDAQEFADFLVPLLDFNPDKRPTAGPCLQHSWLGS

SEQ ID NO: 89599 - protein, 514 aa, Rickettsia sibirica 246
MNQSNIISPELLDERRNIARQGGGEARINAQHQKGKLTARERIEVLLDPNSFTETGMFVSHRCDNFGMQDKKFLGDGVVTGHGTINGRLVFIYSQDFTVLGGSLGEYHAKKICDIIDQAIETGAPVIGINDSGGARIQEGVDALAGYGELFQRNVLASGVIPQITLIMGPCAGGAVYSPALTDFIFMVKNSSYMFVTGPDVVKTVTGEEVSQEKLGGARMHTTKSGVADLAFNNDIEALLEIRKFFNFLPSSNRSPLPVRSTVDPADRVDMSLSTLIPNTPNKPYDMKELVERIVDEGEFFELQPDFAKNIIIGFGYMEGYPVGFVANQPLHLAGCLDINASRKAARFVRFCDAFNIPIVSLVDVPGFLPGTSQEHDGIIKHGAKLLYAYAEATVPKITVITRKAYGGAYIVMNSKHLRGDINYAWFNSEIAVMGAEGAAEIIFKEECKNPEAKKQKIDEYRKVVTSPFVAASRGYLDDIIRPQNTRWRICKALNFLRTKKVELPWKKHDNLPL

SEQ ID NO: 89600 - protein, 420 aa, Salmonella typhimurium LT2
MSFTTISVIGLGYIGLPTAAAFASRQKQVIGVDINQHAVDIINRGEIHIVEPALGNVVKMAVEGGFLRATTTPVEADAYLIAVPTPFKGDHDPDMAYVEAAAKSIAPVLKKGALVILESTSPVGATEQMAGWLAGMRTDLTFPQQAGEQADVNIAYCPERVLPGQVMVELIKNDRVIGGMTPVCSARASALYKIFLEGECVVTNSRTAEMCKLTENSFRDVNIAFANELSLICAEQGINVWELIRLANRHPRVNILQPGPGVGGHCIAVDPWFIVAQNPQQARLIRTAREVNDGKPHWVVDQVKAAVTDCLAATDKRASEVKIACFGLAFKPNIDDLRESPAMGIAQSIARWHSGETLVVEPNIRQLPKKLDGLCTLAKLDAALAAADVLVMLVDHDEFKAIPGDAVHQRYVVDTKGVWR

SEQ ID NO: 89601 - protein, 522 aa, Oryza sativa Japonica Group
MAPPRAQRTMLVVAGDAPPTAGGGARFAAPPPERDHTQDLPDEILSLVFASLTPTDRNACSLTCARWKEVDASTRHRLSLDARAALGYAAQGIFARFTAVSKLALRCARGSGTDSLSDDGARQVAAALPSARLARLKLRGLRQLSDDGLASLAGATPVIRKLSVASCSFGPKAFVAVLRSCPLLEDLSVKRLRGLPDTAGATTAITEEILFPPASSLRSVCLKDLYSALCFVPLVASSPNLRSLKILRCSGSWDLPLEVIAARVPGLVELHLEKLQVGDRGLSAVSACANLEVLFLVKTPECTDAGIISVAEKCHKLRKLHIDGWRTNRIGDHGLMAVARGCPDLQELVLIGVNPTVQSLRMLGEHCRSLERLALCGCETVGDPEIICLAERCAALKKLCIKGCPVSDRGMWALNGGCPSLVKVKLKRCRGVSYECIENLKVVRGGSFSISLDIVLERDAGGAIENGGQEAGQVQITELTDQMAAMDLPTNASNAQSSAQASSRMRSVMSALRRRFGNPPAL

SEQ ID NO: 89602 - protein, 327 aa, Pseudomonas syringae pv. phaseolicola 1448A
MKITSLKNRNLLTMNEFNQSELSHLIDRAIECKRLKKDRIFNLGLNHLNICGIFLKPSGRTSTSFVVASYDEGAHFQFFPADNIRFGHKESIKDFARVVGRLFDGIAFRGFEHEVAEELAKHSGIPVWNALTDTHHPTQVLADVMTVKEEFGRIEGVTIAYVGDGRNNMVTSLAIGALKFGYNLRIIAPNALHPTDAVLAGIYEQTPERNGSIEIFTEVAAGVHQADVIYTDVWISMGESVSVEERIALLKPYKVTEKMMALTGKADTIFMHCLPAFHDLDTEVARETPDLVEVEDSVFEGPQSRVFDQGENRMHTIKALMLETVVP

SEQ ID NO: 89603 - protein, 290 aa, Erythrobacter sp. NAP1
MRFAGKTVIITGAASGIGLATTQLFAREGATVFASDIDSVGGEKLAAESEGDVRFVHSDVTDPASIKALMDKAASETGGIDTVFNNAAAGGARPGIDEIEPEEWDMTMDLVLRSVAFGIRYAVPHMKGRKGASIVNVSSVAAVGPGYSPTAYAVAKAGVLHLTKCAAADLAQHDIRVNAIQPGFINTNIFTSTLEIPDEMKTMANAAIAQLSSNAQPVKRGGQPNDIAEAVAYLASEAASFVTGTSLIVDGGITIGPRHCWDPEEETLFAGLEAMEEQAKAAAAADAAGQ

SEQ ID NO: 89604 - protein, 362 aa, Erythrobacter sp. NAP1
MAKAAILEQPGEGLVIGEVEYSDPAPHEVLIDTKACGLCHSDLHFIDGAYPHALPCVPGHEAAGVVRAVGSEVRTVKPGDHVVSCLSAFCGTCEFCVTGRMALCLGGATRRAKGDAPRMTRADGSPVAQMLNLSALSEQMLIHENACVAIDKDMPLDRAAVIGCAVTTGAGTIFNACKVTPGETVLVVGCGGVGLATINAAKIAGAGKVIAADPLPEKRELAKVLGATHTVDALADDAAKQILEISGGGVHWGIEAVGRQASADLAVASLRRGGTAVILGMMPLDCKVGLGAMDLLGGKKLMGAIMGMNHFPVDLPRLVDFYMRGLLDLDTIIAERIGLEDVNAGFDKMREGSHARSVVMFD

SEQ ID NO: 89605 - protein, 124 aa, Arabidopsis thaliana
MAEVKDQLEIKFRLNDGSDIGPKLFPDATTVATLKETVVAQWPRDKENGPKTVKDVKLISAGRILENNKTVGDCRSPVGNFSGAVTTMHVIIQHQVTEKEKKKKKPKGDLKQNKCVCLCFGARC

SEQ ID NO: 89606 - protein, 564 aa, Polytomella parva
PVKAFNGVKPTICGQPRLVQTALPKVVPQPAVQENVRPVVASASSDASKPAEKKHFLGVAPLTWAKVIPLSLMFFCILFNYTVLRSCKDVLIITAPGSGAEVIPFLKVLNLPVAVGFTLYYSALAGRLSREQLFYAVLLPFIVFFGLFALVVYPNKESLQPNAVCDLLASKLPEGFAGPIALLRNWAYVCFFMMAEIWGSVVISLLFWGTANQIMTVEEAGQFYPFFGMGANVSLVIAGRAIQYFSVVKDNLPAGVDGWGVALNGLMSMVVFSGACICGLYWALQTFVVPRMTPISADQMAGSKKKKKNKQKMSIGDSLKFLASSPYILDMATMVISFGICINLVEVTWKAKLKAQYPNPAEFSAFMGAFSEATGVFTLGMMMVGRIVLGKFGWGVTALATPTVLLVTAILFFALVLAGDVLKGPLAPFGITPLYAAVLVGALQNIFSRSSKYSLFDPCKEMAYIPLDPVMQAQGKAAIDVMGNLIGKSGGAAVQQTLIVLCGSLNNSTPYIGVLLTGIILAWMRSCVSLNTQFQAKYKEYKERAAAAQAAADAAKKDGPEKSA

SEQ ID NO: 89607 - protein, 235 aa, Nepenthes ephippiata
  misc_feature (7)..(7): Xaa can be any naturally occurring amino acid
  misc_feature (39)..(39): Xaa can be any naturally occurring amino acid
LIVWVQXNVGWALGFGIPAISMGIAIASFFSGTALYRLXKPGGSPLTRMCQVLVASFRKSKLALPEDSNLLYETSDENSVIEGSRKLEHTNELKCLDKAAVVSDKEIKREDFSNPWRLCTVTQIEELKILIRMFPIWATGIVFSAIYAQMSTMFVEQGEVMDRTIGSFTIPAASLSMFDTISVIFWVPVYDKILVPLARKFTGKQRGFSELQRMGIGLFISILSMAAAALVEMKR

SEQ ID NO: 89608 - protein, 374 aa, Erythrobacter sp. SD-21
MSATEIDFYEVLGVSRDADGAAIKSAYRKLAMKHHPDKNPGCTESENTFKAISVAYDCLKDPQKRAAYDRYGHAAFQNGGGPGGAHGNADFGDIGDIFETIFGSAFGGGGGRARPRRGADLRYDMEIGLEDAFHGKSTEIEIEVSKACDTCHGSGAQPGTHARTCNLCGGQGNVRAKQGFFVVERPCPNCHGAGEVITSPCRDCRGEGRVDVPQKLEVDIPPGVDTGTRIRLSGKGEAGPRGAPAGDLYIFVHVRPHEIFQREGTTLATRVPISFTKAALGGSIEIPGLDGEELTLEIPAGIQSGKQLRQRGAGMPVLQGRGRGDMVVEIAVETPTKLSKEQRALLEQFRELETGDECPQSKGFFDKIRTAFGS

SEQ ID NO: 89609 - protein, 759 aa, Coxiella burnetii RSA 493
MNMLKILRQITQEVNAAPNLEQALKLVVVRLCEALPADACSLFICDDVHGEYVLMATQGLNSKQVGKLRLKFGEGLIGLVGEREEPINLADAPLHPAYKHRPELGEEDYHGFLGIPIIEQGELLGILVIQQLESHHFAEEEEAFCVTLAIHLAAEIAHARAKGALEKLGARKRRRRKTETVLYGVPGSSGVAIGTAMIVYPPADLDAVPDQEITDIEAEVSDFEAALAAARDEIQTLQARAKNSLSVAENALFDAYLRLLDSRTFINEVIHEIKEGQWAQGALKRIIKKHVLHFESLEDPYLRERAADFRDLGRRILAHLQFSEQEELEYPKNTILVSEEVTATSLIEVPQDRLRGVISGTGSSNSHVAILARALGLPAVMGVRGTPLFKLGEQEIIVDGYNGQIYLSPSAEIKKEFKALAEEEQQLDEELQALRELPAETKDGHALALYVNTGLAIEGGLSLSVGAEGVGLYRTEMPFMIRDRFPSEEEQRIMYRQLLNTFAPRPVIMRTLDIGGDKTLPYFSVEEDNPFLGWRGIRVTLDHPEIFLQQVRAMLHASEGLNNLSVLLPMITSINEVETATRMINQARDELIEEGINVELPSVGLMIEVPATVYQAFELAKRVDFLSVGSNDLIQYLLAVDRNNPRVANLYDGLHPAVLQALKIVVKAGHRAGKPVSICGEMAGDPLAVILLLAMGFDTLSMNARILPRVKWVIRNFEMAHAKELLDEALKMDDPKDIRLLMEHTLEEAGLGGLIRAGR

SEQ ID NO: 89610 - protein, 438 aa, Vitis vinifera
MAPVSRIGLSGLAVMGQNLALNIAEKGFPISVYNRTTSKVDETVERAKQEGNLPLYGFHDPESFVNSIQKPRVIIMLVKAGAPFPGGEEGARHGPSLMPGGSFEAYKYIEDILLKVAAQVPDSGPCVTYIGKGGSGNFVKMVHNGIEYGDMQLIAEAYDVLKSVGKLSNEELRNVFSEWNKGELLSFLIEITADIFSIKDDKGDGFLVDKVLDKTGMKGTGKWTVQQAADLSVAAPTIASSLDARFLSGLKEERVEAAKVFKSSGFENVLSDQTVDKKKLIDDVRQALYASKICSYAQGMNLIRAKSIEKGWDLKLGELARIWKGGCIIRAIFLDRIKKAYDRNADLANLLVDPEFAKEIVERQSAWRRVVCLAINSGISTPGMSSSLAYFDSYRRDRLPANLVQAQRDYFGAHTYERIDTTGSFHTEWFKIAQQSKI

SEQ ID NO: 89611 - protein, 235 aa, Nepenthes eustachya
  misc_feature (6)..(7): Xaa can be any naturally occurring amino acid
  misc_feature (13)..(13): Xaa can be any naturally occurring amino acid
  misc_feature (15)..(15): Xaa can be any naturally occurring amino acid
  misc_feature (17)..(17): Xaa can be any naturally occurring amino acid
  misc_feature (24)..(24): Xaa can be any naturally occurring amino acid
  misc_feature (34)..(34): Xaa can be any naturally occurring amino acid
  misc_feature (38)..(38): Xaa can be any naturally occurring amino acid
  misc_feature (66)..(66): Xaa can be any naturally occurring amino acid
  misc_feature (185)..(185): Xaa can be any naturally occurring amino acid
  misc_feature (230)..(230): Xaa can be any naturally occurring amino acid
LIVWVXXNLGWAXGXGXPAISMGXAIASFFSGTXLYRXQKPGGSPLTRMCQVLVASFRKSKLALPXDSNLLYETSDGNSVIEGSRKLEHTNELKCLDKAAVVSDKEIKCEDFSNPWRLCTVTQIEELKILIRMFPIWATGIVFSAIYAQMSTMFVEQGEVMDRTIGSFTIPAASLSMFDTISVIXWVPVYDKILVPLARKFTGKQRGFSELQRMGIGLFISILSMAAAAXVEMKR

SEQ ID NO: 89612 - protein, 396 aa, Zea mays
  misc_feature (42)..(42): Xaa can be any naturally occurring amino acid
TPPRDRCATGNALKFCLLPTKILWGRTTAEPTPERPPTVSMXVVRASAYADELVKTAKTIASPGRGILAMDESNATCGKRLASIGLENTEANRQAYRTLLVTAPGLGQYISGAILFEETLYQSAVDGRKIVDILVEQGIVPGIKVDKGLVPLAGSNNESWCQGLDGLASREAAYYQQGARFAKWRTVVSIPNGPSELAVKEAAWGLARYAAISQDNGLVPIVEPEILLDGEHGIERTFEVAQKVWAETFYAMAENNVMFEGILLKPSMVTPGAEAKDRATPEQVAAYTLKLLHRRIPPSVPGIMFLSGGQSEVEATQNLNAMNQGPNPWHVSFSYARALQNTCLKTWGGQPDKVKAAQDALLLRAKANSLAQLGKYTSDGEAAEAKEGMFVKNYSY

SEQ ID NO: 89613 - protein, 101 aa, Brassica napus
  misc_feature (82)..(82): Xaa can be any naturally occurring amino acid
MAANFWASSHSKQLLDPEDVDVVPAADRERGITTEEFRLVKIHMSSHIWRLAQQVKVRQRVIATAITYFRRVYTRKSMSEYXPRLVAPACLYLASKVEEST

SEQ ID NO: 89614 - protein, 214 aa, Nepenthes faizaliana
LGFGIPAISMGIAIASFFSGTALYRLQKPGGSPLTRMCQVLVASFRKSKLALPEDSNLLYETSDENSVIEGSRKLEHTNELKCLDKAAVVSDKEIKREDFSNPWRLCTVTQIEELKILIRMFPIWATGIVFSAIYAQMSTMFVEQGEVMDRTIGSFTIPAASLSMFDTISVIFWVPVYDKILVPLARKFTGKQRGFSELQRMGIGLFIAILSMA

SEQ ID NO: 89615 - protein, 235 aa, Nepenthes fusca
  misc_feature (7)..(7): Xaa can be any naturally occurring amino acid
  misc_feature (39)..(39): Xaa can be any naturally occurring amino acid
  misc_feature (77)..(77): Xaa can be any naturally occurring amino acid
  misc_feature (185)..(185): Xaa can be any naturally occurring amino acid
LIVWVQXNVGWALGFGIPAISMGIAIASFFSGTALYRLXKPGGSPLTRMCQVLVASFRKSKLALPEDSNLLYETSDXNSVIEGSRKLEHTNELKCLDKAAVVSDKEIKREDFSNPWRLCTVTQIEELKILIRMFPIWATGIVFSAIYAQMSTMFVEQGEVMDRTIGSFTIPAASLSMFDTISVIXWVPVYDKILVPLARKFTGKQRGFSELQRMGIGLFISILSMAAAALVEMKR

SEQ ID NO: 89616 - protein, 456 aa, Xanthomonas campestris pv. vesicatoria str. 85-10
MSARYDYDVVILGGGSGGLAAGFRAAKHGARVAIMEPDELGGTCVNLGCVPKKAMWLAADLAGKIELASVLGFDVPRPTLAWQELVTHRQGYISNIHASYRRRLNEDGVVLIPQRGVLQDRHTVMGSDGVPVTAEHIVIATGAHPLRPDVEGAEHGEVSDDFFNLCHAPEQVAIVGGGYIAVEIAGLLQALGSRVHLFVQDERLLERFDAELTLQLADNLRHLGVRLHFGFTTTALERDLHGALRVHGHCVHPREQGNDVFDKVFFAVGRRANTAGLGLDTVGVALGDKGEVVVDDGQTTNVPNIHAIGDVGGKVGLTPVAIAAGRKLMDRLFGHQPDARMDYENVPSVVFSHPPLGNVGLTEEQARARYNGAVRVYRSNFRPMLHALADAPQRSLFKLVCVGEEERVVGVHLLGESADEMLQGFAVAVKMGATKRDFEETVAIHPTSSEEIVLMH

SEQ ID NO: 89617 - protein, 322 aa, Bacillus cereus ATCC 10987
MKVLEAISNIAGKYFAFWVICIAAIAYFIPAPFLGLTSYITILLGVVMFGMGLTLKAVDFKIIATKPLPVIIGVCAQFIIMPLVAYVLAYVMNLPAELAAGLVLLGSVPGGTASNVMVYLAKGNLALSIAMTSLSTLLAPIATPLILLLLAGQWMPVNPMSMFLSIVQVIIIPIILGLVVKKFFPKTVKKGMTVIPFISVLAIIIIVSAVVSANVSSITSSGLLIFIAVMLHNAFGFLLGYITAFILRLDEGTRRAISIEVGMQNSGLGVALATAHFGPAAALPSVLAAVWHNIAGPILATIWSKNAKDTFSDETLSVNIEK

SEQ ID NO: 89618 - protein, 525 aa, Oryza sativa Japonica Group
MDTSTLLIALTLVLLLLLLTARRRRSGRLRLRLPPEPPGLPLVGHLHLFRKPLHRTLARLAARHGAVFRLRLGSRRVAVVVSSAPAAEECLGAHDVAFAGRPRLPSAGILSYGWSTMGTAAYGPYWRHVRRVAVAEILSAHRVRQFAGAHAREARATARRLCRAASRQRHGAGAAAGRVRVELKSRLFELLMNTMMAMICDKTYYGADDDGEVSEEARWFREMVEETMALSGASTVWDFLPAALRWVDVGGVGRRLWRLRESRTRFLQGLIDDQRKEMEHDGDGRELPAAAARPRSMIGVLLSVQRQDPEECPDQLISSLCISSLEAGTGTSTDTIEWAMSLLLNNPDVMRKARDEIDAFIGQPVRLLEADDLPKLQYLRCIIMETLRLYPPAPLLVPHESSSDCTVAGFHIPRGTMLLVNTFDIHRDPHIWDEPTSFIPERFEDGRSEGKMAIPFGMGRRKCPAENLGMQMVGLGLGTMIQCFEWERVGEELVDMTEGSGLTMPKKVPLEAFYQPRASVMHLLS

SEQ ID NO: 89619 - protein, 334 aa, Schizosaccharomyces pombe
AMDVQETQKGALKEIQAFIRSRTSYDVLPTSFRLIVFDVTLFVKTSLSLLTLNNIVSAPLWDSEANKFAGLLTMADFVNVIKYYYQSSSFPEAIAEIDKFRLLGLREVERKIGAIPPETIYVHPMHSLMDACLAMSKSRARRIPLIDVDGETGSEMIVSVLTQYRILKFISMNCKETAMLRVPLNQMTIGTWSNLATASMETKVYDVIKMLAEKNISAVPIVNSEGTLLNVYESVDVMHLIQDGDYSNLDLSVGEALLKRPANFDGVHTCRATDRLDGIFDAIKHSRVHRLFVVDENLKLEGILSLADILNYIIYDKTTTPGVPEQTDNFESAV

SEQ ID NO: 89620 - protein, 359 aa, Aspergillus oryzae
MGCMGSKPVDTTDKDALQRNARIDKVLKNDKKVMDRTIKILLLGAGESGKSTIIKQMRIIHSGGFPDDERRQTRAVIYSNVVIAFKVLLDIMRTESIEFEQEKTKPLADYMDTLESDVGSDEAFSDLKVRDAMRDMWNDAGVQKAVARGHEFALHDNLHYFFDSLDRIFAPGWLPDNQDMLQARLRTTGITETLFELGQMNFRMMDVGGQRSERKKWIHCFEGVQCLLFMVALSGYDQCLVEDQNANQMHEAMMLFESLVNGEWFKRKPIILFLNKIDLFKGKLSVSPVSKHFPDYNGSNTDFDAAARYFADRFRGINRIPDREIYIHYTNATDTTLLKATMDSVQDMIIQKNLHTLIL

SEQ ID NO: 89621 - protein, 509 aa, Oryza sativa Japonica Group
MDALLIALFLLLLIALMETARVRRSGTQRRAGNVPPPPPEPAGLPLVGHLHLFRKPLHRTLARLAARHGGAVFGLRLGSRRVAVVSSAPAAEECLGAHDVAFADRPRLPSGRILSYDWSTMGTASYGPYWRHVRRVAVTEILSARRVQHFADVHVREARAMARHLHRAAVRHGVGGAARVRVELKSRLFELLMNTMMAMICDKTYYGDDDDGKVSKEARWFREMVEETMALSGASTVWDFLPAALRWVDVGGVGRRLWRLRESRTRFLQGLINDERKEMEQEQGGDRAQPAARRRTMIGVLLSVQRQDPDACPDQLIRSLCISSLEAGTDTSADTIEWAMSLLLNNPNVMRKARDEIDAFIGQPCIIMETLRLYPPAPLLVPHEASTDCSIAGFHITRGTMLLVNTFAIHRDPQVWNEPTSFIPERFENGRSEGKMAIPFGMGRCKCPAENLGMQMVGLALGTMIQCFEWERVGEELVDMTEGSGLTMPKEVPLQAFYQPRASLMHLLY

SEQ ID NO: 89622 - protein, 524 aa, Oryza sativa Japonica Group
MAVDAMFGSVAVALLAVVVAAAALRRWRRRRRRGGGRPLPGPVALPVVGHLHLFRRPLHRTLARLAARHGAAVMGLRFGSRRVAVVSSAPAAEECLGPHDLAFANRPRLPSGEILAYEWSTMGTASYGPYWRHIRRIAVTELLSAHRVQHFADVNVREVRALARRLYRRAAAAAAAGARTRVELKSRLFELLMNTMMSMICERTFYGADDDEVSEEARWFRSVVKETMELSGASTVWDFLPAPARWLDAGRMTRRMRELSDSRTRFLQRLIDDQRKDMDADSDDHAPAKRRTMIGVLLSLQRKDPDSCPDQLIRSLCIGSLQAGTDTSAATVEWAMSLLLNNPGAMARARGEIDACVGQPAARLLEAADLPKLHYLRCVVMETLRLYPPVPLLAPHESSADCVVAGFHVPQGTMLLVNTFAIHRDPQVWDEPEAFIPDRFADGKNEGKMVIPFGMGRRRCPGENLGMQMVGLALGTLIQCFDWERVGEELVDMRECSGLTMPKELPLEALYQPRASMVDLLTKI

SEQ ID NO: 89623 - protein, 293 aa, Picea sitchensis
MPDAEENHHHRDVSSSNPAMANGKGVLWIFFLLSLMVLLEDFVHADPEDVACLSGVKGSIQDPANRLMGWTGDKLKTPCNGTISELEGVTCNNERVFKLSFAGFGLVGSISPFISNCTNLQSLDMSANRFTGEIPTELQYLVNLAVLNLSVNELTGLIPPSLILCAYLNVIDLHNNRLTGSIPPQLGLLTRLSAFDVSKNKLQGMIPPSLVNRSGVLPRFNASSFLGNKELYGYPLPTPKSHGLSVIAIVGIGLGSGMLSLVVSFTAVCIWLRVTEQGYAAEEGKITHLMPEY

SEQ ID NO: 89624 - protein, 335 aa, Populus trichocarpa
MVIEAVIESVPLKQKIFSEIEKICPPHCILATNTSTIDLNLVGEKTSSQDRIIGAHFFSPAHIMPLLEIVRTEKTSAQAILDLMTVGKTIKKVPVVVGNCTGFAVNRAFFPYTQSALILVHLGVDVFRIDKLISSFGLPMGPYQLQDLSGYGVALAVEKEFANAFPDRTFQSPLIHLLVKSGRNGKTNGKGYYIYEKGSKPRPDPSVLPIIEESRRLANIMPNGKPINITDKEIVEMVLFPVVNEACRVLDEGVVVRASDLDTASVLGMSFPSYRGGIVFWADLVGPKHVYDSLKKWSQRFGDFYKPSKFLEERATGGIPLSAPASSSSGSRSRM

SEQ ID NO: 89625 - protein, 493 aa, Pseudomonas syringae pv. phaseolicola 1448A
MSASDGTPLLHRAIEAECVFNGDWIPSSSPLLPVIEPATGELLMNTAMADAADIAVACREAALAQPAWAALGPREKAEIFLLAADHAVCAFDELALYVARESGGSLHKGQHEVNEAIVLLRQAAGMLSQAHGHGLMLPSAAGRLSYARRVAHGVVGVISPFNFPLVLSMRSVAPALAAGNAVVLKPDPQTPISGGFLIARLFEEAGLPKGLLHVLPGAADAGEALCRDTNVQMITFTGSTAAGRKVAEAAGRNLKKVSLELGGKNPLVILEDADLDLAASNAAFGAWLHQGQICMATGLILVHESIVVDLTRKLADKARALTVGNAARGEAALGPLINKRQLQHVHQVVSDSLQAGAQLETGGEYGGLFYRPTVLSGVKPGMRAFEEEIFGPVAIVVSFSTDEEAIELANRSEYGLAAAVISPNVGRATAIGDRLRCGMLHINDQTVADECINSFGGRGASGNGCSAGSPSDWEEYSQWQWVTVKNQAPTYPF

SEQ ID NO: 89626 - protein, 267 aa, Zea mays
MSEEQFLAVAVEAAKSAGEIIRKGFYQTKNVEHKGQVDLVTETDKACEDLIFNHLRKHFPDHKFIGEEESAALGATADLTDDPTWIVDPLDGTTNFVHGFPFVCVSVGLTIGKIPTVGVVFNPIMNELFTAVRGKGAFLNGSPIKASSQDELVKALLVTEAGTNRDKTTVDDTTNRINRLLYKIRSIRMCGSLALNMCGVACGRLDLCYEIGFGGPWDVAAGAVILQEAGGLVFDPSGGEFDLMSRRMAGSNSLLKDKFVKELGDTN

SEQ ID NO: 89627 - protein, 250 aa, Glycine max
  misc_feature (91)..(91): Xaa can be any naturally occurring amino acid
MARLISSNPIALHRFQPCLPISRHFSANPRRRRPTNTRKFQTLACQTNPNLDQKDTPTTDEEKLVVEPSHTKTSLPQLPAKDINNKISLVXTLAALGLFLSTRLDFGVSLKDLSAIAMPYEEALSNGKPTVVEFYADWCEVCRELAPDVYKVEQQFKDRVNFVMLNVDNTKWEQELDEFGVEGIPHFAFLDKEGNEEGNVVGRLPRQYLLENVDALARGEASVPHARVVGQYSSAEARKVHQVADPRSHG

SEQ ID NO: 89628 - protein, 222 aa, Triticum aestivum
MGPPPKKLVYSFVGRGTTVLADHAEASGNFASVAAQCLQKLPPNNNRLSYNCDGHTFNYHIHDGFTYCVVATESAGRQLPIGFIERVKEDFAKKYSGGKAKTAGPNSLKREFGPKLKEHMKYCDLHPEEIDKLAKVKAQVSEVKGVMMQNIEKVLDRGEKIELLVDKTEDLRSQAQDFKKQGTKIRQKMWWENMKIKLIAFGIIVLLILCIILTVCRDFKCW

SEQ ID NO: 89629 - protein, 462 aa, Moorella thermoacetica ATCC 39073
MNEGQVVQVIGPVVDVEFASDRLPDLYNAITIKTDKINITMEAMQHLGNNTVRCVALSSTDGLQRGMKAVDTGQPITVPVGRATLGRLFNVLGEPIDNQGPVETTERLPIHRPAPSFEEQQPSTEVLETGIKVVDLLAPYAKGGKIGLFGGAGVGKTVLIMELIRNIAYEHGGFSVFSGVGERTREGNDLYLEMKESGVLEKTALVFGQMNEPPGARLRVGLTGLTMAEYFRDAEGQDVLLFIDNIFRFVQAGSEVSALLGRMPSAVGYQPTLATEMGALQERITSTKKGSITSVQAIYVPADDLTDPAPATTFAHLDATTVLSRQIAELGIYPAVDPLDSTSRILDPRVLGEEHYQVARGVQQVLQRYKELQDIIAILGMDELSEEDKLIVARARKIQRFLSQPFHVAEAFTGQPGVYVPLKETIRGFKEILEGRHDNLPEQAFYMVGTIDEAVKKGQELM

SEQ ID NO: 89630 - protein, 235 aa, Nepenthes gracilis
  misc_feature (50)..(50): Xaa can be any naturally occurring amino acid
  misc_feature (66)..(66): Xaa can be any naturally occurring amino acid
  misc_feature (80)..(80): Xaa can be any naturally occurring amino acid
  misc_feature (110)..(110): Xaa can be any naturally occurring amino acid
  misc_feature (124)..(124): Xaa can be any naturally occurring amino acid
  misc_feature (129)..(129): Xaa can be any naturally occurring amino acid
  misc_feature (136)..(136): Xaa can be any naturally occurring amino acid
  misc_feature (138)..(138): Xaa can be any naturally occurring amino acid
  misc_feature (167)..(167): Xaa can be any naturally occurring amino acid
  misc_feature (176)..(176): Xaa can be any naturally occurring amino acid
LIVWVQENLGWALGFGIPAISMGIAIASFFSGTALYRLQKPGGSPLTRMXQVLVASFRKSKLALPXDSNLLYETSDENSXIEGSRKLEHTNELKCLDKAAVVSDKEIKCXDFSNPWRLCTVTQXEELKXLICMFPXWXTGIVFSAIYAQMSTMFVEQGEVMDRTIGXFTIPAASLXMFDTISVIFWVPVYDKILVPLARKFTGKQRGFSELQRMGIGLFISILSMAAAALVEMKR

SEQ ID NO: 89631 - protein, 186 aa, Polytomella parva
KLDQNAGLVPIVEPEILMDGDHDINRTLEVAESIWAETFKYLADNKVIFEGILLKPSMVTPGAEHKNRATPDQVADYTLKMLRRRVPPAVPGIMFLSGGQSEMEATLNLNAMNKTPNPWHVSFSYARALQNSTLKAWQGKPENVKAAQAALLKRAKANSDAQLGKYDPSIESKDASKGMYEKGYVY

SEQ ID NO: 89632 - protein, 235 aa, Nepenthes hirsuta
  misc_feature (7)..(7): Xaa can be any naturally occurring amino acid
LIVWVQXNLGWALGFGIPAISMGIAIASFFSGTALYRLQKPGGSPLTRMCQVLVASFRKSKLALPEDSNLLYETSDGNSVIEGSRKLEHTNELKCLDKAAVVSDKEIKCEDFSNPWRLCTVTQIEELKILIRMFPIWATGIVFSAIYAQMSTMFVEQGEVMDRTIGSFTIPAASLSMFDTISVIFWVPVYDKILVPLARKFTGKQRGFSELQRMGIGLFISILSMAAAALVEMKR

SEQ ID NO: 89633 - protein, 153 aa, Polytomella parva
ALAKRIEELAKAKGVELLLPTDVVIADKFDANANSQTVGIDAIPDGWMGLDIGPKSIELFKKALSDAKTVVWNGPMGVFEFPKFATGTVSIAHSVAELTPKGAITIIGGGDSVAAVEQAGLADQMSHISTGGGASLELLEGKILPGVAALDEK

SEQ ID NO: 89634 - protein, 446 aa, Lactobacillus plantarum WCFS1
MENQQLARKLKRRHVQMIALGGAIGTGLFLGSGLAIKQAGPSILLAYAIGGFFCYLMMRALGELLLSDTRLHSFLEFINRYLGKRFEFAIGWTYWLCWISLAMADLTASGIYIRYWFPWIPQWVTPLIIILILLVFNMLSVSAFGELEYWFSMIKVVAIIALIVTGAILIGSSAHVGGQTVSVTNLVSHGGFFPTGVQGFLMSFSLVIFAFTGIEMVGITAGEAENPEKELPRAINSLPIRISFFYVGALFVIMAIYPWNQITTSQSPFVQVFSDVGIKAAASIINFVVLTAALSACNSAIFSTSRTLFTLAHGDNAPKWMGKVNRYNVPARSLLFSSLILLVIVALNYVIPSTVFTLISNVATTNFIIVWCALLVCHYVYKRTTDSTHNPFKLPLFPVTNIATLAFFIAVTVVLCFDQVNRWAVIGSVVWFVILLVIERSMHRTV

SEQ ID NO: 89635 - protein, 235 aa, Nepenthes inermis
  misc_feature (39)..(39): Xaa can be any naturally occurring amino acid
LIVWVQENLGWALGFGIPAISMGIAIASFFSGTALYRLXKPGGSPLTRMCQVLVASFRKSKLALPEDSNLLYETSDENSVIEGSRKLEHTNELKCLDKAAVVSDKEIKCEDFSNPWRLCTVTQIEELKILIRMFPIWATGIVFSAIYAQMSTMFVEQGEVMDRTIGSFTIPAASLSMFDTISVIFWVPVYDKILVPLARKFTGKQRGFSELQRMGIGLFIAILSMAAAALVEMKR

SEQ ID NO: 89636 - protein, 259 aa, Polytomella parva
MQKVSAASTLRKGAVVRPIPFVTSRVVINRSTVKTEAKKSVGDLSIADLKGKKVFVRADLNVPLDKKTNKVTDDTRIRAAAPTLKYLLKNGAKVILTSHLGRPKKDNKKKYSLDPVIEKLSHYVGTPVKKVDDCIGPVVAKAASELKDGEILLLENVRFYPEEEKNKPEFAKALAANADLYVNDAFGTAHRAHASTEGVTKYLKPAVAGFLLEKELAYLDGAVSHPKKPFVAIVGGSKVSSKITVIEKLLEKVDKIIIG

SEQ ID NO: 89637 - protein, 444 aa, Erythrobacter sp. SD-21
MPTPIKMPALSPTMEEGTLAKWLVKPGDSVSAGDIMAEIETDKATMEFEAVDEGTIASITVDEGTEGVKVGTVIAMLAEEGEDVEKVAKAAPPAEGDAGGSDDSETEAETKQREGKVAQEEKRTEEKSSASDDETSAPAAPVGDDGKRIKASPLARRIAEQKGIDLTTISGSGPNGRIVKADVEEAKPGAAPAKDTAAAPEPAPVKPATQGGDLDAPYEAQKLNNVRKVIARRLTEAKQTIPHIYLTVDVRLDALLKLRSELNKSLEADGIKLSVNDLLIKAQARALQRVPLCNVSFQGDELFQYTREDISVAVAAPSGLITPIIRDAGRKGLAQISTEMKELAGKARDGKLQPHEFQGGTASLSNLGMFGTKQFDAVINPPQAMILAVGAGEQRPHIIDGALGIATVMSATGSFDHRAIDGADGAQFMQAFQQLVENPMGLVV

SEQ ID NO: 89638 - protein, 630 aa, Oryza sativa Japonica Group
MESGLVASHRLRVPFAAAHHRHHPAAPPHLLRQRRGSVAATPLRLGLHLPTPTPLRLPAALPLRPSLPPLRAAAASAAAPEPVGSASPKFLGVETKTLKKIVPLGLMFFCILFNYTILRDTKDVLVVTAKGSSAEIIPFLKTWVNLPMAIGFMLLYTKLADVLSKEALFYTVIFPFIAFFGAFGYLLYPMRDAIHPTALADRLLAALGPSFLGPVAILRVWSFCLFYVMAELWGSVVISVLFWGFANQITTVEEAKEFYPLFGLGANVALIFSGRTVKYFSNMRQNLGPGVDGWAISLRGMMSIVVLLGLVIAGIYWGVNKFVIDKSAAPVVERKKKDKPKLSMGESLKVLVSSRYVRDLATLVVAYGISINLVEVTWKSKLKAQYPSPNEYSSFMGDFSTATGIATFTMMLLGRVILRKFGWGVAATITPAVLLLTGVGFFSLILFGEPLTPLMATLGMTPLLAAVYVGAMQNIFSKSAKYSLFDPCKEMAYIPLDEDMKVKGKAAIDVVCNPLGKSGGALIQQFMILSFGSLANSTPYLGGILLVIVLAWLGAVRSLDSQFSPLAKQELEKEKMLKAKTVETTAQVVGSGNGSLQETLASENSANGSAIKVSQEPESTTSEKSGQQSQ

SEQ ID NO: 89639 - protein, 234 aa, Nepenthes maxima
  misc_feature (1)..(1): Xaa can be any naturally occurring amino acid
  misc_feature (228)..(228): Xaa can be any naturally occurring amino acid
XGWVQENLGWALGFGIPAISMGIAIASFFSGTALYRLQKPGGSPLTRMCQVLVASFRKSKLALPEDSNLLYETSDENSVIEGSRKLEHTNELKCLDKAAVVSDKEIKREDFSNPWRLCTVTQIEELKILIRMFPIWATGIVFSAIYAQMSTMFVEQGEVMDRTIGSFTIPAASLSMFDTISVIFWVPVYDKILVPLARKFTGKQRGFSELQRMGIGLFISILSMAAAXLVEMKR

SEQ ID NO: 89640 - protein, 292 aa, Corynebacterium efficiens YS-314
MSALTSVNHITVIGSGTMGSQIGMVAALSGFETTIIDIAEDALQRAREQLESRMARDVEKGRRTQSEVDEAFTRLDFSTDRDAVVAGTDFVIEAAVEDLSIKRKLFAALDQIAPPHAILATNSSNIVSSRIADATSRPEKVCNMHFFNPVLVMKAVEVVAHPGTSQDTVAITAALAEAMGKQVIHVHKEIPGFVANRLLAALRKEALQLYSDGVVSFEDIDIAAKSALGHPMGPFELMDLVGIDVAYMIRLAEYEQTGDPESLPNPELKKLYDAGRFGRKSGQGWYTYASAT

SEQ ID NO: 89641 - protein, 248 aa, Bacillus cereus ATCC 14579
MIICKTPREIEIMREAGRIVALTHQELKQHITPGITTKELDQIAEKTIQKYGATPSFKGYNGFPGSICASVNEELVHGIPGKRKLKEGDIISIDIGAKYNGYHGDSAWTYPVGNISESVQKLLDVTEKSLYLGLEQVKPGERLSNISHAVQTHAEENGFSIVREYVGHGIGQDLHEDPQIPHYGPPNRGPRLKPGMVICVEPMVNQGRRYVKTLSDDWTVVTVDGKWCAHFEHTIALTEAGYEILTTL

SEQ ID NO: 89642 - protein, 279 aa, Helicobacter hepaticus ATCC 51449
MISIIIDSLRESALHIDSLLKDTSTSYLQSINASGDMQLEIDVRVDKFLSEKLLNLPCVKAICSEEQEEIMYSENKNAPYIIAYDPLDGSSLIDSNLSIGTIFGIYNEELSAKHLIASGYIIYGPRLEMVVAQEQALHYRYNGNMWRNLGALALNTKGKINAPGGTQKHWENKHKAMIESLFAQGYRLRYSGGMVPDLHQILIKGGGLFSYPATSDAPNGKLRKLFEVFPFAFVYEKAGGFATNGTYRILELEVAHLHDSTPCFFGSQSEMNLVKEVYE

SEQ ID NO: 89643 - protein, 483 aa, Rhizobium leguminosarum bv. viciae 3841
MVNLKKTELLRDRCLIDGKWVAGSQNNIAVKNPATGEIVGTVPSLEAGDVEQAVVAAEVAFRSWSALAAKERAAVLLRWFYLIIENADDLAALMTAEQGKPLSEARGEMLYAASFIEWFAEEAKRVYGDIIPAPTTDKRILVFKQPIGVCAAITPWNFPAAMITRKAAPALAAGCTMVVKPAEQTPLTALALGVLAEQAGIPAGVFQIVTGKSREIGKVLTESDIVKKLSFTGSTEVGRILMAQSAPTIKKLSMELGGNAPFIVFDDADLDAAVDGAVASKYRNAGQTCVCTNRIYVQSGVYDVFAEKLAAKVSALKVGEGTQVDVTIGPLIDAEAIAKIEDHISDAIGKGAKVVVGGKRHSLGGRFFEPTVLTGATQAMKIAREETFGPVAPLFRFETEEEALAMANDTEFGLAAYFYTENIRRTWRVAEALEYGMVGHNTGQISNEVAPFGGVKQSGLGREGSRYGIDDYLEIKYLCSAIA

SEQ ID NO: 89644 - protein, 508 aa, Mycobacterium avium subsp. paratuberculosis K-10
MVLADVQAPSRYWENIAGETDLDVTDITGTLPDGLVGTLYRNGSGRWTVGSTQVESIFDADGMVSAFVLDGSGVRFRNRFVRTRHYLRSTAAGRLVDRGFAYQRPGGPRANALRLPANTANTSVMVHRNQLLALWEGGPPHELDLDTLDTIGPCNLGGALRGPVRAYSAHYRYDPMTNTKVNFGFDPYVPRIDPGHALRGPRRLRRLRELAAEAVPRVRLRLYETGADGVTRYLRAVPLPGMGVVHDMALTTRYAVFVLSPLRINPWALTGRQSYWESIRFKPDAPSYFVLAPRDGGAVRVVETDPFYHWHFTNAYDDGDDVVVELPRFAPQTYAGMKNYTAHIRSDIAQVDDYGAIEDAVVLTRFRIAASGRVTREPLADFGCEFPQIDPRRGTMRHHVSYLTVQDPAKFPGQGIARVDHRTGEAQTYCPPGQVLVEPIFVPRPGGTAEDDGWLLTVGYDESRHRSRLMVVDAAHVADGPVAEAWLPFHVPMSYHGTFTTRVAQRTG

SEQ ID NO: 89645 - protein, 216 aa, Helicobacter hepaticus ATCC 51449
MNKDILVAPSMLSADFAKLGQEVEDICKAGCDFVHIDVMDGHFVPNLTMGPMIVQSIAKSSSKPLDIHLMVKNVPFFVDLFLPLKPAFMSVHIEEVQHLHRLIWYIKESGVKAGVVLNPHTNEQSLEYILPDIDLVLLMSVNPGFGGQSFIPHSVKKLQNLKKMRDRLNPSCLLEIDGGVSDKNIDILKNAGIDIVVAGSFIFGSTDYAQAISALR

SEQ ID NO: 89646 - protein, 334 aa, Bacillus cereus E33L
MGRILTLGEIMLRLSTNEGTRITEANYFKAHYGGSEANVAINLANFNHQVSFASKVPSNLLGKAVQQHLQNYGVDTSNLLKGGLRLGTYYLERGTGKRASLVLYDRTYSSFAQMKNVEWNIDDLFKNVSLFHVSGISLALSDSMTNLILGLIKEAKKRQIKVSFDINYRSNLWNYERASKTLNKILPYVDYCSAGKKDALYLIGIPENKTQQSDLEYYYEQMHNKYPNIEVFYSTLRDVHSASSNDLQGTLWKNHFLYTSKVYHINPIVDRVGGGDAFVAGILHGLLKEKDPDYTVSFATAASSLKHTIHGDCNQFSILEVEEFMRNESGNIIR

SEQ ID NO: 89647 - protein, 218 aa, Salmonella typhimurium
MSTFYQKPFLKLLDFTASELTALLQLAAKLKADKKNGKEEQKLVGKNIALIFEKDSTRTRCSFEVAAYDQGARVTYLGSSGSQIGHKESIKDTARVLGRMFDGIQYRGYGQEIVETLAEYSGVPVWNGLTDEYHPTQLLADLLTMQEHLPGKAFNEMTLVYAGDARNNMGNSMLEAAALTGLDLRLVAPKACWPQAALVAECSAMAKKNGGAITLTED

SEQ ID NO: 89648 - protein, 125 aa, Brassica napus
MMAVDLLSENSNMSPRISFSRDFCQSDAIPVEKRPLRSSSNSKPSSLNSSVDFDFCIPGGVTSGESFDQGSWSADELFRNGKILPTEIKKKKPESPPPEKRNPGKKVSDTGPPEPSKPDTRKPET

SEQ ID NO: 89649 - protein, 915 aa, Prosthecochloris aestuarii DSM 271
MPTSRLNIQATSGKQYIYSFTEGGAEGDATMKNLLGGKGANLAEMANIGLPVPPGFTLSTEVCTYYYDHSQTYPEGLFEQDIPDALEKIETALGKKFGDPEDPLLVSVRSGARASMPGMMDTILNLGLNDTTVEGLAHRSGNPRFAWDCYRRFVQMYGDVVMDLKPQDSKHSDPFESILDEHKKKKGCSLDTQLDTDDLKAIVSAFKAAILERTGQEFPEDPHVQLQGAIGAVFGSWNNERAIVYRKLNHIPGYWGTACNVQAMVFGNMGDRSGTGVAFTRDAATGENIFYGEYLMNAQGEDVVAGTRTPLKIRHLQEEKPDIYQQLDCIRTRLEQHYRDMMDIEFTIENDRLFMLQCRVGKRTGLAAIRIAYDMCKEGLIDEKEALLRIEPDQLNQLLRPVFDQKEKDRAISEGRLLATGLNAGPGAATGSICFSARQAQEVKERGQLAILVRIETSPEDIEGMSLAEGILTERGGMTSHAALVARQMGKVCVAGCGELDIDYQKGEMRIEGTDIVLKEGDSISLDGTTGEVIQGEIKTRNPEVIEVLADKTLKPEDAPTWQIFDQVMQWADHYRTLKVRTNADQPEQAELAVTFGAEGIGLCRTEHMFFGGQRIDAMREMILADDIGDRQKALEKLLPYQRDDFYGLFKAMGSRPVTIRLLDPPLHEFLPQEDAEIEALAKKIGMAFHDVKTRIDNLHEFNPMLGLRGCRLGILHPEIPAMQVRAIIEAACIIKKEGHDIIPEIMVPLVSTVRELELTSEIIHKVARRVMAEQEIGVTYLVGTMIEVPRAALTSGDIAKAADFFSYGTNDLTQMGLGMSRDDSGQFLPVYQNYDIFPHNPFESLDQEGIGRLIKLSAKEGRSVKSDLKLGICGEHGGDPATIEFCHTTGINYVSCSPFRIPIARLAAARAAIG

SEQ ID NO: 89650 - protein, 271 aa, Triticum aestivum
  misc_feature (225)..(225): Xaa can be any naturally occurring amino acid
  misc_feature (247)..(247): Xaa can be any naturally occurring amino acid
  misc_feature (253)..(253): Xaa can be any naturally occurring amino acid
AYLGDILEQVCTKKHVPTGPEFPGYRRPTRPGIDLAVTVLTTGFWPTYKSFDINLPAEMVRCVEVFKEFYQTRTKHRKLTWIYSLGICHITAKFEAKTIELIVTTYQAALLLLFNGADKLSYSEIVTQLNLSDDDVVRLLHSLSCAKYKILTKEPSNRSISPNDVFEFNSKFTDKMRRIKIPLPPVDEKKKVVEDVDKDRRYAIDASIVRIMKSRKVLGHQDTSXECVEQLGRMFKPDFKAIKKRIXEDLITXRDYWRRDNGRTELYRYLA

SEQ ID NO: 89651 - protein, 277 aa, Bordetella parapertussis 12822
MKNDLSIAFIGGGNMAAALASGLAGKVCPAANIHVVDINADSHAGWRARGMSAAAAPDATLAGCRVWVYAVKPQHMREAVAGTRPWLRPDTLIVSVAAGIHADTLAGWLGEPGQPWQRLVRCMPNTPALVGAGMTGLAALPGVTPQDRELAGQLLTSVGEVVWVDGDAGLDAVTALSGSGPAYVFLFIEALIAGGRAVGLTDEQARQLALGTLAGATRLAAQSDEPPAVLRERVTSKGGTTATALDVYAQGDFAGLVERAMQAAARRSRELAEEFGR

SEQ ID NO: 89652 - protein, 196 aa, Picea sitchensis
MDIMDGHFVPNLTIGAPVIQSLRKHTQAFLDCHLMVTNPLDYVEPFAKAGASGFTFHVEAAEDNWQDLINRIRNAGMRPAVALKPGTSIETVYPLVESKEPVEMVLVMTVEPGFGGQKFMPDTMDKVRDLRQKYPSLDIEVDGGLGPSTIDQASSAGANCIVAGSSVFGAKDPPAVIAMLRKSVQEAQKIKIVSYM

SEQ ID NO: 89653 - protein, 520 aa, Mesorhizobium loti MAFF303099
MKTANHPDTVLIVDFGSQFTQLIARRIREAGVFSEIVPFQSAEAAFKRINPKAVILSGGPASTSDIGSPRAPQIVFDAGVPVLGICYGQMAMCVQMGGVAESSNHREFGRAFVEIEKDSPLFEGLWATGQRHQVWMSHGDRVIALPPGFQVFGKSESSPFAIFGNVERKMYGIMFHPEVVHTPDGARLLRNFVHNIAGIEGDWTMRAYREHAVEAIRKQVGKGKVICALSGGVDSSVAALLIHEAVGDQLTCILVDHGLMRKDEAAGVVAMFRQHYNLPLILVDASEKFISALEGEVDPEKKRKTIGRLFIEVFEEEAKKLGGADFLAQGTLYPDVIESVSFTGGPSVTIKSHHNVGGLPERMNMQLVEPLRELFKDEVRALGKELGLPESFIGRHPFPGPGLAIRCPGGITREKLEILREADAIYLDEIRKAGLYDAIWQAFAVLLPVQTVGVMGDGRTYEFVCALRAVTSVDGMTADFYHYDMAFLGAAATRIINEVRGINRVVYDVTSKPPGTIEWE

SEQ ID NO: 89654 - protein, 497 aa, Streptomyces coelicolor A3(2)
MADQAPRPAREFVVEADGGSRGNPGPAGYGAVVLDPVTGEALVEAAEYLGVVTNNVAEYRGLLAGLRAAAELDPDATVHVRMDSKLVVEQMSGRWKIKHPDMKPLAAEAARVFPPGRVTYEWIPRASNKHADRLANEAMDAGARGEAWSPSDSTAELDAAAADRAAPAGRTAGSRRTGAASAVAPAGTEGGDGGEPAPDGGGAAAGEPLARAGRDRVDAASLGAGTRAATSTGASATGTSGTGASATGTSGTGASATGAPGLGVAAETSGEADVRAAKVVASPGWGPPDMGAPATFVLLRHGETPLTPQKRFSGSGGSDPSLSPVGREQAERVAASLARRGTIEAVVASPLARTRETAGIVAARLGLEVAIEEGLRETDFGAWEGLTFGEVRERHPADLDAWLASPDAEPTGGGESFAATGTRIAATRDRLVAAYAGRTVLLVSHVTPIKTFVRLALGAPPESLFRMELSAASLSAVAYYADGGASVRLFNETSHLR

SEQ ID NO: 89655 - protein, 1338 aa, Yarrowia lipolytica CLIB122
MSMPNVSAPTLAIPETNGARAIGAALAGATAAGRKRSGSLDAPSAATVTRGGTTSPLLCNSAYSPHPGSSSPGGYFDSNHNLSVRTLSTPASPNDNASVHPVTPQTVPATNNSNTVRPKSPSRQPSNTYAPARHPSQNNQRGTRKTSQGAVPSVSGSKPSSNAQYYAQERAYLQKMRNNLADDYYTKGIPASDLDRSSDEESLSEFEGDFVGLGGVGTFFDDSGAISYPFLEAKYNADDAEKSESIRERLQWQSMLTSVLTGEVVKNEKQRLRAPPEMDKKLVAEELWMGVRAKVCGRSMDEQRRIIEYSRNTKDGILLEVVNFRAKPADEAGGRSASDQVEDLLNRLDNFEQLWRSYSLIETDKPFYGSQEFQERLTALLTWSSLTWNIGTEIRLLQQWIGNEDIDLTRPAEGNDMMADKSPFIERLLKGQDLKNIFENRVLGPLSQLVDRARTSALEYHDTFQTLGLPVLYDHIGSLARFPSLLIMEVMRTRLNYARKLANPTMMMIDQTMVDIRGYIELSLKAKERYMFFVSPTQDGPWPLKDTIGDAFDETLIDCVSFYFDLLSRKFLESSNAVFRTFKEGEQLEFQYKFLSKIGEWISGGDYLVAEQFSYLTSKLMTKLLDYWQDSLKGPASDQANEIAAFYSETAEQIRSFERNLIRFYTSMCSSYENASEYAIQPSRLGAIVNSVRRANYFLVYTGVLERDGIYVFADPSLRERPHKLKEIIRGYSRYRRPEEDSVEYDHIAHVLILCSEEPFIWEGEILNIDMPSFDLEIKMGRMRIVSEGGTHMLQLAKTQFAEVCEREFLNTVVEAKSNQLRVDHEFGRLRKLFFRLSMSVIDNVATIRHTLKGLGCQDTVQNMFVFAREFGQRGLRSLEGPKRGYVTMKLINLCIEWVSFVVDDCTSTEYRTFRYTVTALEFASVMTSGVNILAVNEEAFLRLRVKVAGCMSLLISHFDIMGARSKAKAQQKVEVTSARRKKISHMSFKDDTELMEAFRNDAVKKLEDLERKRNDLEFEHHYVGRVLDDGSADDQFLMSLASAFSNVTMRWQLGRFIGSGTFGDVYSALNLDNGEMMAVKEIRLQDAQSIRTIVKAIKDEMTVLEMLHHPNIVQYFGVEVHRDRVYLFMEICQGGSIADLLSHGRIEDEQVIQVYTFQMLQGLAYLHHAGIVHRDLKPENILLDHNGLIKFVDFGAAKVIARNGRTRAAQTGTRSKINSLTGTPMYMSPEVITGSNPGRQGAIDIWSLGCVVLEMATGRRPWSNLDNEYAIMFHIASGHMPQLPSAEQLSPEGQAFLLKCLDRDPNKRESAIELSNDPWLARVKNDHLEQLTPMGEE

SEQ ID NO: 89656 - protein, 632 aa, Idiomarina baltica OS145
MRGGKTLLSDTSFTIFPQHRIGLIGKNGCGKSSLFALFRDELQLEEGELQLPNEWRIASVAQETPALARSAIDYVMDGDQGFRAAEQALQAAEAKGDGHAIAHSHEQLAQLGAYDIRSRAAMLLDGLGFLPEQIEQPVSAFSGGWRMRLNLAQALIAPSDLMLLDEPTNHLDVDAIFWLESWLKSYSGTLVIISHDRDFLDNVATDILHVENQVISSYTGNYSQFEHQRAEHLMQQQSAYEKAQAIKKHMQAYVDRFRYKASKAKQAQSRLKAIEKLSVQAPLQAERGIDFEFLPPAKLPNPLINMREVKAGYGDTVILENIKLNLVPGTRMGLLGRNGAGKSTLIKTLSGALEPLAGERTLSQGVSIGYFAQHQLEALDPEASPLLHLQRLDSQATEQQLRDFIGGFGFSGDQALAPVAPMSGGEKARLALALIIYQKPNLLLLDEPTNHLDIGLRDALVNALQAFEGALIVVSHDRHLLRTTVDEFYRVHDGSVEPFPGDLDQYHEWLEQQAKQRREKSTSNTSTHNDTKLDRKEQKRRDAEFRKETKPLRDTIAQSEKQLEKIAEALAQVHQSLSESTIYETENKHKLNKLLDEQRNLQTEQDRLESRWMEAEEALAEMTERFEQDTHG

SEQ ID NO: 89657 - protein, 365 aa, Rickettsia sibirica 246
MTLKLGIVGLPNVGKSTLFNALTASKAADAANYPFCTIEPNSSKVLVPDARLHKLASLAGSGKIIPSYIEFVDIAGLVKGASKGEGLGNKFLSHIREVDAILHVLRCFEDEDIMHVHNKVDPLHDLEIIETELILADIESVEKRLATSEKRLKSGDKAMAEQIELLKEVYKVLGEDKPARVLNEALRVDNLKQLQLITSKPVLYICNVLEKDVAIGNEFTKLVAERAKKENAKSVVIASKIEAEIALLESMEEKEEFLKFIGLDETGLNKVIKEGYNLLNLKSFFTIGPKEAHSWTFKDGTLAPAAAGIIHTDFEKGFIRAEVIGYKDYINLGSEAKAKEVGKMRLEGKEYKMQDGDIVHFRFNV

SEQ ID NO: 89658 - protein, 277 aa, Idiomarina baltica OS145
MQFSLTEIAEKLAEVARDAGKLVMELYDSGAFATAEKADESPVTTADIKASEFIVASLKKAFPNIPVLSEESRHEKLSTRAGWSSYFLIDPIDGTQEFIARSGDFAVNIAYIEERQPSIGVIYWPPGETLYSAIREQGAYKHALGQKQAISVRKLNDPQHDPLILAISRRQPRHKVMARVQTERDIQPLPTGSCSLKACFIAEGKADCFLRLGPTGEWDTAASQVIVTEAGGSLLNENFEPITYNETESLLNPNFYVLGDPEVDWQAVFIAHPPNFR

SEQ ID NO: 89659 - protein, 261 aa, Bacillus licheniformis ATCC 14580
MNLKYATLKTEHGITTVTLNNPPANTLSSSCIAELRSLFRELARDEETKAIIITGEGRFFVAGADIKEFVSKLGDQKQGLALAQGGQALCDEIEASKKPVIAAINGPALGGGLELAMSCHFRIVSDDATVGLPELKLGLIPAFGGTQRLRNITDTATALDLILTGRSLSAQEAVELKIAQMAVKGEELMKTAAAVASSFIEGKSMTSVRRAVECVVQGASESMEQALERERNRFAELFVTSDAKEGIHAFVEKRKPNFHHS

SEQ ID NO: 89660 - protein, 470 aa, Erythrobacter sp. SD-21
MATQYDVIVLGSGPGGYVAAIRCAQLGLKTAIVERELLGGICLNWGCIPTKALLRSAEILHYAQHASDYGLKIAGKIEADLEAVVKRSRGVAKQLNQGVTHLMKKNEITVHMGEGTLTGPTSLTVKGEKGEEKLTAKHVIVATGARARDLPFAKADGKRVWTYRHAMTPPEMPKKLLVIGSGAIGIEFASFYNDMGCDVTVVEMLDRIVPVEDKDVSAFLEKSLTNQGMSIMTGAGVEDIKVSDKGVKAKIKDSKGKTSETEFTHCITAIGIVPNTENIGLEKLAEMDRGFIQIDGYGRTKSKGLWAIGDCTPGPWLAHKASHEGVTTAEAIAKELGDKDVHPHPLDRRNIPGCTYCHPQIASVGLTEAKAKEAGYTVKAGTFPFIGNGKAIALGEAEGFVKTVFDSKTGELLGAHMVGAEVTEMIQGFVVGKTLETTEAELMNTVFPHPTISESMHESVLASYGRALHI

SEQ ID NO: 89661 - protein, 484 aa, Bacillus licheniformis ATCC 14580
MITTNAKKMMNHIDGEWVNSLGAESEEVVNPANGNVIAYAPLSVRADVDRAVQAAKHAYQTWSLVPVPNRARLLYKYLQLLQEQKEQLADIITTENGKTLKDARGEVQRGIEVVELATATPTLMMGESLPAIAGGIDGSIWRYPLGVVAGITPFNFPMMVPLWMFPLAIACGNTFVLKPSERTPILAGKLVELFYEAGFPKGVLNLVHGGKDVVNGILENDDIKAVSFVGSEPVAKYVYQTGTANGKRVQALAGAKNHAIVMPDCHLEKTVQGIIGAAFGSSGERCMACSVAAVVDDIADDFMEMLVSETRKLKTGDGRSEDHFVGPLIREVHKQRVLDYIDSGIKEGAALAVDGRNPDVREGYFVGATIFDHVTPEMKIWQDEIFAPVLSVVRVQDLDEGIELANQSKFANGAVIYTSSGKSAQQFRDKIDAGMIGVNVNVPAPMAFFSFAGNKASFYGDLGTNGKDGVQFYTRKKVVTERWF

SEQ ID NO: 89662 - protein, 616 aa, Erythrobacter sp. SD-21
MTGFLILAFLILVAGVIAVPLASRFGLGSVLGYLLAGMAISPLLGALNVDVEALQVFAEFGVVMMLFIVGLELEPKRLWEMRGKLLGLGGGQVLLTTLAITGIALIDSNPWQTALAIGMVLALSSTAIIVQTLTEKNLLRSEGGEASFSVLLVQDVAVIPILALLPLLAMPELYGAGGHGEGAHGGIDLTASMSGWLAALSRIGAVAAVVAIGIYAIRPLFRYIAAANLRELFTAAALVVVIGIALLMSLVGLSPALGAFVAGVVLATSEYRHELESDINPFKGLLLGLFFITVGAGIDFALASEMWGSVLFWAAVTIAAKFAVLIAVGWLYGLRRQALWLFSLSLPQAGEFAFVLIAFAVANAVFPGGLADLLLLVVALTMLATPLLFILYDKVIAHALCESEGRDADTIEEENPVIIAGRGRMGGIVDRMLQAAGFSTTVIDYDSKQLEIVRKFGFRTYFGDATRPDLLHSAGIEKAKLLVVALDEREQIDKLVQYAVKNFPDLHVTARAIDRNHVYELWAYGCRDIIRETYDSSLRIGRSAFEALGMDRQQAQAAADAFEEMDRRSMREVADHYRLDIPYHENEALIAKVKELREEWDPVLREQMEEILKRGP

SEQ ID NO: 89663 - protein, 585 aa, Oryza sativa Japonica Group
MEQYEVLEQIGKGSFGSALLVRHKVEKKRYVLKKIRLARQTDRCRRSAHQEMELIAKVRNPYIVEYKDSWVEKGCYVCIVIGYCEGGDMSEAIKKANSNYFSEERLCMWLVQLLMALDYLHVNHILHRDVKCSNIFLTKDQNIRLGDFGLAKVLTSDDLTSSVVGTPSYMCPELLADIPYGSKSDIWSLGCCLYEMTALKPAFKAFDMQTLINKISKSVLAPLPTIYSGAFRGLIKSMLRKSPDHRPSAAELLKHPHLQPFVLELQLKSSPARNLFPDTNKASCSDDENNWKAKYSKSHSFKVDRIVKVDKVAANNGHPSSTGTAKDYQELLKQPMDELLGQLTEKVVDEVIHGNHSRVTKSPAPTPRRASSTPRIRLEPSKTFHARAAETPPSKCSLERASQPTRRASTPVNMLQTPEKRQGADILTRLKSPDVSVNSPRIDRIAEFPIPSFDDEQLHPTTKLKLYPPSITDQSITKDKCTFQVLRSDSSKNHTGDSSDPSILGTDSNPLITSSSDWMKQRRFDTTSYRQRAEALEGLLEFSAQLLQQERFEELGILLKPFGPGKASPRETAIWLSKSFKGTGL

SEQ ID NO: 89664 - protein, 291 aa, Xanthomonas campestris pv. vesicatoria str. 85-10
MSSALFDHWIARTERSLEAGLPRATHAPQRLHAAMRHAVLGGGKRMRPLLVYASGALFGAAEDQLDTPAVAVELIHAYSLVHDDLPAMDDDALRRGQPTVHIAFDEATAILAGDALQTRAFELLATASASAELRVSWIQSLATAAGAAGMCGGQALDIDATGQLQSLQDLQRMHALKTGALIRAAVRMGALTGGAAAADQQRLDEFADALGLAFQVRDDILDVESSSAQLGKTAGKDAAQAKSTYPALLGMDGAKAKLAELAARMHDVLQPYGQPGETLATLGRFAVNRAH

SEQ ID NO: 89665 - protein, 329 aa, Zea mays
MASISGAAAAPSSAACRLRLRRHILLRPSHLRLRAPHSIADLSRSSSSSSSAPTRAQPLGSRPENGGGVRAVEKDPIKLWERYVEWLYQHKELGLFVDVSRMGFTEDFLRQMEPRMQRAFAAMRELEKGAIANPDEARMVGHYWLRDPALAPNSFLRSKIETTLDRILAFSQDVVSGKIQSPSGRFTSILSIGIGGSALGPQFVAEALAPDNPPLKIRFIDNTDPAGIDHQIAQLGPELATTLVIVISKSGGTPETRNGLLEVQKAFRDAGLQFSKQGVAITQENSLLDNTARIEGWLARFPMFDWVGGRTSEMSAVGLLSAALQGIDI

SEQ ID NO: 89666 - protein, 380 aa, Corynebacterium efficiens YS-314
MVTASANYRGVTMSFTVPGIIARSKGAPVEKVNVVVPDPGANDVIVDIQACGVCHTDLAYRDGDISDEFPYLLGHEAAGVVSVVGENVTHVEVGDFVVLNWRAVCGECRACKKGEPKYCFNTHNASKKMTLEDGTELSPALGIGAFIEKTLVHEGQCTKVNPDEDPAAAGLLGCGIMAGLGAAVNTADIQLGESVAVFGLGGVGMAAVAGAKLAGASKIIAVDIDERKLEWAREFGATDVINSSGLSGEGEESEVVAKIRELTGGFGTDVTIDAVGIMPTWQQAFYSRDHAGRMVMVGVPNLTSHIDIPAIDFYGRGGSLRPAWYGDCLPERDFPAYVELHLQGRFPLDKFVSERIGLDDVEEAFNTMKAGDVLRSVVEL

SEQ ID NO: 89667 - protein, 226 aa, Polytomella parva
MLATSACTVRVSPKAKSVKIVSRPVNQRIVSANASKAKFFVGGNWKCNGDSAAVKTLVEDLNKGKVPSDVDVVCAPPFLFLDYVNKNLDKSKYAVSAQNCWVGKNGAYTGEVSADMLVNAQIPWVILGHSERRAIFNESSEFVAKKCAYALSKGLGIIPCIGETLEQRNSGKMFEVLTSQMEPLFKEIKDWSKVVIAYEPVWAIGTGVVATPAQAQEVHAFLRKLL

SEQ ID NO: 89668 - protein, 242 aa, Alteromonadales bacterium TW-7
QLDKTNVLLIGAGETIELVAKHLYQNEPQNITVANRTIERARNLADEVSADVIALAQLPERLHNADIIISSTASTLPIIGKGVVEQALKQRRNKPMLFIDIAVPRDIESQVGELDAAYLYSVDDLQTIVSENMAAREQAAQQAQIIITERTKEFCMWMRSLDSVGLIRHYRNDVQTIKSELVERAVSQLSSGKDAEKVILELANKLTNRLMHAPTRAIQDAAKKGEVAQLNQLKKMLGIDQE

SEQ ID NO: 89669 - protein, 612 aa, Oryza sativa
  misc_feature (552)..(552): Xaa can be any naturally occurring amino acid
MGNVCIGPRRNFAKNGLLGILRPRHAAPSSPSQPTTTSRSIPVVLPSAPSSKPPPPTQTAPPVPVVISEPPPPQPQPEPQPAAPSQPPPPQEQPSPPPPASSNTTQQPPPPQQRQQSRAKKPAHIKRISSAGLQVESVLRRKTENLKDKYSLGRKLGQGQFGTTYLCVDKANGGEYACKSIAKRKLLTDEDVEDVRREIQIMHHLAGHPNIISIRGAYEDAVAVHVVMELCAGGELFDRIVRKGHYTERQAAGLARVIVAVVESCHSLGVMHRDLKPENFLFVGNEEDAPLKTIDFGLSMFFRPGEVFTDVVGSPYYVAPEVLKKSYGQEADVWSAGVIIYILLCGVPPFWAETEQGIFEQVLHGTLDFESDPWPNVSDGAKDLLRKVLVRDPKKRLTAHEVLCHPWLQMSGSAPDKPLDSAVLSRLRQFSAMNKLKKMALRVIAENLSEEEIAGLKEMFKMMDTDNSGQINYEELKAGLERVGANMKESEIYQLMQAADIDNSGTIDYGEFIAATLHLNKVEREDHLYAAFQYFDKDGSGYITSDELQQAXDEFGIEDVRLEDMIGEVDQDNDGRIDYNEFVAMMQKTTTGFGKKGGHNFSGFRDALKSHS

SEQ ID NO: 89670 - protein, 264 aa, Geobacillus kaustophilus HTA426
MAEKWEEIDRYARQWIDEAGKRIRASFAKQLTVEAKENPNDLVTNVDRAIEQFFAEHIRRQFPSHRLLGEEGFGDRIDALDGVVWVIDPIDGTMNFVHQRRHFAVSIGIFEDGIGQLGYVYDVVFDELYAAQKGRGVFLNGEPLGLLQPAPVTESIIAINGTWLMENKRLDHRPLMRLAKEARGTRSYGSAALELAYVAAGRLDAYISPRLSPWDFAGGMILIEEAGGMVTTLDGKPLDLLGRNSVLAAKPGVHEEILRRYLHD

SEQ ID NO: 89671 - protein, 363 aa, Rhodococcus erythropolis
MQTAAAVLRSTDRPYSLEELTLDPPGPGEIAIRIVGVGLCHTDLLPRAAQSGIPLPLVPGHEGSGVVEVVGSHVQGLAVGDHVVLSFDSCHACANCLQGRPAYCDTFFPRNMSGRTVDGSTNARDCEGLPVSTRWFGQSSFATRSVVDARNAVKVDSALPLELLGPLGCGFQTGAGAVLNSLGVEVGADIVVFGAGAVGLAAVMAARVAGASTIVAVDLNRDRLDLARDLGATHVIDGTADDIARQIRRIVRGGVDYALDTTGAPRVIATAIDSLRASGVCGLIGAPAGDVRISATALSTGRTVKGIVEGDAVPRLFIPRLISLWQDGLFPFDRLIEKFAFTDIDAAERAAIDGKVIKPVLVL

SEQ ID NO: 89672 - protein, 362 aa, Rhodococcus erythropolis
MQMTAALSHGPHSPFTLDTVEIDEPRADEILVRIVATGLCHTDLFTKTVLPEKLGPCVFGHEGAGVVQAVGSSIDNIAAGDHVLLSYRSCGVCRQCLSGHRAYCESSHGLNSSGARTDGSTPVRRNGTPIRSAFFGQSSFAEYVIASADNTVVVDPAVDLTVAAPLGCGFQTGAGAVLNLLRPEPDSTFVVFGAGSVGLAALLAARAAGVSTLVAVDPVAQRRELAEEFGAVTVDPSNEDALDAVRAATDGGSTHSLDTTGIGSVINQAVTSLRARGTLAVVGLGASTVEVNMADIMLSGKTIRGCIEGESEVSTFIPELVELFTGGRFPIDRLVTRYAFSDINKAVEDQASGRVIKPVLVW

SEQ ID NO: 89673 - protein, 174 aa, Legionella pneumophila subsp. pneumophila str. Philadelphia 1
MLSINELNPSLFCAIFIQRVANLVLIRESAMAHLIHSVLPVPPRKIAYIHPDDSVKECIKQMVEKDIGALVVFDNDAHLIGIVSERDILRCYFHKSLSLETAKVSDVVYTNVTILSPHDSVEKAMQVITETKRRHVLIQEEGELLAILSIGDLLYHVLEDKLRVIEHLENYIHS

SEQ ID NO: 89674 - protein, 495 aa, Cryptococcus neoformans var. neoformans JEC21
MSATVAEVTFNTGLYINGLWKNGRGEPLLSVNPATEEVIAEVQTASKEDVDEAVKAARHCFETAWGTEVSSQLRGQLLFKLADGMEAAMEELAKLEYLDSGKPLAWCKADIEDSVACLRYYAGSADKIQGSMIELDDKHKHALARKEPIGVCAQIVPWNYPLLMMIWKIAPALAAGCTIVFKPAEQTPLSTLKFAELFELAGYPAGVFNLVNGLGRTTGDALSRHMDVDKIAFTGSTITGRRIAIAAAESNLKSVTLELGGKSANIVFDDANLQEAAKWAAFGVYENMGQSCSAGSRVLVQESIYDQFITHFKAAAEAFKVGDPADPDTFQGPQVNEAQFRKVLDYIESGKRSGAKLLTGGSRHGSRGYFIQPTVFGDVTMDMKIAREEIFGPVASVIRFKDEADAISIANNTEYGLAAAVHSQNYARVQRVTRKLKAGTVWINQYVALSHQVPFGGYKQSGWGRELGLEGLEPYLITKSVHHYYGGDFEWPIKI

SEQ ID NO: 89675 - protein, 362 aa, Rhodococcus erythropolis
MPQQVRGVIARSKGAPVEIVPITIPDPGANEVVVAIAACGVCHTDLTYRDGGINDEYPFLLGHEASGIVESVGPGVTHVEVGDFVVLNWRAVCGQCRACKRGRPQYCFDTFNAEQKMTLEDGTELTPALGIGAFADKTLVHEGQCTKVDASADPAVVGLLGCGVMAGMGAAMNTGNVGRGDSVAVIGCGGVGDAAIMGSRLAGANTIIAIDRDPRKLEWATELGATHTINATEVDDVVEAVQELTGGFGADVVVDAVGRPETWKQAFYARDLAGTVVLVGVPTPDMKLEMPLVDFFSRGGALKSSWYGDCLPERDFPVLVDLYQQGRLPLEKFVSERIKLDEVEKAFETMHRGEVLRSVVVL

SEQ ID NO: 89676 - protein, 237 aa, Cryptococcus neoformans var. neoformans JEC21
MKVNFSNPATGAQKLIDFEDERKTRIFMEKRMGQEVAIDSLGEEFAGYVVRITGGNDKQGFPMKQGVLLQHRTRLLLSDGHSCYRARRDGERKRKSVRGCIVGSDIGVLAVAIVKQGANELPGLTDVVLPKRLGPKRATKIRKFFNLSKEDDVTKFVVRREVTKKNGKTTTKAPKIQRLVTPLRLQRKRHLRSLKKRRTEAQKETVAEYNAAVAKHAEEKKVHNAAVKAAKKARRSA

SEQ ID NO: 89677 - protein, 327 aa, Burkholderia xenovorans LB400
MSNTGAALDVITYGEAMAMFVAAETGRLAGVGQFAKRIAGADLNVAIGLSRLGFKVGWMSRVGNDSFGQYVRDTLTREGIDQRCVTTDERYPTGFQLKSRNDDGSDPAVEYFRRGSAASHLSLDDYAADYVLPARHLHLTGVAPAISASSRELAFHLAREMRAAGKTISFDPNLRPTLWPSRAAMVEGLNALAALADWVLPGIGEGEILTGYTQPDDIAKFYLDRGARGVIIKLGAQGAYFRTAADAALIAGQPVAKVVDTVGAGDGFAVGVVSALLEGKSLPQAVARGNRIGALAIQVIGDSEGLPGRAELDALESADATSIAAAA

SEQ ID NO: 89678 - protein, 177 aa, Brassica napus
  misc_feature (166)..(166): Xaa can be any naturally occurring amino acid
MPLTKLVPDAFGVLTISLVLLLILLGLLCIAYSFYFQSHVRKQGFLQLGYFSGPWIIRIAFILFAICWAVGEILRLSLFRYHRRILSGLDLRWQENVCKWYTVSNLGLAEPGLFLTLMFLLRAPLKMESGGAPSGKWNRNTAGYIVLYCLPILALQLAVVLSESRXNGGSGSYVNCR

SEQ ID NO: 89679 - protein, 221 aa, Prosthecochloris aestuarii DSM 271
MQAKTTLLAPSILSADFTQLGNSIQLAEKAGADWLHCDVMDGHFVPNITFGPFIIQAIAKCSSMTIDTHLMISDPDRYIPDFIKAGSHQVTVHQETCPHLHRSVQLIKSLGAKAGVSINPGTPISTLEAIIGELDMVLLMSVNPGFGGQKFIPSSVEKIKKLHEMRNAMNPDMVIAVDGGVTVDNAQELVSAGADALIAGTAFFKAENPAEAAAQIKSASR

SEQ ID NO: 89680 - protein, 355 aa, Bacillus cereus ATCC 14579
MVTKEQVVEALEGIVDPFLHKTLKETSAIKEVTVKPEKEHVSVKIAIVKTGTAEQMQLQSGIVKLVKELGAATVGLRFAEFTEEELAQFAPEQEEEQSESLLSPNSKTTFLAVASGKGGVGKSTVSVNLAVALARLGKKVGIIDADIYGFSVPDMMGIEKRPIVRGDKIIPVERLGVKVISMGFFVEDNAPVIWRGPMLGKMLNHFFTEVEWGDLDYLVLDLPPGTGDVALDVHSMLPSCKEIIVTTPHPTAAFVAARAGAMALRTEHSILGVVENMAYFESKVTGEKEYVFGKGGGDKLATELQTNVLGRIPLQQPDWNKEDFAPSVYEDTHTTGIIYSKIAETVIDKTAVTQK

SEQ ID NO: 89681 - protein, 531 aa, Cryptococcus neoformans var. neoformans JEC21
MLSRQLTRNLFNKRAASTLAADINAAQDNGRWKGTSTLGGDAKLLIGGSWESSKTDKWSEVHDPSTQHLISKVPHATSAEMKRIVDVAENKFYEWSESSVLTRQRIMLDLQGLIRKYHKDIARNIVLEQGKTFADAMGDVTRGLQVVQMATNIPTELLGRNIEVSRDMDTLTRIEPLGVGAAICPFNFPAMIPLWSVAMAIATGNTLILKPSERDPGASAIIAELCEMAGLPSGVLNILHGGVDAVNFICDEPRIKAISFVGGDKAGKHIYDRAGALGKRVQAQLGAKNHAIILPDANKSALKAVAGAAFGAAGQRCMALSVLVTVGDADWLPGLVEEANALKMGNGFDEAADLGPVISPQARERIEQLIESCEKQGGNIVLDGRGATVKDYPNGNWVGPTILEATTDMDCYKNEIFGPALVVVKTRDLDEAIELVNRNPYGNGAAIFTQSAVSSRKFEKKIEAGQVGVNVPIPVPLPMFSWSGNKASVLGNASLYGPLGLNFWTKTKTITSLWREDAKEDKAAVAMPVHH

SEQ ID NO: 89682 - protein, 466 aa, Mesorhizobium loti MAFF303099
MVEPALSLNETGAPTNERFHLIQAAPLAGSIGAEARELITSSEDIFVTDQSGRKLIDGPAGMWCINVGHRNQALADTLRDQAMSMTYSTPWYTSNAPAEKLAQMLAERAPGDLNHVFLTTGGSSAVETAIRLVQFYNNVRGLPQKKLLISRQGSYHGSTYLTASLNGRPRDHDWMDGAGDLVRKLTCPNPFHRPANLSLEAFEDFLVNEFRALIEHEGAQQIAAFIAEPIQASGGVLMSPPNYLKRMRALCTENDILFITDEVVTAFGRLGHIFASQDVFGIQPDMITFAKGVTSGYFPLGGVMVSDRLLSELRRLNHPKANFVHGLTYSSHPIGCAVAIRNIELLEDGLLHHAREIGPYFQEQLRTLEELPLVGEVRGAGLMAGIECVADAKTEDRLDLDLTVGKRIDFHCQENGLLVRPLINMCVMSPPLTISRSQIDMMTDALRKGIEATADDLIREGLWKPA

SEQ ID NO: 89683 - protein, 279 aa, Prosthecochloris aestuarii DSM 271
MTNRLVAYQGEPGAYSEIAALRFGQPEPFESFDDAFNAVENKQVACAVIPIENSLGGSIHHNYDLLIEHPVHIVAETFVKVQHCLLGLPGSSTASPGNVLSHPQALAQCRNFFNRHPHLKAEVAYDTAGSAKIIASEGKSSNLAIASKRAAELYGLSILQENLADEEWNITRFFCIAHEHHRENLPFLQTEESERQKTSIVFTLPNEPGSLFKALATFALRSIDLTKIESRPFRKKAFEYLFYVDCIGHSDDQNVRNALGHLKEFATMVKVLGSYGIVK

SEQ ID NO: 89684 - protein, 130 aa, Glycine max
LFQKQLPKMPREYITRLVLDKNHISMAIVKKGWRVVGGICYRPFESRGFAEIVFCAVDSSEQIKGYGSHLMNSLKDHVRKAHPTINHFLTYADNYAVGYFKKQGFTKQISLPRERWVGYIKDYEGGTIMQ

SEQ ID NO: 89685 - protein, 324 aa, Magnaporthe grisea 70-15
MASPTMKLNNGLDMPQVGFGLWKVENSVCADVVYNAIKAGYRLFDGACDYGNEVECGQGVKRAIDEGLVKREELFIVSKLWNTFHDGERVEPIVKKQLADWGIEYFDLYLIHFPVALEYVDPSVRYPPGWHYDDAGTEIRPSKASIQETWTAMEKLVDAGLSKAIGVSNFQAQLLYDMLRYARIRPATLQIEHHPYLVQQRLIEACKTEGIVVTAYSSFGPASFKEFNMEHAEALTPLLEEPTIVKLAEKYGKDPGQVLLRWATQRGLAVIPKSSREKTMKSNFEAVGWDMEDSDIKTISALDKGIRFNQPANYFSTDKLWIFG

SEQ ID NO: 89686 - protein, 191 aa, Triticum aestivum
  misc_feature (158)..(159): Xaa can be any naturally occurring amino acid
  misc_feature (181)..(183): Xaa can be any naturally occurring amino acid
  misc_feature (188)..(190): Xaa can be any naturally occurring amino acid
METGIGSVDGPKGAPSGAVACPATFPASSPTFVGSPEATLGRHLAQRLVQVGVGDVFAVPGDFNLTLLDYLVAEPGLRLVGCCNELNAGYAADGYARAKGVGACAVTFTVGGLSVLNAIAGAYSENLPLICIVGGPNSNDYGTNRVLHHTIGLPDFSXXLRCFTPVTCYQAVVNNLDDAHXXXDKAIXXXL

SEQ ID NO: 89687 - protein, 1421 aa, Sorangium cellulosum
MADRPIERAAEDPIAIVGAGCRLPGGVIDLSGFWTLLEGSRDTVGQVPAERWDAAAWFDPDLDAPGKTPVTRASFLSDVACFDASFFGISPREALRMDPAHRLLLEVCWEALENAAIAPSALVGTETGVFIGIGPSEYEAALPRATASAEIDAHGGLGTMPSVGAGRISYVLGLRGPCVAVDTAYSSSLVAVHLACQSLRSGECSTALAGGVSLMLSPSTLVWLSKTRALATDGRCKAFSAEADGFGRGEGCAVVVLKRLSGARADGDRILAVIRGSAINHDGASSGLTVPNGSSQEIVLKRALADAGCAASSVGYVEAHGTGTTLGDPIEIQALNAVYGLGRDVATPLLIGSVKTNLGHPEYASGITGLLKVVLSLQHGQIPAHLHAQALNPRISWGDLRLTVTRARTPWPDWNTPRRAGVSSFGMSGTNAHVVLEEAPAATCTPPAPERPAELLVLSARTAAALDAHAARLRDHLETYPSQCLGDVAFSLATTRSAMEHRLAVAATSSEGLRAALDAAAQGQTPPGVVRGIADSSRGKLAFLFTGQGAQTLGMGRGLYDVWPAFREAFDLCVRLFNQELDRPLREVMWAEPASVDAALLDQTAFTQPALFTFEYALAALWRSWGVEPELVAGHSIGELVAACVAGVFSLEDAVFLVAARGRLMQALPAGGAMVSIAAPEADVAAAVAPHAASVSIAAVNGPDQVVIAGAGQPVHAIAAAMAARGARTKALHVSHAFHSPLMAPMLEAFGRVAESVSYRRPSIVLVSNLSGKAGTDEVSSPGYWVRHAREVVRFADGVKALHAAGAGTFVEVGPKSTLLGLVPACLPDARPALLASSRAGRDEPATVLEALGGLWAVGGLVSWAGLFPSGGRRVPLPTYPWQRERYWIDTKADDAARGDRRAPGAGHDEVEKGGAVRGGDRRSARLDHPPPESGRREKVEAAGDRPFRLEIDEPGVLDRLVLRVTERRAPGLGEVEIAVDAAGLSFNDVQLALGMVPDDLPGKPNPPLLLGGECAGRIVAVGEGVNGLVVGQPVIALSAGAFATHVTTSAALVLPRPQALSATEAAAMPVAYLTAWYALDGIARLQPGERVLIHAATGGVGLAAVQWAQHVGAEVHATAGTPEKRAYLESLGVRYVSDSRSDRFVADVRAWTGGEGVDVVLNSLSGELIDKSFNLLRSHGRFVELGKRDCYADNQLGLRPFLRNLSFSLVDLRGMMLERPARVRALFEELLGLIAAGVFTPPPIATLPIARVADAFRSMAQAQHLGKLVLTLGDPEVQIRIPTHAGAGPSTGDRDLLDRLASAAPAARAAALEAFLRTQVSQVLRTPEIKVGAEALFTRLGMDSLMAVELRNRIEASLKLKLSTTFLSTSPNIALLTQNLLDALATALSLERVAAENLRAGVQSDFVSSGADQDWEIIAL

SEQ ID NO: 89688 - protein, 144 aa, Lactobacillus plantarum WCFS1
MDKQQGELRQRLTPEQYAVTQEAATERPFSGEYDNFYQEGIYVDVVSGQALFSSRDKYDAGCGWPSFTKPIDQTNLNEHRDESFGMHRTEVTSTQANSHLGHVFPDGPRDRGGLRYCINSAALKFIPVADLEKAGYGQYQSLFK

SEQ ID NO: 89689 - protein, 175 aa, Salinibacter ruber DSM 13855
MVWPNSYTSSNALPAMDERELVETRVRDVLRTKGTLQQNGDVLTATPTDTVYECIDAMVDRGIGSIVITEDDEMVGIFTERDYMRDIALKGRSSPETEVQEVMTEDVVTAEAEDQLRDCLDRMNDLQCRHLPVVDDEGNLADIISMRDCAKQVAESAESGATQLVNYVTGQYSTR

SEQ ID NO: 89690 - protein, 232 aa, Zea mays
MSEAAVRVIGLWPSPFVIRVLIALKLKGVEFEFVEEVVGRKSELLLRSNPVHKKIPVLLHHGKPISESLIIVQYIDEVWSSGAPAFLPVDAHARAVQRFWAQYVDDKLPWAIRILKGTDDGGMEQAAGQLSAALQLLEEAFAQLSQGKRYFGGDSVGYLDIALVSHVGWVKAVEKIAGVTLLDKAKVPNLVAWADRLCAHPAVVDAIPDADKFVEFSVTYGSFSKPINAPAK

SEQ ID NO: 89691 - protein, 362 aa, Corynebacterium efficiens YS-314
MCAWPTLRRATILARMTIPVKALQKTGPDAPFQITTIQRRSPRADDVVIDIKAAGICHSDIHTVRNEWGEANFPLTVGHEIAGVVSAVGSEVTDWKVGDRVGVGCLVDSCGTCEMCQQGFENHCLNGAVGTYNSVDVDGTITQGGYAEKIVVSERFVCRIPDALDFDVAAPLLCAGITTFSPIVQWNVKEGDKVAVMGLGGLGHMGVQIAAAKGAEVTVLSRSLKKAEVAKSLGAVRTLATSDESFFNDYRGEFDFILNTISANINLGAYLGLLKPRGVMAVVGLPPEKQPLSFGSLIGGSKVLTGSNIGGIPETQEMLDFCAEHGLGARIEKISVHEVDEAYDRVVAGDVQFRFVIDTSTF

SEQ ID NO: 89692 - protein, 514 aa, Zea mays
  misc_feature (451)..(451): Xaa can be any naturally occurring amino acid
LEGGGPGAMEYLTSVLSSKVYDVAIESPLQLASKLSHRLGVNIWIKREDLQPVFSFKLRGAYNMMAKLSREQLERGVICSSAGNHAQGVALSAQRLGCDAVIVMPVTTPEIKWKSVERLGATVVLEGDSYDEAQSYAKLRCQQEDRTFIPPFDHPDVITGQGTVGMEIVRQLQGPLHAIFVPVGGGGLIAGIAAYVKRVRPEVKIIGVEPSDANAMALSLYHGKRVMLEHVGGFADGVAVKAVGEETFRLCRELVDGIVMVSRDAICASIKDMFEEKRSILEPAGALALAGAEAYCKYYNLKGDTVVAITSGANMNFDRLRLVTELADVGRKREAVLATFLPEEHGSFKKFTELVGRMNITEFKYRYDFNAKDALVLYSVGIYTDNELGAMVDRMELAKLKTVNLTDNDLAKDHLRYFIGGRSEIKDELVYRFIFPERPGALMKFLDAFSXPRWNISLFHYRAQGETGANVLVGIQVPPVDFDEFKSHADNLGYEYMSENNNEIYRLLLRDPEV

SEQ ID NO: 89693 - protein, 105 aa, Polytomella parva
TRDAALSNLLVDPEFAADLKAAEASWRRVVALAVVNGLPVPGMTASLSYFDAYRRERLPANLVQAQRDFFGSHTYQRVDAEGWFHTVWDENFASKDSITTSGYVA

SEQ ID NO: 89694 - protein, 380 aa, Erythrobacter sp. SD-21
MQDESPLLSFAAIVVAAGKGMRADQPLPKQFAMWRGKQVLRHSVEAFLEAGADPLVVVIPEGGEDATSTALEGLNGWRMVVGGDTRQQSVANGLDEIEAADRVLIHDAARPDLPRDVIARLLEALANHPGAIPTLPVVDSLAIDESGVMAGNGEREKLRRVQTPQAFRFDDILAAHRAWQGEPDAGDDAQVLRAGAGAVALVEGDERLKKLTFAEDFVSDLPPVRIGSGFDVHKLAAGEELWLGGVKIDHDKGLAGHSDADVALHAIVDALLGAIGDGDIGSHFPPSDPQWKGASSDRFLAHAADLVAKAGYRTGNVDLTIICEAPKIGPHREAMRARIAELLGVDIGAISVKATTTERLGFTGRGEGIAAQAVATVIRD

SEQ ID NO: 89695 - protein, 124 aa, Polytomella parva
GCKESFVFRGVAENDIDVFSVPGSFELPVIAKTLASSGKYGAVVCIGAVIKGATSHYDAVVGASTNGIMNAGVNTGVPVVFGVLTCENLEQALDRAGGKLGNKGAEFAAVAVEMASLVEKVKKL

SEQ ID NO: 89696 - protein, 197 aa, Brassica napus
  misc_feature (41)..(41): Xaa can be any naturally occurring amino acid
  misc_feature (47)..(47): Xaa can be any naturally occurring amino acid
EALKSLCTIKASNGSVNLSLVPSETKNGKPGLVQPLTNTDXSPAPSXGSTLHVAYQGVPGAYSEAAAGKAYPNSEAIPCDQFDVAFQAVELWIADRAVLPVENSLGGSIHRNYDLLLRHRLHIVGEVQIPVHHCLLALPGVRAGCITRVISHPQALAQTEGSLNKQSPKHKCKDLYKKRMKGRWNETMKKGLKSIID

SEQ ID NO: 89697 - protein, 219 aa, Brassica napus
MGERFFPNEIPEFLPEDAGEEETFSTHKDSLTKLLSLPYRSFSKKLQRYALSLKDTIVFETWDRSGKRVRDFNLYTGVLGTAYLLFQSYQVARNENDLKLCLEIVEACYTASKDSDRVTFICGRAGVCALGAVAAKLTGDSQLQDRYLARFHEIRLPGDLPYELLYGRAGYLWACLFLNKHIGKDSVSSARMRSVVEEIFRAGRQLGERVKCPLMFEWH

SEQ ID NO: 89698 - protein, 456 aa, Mycobacterium avium subsp. paratuberculosis K-10
MSVAEPKRDIAGLPLAPKNPLSYRERLRAIKEFHTGTNKLRDAGGPVTRVTLGPRWLISPIVLATSPQGIRDIVSVRDGSIDKTSTVATELRRLLGPNLFVLPHTEWLPRRRTLQPVFTRQRVREFGGHMAEAAESVCAGWPEDTEIDLDAQCRTLTLRALGRSVLGLDLDERSDAIAEPLRVATSYAVRRALRPLRAPEWLPTPSRRRARAAAGAIRALADEILQACRADPGREAPLVHALIAATDPETGQALSDKEIRDEMIIFLFAGHDTTATTLTYALWALGRHPEYQARVAAEVAELPDRHLTPDDVARLGFTVRVLQEALRLCPPGPTGTRMATRDVEVAGYRVEAGTMLAFGRMAVQTDPSLWDAPLRFDPDRFDPRRAGDRDRWQYLPFGGGPRSCIGDHFAMLEATLALATIVRRVEIESLSDDFPLAVPFTMVAAAPIRAMVRRRR

SEQ ID NO: 89699 - protein, 808 aa, Ostreococcus tauri
MVKTRSMRSTPEGTRAHPLAREWSSTMHPSVVREAFLAESIDAYTTRVRTRVTTGTWNTNGKAPRGDEDVRGWLMGARGEEGTPDVVVVGFQEIVPLHVDKVLAGKDAAATEAWEEVLDRALNGDAARQGATKRRGTMVDYDASYGNDAGRGGGASTSGTTSWVSFDDADVSRRAKSKAEPTYRPVAQKQLVGVYITVWVKTSLLPHLKDVRVASVATGFNIGVGVLGNKGACAVWMKLYSTPLVFVCSHLSAGTKPGDEHRRNEDFATIVDQLRFHPPDGLDGVEHTIEDAASAIWMGDLNYRLNATDKFVRDCITKGTFSQLLACDQLNIERAGGRVFQGWHESELTFAPTYKYRPGTNIYSGAEDADADVVDAGQKKEEEKKRTPAWCDRVLWNGDFDINLLEYGRSELTHSDHKPVHAVFSIVVRELDPQKLNALMFDLRRRLDHVEMAAQPKCAIVNPSVDLGEMFYSRDALGEFTMSNVGDVPAKFSLVSPIPGGPATPGWITVNPMAGSLLPGEEIVLKVRACVQGGRESGPSAFSHDSLSRRSEEPLIEIGAKPKLVEAVLVVRLEGGRDFFVMVKGQYIPCVFGTPLEDLPTTMFPPNCPQVISTLVDYVFENISTAPGIFFEPLDGLRTPGGVAKIAETLQHGETDIDFGALGVNVYDVGEALVSLLSALPRRILDEPGVLDAVDAMKLDDPQPKEFAHGLLGRHLSTKAKAALVHIAALIKRLDEECAKTGARVHVTEMILTFATCLFPESTEQPNPRRVAFIGALAGCHPSFLRTLRAREVAPPPSEPSFLPGVDR

SEQ ID NO: 89700 - protein, 178 aa, Helicobacter hepaticus ATCC 51449
MDKQKIADSIRAVYNYKPGVIFRDITTLIGDAEVFKEVINILRSRYENQSIDFIAAIEARGFIFGSALAYALGIGFVPIRKKGKLPYNTISEKYTLEYGTDELHIHTDAFRDKKNAKVVLIDDLIATGGTAEASVKLIKSIGAQCVEAAFVINLKGLEGEKKLAPYTQVFSIVEYEGK

SEQ ID NO: 89701 - protein, 106 aa, Pinus resinosa
FVEKAEELKGKGIDEIICISVNDPFVMKEWAKTYTNNKHVKFLADGSAKYTYALGLEMDLSEKGLGIRSRRFALVVDNLEVKVANIEEGPTFEVSSAEEILKSVGA

SEQ ID NO: 89702 - protein, 126 aa, Acidobacteria bacterium Ellin345
MADLAQLEEQIVGLSLLDAAELVKKLESRLGVSAAAAAPVMVAGGGGAAAAAPVEEKTEFTVVLTAAGANKINVIKAVREVTSLGLKEAKDLVDGAPKTVKEGVSKDEAATIQKKFQEAGATVEVK

SEQ ID NO: 89703 - protein, 7257 aa, Sorangium cellulosum
MTTRGPTAQQNPLKQAAIIIQRLEERLAGLAQAELERTEPIAIVGIGCRFPGGADAPEAFWELLDAERDAVQPLDRRWALVGVAPVEAVPHWAGLLTEPIDCFDAAFFGISPREARSLDPQHRLLLEVAWEGLEDAGIPPRSIDGSRTGVFVGAFTADYARTVARLPREERDAYSATGNMLSIAAGRLSYTLGLQGPCLTVDTACSSSLVAIHLACRSLRAGESDLALAGGVSTLLSPDMMEAAARTQALSPDGRCRTFDASANGFVRGEGCGLVVLKRLSDAQRDGDRIWALIRGSAINHDGRSTGLTAPNVLAQETVLREALRSAHVEAGAVDYVETHGTGTSLGDPIEVEALRATVGPARSDGTRCVLGAVKTNIGHLEAAAGVAGLIKAALSLTHERIPRNLNFRTLNPRIRLEGSALALATEPVPWPRTDRPRFAGVSSFGMSGTNAHVVLEEAPAVELWPAAPERSAELLVLSGKSEGALDAQAARLREHLDMHPELGLGDVAFSLATTRSAMTHRLAVAVTSREGLLAALSAVAQGQTPAGAARCIASSSRGKLALLFTGQGAQTPGMGRGLCAAWPAFREAFDRCVTLFDRELDRPLREVMWAEAGSAESLLLDQTAFTQPALFAVEYALTALWRSWGVEPELLVGHSIGELVAACVAGVFSLEDGVRLVAARGRLMQGLSAGGAMVSLGAPEAEVAAAVAPHAAWVSIAAVNGPEQVVIAGVEQAVQAIAAGFAARGVRTKRLHVSHAFHSPLMEPMLEEFGRVAASVTYRRPSVSLVSNLSGKVVTDELSAPGYWVRHVREAVRFADGVKALHEAGAGTFLEVGPKPTLLGLLPACLPEAEPTLLASLRAGREEAAGVLEALGRLWAAGGSVSWPGVFPTAGRRVPLPTYPWQRQRYWIEAPAEGLGATAADALAQWFYRVDWPEMPRSSVDSRRARSGGWLVLADRGGVGEAAAAALSSQGCSCAVLHAPAEASAVAEQVTQALGGRNDWQGVLYLWGLDAVVEAGASAEEVGKVTHLATAPVLALIQAVGTGPRSPRLWIVTRGACTVGGEPDAAPCQAALWGMGRVAALEHPGSWGGLVDLDPEESPTEVEALVAELLSPDAEDQLAFRQGRRRAARLVAAPPEGNAAPVSLSAEGSYLVTGGLGALGLLVARWLVERGAGHLVLISRHGLPDREEWGRDQPPEVRARIAAIEALEAQGARVTVAAVDVADAEGMAALLAAVEPPLRGVVHAAGLLDDGLLAHQDAGRLARVLRPKVEGAWVLHTLTREQPLDLFVLFSSASGVFGSIGQGSYAAGNAFLDALADLRRTQGLAALSIAWGLWAEGGMGSQAQRREHEASGIWAMPTSRALAAMEWLLGTRATQRVVIQMDWAHAGAAPRDASRGRFWDRLVTVTKAASSSAVPAVERWRNASVVETRSALYELVRGVVAGVMGFTDQGTLDVRRGFAEQGLDSLMAVEIRKRLQGELGMPLSATLAFDHPTVERLVEYLLSQALELQDRTDVRSVRLPATEDPIAIVGAACRFPGGVEDLESYWQLLTEGVVVSTEVPADRWNGADGRGPGSGEAPRQTYVPRGGFLREVETFDAAFFHISPREAMSLDPQQRLLLEVSWEAIERAGQDPSALRESPTGVFVGAGPNEYAERVQDLADEAAGLYSGTGNMLSVAAGRLSFFLGLHGPTLAVDTACSSSLVALHLGCQSLRRGECDQALVGGVNMLLSPKTFALLSRMHALSPGGRCKTFSADADGYARAEGCAVVVLKRLSDAQRDRDPILAVIRGTAINHDGPSSGLTVPSGPAQEALLRQALAHAGVVPADVDFVECHGTGTALGDPIEVRALSDVYGQARPADRPLILGAAKANLGHMEPAAGLAGLLKAVLALGQEQIPAQPELGELNPLLPWEALPVAVARAAVPWPRTDRPRFAGVSSFGMSGTNAHVVLEEAPAVELWPAAPERSAELLVLSGKSEGALDAQAARLREHLDMHPELGLGDVAFSLATTRSAMNHRLAVAVTSREGLLAALSAVAQGQTPPGAARCIASSSRGKLAFLFTGQGAQTPGMGRGLCAAWPAFREAFDRCVALFDRELDRPLCEVMWAEPGSAESLLLDQTAFTQPALFTVEYALTALWRSWGVEPELVAGHSAGELVAACVAGVFSLEDGVRLVAARGRLMQGLSAGGAMVSLGAPEAEVAAAVAPHAAWVSIAAVNGPEQVVIAGVEQAVQAIAAGFAARGVRTKRLHVSHASHSPLMEPMLEEFGRVAASVTYRRPSVSLVSNLSGKVVTDELSAPGYWVRHVREAVRFADGVKALHEAGAGTFLEVGPKPTLLGLLPACLPEAEPTLLASLRAGREEAAGVLEALGRLWAAGGSVSWPGVFPTAGRRVPLPTYPWQRQRYWPDIEPDSRRHAAADPTQGWFYRVDWPEIPRSLQKSEEASRGSWLVLADKGGVGEAVAAALSTRGLPCVVLHAPAETSATAELVTEAAGGRSDWQVVLYLWGLDAVVGAEASIDEIGDATRRATAPVLGLARFLSTVSCSPRLWVVTRGACIVGDEPAIAPCQAALWGMGRVAALEHPGAWGGLVDLDPRASPPQASPIDGEMLVTELLSQETEDQLAFRHGRRHAARLVAAPPRGEAAPASLSAEASYLVTGGLGGLGLIVAQWLVELGARHLVLTSRRGLPDRQAWREQQPPEIRARIAAVEALEARGARVTVAAVDVADVEPMTALVSSVEPPLRGVVHAAGVSVMRPLAETDETLLESVLRPKVAGSWLLHRLLHGRPLDLFVLFSSGAAVWGSHSQGAYAAANAFLDGLAHLRRSQSLPALSVAWGLWAEGGMADAEAHARLSDIGVLPMSTSAALSALQRLVETGAAQRTVTRMDWARFAPVYTARGRRNLLSALVAGRDIIAPSPPAAATRNWRGLSVAEARMALHEVVHGAVARVLGFLDPSALDPGMGFNEQGLDSLMAVEIRNLLQAELDVRLSTTLAFDHPTVQRLVEHLLVDVLKLEDRSDTQHVRSLASDEPIAIVGAACRFPGGVEDLESYWQLLAEGVVVSAEVPADRWDAADWYDPDPEIPGRTYVTKGAFLRDLQRLDATFFRISPREAMSLDPQQRLLLEVSWEALESAGIAPDTLRDSPTGVFVGAGPNEYYTQRLRGFTDGAAGLYGGTGNMLSVAAGRLSFFLGLHGPTLAMDTACSSSLVALHLACQSLRLGECDQALVGGVNVLLAPETFVLLSRMRALSPDGRCKTFSADADGYARGEGCAVVVLKRLRDAQRAGDSILALIRGSAVNHDGPSSGLTVPNGPAQQALLRQALSQAGVSPVDVDFVECHGTGTALGDPIEVQALSEVYGPGRSEDRPLVLGAVKANVAHLEAASGLASLLKAVLALRHEQIPAQPELGELNPHLPWNTLPVAVPRKAVPWGRGARPRRAGVSAFGLSGTNVHVVLEEAPEVELVPAAPARPVELVVLSAKSAAALDAAAERLSAHLSAHPELSLGDVAFSLATTRSPMEHRLAIATTSREALRGALDAAAQRQTPQGAVRGKAVSSRGKLAFLFTGQGAQMPGMGRGLYEAWPAFREAFDRCVALFDRELDQPLREVMWAAPGLAQAARLDQTAYAQPALFALEYALAALWRSWGVEPHVLLGHSIGELVAACVAGVFSLEDAVRLVAARGRLMQALPAGGAMVAIAASEAEVAASVAPHAATVSIAAVNGPDAVVIAGAEVQVLALGATFAARGIRTKRLAVSHAFHSPLMDPMLEDFQRVAATIAYRAPDRPVVSNVTGHVAGPEIATPEYWVRHVRSAVRFGDGAKALHAAGAATFVEIGPKPVLLGLLPACLGEADAVLVPSLRADRSECEVVLAALGTWYAWGGALDWKGVFPDGARRVALPMYPWQRERHWMDLTPRSAAPAGIAGRWPLAGVGLCMPGAVLHHVLSIGPRHQPFLGDHLVFGKVVVPGAFHVAVILSIAAERWPERAIELTGVEFLKAIAMEPDQEVELHAVLTPEAAGDGYLFELATLAAPETERRWTTHARGRVQPTDGAPGALPRLEVLEDRAIQPLDFAGFLDRLSAVRIGWGPLWRWLQDGRVGDEASLATLVPTYPNAHDVAPLHPILLDNGFAVSLLATRSEPEDDGTPPLPFAVERVRWWRAPVGRVRCGGVPRSQAFGVSSFVLVDETGEVVAEVEGFVCRRAPREVFLRQESGASTAALYRLDWPEAPLPDAPAERMEESWVVVAAPGSEMAAALATRLNRCVLAEPKGLEAALAGVSPAGVICLWEPGAHEEAPAAAQRVATEGLSVVQALRDRAVRLWWVTTGAVAVEAGERVQVATAPVWGLGRTVMQERPELSCTLVDLEPEVDAARSADVLLRELGRADDETQVVFRSGERRVARLVKATTPEGLLVPDAESYRLEAGQKGTLDQLRLAPAQRRAPGPGEVEIKVTASGLNFRTVLAVLGMYPGDAGPMGGDCAGIVTAVGQGVHHLSVGDAVMTLGTLHRFVTVDARLVVRQPAGLTPAQAATVPVAFLTAWLALHDLGNLRRGERVLIHAAAGGVGMAAVQIARWIGAEVFATASPSKWAAVQAMGVPRTHIASSRTLEFAETFRQVTGGRGVDVVLNALAGEFVDASLSLLTTGGRFLEMGKTDIRDRAAVAAAHPGVRYRVFDILELAPDRTREILERVVEGFAAGHLRALPVHAFAITKAEAAFRFMAQARHQGKVVLLPAPSAAPLAPTGTVLLTGGLGALGLHVARWLAQQGAPHMVLTGRRGLDTPGAAKAVAEIEALGARVTIAASDVADRNALEAVLQAIPAEWPLQGVIHAAGALDDGVLDEQTTDRFSRVLAPKVTGAWNLHELTAGNDLAFFVLFSSMSGLLGSAGQSNYAAANTFLDALAAHRRAEGLAAQSLAWGPWSDGGMAAGLSAALQARLARHGMGALSPAQGTALLGQALARPETQLGAMSLDVRAASQASGAAVPPVWRALVRAEARHAAAGAQGALAARLGALPEARRADEVRKVVQAEIARVLSWGAASAVPVDRPLSDLGLDSLTAVELRNVLGQRVGATLPATLAFDHPTVDALTRWLLDKVLAVAEPSVSPAKSSPQVALDEPIAVIGIGCRFPGGVTDPESFWRLLEEGSDAVVEVPHERWDIDAFYDPDPDVRGKMTTRFGGFLSDIDRFEPAFFGISPREATTMDPQQRLLLETSWEAFERAGILPERLMGSDTGVFVGLFYQEYAALAGGIEAFDGYLGTGTTASVASGRISYVLGLKGPSLTVDTACSSSLVAVHLACQALRRGECSVALAGGVALMLTPATFVEFSRLRGLAPDGRCKSFSAAADGVGWSEGCAMLLLKPLRDAQRDGDPILAVIRGTAVNQDGRSNGLTAPNGSSQQEVIRRALEQAGLAPADVSYVECHGTGTTLGDPIEVQALGAVLAQGRPSDRPLVIGSVKSNIGHTQAAAGVAGVIKVALALERGLIPRSLHFDAPNPHIPWSELAVQVAAKPVEWTRNGAPRRAGVSSFGVSGTNAHVVLEEAPAAAFAPAAARSAELFVLSAKSAAALDAQAARLSAHVVAHPELGLGDLAFSLATTRSPMTYRLAVAATSREALSAALDTAAQGQAPPAAARGHASTGSAPKVVFVFPGQGSQWLGMGQKLLSEEPVFRDALSACDRAIQAEAGWSLLAELAADETTSQLGRIDVVQPALFAIEVALSALWRSWGVEPDAVVGHSMGEVAAAHVAGALSLEDAVAIICRRSLLLRRISGQGEMAVVELSLAEAEAALLGYEDRLSVAVSNSPRSTVLAGEPAALAEVLAILAAKGVFCRRVKVDVASHSPQIDPLRDELLAALGELEPRQATVSMRSTVTSTIVAGPELVASYWADNVRQPVRFAEAVQSLMEGGHGLFVEMSPHPILTTSVEEIRRATKREGVAVGSLRRGQDERLSMLEALGALWVHGQAVGWERLFSAGGAGLRRVPLPTYPWQRERYWVEAPTGGAASGSRFAHAGSHPLLGEMQTLSTQRSTRVWETTLDLKRLPWLGDHRVQGAVVFPGAAYLEMALSSGAEALGDGPLQVSDVVLAEALAFADDTPVAVQVMATEERPGRLQFHVASRVPGHGRAAFRSHARGVLRQTERAEVPARLDLAALRARLQASAPAAATYAALAEMGLEYGPAFQGLVELWRGEGEALGRVRLPEAAGSPAACRLHPALLDACFHVSSAFADRGEATPWVPVEIGSLRWFQRPSGELWCHARSVSHGKPTPDRRSTDFWVVDSTGAIVAEISGLVAQRLAGGVRRREEDDWFMEPAWEPTAVPGSEVTAGRWLLIGSGGGLGAALYSALTEAGHSVVHATGHGTSAAGLQALLTASFDGQAPTSVVHLGSLDERGVLDADAPFDADALEESLVRGCDSVLWTVQAVAGAGFRDPPRLWLVTRGAQAIGAGDVSVAQAPLLGLGRVIALEHAELRCARIDLDPARRDGEVDELLAELLADDAEEEVAFRGGERRVARLVRRLPETDCREKIEPAEGRPFRLEIDGSGVLDDLVLRATERRPPGPGEVEIAVEAAGLNFLDVMRAMGIYPGPGDGPVALGAECSGRIVAMGEGVESLRIGQDVVAVAPFSFGTHVTIDARMVAPRPAALTAAQAAALPVAFMTAWYGLVHLGRLRAGERVLIHSATGGTGLAAVQIARHLGAEIFATAGTPEKRAWLREQGIAHVMDSRSLDFAEQVLAATKGEGVDVVLNSLSGAAIDASLATLVPDGRFIELGKTDIYADRSLGLAHFRKSLSYSAVDLAGLAVRRPERVAALLAEVVDLLARGALQPLPVEIFPLSRAADAFRKMAQAQHLGKLVLALEDPDVRIRVPGESGVAIRADGTYLVTGGLGGLGLSVAGWLAEQGAGHLVLVGRSGAVSAEQQTAVAALEAHGARVTVARADVADRAQIERILREVTASGMPLRGVVHAAGILDDGLLMQQTPARFRAVMAPKVRGALHLHALTREAPLSFFVLYASGAGLLGSPGQGNYAAANTFLDALAHHRRAQGLPALSIDWGLFADVGLAAGQQNRGARLVTRGTRSLTPDEGLWALERLLDGDRTQAGVMPFDVRQWVEFYPAAASSRRLSRLVTARRVASGRLAGDRDLLERLATAEAGARAGMLQEVVRAQVSQVLRLPEGKLDVDAPLTSLGMDSLMGLELRNRIEAVLGITMPATLLWTYPTVAALSAHLASHVVSTGDGESARPPDTGNVAPMTHEVASLDEDGLFALIDESLARAGKR

SEQ ID NO: 89704 - protein, 503 aa, Chrysanthemum lavandulifolium
MTTIPSRQLFIDGEWREPVKKNRIPVINPSTEQIVGDIPAATAEDVDVAVKAARKALKRNGGKDWASATGAHRAKYLRAIAAKITGKKELFSKLEAIDCGKPYDEAAWDIDDVAGCFEYNADLAEALDKKQNAPIELPMDTFKCHVIKEPIGVVGLITPWNYPLLMATWKVAPALAAGCAAILKPSELASLTCLELGEVCKEVGLPAGVLNILTGLGPDAGAPLAAHPDVDKIAFTGSSATGSKIMTAAAPNVKPVTLELGGKSPIVVFDDVDIDKAVEWTLFGCFWTNGQICSATSRLILHESIAKEFLDKLVKWAKNIKISDPLEEGCRLGPVVSSGQYERVLKFVETARSEGATILSGGQRPQHLKKGFFIEPAIITDITTSMQIWRDEVFGPVLCVKTFSSEEEAIELANDTHYGLGSAVISNDLDRCDRVTRAFDAGIVWVNCSQPCFCQAPWGGKKRSGFGRELGEWGLDNYLSVKQVTRYISNDAWGWYTPPSPKL

SEQ ID NO: 89705 - protein, 2439 aa, Sorangium cellulosum
MATTNAGKLEHALLLMDKLAKKNASLEQERTEPIAIIGIGCRFPGGADTPEAFWELLDSGRDAVQPLDRRWALVGVHPSEEVPRWAGLLTEAVDGFDAAFFGTSPREARSLDPQQRLLLEVTWEGLEDAGIAPQSLDGSRTGVFLGACSSDYSHTVAQQRREEQDAYDITGNTLSVAAGRLSYTLGLQGPCLTVDTACSSSLVAIHLACRSLRARESDLALAGGVNMLLSSKTMIMLGRIQALSPDGHCRTFDASANGFVRGEGCGMVVLKRLSDAQRHGDRIWALIRGSAMNQDGRSTGLMAPNVLAQEALLRQALQSARVDAGAIDYVETHGTGTSLGDPIEVDALRAVMGPARADGSRCVLGAVKTNLGHLEGAAGVAGLIKAALALHHESIPRNLHFHTLNPRIRIEGTALALATEPVPWPRAGRPRFAGVSAFGLSGTNVHVVLEEAPATVLAPATPGRSAELLVLSAKSTAALDAQAARLSAHIAAYPEQGLGDVAFSLVATRSPMEHRLAVAATSREALRSALEAAAQGQTPAGAARGRAASSPGKLAFLFAGQGAQVPGMGRGLWEAWPAFRETFDRCVTLFDRELHQPLCEVMWAEPGSSRSSLLDQTAFTQPALFALEYALAALFRSWGVEPELIAGHSLGELVAACVAGVFSLEDAVRLVVARGRLMQALPAGGAMVSIAAPEADVAAAVAPHAASVSIAAVNGPEQVVIAGAEKFVQQIAAAFAARGARTKPLHVSHAFHSPLMDPMLEAFRRVTESVTYRRPSMALVSNLSGKPCTDEVCAPGYWVRHAREAVRFADGVKALHAAGAGIFVEVGPKPALLGLLPACLPDARPVLLPASRAGRDEAASALEALGGFWVVGGSVTWSGVFPSGGRRVPLPTYPWQRERYWIEAPVDGEADGIGRAQAGDHPLLGEAFSVSTHAGLRLWETTLDRKRLPWLGEHRAQGEVVFPGAGYLEMALSSGAEILGDGPIQVTDVVLIETLTFAGDTAVPVQVVTTEERPGRLRFQVASREPGARRASFRIHARGVLRRVGRAETPARLNLAALRARLHAAVPAAAIYGALAEMGLQYGPALRGLAELWRGEGEALGRVRLPESAGSATAYQLHPVLLDACVQMIVGAFADRDEATPWAPVEVGSVRLFQRSPGELWCHARVVSDGQQAPSRWSADFELMDGTGAVVAEISRLVVERLASGVRRRDADDWFLELDWEPAALEGPKITAGRWLLLGEGGGLGRSLCSALKAAGHVVVHAAGDDTSAAGMRALLANAFDGQAPTAVVHLSSLDGGGQLDPGLGAQGALDAPRSPDVDADALESALMRGCDSVLSLVQALVGMDLRNAPRLWLLTRGAQAAAAGDVSVVQAPLLGLGRTIALEHAELRCISVDLDPAQPEGEADALLAELLADDAEEEVALRGGERFVARLVHRLPEAQRREKIAPAGDRPFRLEIDEPGVLDQLVLRATGRRAPGPGEVEIAVEAAGLDSIDIQLAVGVAPNDLPGGEIEPSVLGSECAGRIVAVGEGVNGLVVGQPVIALAAGVFATHVTTSATLVLPRPLGLSATEAAAMPLAYLTAWYALDKVAHLQAGERVLIRAEAGGIGLCAVRWAQRVGAEVYATADTPEKRAYLESLGVRYVSDSRSGRFAADVHAWTDGEGVDVVLDSLSGEHIDKSLMVLRACGRLVKLGRRDDCADTQPGLPPLLRNFSFSQVDLRGMMLDQPARIRALLDELFGLVAAGAISPLGSGLRVGGSLTPPPVETFPISRAAEAFRRMAQGQHLGKLVLTLDDPEVRIRAPAESSVAVRADGTYLVTGGLGGLGLRVAGWLAERGAGQLVLVGRSGAASAEQRAAVAALEAHGARVTVAKADVADRSQIERVLREVTASGMPLRGVVHAAGLVDDGLLMQQTPARLRTVMGPKVQGALHLHTLTREAPLSFFVLYASAAGLFGSPGQGNYAAANAFLDALSHHRRAHGLPALSIDWGMFTEVGMAVAQENRGARLISRGMRGITPDEGLSALARLLEGDRVQTGVIPITPRQWVEFYPATAASRRLSRLVTTQRAVADRTAGDRDLLEQLASAEPSARAGLLQDVVRVQVSHVLRLPEDKIEVDAPLSSMGMDSLMSLELRNRIEAALGVAAPAALGWTYPTVAAITRWLLDDALAVRLGGGSDTDESTASAGSFVHVLRFRPVVKPRARLFCFHGSGGSPEGFRSWSEKSEWSDLEIVAMWHDRSLASEDAPGKKYVQEAASLIQHYADAPFALVGFSLGVRFVMGTAVELASRSGAPAPLAVFALGGSLISSSEITPEMETDIIAKLFFRNAAGFVRSTQQVQADARADKVITDTMVAPAPGDSKEPPSKIAVPIVAIAGSDDVIVPPSDVQDLQSRTTERFYMHLLPGDHEFLVDRGREIMHIVDSHLNPLLAARTTSSGPAFEAK

SEQ ID NO: 89706 - protein, 506 aa, Chrysanthemum lavandulifolium
MTTTIPIPSRQLFIDGEWREPVKKNRISVINPSTEQIVGDIPAATAEDVDVAVKAARKALKRNGGKDWASATGAHRAKYLRAIAAKITEKKELFSKLEAIDCGKPYDEAAWDIDDVAGCFEYNADLAEALDKKQNAPIELPMDTFKCHVIKEPIGVVGLITPWNYPLLMATWKVAPALAAGCAAILKPSELASLTCLELGEVCKEVGLPAGVLNILTGLGPDAGAPLAAHPDVDKIALTGSSATGSKIMTAAAQNVKPVTLELGGKSPIVVFDDVDIDKAVEWTLFGCFWTNGQICSATSRLILHESIAKEFLDKLVKWAKNIKISDPLEEGCRLGPVVSSGQYEKVLKFVETARSEGATILSGGQRPQHLKKGFFIEPAIITDITTSMQVWREEVFGPVLCVKTFSSEEEAIELANDTHYGLGSAVISNDLDRCDRVTRAFDAGIVWVNCSQPCFCQAPWGGKKRSGFGRELGEWGLDNYLSVKQVTRYISNDAWGWYTPPSPKL

SEQ ID NO: 89707 - protein, 341 aa, Idiomarina baltica OS145
MKALAKLHSKPGIWMTDVEKPEFGYNDVLIKIKKTAICGTDVHIYKWDDWSQKTIPVPMVVGHEYVGEVAAMGDGVRGFEVGDRVSGEGHITCGHCRNCRAGRRHLCRNTYGVGVNRPGAFAEYLVIPADNAFKLPDDVTDDMAAIMDPLGNAVHTALAFDLVGEDVLITGAGPIGIMAAAVARHVGARHVVITDVNEYRLELAKKMGVTRAVNVAEESLKDVMSELGMKEGFDVGLEMSGVPSAFSQMLATMNHGGKVAMLGIPPENVAIDWNEVIFKGLVIKGIYGREMFETWYKMASLLQSGLDISPILTHQMSVDDYEEGFETMVSGQSGKVILNWD

SEQ ID NO: 89708 - protein, 520 aa, Staphylococcus aureus subsp. aureus MRSA252
MAYFNQHQSMISKRYLTFFSKSKKKKPFSTGQLIGLILGPLLFLLTLLFFHPQDLPWKGVYVLAITLWIATWWITEAIPIAATSLLPIVLLPLGHILTPEQVSSEYGNDIIFLFLGGFILAIAMERWNLHTRVALTIINLIGASTSKILLGFMVATGFLSMFVSNTAAVMIMIPIGLAIIKEAHDLQEANTNQTSIQKFEKSLVLAIGYAGTIGGLGTLIGTPPLIILKGQYMQHFGHEISFAKWMIVGIPTVIVLLGITWLYLRYVAFRHDLKYLPGGQTLIKQKLDELGKMKYEEKVVQTIFVLASLLWITREFLLKKWEVTSSVADGTIAIFISILLFIIPAKNTEKHRRIIDWEVAKELPWGVLILFGGGLALAKGISESGLAKWLGEQLKSLNGVSPILIVIVITIFVLFLTEVTSNTATATMILPILATLSVAVGVHPLLLMAPAAMAANCAYMLPVGTPPNAIIFGSGKISIKQMASVGFWVNLISAIIIILVVYYIMPIVLGIDINQPLPLK

SEQ ID NO: 89709 - protein, 417 aa, Coxiella burnetii RSA 493
MDIYTLGSIVLTFAVLIAYVNHRFIRMQSTIAIMSASLLLSAIFIIFHHFHIANIGQLTENVIENIDFPDLLLKGLLNFLLFAGALTIDFNMLKAQKWEIGMLASLSTIVSTVLIAFILYYFLQFLHLDLPFLYCLLFGALISPTDPIAVLATFKQLGAPERLTACVAGESLFNDGVGIVLFITFYALTVNHIPATIEKISLLFLRQAVGGIIYGLLLGFITTQLLKSVKDYSLSILLTLAAVTGGYQLALALGISGPLAMVITGIMVGAYIRRDQDETHKKKTKALETFWEVIDEVLNAILFLLIGFELLAIKASTLQIVAILLTIPLVLLVRLITVSIPIKFIQLKRNHNPYIISILTWGGLRGGLAVALALSLPFNEYRNFILGMTYGVVIFSIIVQGLTIKPLTRLARRSHEG

SEQ ID NO: 89710 - protein, 497 aa, Zea mays
  misc_feature (13)..(13): Xaa can be any naturally occurring amino acid
MFSHGADSAHDAXGAVGVSSGGATVPTRFVWPYGGKRVFVSGSFTRWSEHLPMSPIEGCPTVFQAICSLSPGIHEYKFFVDGEWRHDERQPTISGEFGIVNTLYLTREYNQINTLSSPSTPGSRMNMDVDNENFQRTVTLSDGTVSEGTLRVSEAAIQISRCRVSEYLSLHTCYDLLPDSGKVIALDINLPVKQSFHILHEQGIPVAPLWDSFRGQFVGLLSPLDFILILRELETHGSNLTEEQLETHTISAWKEAKRQTNGRNDGQWRPQQHLVHATPYESLRDIAVKLLQNGISTVPVIYSSSSDGSFPQLLHLASLSGILKCICRYFKNSTGNLPILNQPVCSIPLGSWVPKIGDLNSRPLAMLRPNASLSSALNMLVQAGVSSIPIVDDNDSLLDTYSRSDITALAKAKVYTHVRLDEMTIHQALQLGQDANTPFGFFNGQRCQMCLRSDPLLKVMERLANPGVRRVFIVEAGSKRVEGIISLSDIFKFLLSL

SEQ ID NO: 89711 - protein, 415 aa, Bupleurum falcatum
MGSLGAFLKHPDDLYPLLKLKYAVKHAEKQIPPQPHWAFCYSMLHKVSRSFGLVIQQLGPQLRDAVCIFYLVLRALDTVEDDTSISSEVKVPILMEFHRHIYNNSWHFSCGTKEYKILMDGFHHVSNAFLELGKGYQEAIEDITMRMGAGMAKFICKEVESIDDYDEYCHYVAGLVGLGLSKLFHASGAEDLATDALSNSMGLFLQKTNIIRDYLEDINEIPKSRMFWPRQIWSKYVDKLEDLKYEENSAKAVQCLNDMVTNALIHAEDCLKYMSDLRDPANFRFCAIPQIMAIGTLSLCFNNIQVFRGVVKMRRGLTAKIIDRTKTMSDVYGAFFDFSCLLKAKVDHDDPSAKITLSRLEAIQQTCKNSGTLTKSRKSYILENESRYNSVLIAIIFIILAFFYAYLSSNLSNNA

SEQ ID NO: 89712 - protein, 643 aa, Klebsiella pneumoniae
MAEFETTFADLGLKAPILEALTDLGYEKPSPIQAECIPHLLDGRDVLGMAQTGSGKTAAFSLPLLNNIDPELRAPQILVLAPTRELAVQVAEAMTEFSKHMRGVNVVALYGGQRYDVQLRALRQGPQIVVGTPGRLLDHLKRGTLDLSKLSGLVLDEADEMLRMGFIEDVETIMAQIPEGHQTALFSATMPEAIRRITRRFMKEPQEVRIQSSVTTRPDISQSYWTAYGMRKNEALVRFLEAEDFDAAIIFVRTKNATLEVAEALERNGYNSAALNGDMNQALREQALERLKDGRLDILIATDVAARGLDVERISLVVNYDIPMDSESYVHRIGRTGRAGRAGRALLFVENRERRLLRNIERTMKLTIPEVELPNAELLSKRRLEKFAAKVQQQLESSDLDQYRALLAKIHATAEGEELDVETLAAALLKMAQGERSLIVPPVAPMRPRREFRDRDDSFDRRGDRNDRGPRGDREDRPKRERRDVGDMELYRIEVGRDDGVEVRHIVGAIANEGDISSRYIGNIKLFASHSTIELPKGMPGEVLQHFTRTRILNKPMNMQLLGDAQPRTERRGGGERREGGRGFGGERREGGRGFGGERREGGRGEGRRFSGERREGRAPGRDDASAPRRDDSAGRRRFGGDA

SEQ ID NO: 89713 - protein, 405 aa, Helicobacter pylori J99
MLIVQKYGGTSMGSIERIHNVAQRVLESVKLGHQVVVVVSAMSGETDRLLEFGKNFSHNPNKREMDRIVSAGEWISSAALSMALERYGHRAISLSGKEAGILTSSHFQNAVIQSIDTQRITELLEKNYIVVIAGFQGADIQGETTTLGRGGSDLSAVALAGALKAHLCEIYTDVDGVYTTDPRIEEKAQKIAQISYDEMLELASMGAKVLLNRSVELAKKLSVKLVTRNSFNHSEGTLIVAEKDFKGERMETPIVSGIALDKNQARVSMEGVEDRPGIAAEIFGALAEYRINVDMIVQTIGRDGKTDLDFTIVKTQIEETKQALKPFLAQMDSIDYDENIAKVSIVGVGMKSHSGVASIAFKALAKDNINIMMISTSEIKISVLIDIKYAELAVRTLHAVYQLDQ

SEQ ID NO: 89714 - protein, 474 aa, Shewanella sp. MR-4
MNMATDPAKISPLTELLQRQRASYLAAPNPDYAIRKERLIRLKATLLKFQQPLVEALSQDYGHRSVDDSLISDIMPVVNNINYSLKNLKKWLKPSRRHAGILLAPAQVKVHYQPLGVIGIIVPWNFPVMLSISPLVTAIAAGNHAMLKLSEFTPATNSVIKQLLAEVFEESHVAVVEGEADVAAQFSALPFDHLLFTGSTTVGRHVMRAAANNLTPVTLELGGKSPVIIAPDMPLEIAVERMIYGKCLNAGQICVAPDYVLCPKAKVAEFIQAYQTKFQAMYGAITQNKDYGSIINARQFERLLSVLEDAKAKGAKVIPASNDVIDSQHRKLATQLITDTTEDMLLMQEEIFGPLLPVIGYDSLDEAISYVNHRARPLALYVMSFDEASQQKILKQTHSGGVCINETVFHVAADDAPFGGIGPSGMGHYHGKEGFLTFSHAKTVLSRGRFNTGKFVHPPYGTFIQRMLMKLFLR

SEQ ID NO: 89715 - protein, 788 aa, Arabidopsis thaliana
MRCDNNYSFSILFSLLLILILDSKVVSLSTSCQSKSVCGNINIPYPFGIEKGCYLNEWYKIECKNATYPFLFKMGMAVVNISLPGDDGYNNPVSYGSIRVKIPITSIGCSRDGKESGSVLNFTDSPFYFGIGNSLVAVGCNSKASLTNINPSKVGCELNCTASKETLPSKSIPFFDKTGCSNNKLPYYSSLCTKNNGEDERSCDGNGCCIAGLLDSEAPQVIGINIESFDHGNSTKLECRVAFLTDDVSPFSNASEPKRLFAKRYATVSLGWVIQTKNLSFVNSLSCKNTKEYDNSTYNIKLVTSCICNNVTISGTDYANCGCSQGYEGNPYLPGGCKDINECLRNSYGQRQNCRESDTCVNLPGTFNCIGNKTRVTMIGVGSAFGILVLVVGIWWLRKFLKKRRMSKRKRKFFKRNGGLLLQQQLNTNKGNVEKTRIFSSRELEKATDNFSESRILGQGGQGTVYKGMLVDGRTVAVKKSKVVDEDKLEEFINEVVILSQINHRHVVKLLGCCLETEVPTLVYEFIPNGNLFQHIHEESDDYTKTWGMRLRIAVDIAGALSYLHSAASSPIYHRDIKSTNILLDEKYRTKVSDFGTSRSVTIDHTHWTTVISGTVGYVDPEYYGSSQYTDKSDVYSFGVVLVELITGEKPVITVSNSQEIRGLADHFRVAMKENRFFEIMDARIRDGCKPEQVMAVANLARRCLNSKGKKRPCMRKVFTDLEKILASQEDSLVNIENDDGADDEEEGMTMINIDDSQTIYVTAPAPSIVASSSSSDVQPLFPHPTWI

SEQ ID NO: 89716 - protein, 605 aa, Zea mays
MDTHIGSVNGAASNQTVGCPASAPGCPMASTPAQPAATLSAGEASLGRHLARRLVQVGVNDVFAVPGDFNLTLLDHLIAEPGLRLVGCCNELNAGYAADGYARARGVGACAVTFTVGGLSVLNAIAGAYSENLPVICIAGGPNSNDYGTNRILHHTIGLPDFSQELRCFQTVTCHQAVVNNLDDAHEQIDTAIATALRESKPVYLSISCNLPGLPHPTFSRDPVPFFLTPRSNKMGLEAAVEATVEFLNKAVKPVLVAGPKLRVAKAGKAFVDMVDASGYAYAVMPSAKGLVPETHPHFIGTYWGAVSTAFCAEIVESADAYLFAGPIFNDYSSVGYSFLLKKEKAIIVQPERVIVGNGPAFGCVMMKEFLSELAKRVNKNTTAYENYKRIFVPEGQPLESEPNEPLRVNVLFKHVQKMLTGDSAVIAETGDSWFNCQKLKLPEGCGYEFQMQYGSIGWSVGALLGYAQGANHKRVIAFIGDGSFQVTAQDVSTMLRCEQNSIIFLINNGGYTIEVEIHDGPYNVIKNWNYTGFVDAIHNGLGKCWTSKVKSEEELTAAIETALGEKKDCLCFIEVIAHKDDTSKELLEWGSRVSAANSRPPNPQ

SEQ ID NO: 89717 - protein, 500 aa, Legionella pneumophila subsp. pneumophila str. Philadelphia 1
MMIRNSMKSHTELLSWNLLQKEADRVRLNSDSLTCVVPDSNNYESSKQINCIEYDYSRQRVNRTIIDLLIDLANEVKLQEKIDNLINGKKINISENRPALHTALRDLGNKSIMIDGLDIMSAVINTREKIKVISNQIREKKWLGHSGLPITDIVNIGIGGSDLGPRVCINALSNYISKEFNYHFISDVDPASFNDVIAKINPQTTLFIVSSKSFTTKETLLNARKAFALYEDTASIDQHFIAVTAHPERAYQMGIKTVLPIWDWVGGRFSFCSAVNLITAIAIGYEQFVELLAGAHDVDTHVQFTDFKNNIPVLMALIGIWNNNFLNIHNLLILTYSKKLEYFVPYVQQLDMESNGKSIDVNGSMVDYATGPIVWGGLGNQAQHSYFQLLCQGTHRCVGDFITLKTNDEHEINSMCHYKMKVLSEGIQTIENPYGYIPGNMPMNHLILSDCSPYTLGALVALYEHKIFVQSVIWNINPFDQPGIESAKSAHREITLSSES

SEQ ID NO: 89718 - protein, 193 aa, Arabidopsis thaliana
KGGKLDKDKMTALEKHVSFFDRNKDGTVYPWETYQGFRALGTGRLLAAFVAIFINMGLSKKTRPGKGFSPLFPIDVKNSHLCMHGSDTDVYDDDGRFVESKFEEIFNKHARTHKDALTAEEIQKMLKTNRDPFDITGWLSDYGEWKILHTLAQDKNGLLSEKSVRAIYDGSLFHQLEKKRSSSSSRGKKQKLP

SEQ ID NO: 89719 - protein, 141 aa, Geobacillus kaustophilus HTA426
MQTVRDVMSTDVQYCTPLDNLYEAAVKMRDFNVGAIPIIDDGRLVGMITDRDIVVRGMAEKRPGSTAVTEVMSRDLVTLSPDDSVQKAADMMARHQIRRLPVVENGRLVGIISLGDLATNRYSDERAGRALSEISEQDAIH

SEQ ID NO: 89720 - protein, 305 aa, Legionella pneumophila subsp. pneumophila str. Philadelphia 1
MLFVQRKIESRLDIMKGIILAGGFGTRLYPLTKSISKHMIPVYDKPMIYYAISTLMLANIREILIISTEEHLPLYQNLLSDGSQWGISFAYLVQNEPRGIAEAFILGEKFIGNDSVCLVLGDNIHQGRGFSELLQNAKSKLNGATVFAYYVDKPQAYGVVEFNEKQQVLSIVEKPAQPKSNYAVTGLYFYDNQVIEIAKSLKPSGRGELEITDINQFYLYENKLDVQILGRGFVWLDMGTPETLLSASNYICTIEQRQGLKIGCPEEIAWRMKFISDDELLCRARELNKSSYGQYLAELLNHKRY

SEQ ID NO: 89721 - protein, 366 aa, Helicobacter hepaticus ATCC 51449
MGLSIGIVGLPNVGKSTTFNALTKAQNAEAANYPFCTIEPNKAVVSVPDVRLQELAKIVNPQKIQHSVVEFVDIAGLVRGASKGEGLGNQFLANIKECNMILHIVRCFEDSNITHIEGRIDPIDDIEIIELELLFADMASLNKRIEKLQRESKSQKGVNTQLTLCQELLAHLESNKPVRSFAKRESEEFIALNKDLRFLTNKEVIYGANVNEEGLESDNEFVQKVREYAAQNDGIAIKLCAKIEEEMVDMSDDERTEFLVSLGAKQSGLTQIIREGFARLGLISYFTAGVKEVRAWSIRKGDSAPKAASVIHKDFEKGFIRAECISYADFIKYGGEAKAKEAGAMRIEGKEYIVQDGDVMHFRFNV

SEQ ID NO: 89722 - protein, 222 aa, Oenococcus oeni PSU-1
MSKLVLIRHGESTANHDNIFTGWTDVPLTEKGISQAHVAGKQLSHSGIDFDIVYTSMLQRAIVTSYIILNEINQAWLPIVKSWRLNERHYGALRGLNKAETAQKYGDTQVREWRRSYTTVPPLLGHEESSERYLKLGIKEPLGESAEMSWKRVQPFWEDQIAKQLRSEKNVLLVAHGSSIRVLLKFLDRISDDNFMKVEVGNGEPIIYNFDQQLKVISKSNL

SEQ ID NO: 89723 - protein, 146 aa, Alteromonadales bacterium TW-7
MLKWKDVINFANNGNPAPSKKVIKTDEQWREQLSENEYYVTRMKGTERPDMSGSCTLLEPGKYVCVCCDNLLFDADEKFESGTGWPSFTQPATIEAIGYVRDVSHGMERVEVVCNVCDAHLGHIFPDGPLPTGLRYCVNGAAMKKL

SEQ ID NO: 89724 - protein, 130 aa, Brassica napus
RPTRPRKMKERYAVTDMMKLANRMAFGTPEESSLGDGLGEGYGMLGQAGSNRLRISTVPSKLKINPTIAKKLKERNYAGGATTSGLTSSLAFTPVQGIELCNPQQALGLGSGTQSTYFSESGTFSKLKKI

SEQ ID NO: 89725 - protein, 628 aa, Nectria haematococca
MDNRSNDIDAAAKGTCEWLLRHKTYIRWASCGRGLLWIKGKPGSGKSTLLRNVLNNATPRLKTEEGALILSFFFHGRGSELQKTPLGLFRSLLHQLLRQASKALEDKDLLSIFQQRCETIGKPGEKWQWHPSELPRLFESSLPKVLETHPVWLFVDALDECGKENAVKLVKVFKSLLQGLPSSDSKEFCICFTCRHYPILDLGGVFEVCLEDENRKDIATFVQHELSSFRERMLSTIPVLITQRADGVFLWAMLVVKKVLDLELEGAGLKEIKAAILSVPQELDALYRQLIQSMSMDSLKLVQWICFAMRPLSLEEWRWAMLIDADCPYRSLHECQTAADYPSDDDGMKRRVQTLSRGLAEVTSDVKVIQFIHQSVKDFFVEKGLSALDGSANPDAVVGMAHHRLSRTCIRYLAMEEIGRLTSDERYPYHLQSESSFHSMAMEEIGQSESDEHYSYYLKTRFPFLHYATTSWMAHTKQSDARSIPQEDLLEHFAGPNTLMGRWVHIYRTLEKRARDSPPEGTSLAHVLSRYGVAGALRAILERADQSGIDIDSKDSEGQTPLACATEKGHGAIVRLLLDRGAYIEAADEWGRTPLALTIEKGHEAIVRLLLDQGAHIEAADKWGQTPL

SEQ ID NO: 89726 - protein, 639 aa, Xanthomonas oryzae pv. oryzae KACC10331
MHARMRALHPAGRAIFARQWLALRPAAGHNRGFPILLPEFPRMAEIKEALVPDIGDYSDVPVIEVLVSVGDTVSKDQSLVTLESDKATMEVPSSVSGVVKEIKVKLGDSLSQGALVALIEVADAGVDAGAAAAAKPAAAAAAPAAPAKAAPASAPAPAAKAEAAAPAASSNGGLTEARVPDIGDYTDIPVIEVLVAVGDTVAKDQSLVTLESDKATMEVPSSAAGVVKELKVKVGDLLSQGSVVAIIAASDGGAGAAQSSVKPTTDTAETAGKVEPVAVPAEPDKLAQREIAQVQGARSGAAAQSAQVSQPSAGNPSSPPVTFDADSVLPSKVPYASPVVRVFARELGVDLNQLKGSEKGGRITREDVQRFVKAALSGGAPAAAGAVPAGGANGLNLLAWPKVDFSKFGETETQPLSRIKKISGANLARNWAMIPHVTQFESADITDLEALRVALNKENEKAGIKLTMLAFLVKASAAALKTFPEFNASLDAAGENLTLKKYINIGFAADTPNGLVVPVIRDVDKKGVLQIAQESGELAKKARDGKLGPADMSGGCFSISSLGGIGGTAFTPIINAPEVAILGVSKSAMQPVWNGKEFVPKLMLPLSLSYDHRVIDGALAARFTTYLSQVLADMRRVLL

SEQ ID NO: 89727 - protein, 500 aa, Rhodococcus sp. RHA1
MTSTQTSLAELHIPEARDYPMFVDGAWVDASSGQWSEVTTPILREHVIGRVPSSSTEDVDRAVRAAQKAFPRWRSQHFTARGRILSQIADAIDVRAEELARLTALDTGNALRTQARPEVATLANLFRYFAGVAGEIKGTVLPAGDDQLQYSRQEPLGVIGCILPWNSPLMIAGFKIPAALVAGNTVVVKAAEAAPLSVLLLAEICAEFLPAGVLNVITGSGRVAGEALVQHPDVDKISFTGSTEVGRHVAREAGGRLAHVSLELGGKNPSIVFPDVDIDEDFINQLLLSTRVHRQGQSCTAGSRLFLHQDIYDEVLDRLVNTLADLKVGNPLDESTDMGAIINETQFASVCGFLDDGLSSTQVATVLDGSPAKVPNSDGYYMGPTVFSGADNSWRLSREEIFGPALVAIPWNDHSDVIAMANDSHYGLAAYVWTRNLDLALSTAHALETGWVQVNQGGGQMVGQSYGGYKQSGLGREVSLEGMIAGFTQTKQVNVRLRTL

SEQ ID NO: 89728 - protein, 91 aa, Oryza sativa
  misc_feature (39)..(39): Xaa can be any naturally occurring amino acid
SANSLDIVGTVYCRFNCQKLKLPEGCGHEYQMHYGSIGXGGATLGYAQAGKDKRGIACIGNGSFHVTAQEVSTMLYWGQKSIIFSHQPMKG

SEQ ID NO: 89729 - protein, 404 aa, Vibrio cholerae O1 biovar eltor str. N16961
MMLNLDAIRAQFPALQQIVNGNPLVYLDSAATTQKPQCVIDAISHYYSQHNANVHRGSHSLTAQATSQFEGAREQVAQFIGAPSSKNIIWTRGATEALNLIAQSYARSTLQAGDEILVSETEHHANIVPWQMVAEQTGAKVVKIPMTTTGEFGLAAFRQLLSPRCKIVALAHITNVTGTRQPIEAVIQAAHQQGAIVVIDGAQGIVHETVDVRALDADFYVFSGHKLYAPAGIGVLYGKTALLEAMPPWHGGGKMVEKVSFDGTTFTGLPGKFEAGTPNVAGAIALATAIDWYQSLDRAAVEAHLHQLQQQAYQAISQIDDIRVLGYQPNASVLSLVMDGVHHQDLATLLDQQGIAVRAGHHCAHPLMDAFGVKGTVRISFGVYNSAEEVERLIAAIHKAVDLL

SEQ ID NO: 89730 - protein, 625 aa, Xanthomonas oryzae pv. oryzae KACC10331
MNSSRRLPARPVELQEKQMAVIEIKVPDIGDYSDVPVIEVLVAVGDSVAKDQGLVTLESDKATLEVPSSAAGVVKELKVKVGDILSEGALVLLLETEGEAAAPAKAETKAAPAAVAPAAAPGSKPPVTPSHRAPAEPAPSKPALASDKPADIACKMVVLGAGPGGYTAAFRAADLGLDTVLIERYASLGGVCLNVGCIPSKALLHAAAVIDEVAHAGDFGVDFGQPKITLGTLREYKEKVVGKLTGGLASMAKQRKVRTVTGVATFVSPNELEIVGDDGKTQLLRFEHCIIAAGSQAVKLPNFPWDDKRVMDSTDALELHDIPKTLLVVGGGIIGLEMATVYSALGSKVTVVEFMDQLMPGADKDLVKPLADRLKKQGVDVHLKTKATDVTAGKKGITVSFEAAVEGDKPGLQATAYDRVLVAVGRSPNGKKIGADKAGVTVTERGFIPVDRQMRTNVPHIFAIGDIVGNPMLAHKATHEGKLAAEVAAGEKKEWVARVIPSVAYTNPEIAWVGVTETEAKAKGLKVGVAKFPWAASGRAIGIGRTEGFTKLIFDEETHRVIGGAIVGVHAGDLLAEIGLAIEMGAEAEDIGHTIHAHPTLSESVGMAAEVYDGTITDLYIPKKK

SEQ ID NO: 89731 - protein, 273 aa, Vibrio cholerae O1 biovar eltor str. N16961
MVMRELDTPASDSYNQRFGGTRRLYGYDEVDILRAAHVCVIGIGGVGSWAVEALARTGIGELTLIDMDDVCVTNINRQIHAMTGTIGKSKIEVMAERVKLINPECKVNLVDDFITPDNQHLYLNKSFDYVLDAIDSLKAKASLLAYCRSNKIKVITVGGAGGQTDPTQITVADLTKTIQDPLAKKLKDRLRQHHNFPTNPARKFGIDCVFSTEQLKYPQADGSVCATKSTAEGPKRMDCASGFGAATVVTATFGFVAVARIVDKLIQKHKVKA

SEQ ID NO: 89732 - protein, 367 aa, Glycine max
AVAWEAGKPLSIETIEVAPPQKGEVRLRILFNSLCRSDVYWWDAKDQTPLFPRILGHEASGIVESVGEGVTHLKPGDHALPIFTGECGECTYCKSEESNLCELLRINTDRGVMLSDGKTRFSKNGQPIYHFVGTSTFSEYTVLHEGCVAKINPNAPLDKVAIVSCGFCTGFGATVNVAKPKPNNTVAVFGLGAVGLAACEGARVSGASRIIGVDLLPNRFEQAKKFGVTDFVNPKDHNKPVQEVIAEMTNGGVDRAIECTGSIQASISAFECTHDGWGTAVLVGVPKKDVEFKTNPMKFMEGRTLKGTFYGHYRPRTDIPGVVEKYLNKELELDKFITHSVPFSKINTAFDLMLKGEGIRCLICMEE

SEQ ID NO: 89733 - protein, 174 aa, Streptomyces avermitilis MA-4680
MASEASDVRLPPGGPVVLPLVGIGTDIHAFEDGRELWCAGLKWEGEGPGLAGHSDADVVAHAACNALFSAAGLGDLGQHFGTGRPEWSGASGVTLLTEAARIVRAAGFTIGNVAVQVVGPRPKIGKRRDEAQKILSDAVGAPVSVSGATTDGLGFPGRDEGLMAVATALVVRAG

SEQ ID NO: 89734 - protein, 459 aa, Staphylococcus aureus subsp. aureus MRSA252
MNIIEQKFYDSKAFFNTQQTKDISFRKEQLKKLSKAIKSYESDILEALYTDLGKNKVEAYATEIGITLKSIKNARKELKNWTKTKNVDTPLYLFPTKSYIKKEPYGTVLIIAPFNYPFQLVFEPLIGAIAAGNTAIIKPSELTPNVARVIKRLINETFDANYIEVIEGGIEETQTLIHLPFDYVFFTGSENVGKIVYQAASENLVPVTLEMGGKSPVIVDETANIKVASERICFGKFTNAGQTCVAPDYILVHESVKDDLITALSKTLREFYGQNIQQSPDYGRIVNLKHYHRLTSLLNSAQMNIVFGGHSDEDERYIEPTLLDHVTNDSAIMQEEIFGPILPILTYQSLDEAIAFIHQRPKPLSLYLFSEDENATQRVINELSFGGGAINDTLMHLANPKLPFGGVGASGMGRYHGKYSFDTFTHEKSYIFKSTRLESGVHLPPYKGKFKYIKAFFKN

SEQ ID NO: 89735 - protein, 311 aa, Pantoea agglomerans
MANPLYRKHIISINDLSREELELALHTAAKLKAHPQPELLKHKVIASCFFEASTRTRLSFETAIHRLGASAVGFADGSNTSLGKKGETLADTISVISTYVDAIVMRHPQEGAARLATEFSGGIPILNAGDGANQHPTQTLLDLFTIQETQSRLNQLNVAMVGDLKYGRTVHSLTQALAKFDGNRFFFIAPDALAMPAYITDMLDEKNISWSRHDSFEEVMPQLDILYMTRVQKERLDPSEYANVKAQFILRAADLATARDNMKVLHPLPRIDEITTDVDKTPYAWYFQQAGNGIYARQALLALVLNSELAL

SEQ ID NO: 89736 - protein, 386 aa, Synechococcus sp. CC9311
MVDSSHRRAIAPISTPDRLLLGPGPSNADPTVLKALSRTPIGHLDPLYVELMGEVQELLRYAWQTDNRLTLPMSGTGSAAMEATLANTVEPGDTVLVAVKGYFGNRLVDMAGRYRANVKVIEKPWGEAFTKDELETALIEHKPTILAMVHAETSTGVCQPMEGIGDLCRKHDCLLLLDTVTSLGGVPLYLDEWKVDLAYSCSQKGLSCPPGLGPFTMGPRAEAKLAARQDKVPNWYLDVSLLNQYWGSDRVYHHTAPVNMNFGMREALRLLAEEGLDMAWARHRSNAEALWSGLESMGLEMHVPEELRLPTLTTVRIPDDVDGKAFTQHLLNNHGIEVGGGLGVLAGKIWRIGLMGYNSNPQNVSRLLNLFETELPQFRQNVAVAA

SEQ ID NO: 89737 - protein, 459 aa, Shigella flexneri 2a str. 2457T
MEQITKPHCGARLDRLPDCRWHSSMFAIVAFGLLVCWSNAVGGLILAQLKALGWTDNSTTATFSAITTAGMFLGALVGGIIGDKTGRRNAFILYEAIHIASMVVGAFSPNMDFLIACRFVMDVGLGALLVTLFAGFTEYMPGRNRGTWSSRVSFIGNWSYPLCSLIAMGLTPLISAEWNWRVQLLIPAILSLIATALAWRYFPESPRWLESRGRYQEAEKVMRSIEEGVIRQTGKPLPPVVIADDGKAPQAVPYSALLTGVLLKRVILGSCVLITMNVVQYTLINWLPTIFMTQGINLKDSIVLNTMSMFGAPFGIFIAMLVMDKIPRKTMGVGLLILIAVLGYIYSLQTSMLLITLIGFFLITFVYMYVCYASAVYVPEIWPTEAKLRGSGLANAVGRISGIAAPYAVAVLLSSYGVTGVFILLGAVSNIVAIAIATIGIETKGVSVESLSIDAVANK

SEQ ID NO: 89738 - protein, 375 aa, Helicobacter pylori J99
MVSLYLENGLFLQAQSFGASGTQVGELVFNTSMSGYQEVISDPSYKGQFVVFSMPEIGVVGANPKDDESFFSCAGVLARHYNEFFSNSRADSSLSTYLKKRGVLGISGVDTRSLIKTLRHHGCLMMIASTIEHDRNKLEEVLKNAPKISHSPLVSSVSTPKIITHQRATFDFNTLDYKPFDEKIPHKIIAVLDFGAKGNILNELQNVGLKALIYPHHTKANELIKAYEKKEISGIFLSNGPGDPLSLQQEIGEIKRLINAKIPMFGICLGHQLLSIAQGYPTYKLKFGHHGSNHPVKNLETNAVEITAQNHNYCVPEEIEEIATITHRNLFDNTIEGVRYKNAPIISVQHHPESSPGPKESHYIFKEFVGLLEGF

SEQ ID NO: 89739 - protein, 315 aa, Shigella flexneri 2a str. 2457T
MDNLDVICIGAAIVDIPLQPVSKNIFDVDSYPLERIAMSTGGDAINEATIISRLGHRTALMSRIGKDASGQFILDHCRKENIDIQSLKQDVSIDTSINVGLVTEDGERTFVTNRNGSLWKLNIDDVDFARFPQAKLLSLASIFNSPLLDGKALTEIFTQAKARQMIICADMIKPRLNETLDDICEALSYVDYLFPNFAEEKLLTGKETLDEIADCFLACGVKTVVIKTGKDGCFIKRGDMTMKVPAVAGITAIDTIGAGDNFASGFIAALLEGKNLRECARFANATAAISVLSVGATTGVKNRKLVEQLLEEYEG

SEQ ID NO: 89740 - protein, 333 aa, Streptococcus pyogenes M49 591
MSKLLLVGEPLIRVSPNQFQPLTNACDAQLFFGGSEVNIARTLGGFGLEARLFTALPDNPVGHAFHQFLKQIGVDMTLTAWQGNRVGLYYLENGFGCRASQVYYDRCGSSFSALDKDSLDLAAIFEGISHFHFSGISLALGKKTQDLIEVLVREAKKRDICVSFDLNFRSSMIAVADAKRLFSHFAQYADIIFGMEPLLLDSDDFDMFDRNKADTTMIRERLAGLYQRYQLQAIYHTERSKDAQGSNRFKAYAYDGQFYESCEVTTPVLQRVGSGDAFVAGLLYQLLEGNEKQRNLDFAVATASLKCTVAEDQLYHSVQQVEAVLANQRDVQR

SEQ ID NO: 89741 - protein, 260 aa, Shewanella sp. MR-4
MNNQVKIKSAEEIALMRRAGQLLAQVFQMLDTYVRPGISTMDINDTVEAFIVNELKSRPASKGQYGYQYVLNSSINEVVCHGVPSAHEVIKSTDIINLDITLEKDGYIADSSKMYVMPQAPAPAQKLADVTYLAMWQGIKQVKPGATLGDIGHAIQQYAQSFGYSIVRDYCGHGIGQEMHEEPQVLHYGKPNQGLKLKAGMVFTIEPMVNQGTEKIKLKKDGWTVVTRDKKLSAQSEHTILVTPTGYEVLTLRHDEQSPR

SEQ ID NO: 89742 - protein, 412 aa, Arabidopsis thaliana
MVNISEIPDDSNDGCDPNKKPEEQVLRRSRRIATRNENQNKKPKEEEEEDNRSVSFPIPNELTEACVALIRKCDYPSLSSVSSYFFNLIASSGLYETRSRLGLSETFLYAAIKFPDTNPANWYILHRNKVSSLRLTEVGSLPPVPWGCSVVTVGQEMYVIGGLLDIRRLQLMTLIDCRTHKCRSLPSMKRGRYKAAAGVVDGKIYVIGGFRMRKPDAEWIEVFDLKTQIWESLPGPYPRTSAGSQFSAHAVMEDKLYMLGSKFCLVYEPKRNGEWDASVGATPLKDLWDKTCCVVDDMLYTTDPRRTLGHPIVVYHPKDKTWRPVKGESLWSLPSYFFSKSEMANFGGKLVILGSNKSYVTGDCIGEKGIWCVMIELEKREGGEIWGKVESLDCVLGDINFLSVRLCQTLTI

SEQ ID NO: 89743 - protein, 329 aa, Lactococcus garvieae
MTVLVLGGAGYVGSHAVDILVARGYDVAVVDNLVTGHREAVPADVRFYEGDVRDQAFLADVFTKEKDIEGLMHFCAYSLVGESMQKPLMYFNNNVGGAQVILETMEKFGIKHIVFSSTAATFGIPEESPISEKTPQKPINPYGESKLIMEKMMKWQSEATDMTYVALRYFNVAGAKHDGTIGEAHKNETHLIPLILQTALGQREFITIYGDDYNTPDGTCVRDYIDMEDLIEAHIKALEYLKAGGASDQFNLGSSKGYSNLEVLETARRVTGESIPSQMGSRRPGDPSMLVASSTKAGSILDWHVNHNLSWIIDNAWKWHSSHPDLYQK

SEQ ID NO: 89744 - protein, 260 aa, Arabidopsis thaliana
MENLEDLKILAEQWSHQGIEYLQKIPPNQLYAAIGVLLFTTILLFLSIRLVRRTKSNTVLLSGLTGSGKTVLFYQLRDGSSHQGTVTSMEPNEGTFVLHSENTKKGKIKPVHLVDVPGHSRLRPKLEEFLPQAAAIVFVVDALEFLPNCRAASEYLYEILTNANVVKKKIPVLLCCNKTDKLTAHTKEFIRKQMEKEIEKLRASRSAVSTADIANDFTIGIEGEVFSFTHCSNKVTVAEASGLTGETIQIEDFIREYIKP

SEQ ID NO: 89745 - protein, 437 aa, Sinorhizobium meliloti 1021
MKITMIGAGYVGLVSGVCFADFGHDVVCVDKDEGKISALKKGQIPIFEPGLDHLVASNVASGRLNFTDDLKTAVAASDVVFIAVGTPSRRGDGHADLSYVYAAAREIAANLQGFTVVVTKSTVPVGTGDEVERIIRETNPAADVTVVSNPEFLREGAAIEDFKRPDRIVIGVDGSDGRAREVMTEVYRPLYLNQSPLVFTTRRTSELIKYAGNAFLAMKITFINEIADLCEKVGANVQDVARGIGLDGRIGSKFLHAGPGYGGSCFPKDTLALVKTAQDHDTPVRLVETTVAVNDNRKRAMGRKVIAAAGGDIRGSKIAVLGLTFKPNTDDMRDSPAIAVVQALQDAGARVTGYDPEGMENARKLIEGLDCARDPYEAAAEADALVIITEWNEFRALDFDRLKSTMKTPLLVDLRNIYRKDEVAKHGFRYASIGRPD

SEQ ID NO: 89746 - protein, 341 aa, Sinorhizobium meliloti 1021
MRYLITGTAGFIGFHVAKRLIDEGHFVVGFDGMTPYYDVTLKERRHAILQRSNGFKAVTAMLEDRAALDRAAELAEPEVIIHLAAQAGVRYSLENPKAYVDANLVGSWNMLELAKAIAPKHLMLASTSSIYGANEKIPFAEADRADEPMTLYAATKKSMELMAHSYAHLYKVPTTSFRFFTVYGPWGRPDMALFKFVDAIHNGRPIDIYGEGRMSRDFTYIDDLVESIVRLSHVPPSEENRVAPEKATDTLSRHAPFRVVNTGGGQPVELMTFVETVEKAVGRPAIHNMLPMQQGDVPRTFASPDLLEALTGFKPSVSVEEGVARFVEWYDQNYRRAHTTV

SEQ ID NO: 89747 - protein, 448 aa, Burkholderia xenovorans LB400
MRLARGCSLEPQALMNTNPSALRPNRRRRLPASGPARPPHWFSFVGAGALIAVGYIDPGNWATALGAGAGYGYRLLSMVLLASLMAMLLQWLSSRLGVVTGRDLAQICRERTSRRGTLFLWLTSEVAIIACDVAEVVGSAVALQLLLGVSLTVGVLMSAVCTFALLALQQKGGRKLEAVIAALIGFVGLCFVVQLALARPDWHAALAGTVPSVELLRNAGMVWLAAGIVGATVMPHNLYLHSALVKHHAPEGSDAQIKAALHVVNLDTFGSLSFAFVINAALLIVAAAVFYVSGHRDVTDLADAHRLIAPLVGTHWAGILFAAALLACGLSATVTGTLAGQAVMEGFLRIRLPRWQRALLTRALAIGPALLAVALFGQHGSNQLLVASQVVLSLQLPLAVVPLIRYTSDAGLMRGWRVRGVPLALAWLSAAFIVMLNGALLWQLAFGN

SEQ ID NO: 89748 - protein, 295 aa, Mycobacterium avium subsp. paratuberculosis K-10
MTPSTEALPTAVKAQVLAEALPWLKQLHGKIVVIKYGGNAMTDDTLRRAFAADMAFLRNCGIHPVVVHGGGPQITAMLRRLGIPGDFKGGFRVTTPEVLDVARMVLFGQVGRELVNLINAHGPYAVGITGEDAQLFTAVRRSVTVDGVTTDIGLVGDVERVNAAAVLDLIAARRIPVVSTLAPDAEGVVHNINADTAAAALAEALGAEKLLMLTDVEGLYTSWPNRDSLVSEIDTATLSQLLPTLEAGMIPKVEACLRAVSAGVPSAHVIDGRVEHCVLVELFTDEGTGTKVVSS

SEQ ID NO: 89749 - protein, 409 aa, Mycobacterium avium subsp. paratuberculosis K-10
MVTNTDALRRRWEAVMMHNYGTPPVALASGEGAVVTDVDGNTYLDLLGGIAVNVLGHRHPAIIEAVTKQLSTLGHTSNLYATEPSLALAEELVALLGAGHEPAGHESGGTESAGTARVFFCNSGTEANEVAFKLSRLTGRTKLVAAQEAFHGRTMGSLALTGQPSKQAPFAPLPGDVTHVPYGDAEALAAAVDDGTAAVFLEPIMGESGVVVPPEGYLAAARDITARHGALLVLDEVQTGMGCTGTFFAHQHDGITPDVVTLAKGLGGGLPIGACLAVGPAADLLTPGLHGSTFGGNPVCAAAALAVLRVLASENLVRHAEVLGKSLHQGIEGLGHPLVDHVRGRGLLCGVVLTAPHAKDAEAAAREAGFLVNAAAPGVIRLAPPLIVTEAQIDGFIAALPGILDRAAA

SEQ ID NO: 89750 - protein, 309 aa, Mycobacterium avium subsp. paratuberculosis K-10
MTPRHFLRDDDLSPAEQAEVLALAAELKKDPFSARPLEGPRGVAVLFDKNSTRTRFSFEVGIAQLGGHAVVVDARSTQLGRDETLEDTARVLSRYVEAIVWRTFEQQRLEAMAGAATVPVINALSDEFHPCQMLADLQAIAEHKGSLSGLRMCYLGDGANNMAHSLMLGGVTAGIHVTIAAPDGFTPAPEFVAAARRRAESTGATVTLTTDARAAARGVDVLVTDTWTSMGQEDDGLDRRTPFWPYQLNADLVSLADPEAIVLHCLPAHRGEEITDEVMDGPSSVVWDEAENRLHAQKALLTWLLERQS

SEQ ID NO: 89751 - protein, 498 aa, Shewanella oneidensis MR-1
MSTPKTRSDWENLAVSLAINGKAFINGEYRDASSGNTFDCISPIDGRLLAPVASCDLMDANIAVANAREVFDSGVWSKAAPVKRKQVMIRFAELLEENANELALLETLDMGKPIRFSKAVDVAGAARAIRWSGEAIDKLYDELAPTAHNEIGMITREPVGVVAAIVPWNFPLLMACWKLGPALVTGNSVILKPSEKSPLTAIRIAELAVQAGIPKGVLNVLPGYGHTVGKALALHMDVDTLVFTGSTKIAKQLMIYAGESNMKRVWLEAGGKSPNIVFNDAPDLKAAAVAAAEAIGFNQGEVCTAGSRLLVESGVKDELVGLIAEELASWQPGHPLEPTTVSGAVVDKQQLDTILSYIKAGQNEGASLVYGGQQVLAETGGVYVQPTVFSNVKNQMKIASEEIFGPVLSVIEFNGMEEAIAIANDTIYGLAAGVWTADISKAHKTAKALRSGMVWINHYDGGDMTAPFGGYKQSGNGRDKSLHSFDKYTEIKATWIVL

SEQ ID NO: 89752 - protein, 446 aa, Shewanella oneidensis MR-1
MADSPNNLAHEHPSLEHYWMPFTANRQFKASPRLLAQAEGMYYTDINGNKVLDSTAGLWCCNAGHGRREISEAVSKQIRQMDYAPSFQMGHPIAFELAERLTELSPEGLNKVFFTNSGSESVDTALKMALCYHRANGQASRTRFIGREMGYHGVGFGGISVGGLSNNRKAFSGQLLQGVDHLPHTLDIQHAAFSRGLPSLGAEKAEVLEQLVTLHGAENIAAVIVEPMSGSAGVILPPQGYLKRLREITKKHGILLIFDEVITAFGRVGAAFASQRWGVIPDIITTAKAINNGAIPMGAVFVQDYIHDTCMQGPTELIEFFHGYTYSGHPVAAAAALATLSIYQNEQLFERSFELERYFEEAVHSLKGLPNVIDIRNTGLVAGFQLAPNSQGVGKRGYSVFEHCFHQGTLVRATGDIIAMSPPLIVEKHQIDQMVNSLSDAIHAVG

SEQ ID NO: 89753 - protein, 276 aa, Caulobacter crescentus CB15
MTLDNALEIEAETRTGQIKLHKAEDFEGMRKAGKLAAECLDMLIPHVQPGVSSDELDRLAREFILDNGGLPACLYYRGYPKTVCISRNHVVCHGIPGDWALKEGDIVNIDVTAIVDGWHGDTSRMYGVGEVGPRARRLVEITYEGMRRGLEAVKPGATLGDIGHAIQSYVEAQRCSVVRDFCGHGLGRVFHDAPNILHFGRPGQGAVLKPGMFFTVEPMVNLGKPAVKVLNDGWTAVTRDKSLSAQCEHSIGVTEDGYEVFTASPAGLFQPAIQGG

SEQ ID NO: 89754 - protein, 1209 aa, Oryza sativa Japonica Group
MWAEPEIAVNYGPRRGGCESSSSRPTLQPAPILRHPFAGGFSPPLPPPLHRRPRNLDTSPLAGDHHHGASRFASTSVVKQSSGGLLGWFLGGNSSQLPPLDVPLPGVIISPPLPDFVEPSKTKITTLPNGIKIASETSPIPAVSVGLYIDCGSVYETSSSSGTSHLLERMAFKSTTNRSHLRLVREVEAIGGNVFASASREQMSYTYDALKCYAPEMVEVLIDSVRNPAFLEWEVKEQLQKIKSEISEVSGDPHGLLMEALHSAGYSGALAKPLMASESAVNRLDVATLEEFVSENYTAPRMVLAASGIEHDELVSVAEPLLSDLPSVKRPEEPKSVYVGGDYHCQADSTSTHIALAFEVPGGWRQEKTAMIVTVLQVLMGGGGSFSTGGPGKGMHSWLYLRVLNNYGQIESFSAFSSIYNNSGLFGIHATTNPDFVSSAVDLAARELHEVATPGKVTQEQLDRAKEATKSSVLMDLESRIVASEDIGRQVLTYGERKPIEYFLKTVEEITLNDISSTAKKIISSPLTLASWGDVACCVFVQTHANIVLPVLHFNIESDVMASWLSHLPIHRCQLSFPAAQASYATPGIDSALLLDVDDMAGGDAGLNEGLKKQAKPRLRLPKPAAKRSESEFLRSRPLALLMASSHIILPPDDDDEEQRRLEEEEDEDPWARSGPPPAAPEHAMKAALPFSATCVRISRDSYPNLRALRNASSVSLADAAYVKISEGDFGYVLDDVPHLVDHLPDAPTYPNPLQDHPAYSTVKQYFVNEDDTVPQKVVVQKNSRRGVHFRRAGPRQKVYFESDEVKACIVTCGGLCPGLNTVIRELVCGLAHMYNVSKIYGIQNGYKGFYSSNYLTLTPKSVDDIHKRGGTVLGTSRGGHDTKKIVDNIQDRGINQVYIIGGDGTQKGAYEIFKEIRKRGLKVSVAGIPKTIDNDIAIIDKSFGFDTAVEEAQRAIDSAHVEACSAENGIGLVKLMGRYSGLIAIYATLEIRDVDCCLIPESPFYMDGEGGLLQYVERRLKENKHMVIVVAEGAGQDLIAKSLSTSEQQDASGNKLLLDIGLWLTHKIKDHFKSKKMEMTIKYIDPTYMIRAIPSNASDNVYCTLLAHSAIHGAMAGYSFTVGNVNGRHAYIPFYRVTSTRNKVKITDRMWARLLSSTNQPSFLSQKDIDEAKENDRTANKPPLPTGLSHHVANSFDQSASSSSNSQI

SEQ ID NO: 89755 - protein, 940 aa, Oryza sativa Japonica Group
MAARSWLLLLCFVAVATAGVLQARAQPDSNGFISVDCGLPGKTGFVDDKTKISYAADDGFTDGGACHNISAEYITPGLAKRYHTLRSFPDGKRNCYTLRSLVAGLKYLFRTTFFYGNYDGLNKLPVFDLYVGVNYWTMVNITGPGDAVIVEAIVVVPDDFVQVCLVNTGAGTPFISGLDLRPLKNTLYPQSNATQGLVLLGRLNFGPTDYTDVIRYPDDPHDRIWFPWVDSTKWSQISSTKKVQDLDNDMYETPTAVMQTAITPRNASRNIEFSWDPVPLPNDPTPGYIAIFHFSELQLLPGNAVREFYINLNGKPWSLTAFKPEYLYNDATFNRNPFLRYPQYNISINATANSTLPPLINAVEVFSVIPTATIGTDPEDVAAITAIKEKYQVVKNWMGDPCVPKMLAWDKLTCSYAISNPARIIGLNLSSSGLSGEVSSYFGNLKAIQNLDLSNNKLTGPIPDALSQLPSLTFLDLTGNQLSGSIPSGLLKRIQDGSLNLRYGNNPNLCTNGDSCQPAKKKSKLAIYIVIPIVIVLVVVIISVAVLLCCLLRRKKQAAMSNSVKPQNETVSNVSSNGGYGHSSSLQLKNRRFTYNELEKITNNFQRVLGRGGFGYVYDGFLEDGTQVAVKLRSESSNQGAKEFLAEAQILTRIHHKNLVSMIGYCKDGEYMALVYEYMSEGTLQEHIAGKNNNRIYLTWRERLRIALESAQGLEYLHKACNPPLIHRDVKATNILLNTRLEAKIADFGLSKTFNHVNDTHVSTNTLVGTPGYVDPEYQATMQPTTKSDVYSFGVVLLELITGKPSILREPGPISIIQWARQRLARGNIEGVVDAHMHGDHDVNGVWKAADIALKCTAQTSTQRPTMTDVVAQLQECLELEDRRCGMEDTYNNFYAGNNNDPNSSYNMYNTDQSTDVSQNNTMEHNFERVPTMATGPVAR

SEQ ID NO: 89756 - protein, 902 aa, Oryza sativa Japonica Group
MAARSSLFLLCLATATAGVLQARAQPDSKGFISVDCGLPGKTSYIDDKTKISYASDDGFTDGGKHYNVSPEYIKPAVTARYYNPVNREAIVVVPDDSVQVCLVNTGAGTPFISGLDLRPLMNKLYPQVNATQGLLQLARLNFGPSDETSIRYPDDPHDRVWFPWFDAAKWNEISTTNRVQNIDNDLFEAPTAVMQTAVTPINASNNIDFFWNSQPQPNDPAPGYIAIFHFSELENLPNNATRQFYININGILFDDGFTPSFLYAEASYSSKPFVRHPQYNITINATANSTMPPLINAVEVYSVISTANIGTDSQDVSAIMTIKAKYQVKKNWMGDPCLPRNLAWDNLTCSYAISNPARITSLNLSKIGLSGEISSSFGNLKALQYLDLSNNNLTGSIPNALSQLSSLTIFTGGEDDDGWLMVDNNDGAAGGRQRQRWRTVEGAARAVEGRRRREQRDLTGNQLNGTIPPGLLKRIQDGFLNLRYGNNPNLCTNGNSCQPPKNKSKLAIYIVVPIVLVLAIVSVTTLLYCLLRRKKQGSMNNSVKRQNETMRYGPTNNGSGHNSSLRLENRWFTYNELEKITNKFQRVLGQGGFGKVYDGFLEDGTEVAVKVRTESSNQGDKEFLVEAQILTRIHHKNLVSMIGYCKDEKYMALVYEYMSEGTLQEHIAGKGNDGRYLTWKERLRIALESAQGLEYLHKGCNPPLIHRDVKGTNILLNTRLEAKIADFGLSKVFNPENGTHVSTNKLVGTPGYVDPEEILIVRLIGTDQMRRYQSTMQPTTKSDVYSFGVVLLELVTGKPAILRDPEPISIIHWAQQRLARGNIEGVVNASMHGDYDVNGLWKVADIALKCTALSSAHRPTMTDVVAQLQECLELEDKHQVSDINNGFYNGNSGDLNSNFYTT

SEQ ID NO: 89757 - protein, 528 aa, Acidobacteria bacterium Ellin345
MAKGTLVDRIAAMNLEQKLAELKRRDELAEAGGGAERREREHKQGKMSARERIEFLLDEGTFEETDKFVTHRCTDFGMDENKIFGDGFVTGYGRVEGRLIFVFAQDFTVFGGSLSETNASKIVKIMDMAMRVGAPVIGLNDSGGARIQEGVMSLAGYADIFLRNTLASGVVPQISAIMGPCAGGAVYSPAITDFILMVDKTSYMFITGPDVIKAVTHEEVSKAELGGAETHNSKSGVAHFMAHDDAECLSMVRELLSFVPSNNLEDPPRKACTDPVDRVEEKLDTLVPAESTMPYDIKDAINLVVDDNYFFEVQEHYAKNIVVGFARLNGRPVGIVANQPNFLAGVLDISASIKGARFVRFCDCFNIPLITFEDVPGFLPGVTQEHGGIITHGAKLLFAFAEATVPKITVITRKAYGGAYCVMASKHIRTDVNYAWPTAEIAVMGPEGAVNIVYKRELDKSQNFEKDRAAKIEEFRDRFANPYIAAERGFVDAVIQPRDTRKKLIQALEMLDSKRDKNPAKKHGNIPL

SEQ ID NO: 89758 - protein, 701 aa, Oryza sativa Japonica Group
MSRYPDDPRDRVWTPWDSPSNWTEISTTRPVQQTYDDLFEVPTAVMQTAIVPMFATDNIELAWVAYTQPKDPSPGYIAIMHFSELELSPPSRDVREFYINLNGNMMYSKGYKPVYLYAHAIYNTNPFLRYPQYNISINATYNSTMRPFINAMEVYSVFSTTTIGTYGQDASAMMVIKEKYQVKKNWMGDPCIPTEFTWESLTCSYENSKHVIKINLSSSGLSGEISSSFGDLKALQYLDLSNNNLTGSIPDALSQLPSLTVLYGNNPNLCTNDNSCQAAKHKSKLAIYIVAPVVLVLVIVSVTILLFCLLGQKKKQGSMNTSIKPQNEANYVPTNDSDGHGSSMQLENRRFTYKDLEKITNNFQRVLGRGGFGKVYDGFLEEGTQVAVKLRSESSNQGDKEFLVEAQILTRIHHKNLVSMIGYCKNGKYMALVYEYMSEGTLQEHIAGKRNNGRHLTWRERLRIALESAQGLEYLHKWCNPPLIHRDVKATNILLNARLEAKIADFGLSKSFNLENGTHVSTNTLVGTPGYVDPEYQATMQPSTKSDVYSFGVVLLELVTGKSAVLRDPEPISIIHWAQQRLAQGNIEEVVDACMCGDHDVIGVWKVADIAFKCTAQVSARRPTMTDVVAQLQECLELEEEHCAVNDANNNFYTSNNSKPNSSYDTYAADHSIDVSQNSVAFEMEKNFGRMPSTAPGPATR

SEQ ID NO: 89759 - protein, 512 aa, Xanthomonas oryzae pv. oryzae KACC10331
MGIRDWLERSELRPCESPLTNPKSQNSTRWHRPLGQNKANRSSKMSQGKIVQIIGAVVDVEFPRNEVPKVYHALKVEGTEITLEVQQQLGDGVVRTIALGSTDGLKRNLLATNTERAISVPVGAGTLGRIMDVLGRPIDEAGDVQASDHWEIHRGAPSYEDQSSSTELLETGIKVIDLMCPFAKGGKVGLFGGAGVGKTVNMMELINNIAKAHSGLSVFAGVGERTREGNDFYHEMKDSNVLDKVAMVYGQMNEPPGNRLRVALTGLTMAEYFRDEKDANGKGKDVLLFVDNIYRYTLAGTEVSALLGRMPSAVGYQPTLAEEMGVLQERITSTKSGSITSIQAVYVPADDLTDPSPATTFAHLDSTVTLSRNIASLGIYPAVDPLDSTSRQMDPLVIGHEHYDTAQRVQQTLQKYKELKDIIAILGMDELSEEDKQSVSRARKIERFFSQPFHVAEVFTGSPGKYVSLKDTIRGFKAICDGEYDHLPEQAFYMVGSIEEAVEKANKMSAKA

SEQ ID NO: 89760 - protein, 468 aa, Buchnera aphidicola str. Bp (Baizongia pistaciae)
MAKQQIGVIGMAVMGRNLALNMERNQYTVSIFNRSLDITEKIILNNPNKNLFPFFSIKDFVLSLIVPRCIVLMIKSGVATDDTIKSLIPYLSKGDIIIDGGNTFYKDTIQRGYELLKIGVNLIGAGFSGGEKGALYGPSIMPGGRQEAYNYVSPILKKIASNSEGIPCVTYIGPDGSGHYVKMVHNGIEYGDMQLIAESYFILKTLLRLDNQSISKIFDIWNQGELNSYLIDITKDILIKKDDQNNYLIDCILDEGSSKGTGTWTTKSALDLNEPLTLITESVFFRYLSSLKSQRLLASKILCGPKDFFIVLNRDDFIEKIRQALYLGKIISYAQGFSQLNSASQKYNWNLKLGEISRIFQSGCIIRAKLLKNITQEYSSNNNFVNLLLTPYFREIANTYHSSLREIVSISVKYGIPIPALSSAISYFDSYRSAFLPSNLIQAQRDFFGAHTYKRIDKSGIFHTNWYS

SEQ ID NO: 89761 - protein, 351 aa, Listeria monocytogenes str. 4b F2365
MYKGLLEKYKEYLPVTDKTPMISLAEGNTPLIPLPNLSKELGVTLYGKYEGLNPTGSFKDRGMVMAVAKAKEEGAEAVICASTGNTSAAAAAYATRAGLKAYIVIPEGKVALGKLAQAVMYGADIISIQGNFDEALKSVRELAETEAVTLVNSVNPYRLEGQKTAAFEICEQLGSAPDVLAIPVGNAGNISAYWKGFKEWNEAKASGLPRMHGFEAEGAAAIVQGKPIDNPETIATAIRIGNPASWELAEAARDESGGYIHSVTDDEIVNAYKKIAAQDGVFIEPGSAASLAGVIQHVANGTIKKGETVVCVFTGNGLKDPDTAMSVHEIPISHVDDIEAMRTHLRSGVKA

SEQ ID NO: 89762 - protein, 888 aa, Oryza sativa Japonica Group
MAARWWLLLLLGLAVAGVVRGQGGAPDTSGFISIDCGLPEKTSYVDDATKLKFTSDDAFTDAGTIHNVSSEFATPTTTTDRSLYNVRSFPAGARNCYTVPSVVPGSKYLVRAKFLYGNYDGLNKPPVFDLHLGVNFWQTVTVPSADWLGNAEVIAVVPDDFLQVCLVNTGAGTPFISGLDLRPLPSSLYAPANATQGLVLLDRRNFGASGSTVIRYPDDTYDRVWWPWSNPPAEWSDISTADKVQNTIAPVFDVPSVVMQTAITTRNSSIPIQFSWDTKPNHVYPDPGSIFTLYVTELELLAGNAVRQFNVTINGVIWTKAPYKPVYLSTDAMYNGDRPYRGITRYNFSLNAAGSSTLPPILNAAEAFSVISTADLATDAQDVSAITAIKAKYQVNKNWTGDPCAPKTLAWDGLTCSYAISTPPRITGVDLSHNNLTGSIPNVISQLQFLAVLDLTGNQLNGSIPSSLLKRSQDGSLTLRYGNNPNLCSNSSSCQLPQKKSNSMLAVYVAVPVVVIGAVAVFLIFFIRKKKNKSKGAVKPQILGNGVQSHSQNGSGGSLLELHNRQFTYKDLAVITNNFQRVLGKGGFGPVYDGFLKDGTHVAVKLRDESSSQGYSEFLTEAQTLTKIHHKNLVALIGYCKDEIHLALVYEHMSEGTLEDKLRGKDRKGRSLTWRERLRIVLESAQGLEYLHKACSPRFVHRDVKSSNILLNANLEAKVADFGLTTAFKCDGDTHVSTVRVVGTYGYLAPEYATALQVSEKIDVYSFGVVLLEVITGQPPIIKLPEPTTIIQWTRQRLARGNIEGVVDVNMPDDRYDINCIWKVADVALKCTAHAPGQRPTMTDVVTQLKECLELEETSFKGDTSSSYMSGSSIDPNSSYNTYTTEMS

SEQ ID NO: 89763 - protein, 249 aa, Ureaplasma parvum serovar 3 str. ATCC 700970
MVIVKTEKDIAAIKEAVRIWKIAREAIYKQAKAGVSLKELDLLAKEVIEANGGIAAFHNYLGFKGHICISVNECVIHGVPTDYVLKDGDKVTFDVGVKYDNHYCDAAFTIIINNSNVEALKISEICKKSIDEAVAIIKPKVTTHAISNAIQKFIEKNGYFVLRDFAGHGCGNEIHEDPLIPNYRSLLYRNVTLEENMVICIEPMILSGSNAYYIDPNDQWSVKSKNHQMTCHWEHMILITKDGCEVLTD

SEQ ID NO: 89764 - protein, 253 aa, Streptomyces avermitilis MA-4680
MADAPYKLILLRHGESEWNAKNLFTGWVDVNLNEKGEKEAVRGGELLKDAGLLPDVVHTSLQKRAIRTAQLALESADRHWIPVHRSWRLNERHYGALQGKDKAQTLAEFGEEQFMLWRRSYDTPPPPLADGSEFSQSDDPRYASIPPELRPKTECLKDVVNRMLPYWYDGIVPDLLTGRTVLVAAHGNSLRALVKHLDGISDEDIAGLNIPTGIPLSYELDTDFKPLNPGGTYLDPDAAAAAIEAVKNQGKKK

SEQ ID NO: 89765 - protein, 420 aa, Salix gilgiana
MFGRAPKKSDNTKYYEVLGVSKSASQDDLKKAYRKAAIKNHPDKGGDPEKFKELAQAYEVLSDPEKREIYDQYGEDALKEGMGSGGSGAHDPFDIFQSFFGGGNPFGGGGSSRGRRQRRGEDVIHPLKVSFEDLYNGTSKKLSLSRNVICSKCKGKGSKSGASSKCAGCQGSGMKVSIRHLGPSMIQQMQHACNECKGTGETINDKDRCPQCKGEKVVQEKKVLEVVVEKGMQNGQKVTFPGEADEAPDTVTGDIVFVLQQKDHPKFKRKGDDLFVEHTLSLTEALCGFQFVLTHLDGRQLLIKSQPGEVVKPDQFKAINDEGMPMYQRPFMRGKLYIHFSVEFPDSLSPDMCKALEAVLPPRASVQLTDMELDECEETTLHDVNIDEEMRRKQQQQAQEAYDEDDEMPGGAQRVQCAQQ

SEQ ID NO: 89766 - protein, 642 aa, Magnaporthe grisea 70-15
MAGPPSIISSRMTDINSDDEGNKEAQGSTNGNRRSQLENLSRPGTARTGLSSRTQNQPLRHTLGKRTSAAASSVASGRPGSSLSRSHVPSLTSHAFFHPMSSQKLQAQRSGTRPTMLLRQHSRGDIELSRDGRSVTRQSVTSDFTNPQMMSRLAQSQSAYDSEQLRPPGSRGTEATDLDGGADRVTANTSPTYGHYPTGSLSESVRPLQKKPGEGRNNSLTVRVDRNYKSRDNLPTPVRTPRSFRSSFMLPTRNGSPQTGVNRDIQGGEKLESVASTPQLSPADAVAPTANASNGEKMAVAVGRNFEFFEGNTVFFLGGRFQNTRSTPINIATGSLVVIPSILWFAFSAPWLWENVSPAVPITFGYLFYICISSFVHASVSDPGILPRNLHQFPPPDENEDPLRLGPPTTDWTLIRSAESSTSAMEVPTKYCRTCNIWRPPRTHHCRLCDNCIETADHHCVWLNNCVGRRNYRYFFAFVTSTTLLSIYLLGSCLGQITTYASLENISVGQAIDHFRVPFALVIYGFLGFLYPAALMLYHVFLMARGETTREFLNSHKFLKKDRYRAFTQGNWVKNWIVVLCRPRPPTYYRFKEIAVQGDQRLAARKRSELRRAETKEGMEMQDVGPASVGFQGPTSRAAAAA

SEQ ID NO: 89767 - protein, 888 aa, Geobacter metallireducens GS-15
MAEKYVYFFGNGKAEGKADMKNLLGGKGANLAEMTAIGLPVPPGFTITTEVCTYYYANNKSYPSVLAAQVAENLKSVEAIMGRTFGDPKNPLLVSVRSGARASMPGMMDTILNLGLNDETVQGIIVQSGDERFAYDAYRRFVQMYSDVVMGMDKEALEHLLEEKKAAKGVHLDTDLTAADWKELVGAFKAKIRETLGTAFPENPQEQLWGAVGAVFGSWMNQRAITYRRLNGIPADWGTAVNVQSMVYGNMGNDCATGVAFTRDPSTGENYFYGEYLVNAQGEDVVAGIRTPQPINRANSKDATLPSMEEVLPECYQQLVQIRGILEKHYRDMQDIEFTIEKGKLFMLQTRNGKRTAKAAIKVAVDMVKEGLIDEKTAVLRVSPSQLDQLLHPSLDPKAPRTIIAKGLPASPGAASGEVVFTADEAEAAGRLGLKVILVRIETSPEDIHGMHAAQGILTARGGMTSHAAVVARGMGKCCVAGCGDIKVDYAAGQFVTAKGQVVKRGDTITLDGSTGEVMLGEVPTVAPQLTGDFGVLMGWVDTYRKLKVRTNADTPNDSRVAREFGAEGIGLCRTEHMFFEADRIAAVREMILSEDVEGRTKALAKILPMQKGDFLGIFREMKDLPVTIRLLDPPLHEFLPQEEKDVDALAKTMGVTAQTLKNKVDYLHEFNPMLGHRGCRLGLTFPEIYDMQVQAIMEAACELTKNEGFTIVPEIMIPLVGVVSELARLRENTVRVCEEVIARYGVKIDYLIGTMIELPRAALTADEIAREADFFSFGTNDLTQTTFGLSRDDAGKFLPFYVESGLLEEDPFVSLDQNGVGILVKMAVEKGRTTRAGIKLGICGEHGGDPSSVIFCHKIGLDYVSCSPFRVPIARLAAAHAALGEGN

SEQ ID NO: 89768 - protein, 428 aa, Staphylococcus aureus subsp. aureus MRSA252
MNPLAQSLNEQLQQSNATAFAMLSDLGQNMFYPKGILSQSAEAKSTTYNATIGMATNKDGKMFASSLDAMFNDLTPDEIFPYAPPQGIEELRDLWQQKMLRDNPELSIDNMSRPIVTNALTHGLSLVGDLFVNQDDTILLPEHNWGNYKLVFNTRNGANLQTYPIFDKDGHYTTDSLVEALQSYNKDKVIMILNYPNNPTGYTPTHKEVTTIVEAIKALANKGTKVIAVVDDAYYGLFYEDVYTQSLFTALTNLHSNAILPIRLDGATKEFFAWGFRVGFMTFGTSDQTTKEVLEAKVKGLIRSNISSGPLPTQSAVKHVLKNNKQFDKEIEQNIQTLKERYEVTKEVVYADQYHSHWQAYDFNSGYFMAIKVHDVDPEALRKHLIDKYSIGVIALNATDIRIAFSCVEKDDIPHVFDSIAKAIDDLR

SEQ ID NO: 89769 - protein, 484 aa, Oenococcus oeni PSU-1
MALKQYQMYINGEWVDSDNGEKITVYNPSNEEAISQVPSASLKQVKEAIDDAYAAQKDWKRVPAATRGSYLVRIAALIRKNADYLARTLSEEEGKILSLAMTEVTFSADYIDYMAAQGRTYEGEVIQSDNANENIALLKQPIGVAAGILPWNFPFFLITRKFAPALVTGNTIVIKPSSDTPNIALEFAKLANQVGLPKGVLNFVTGPGSVVGSELSKNEKIGIISLTGSVDSRKRVMADASNHVAKVSLELGGKAPAIVCKDADIDLAVDSIINSRIDNNGELCNNCERVYVQEDIAEEFTKKLVAKMAATTIGDPIEHENIGMGPLINKAAVEKVDAMVQRAVKAGAKVECGGKRPEGKGYFYPATVVTNVKQSDELVQEEIFGPVLPILTFKKLDQAIDMANDSKLGLTSSIFTENMDAAATAANELEDGETYINRFNFEAMQGFHAGWKESGLGGADGKHGLEEYVNTHVVYLQRHPEKAD

SEQ ID NO: 89770 - protein, 301 aa, Arabidopsis thaliana
MLFLCLCVICSYLKELLAKEGYLIVSVPYNVTFDHEQAAKQVYERFNSCLDTIVSSGIPNSNLKPGDLADLPLFSVGHSNGALLQVLTGSYFAEKIPKVNAIISFNNKSATEAVPYFEQLGPLIQQMLPMVEASPVYEMARNASGDVLKLLLDTAGTTILNNDQEALKSFTKLVDQLPSVFGEVGQGVSEFRPSPLENRNCFKCSYSVPHTLLVQFNSDAIDETDLLEETLRPRIESIGGTLEKVRLNGNHLTPCIQDPKWQIGTVYTPADAVAQALKTIPLSETRVLSRTIVDWFRRFEN

SEQ ID NO: 89771 - protein, 500 aa, Atriplex centralasiatica
MAFPMPVRQLFIDGEWREPLLKNRIPIINPSTEEIIGDIPAATAEDVEVAVVAARKAFKRNKGRDWAATSGAHRARYLRAIAAKITERKDHFVKLETLDSGKPLDEAVLDIDDVATCFEYFAGQAEALDAKQKAPVTLPMDRFKSHVLRQPIGVVGLISPWNYPLLMATWKIAPALAAGCTAVLKPSELASVTCLEFGEVCNEVGLPPGVLNILTGLGPDAGAPIVSHPDVDKIAFTGSSATGSKIMASAAQLVKPVTLELGGKSPVIMFEDIDIETAVEWTLFGVFWTNGQICSATSRLLVHESIAAEFVDRMVKWTKNIKISDPFEEGCRLGPVISKGQYDKIMNFISTAKSEGATILCGGSRPEHLKKGYYIEPTIITDITTSMQIWKEEVFGPVICVKTFSTEDEAIELANDTEYGLAGAVFSKDLERCERVTKALEVGAVWVNCSQPCFVHAPWGGVKRSGFGRELGEWGIENYLNIKQVTSDISDEPWGWYKSP

SEQ ID NO: 89772 - protein, 520 aa, Suaeda salsa
MAALEELKKKLTPLFDAEKGFSAGTTLECGDSDMLSDSGTINLLSRSYGVYNFNEQGLQKCTSSPVDENSPSEKTYRISSREMRVFGAIGSGASSIVQRAIHIPTHRIIALKKINIFEKEKRQQLLTEIRTLCEAPCSEGLVEFYGAFYIPDSGQISIALEYMDGGSLADVIQVQKCIPESVLSAIVRKLLHGLNYLHGVRHLVHRDIKPANLLMDLKGEPKITDFGISAGLENSMAMCATFIGTVTYMSPERIRNESYSYPADIWSLGLALFECGTGEFPYIANDGPVNLMLQILDDPSPSPSKEKFSSEFCSFVDVCLQKDPEARPTAEQLLSHPFITKYKDSQVDLATFVQSIFDPVQRLKDLADMLTIHYYLLFDGPDEEEWQQAKSLYNEGSVFSFSGKQYAGTNDIFSVLSDVRRKLAGKWPPEKLIHVVEKLQCKAHGQGGIAIRVSGSFIAGNQFIICGDGMQVEGLPNFRDLNVDIASKRMGTFKEQFIIEPGDAIGCYNISNQELYIMSQ

SEQ ID NO: 89773 - protein, 281 aa, Prunus mume
MAKDVEGAEHGEFAAKDYHDPPPTPFFDAEELTKWSFYRALIAEFVATLLFLYITVLTVIGYKSQSSGDQCGGVGILGIAWAFGGMIFVLVYCTAGISGGHINPAVTFGLFLARKVSLPRAVLYIIAQSLGAICGVGLVKAFQKTYYEEYGGGANELAAGYNKGTGLGAEIIGTFVLVYTVFSATDPKRNARDSHVPVLAPLPIGFAVFIVHLATIPITGTGINPARSFGAAVIYNKDKAWDDQWIFWLGPFIGAAIAALYHQYILRAGAIKALGSFRSNA

SEQ ID NO: 89774 - protein, 448 aa, Oenococcus oeni PSU-1
MTEIFKMPDIGEGMAEGEISDWLVKVGDQVKTDDSVAEVQNDKLLQEILSPYSGKVTKLFVEPGTTVKVGEPLIEFDGDGSGSAADDGQKGKTEAKEIEEPAESEKKTAVSSQASPAAPTSDSSNSSGAATASNGNILAMPSVRHYAHEHGIDLSQVTASGHHGHITMSDVENFSTSSAAPEKEPENQPSEAETTTKQTASESAPTKKAAAPDPLKEGRVSMTPVRKAIAKAMSLQNSTIPTVTNFDQTEVSKLVAHRKQFKPIAADQNIHLTYLAYAAKALAATAKKFPEINASLDMDKQEIVYHDDINLGIAVNAPSGLYVPVIAHADQKSIMAIAQEIEDLAAAVRDGSIKPDQMRGGTITISNIGSARGTWFTPIINAKEVAILGLGSIVKEPIISDDGTIVAGQMMKLSLSYDHRLIDGMLGQTSMNYLKSLLADPAYMLMEV

SEQ ID NO: 89775 - protein, 473 aa, Oenococcus oeni PSU-1
MATGGVVGAQATDIDTVVIGSGPGGYVAAIRAAELGQKVTIIESTFIGGVCLNVGCIPSKALINVGHHYHDAVSEQPFGLKSSGTELDWKTTQEWKQKKVVNQLTGGVEMLLKKHRVDIIHGVASFVDNKQINVVKGDDHELFQFNNCILATGSRPIEIPGFAFGKRIVDSTAALSLPEIPKHLIVIGGGVIGFELGSVYQNLGSKVTVIEGLDHVLSGFDKEMIQPVLDDFKAQGGEIFTSAKAKSASQTEKDVTVTFEADGKEQTVDGDYLLVSVGRRPNTDNIGLNNTNVKLTDRGLVEIDDTMKTNVSHIYAIGDITVGPALAHKASFQGKIAAAAISGDQNAHDLHYSLPAVAYTNYELATTGETPESVKEKKLDAKAYKFPFAANGRALSINEGKGFIRLISDNQTKALIGSQIVGPGASDLISELSLAIENGLTTEDISLTIHPHPTLGEAIMDASELADGLPIHI

SEQ ID NO: 89776 - protein, 283 aa, Sinorhizobium meliloti 1021
MHVTGLNIHPLKSGRAVPQTAVTVNLDGLAGDRRFMLVAPDGHFITQRDLQALARVEAEHVDGGVHLRMNGEELSVRFDPDDRLDVRVWSSDVNAAVAGGAANDVLSGWFGRPVKLVHMDAEAERFVGAEWAGAAAPVAFADGFPILVTTTGSLADLNCTLAEKGQEPVGMERFRTNILIDCDEPWAEDLWESIVIAGIAFDLVKPCARCIMTTQDQTTGERIGGNPIQGLSEKRMSADRRVPGVLFGWNAVPRGEGILRLGDAVEVVRRRDERWPMKVRSAG

SEQ ID NO: 89777 - protein, 587 aa, Streptococcus pyogenes M49 591
MAVEIIMPKLGVDMQEGEIIEWKKQEGDTVNEGDILLEIMSDKTNMELEAEDSGVLLKITRQAGETVPVTEVIGYIGAEGESVEVSSPAASDVNVARTTEDLEAAGLEVPKAPAQAASAAPKAALADDEYDIIVVGGGPAGYYAAIRGAQLGGKIAIVEKSEFGGTCLNVGCIPTKTYLKNAEILDGIKIAAGRGINLASTNYTIDMDKTVDFKNIVVKTLTGGVQGLLKANKVTIFNGLGQVNPDKTVTIGSQTIKGRNVILATGSKVSRINIPGIDSKLVLTSDDILDLREMPKSLAVMGGGVVGIELGLVWASYGVDVTVIEMADRIIPAMDKEVSLELQKILSKKGMKIKTSVGVSEIVEANNQLTLKLNNGEEVVAEKALLSIGRVPQMNGLENLNLEMDRNRIKVNDYQETSIPGIYAPGDVNGTKMLAHAAYRMGEVAAENAIHGNTTRKANLKYTPAAVYTHPEVAMVGLTEEQAREQYGDVLIGKNSFTGNGRAIASNEAHGFVKVIADAKYHEILGVHIIGPAAAEMINEAATIMESELTVDELLLSIHGHPTFSEVMYEAFADVLGEAIHNPPKRK

SEQ ID NO: 89778 - protein, 500 aa, Atriplex centralasiatica
MAFPMPVRQLFIDGEWREPLLKNRIPIINPSTEEIIGDIPAATAEDVEVAVVAARKAFKRNKGRDWAATSGAHRARYLRAIAAKITERKDHFVKLETLDSGKPLDEAVLDIDDVATCFEYFAGQAEALDAKQKAPVTLPMDRFKSHVLRQPIGVVGLISPWNYPLLMATWKIAPALAAGCTAVLKPSELASVTCLEFGEVCNEVGLPPGVLNILTGLGPDAGAPIVSHPDVDKIAFTGSSATGSKIMASAAQLVKPVTLELGGKSPVIMFEDIETVVAVEWTLFGVFWTNGQICSATSRLLVHESIAAEFVDRMVKWTKNIKISDPFEEGCRLGPVISKGQYDKIMNFISTAKSEGATILCGGSRPEHLKKGYYIEPTIITDITTSMQIWKEEVFGPVICVKTFSTEDEAIELANDTEYGLAGAVFSKDLERCERVTKALEVGAVWVNCSQPCFVHAPWGGVKRSGFGRELGEWGIENYLNIKQVTSDISDEPWGWYKSP

SEQ ID NO: 89779 - protein, 519 aa, Cryptococcus neoformans var. neoformans JEC21
MRLPWVKKNVDLEPKTGDEPHDSNFIEKKLGLSKKGAIFAAGASLFSDGYANASIGPATTIIKTYVYPDLFESRPVNSRLLPAIAFAGIIVGQLSFGWISDKVGRKFGMLLCTGIVFVFSALQAASKGVGGAQGTINALIAYRFLVGIGIGGEYPTGSVAAAENTEDPDIPKASQQRLFVLATNSMIDAAFVISYFVCLVLLWIFGMNHLNAVWRMTLGLGCVPPLFLFYFRLKMKEPESYEKYSMKHTRIPYWLILKRYWVKLAAVSITWFLYDWITYPFGLYATPITDAADPNGTLYTSIGWGCLINFFYLPGTLFGAFIVDYLGPKYCMIFGLCMQAIFGFVLSGCYNLLTQPHRIAGFAILYGFFLSFGEVGPGNNLGLLASKAIGPTAARGQLYGIAAAVGKVGAFIGTYTFPQIQASFGKHGQYAEDTGVFYLGSALALVSALITLIFIPNIQPDAMHDEDIAFREYLEANGFDTSKMGLKDTASDVEVGDGSRDEKENKTPNESIETHALAI

SEQ ID NO: 89780 - protein, 146 aa, Helicobacter hepaticus ATCC 51449
MEINREEFSEVVVNIGRVTKVVKGGRRFRFNALVVVGNKNGLVGFGLGKAKEVPDAIKKAIDDAFKNIIKVNIKGTTIAHDIEHKYNASRILLKPASEGTGVIAGGSTRPVIELAGIKDILTKSLGSNNPYNVVRATIDALARIKA

SEQ ID NO: 89781 - protein, 469 aa, Streptococcus pyogenes M49 591
MAFEIIMPKLGVDMQEGEIIEWKKQEGDTVNEGDILLEIMSDKTNMELEAEDSGVLLKIVRPAGDTVPVTEVIGYIGAEGESVDTIASSEKTTEIPVPASADAGPTVAPKENVASPAPQVAATAIPQGNGGKVRATPAARKVAAEMGIDLGQVPGTGPKGRVHKEDVENFKGAQPKASPLARKIAADKGIDLATVSGTGFNGKVMKEDIMAILEAAKPAEAKAPAAKEEKVVDLPEGVEHKPMSAMRKAISKGMTNSYLTAPTFTLNYDIDMTEMIALRKKLIDPIMAKTGLKVSFTDLIGMAVVKTLMKPEHEYMNASLINDANDIELHRFVNLGIAVGLDDGLIVPVIHGADKMSLSDFVLASKDVIKKAQTGKLKAAEMSGSTFSITNLGMFGTKTFNPIINQPNSAILGVGATIPTPTVVDGEIVARPIMAMCLTIDHRLVDGMNGAKFMVDLKKLMENPFELLI

SEQ ID NO: 89782 - protein, 427 aa, Mycobacterium avium subsp. paratuberculosis K-10
MRYRPGEALLALYRRRGPVIDAGAGRHGYTLLLGAEANKFVFANADAFSWRATFENLALVDGPTALIVSDGDDHRRRRSVVAPGLRHRQIQDYVTTMVSCIDRVIDGWRPGQRLDVYQHCRAAVRRSTAESLFGPRLAVHSDALGEHLQPLLDLTHQPPQLVGLQRRINAPAWRRAMAARQRINNLVDTLIADARAAPNPNDHMLTMLIDGRGDEGYTLSDNEIRDAIVSLVTAGYETTSGALAWAVYLLLSQPGAWATAAGEVRRVLAGLPPAAADLSGLTYLNGVVHETLRLYPPGVISARRVMRDLRFKGRRIRSGRLLIFSPYVTHRLHEIWPEPRRFAPERWNPDAPGYRRAAPHEFIPFSAGLHRCVGAAMATTEMTVMLARLLARTRLRLPAQRLRAANVAALRPTPGLTVEVIDSVPAQ

SEQ ID NO: 89783 - protein, 348 aa, Ustilago maydis 521
MGAEDYSPPATDIITLTRHVLTEGFKLRTESAASGDLTILLSSLQTTCKFIESNVRKASLINLIGAAGNTNVQGEDQKKLDVLSNEIMINALRASGKTAVLVSEEDDEAIFVGEKEEGGTFESTKGKYCVVFDPLDGSSNIDAGVNIGTIFGIYLVKEGSKGTLEDVLRPGREMVAAGYCMYGSSANLVLTTGNGVNGYTLDNQIGEFILTHPNIRLPSRGKIYSVNEGNSMYYYEPVLKYLDSIKYPKGEGAKPYSARYIGSMVADVHRTLLYGGIFIYASDKKSKDGKLRMLYEAFPMAFITEQAGGLATTGTQRILDIQPTSIHQRCPVFLGSKDDVEDLMKCFQ

SEQ ID NO: 89784 - protein, 277 aa, Bacillus cereus ATCC 14579
MILTNLKDYTTLHNGVKMPWFGLGVFKVEDGSEVIDSVKAAIKNGYRSIDTAAIYQNEEGVGQAIRESGVSREELFITSKVWNSDQGYETTLQAFETTLEKLGLEYLDLYLVHWPVKGKYTESWKALETLYKDGRVRAIGVSNFHIHHLQDVFEIAEIKPMVNQVEYHPRLAQEELHAFCKEHNIQLEAWSPLMQGQLLDNPTLQEIATKYNKSTAQIILRWDLQNEVVTIPKSIKEHRIIENANIFDFELSADDMKAIQALNEDRRVGPDPDNFNF

SEQ ID NO: 89785 - protein, 404 aa, Oenococcus oeni PSU-1
MPEVKKNLDKKTNSFVQGAKPSQIISLNKEFKKIDNIVLLTVGEPDFNTPEHIKKAAIADIQANDSHYGPSSGTPELLQSVADFLKNHYHLNYDPATEIVNTLGVTEGICDTMKTILNPGDELIVPEPTFPVYAAAASAFGGKIVPVSTEESGFILTAEKLKQVLLAHPQAKAIVLTTPGNPTGVAYNEKQIQALVNVLKNHDIFVISDEIYSELTYDRPHSSFAAALPGQTILFNGVSKSHAMTGYRLGIIAGPQSIISQIAVIHQLITTALPDVVMAAATEAFSAGENDAATMRVEYKKRRDYLIDAFTKLDISFAYPDGAFYFFFKIPDYLEQDGFKLARQIAEEAKVGLTPGVAFGQAGYLRLSYAASLDQIKIAVNRLSEFFSKQKQAQAKIYEKSTTK

SEQ ID NO: 89786 - protein, 267 aa, Bacillus cereus ATCC 14579
MLTKHRILFIGAGRMAEAIFSGLLKTSKEYIEEIIVSNRSNIEKLKQLQHQYNVSTTTDWKQHVTSVDTVVLAMPPSAHEELLAELSPLISNQLVVTVAAGIGPSYLEARLPKGTPVAWIMPNTAAEIGKSISLYTMGQSVNEIHQETLQLLLKGIGTSQLCTEEEVHQLTAVTGSAPAFLYYFAESLIEATKSYGVDEETAKHLVIQMISGSASMLEQTQNPANLREQVTTPGGSTAEGLKTLYEYNFSEAIQKAVEATNKKARGK

SEQ ID NO: 89787 - protein, 252 aa, Helicobacter hepaticus ATCC 51449
MAIGIKSKKDIESLRIPNKIVAQTLELLRLEAKEGISLLELDRKAKDFIISQGGRPSFYQLYGFPQSICISVNQVIIHGIPTDYILKNGDIVGIDIGVEYNGWYGDAAITIGIGDIQETDRILIDCAKDTLYEAISKVKIGMRFKELSLILEQAINGRGFVPLRGFCGHGIGRSPHEEPEIPNYLESPHTNQGPKIKEGMVFCLEPMIAQHNGEPVILNDNWSVIAKDGLNGSHYEHTIAIVDGKAEILTEV

SEQ ID NO: 89788 - protein, 207 aa, Zea mays
  misc_feature (54)..(54): Xaa can be any naturally occurring amino acid
  misc_feature (72)..(72): Xaa can be any naturally occurring amino acid
  misc_feature (121)..(121): Xaa can be any naturally occurring amino acid
  misc_feature (126)..(126): Xaa can be any naturally occurring amino acid
MITMIDNAAYPRPAHQAIPAAEVLTGTTEQRLSSIRVHKADDNRRGLPDLLFCXHGDLKQIPGEIHFDQSLXHKTNQVNPFEDVSRRQKPPSTQAEKQPLTGAAADHETTTSGHDDIAMRXSKYYXTPARCAIRRRVLKIGPNESSQLAIDLNAQGLSRYAIICQENGLMPIVEPEILADGPHDIDRCAYVTETVLAACYKALNEHH

SEQ ID NO: 89789 - protein, 319 aa, Solanum tuberosum
MAVNGSALSSGLIVSFGEMLIDFVPTVSGVSLAEAPGFLKAPGGAPANVAIAVTRLGGKSAFVGKLGDDEFGHMLAGILKTNGVQADGINFDKGARTALAFVTLRADGEREFMFYRNPSADMLLTPDELNLDLIRSAKVFHYGSISLIVEPCRSAHLKAMEVAKEAGALLSYDPNLRLPLWSSEAEARKAIKVSDVELEFLTGSDKIDDESAMSLWHPNLKLLLVTLGEKGCNYYTKKFHGSVGGFHVKTVDTTGAGDSFVGALLTKIVDDQAILEDEARLKEVLRFSCACGAITTTKKGAIPALPTESEALTLLKGGA

SEQ ID NO: 89790 - protein, 451 aa, Bdellovibrio bacteriovorus HD100
MKNLPRIILCLSLTTALSACSGGFSGKKSGQDDQASENPPQSSPTQPPSQSPGQGQTPTPSPEPVPAPAPEEPAPTPEPSPAPTPEEPTPAPAPAPEPAPAPAPQPAPEPAPVPAPTPDPTPAPVPTPTPEPSPAPAPEPSPAPAPQPTPDPAPAPTPAPEPAPEPTPAPTPTPVPVPEPAPVPEPVPTPVSGCPENYELVAANSTVKTEAFCIAKFEMKKVGGKAVSTAANKPWLATKAAAIDACAALGAGYRLPTNSEWNAAALEIYYNQENWIDKNKKDTLYTGYYSGWSEPVEVKDPTNPYDSTGKTSGSERRTFVLASGKVIWDFGGNAWEWVSDTIYGNSYNPDLSSFYGRQYHNNNWDVKPGSKALFDFTGLADAGKKDTSMGNLFGGSSGKVIRGGALCMHSKGTTGIFTANIGDITADEMQAPASWNLKINNIGFRCVTKPQ

SEQ ID NO: 89791 - protein, 431 aa, Rhodopirellula baltica SH 1
MIVTTSPSKLDVAKIRDDFPILGIRSASDRPLVYFDNAASTQRPTSVIEAMSRCYREYYSNVHRGIHTLSEASTQAYENARATVASFMNAASTNEVIFAAGTTAAINTVARTWGDQNLSQGDVILLLISEHHANIVPWHQLAERVGCRVEFIPVDEEFLIDDEAVASAIETHQPKLFAFGAASNTLGTEYPVKRWTRMAHDAGASVLIDAAQAAPHWKMDVQDWDADFVVFSGHKVCGPTGIGVLWGRESLLDSMPPFLGGGGMIQTVTTEGFTSHALPEKFEAGTPPIVEAIGLEAAIEYLTQVGMDNIHAHERQLGSRADAGLREIAGVRVIGPTPEHKGGINSFVIDGVHAHDVSQFLDGQGVAVRAGHHCTMPLHHAIGVTATSRASCYFYNTVDEVDVFLQAVSDVRDRFAKTGRRRRSRASRSDS

SEQ ID NO: 89792 - protein, 434 aa, Bacteroides thetaiotaomicron VPI-5482
MTIIKYIKFVVIIVIVTIVFSCSKNEAGNSEYDPSLPISLTDFFPIQGGMATRMVIEGANFGTDLSQIKVFFNQKEASILNVKNSIIYLLVPKLPGNDCIVTVKVGNQEARFTRNFQYIENYSVTTIAGQPGTNLFVEGTLAAAQFGPVQHLAIDDENNLFITERNGSDGKGTCSVLNEESGTVTFLFKASDNLNVPTVNAQTQNVYIPLDGGYTFYELNPVNQWIAKSRLVLHPSKEQQEAGMDDFEINWKHSLAFSRYDNMIYTRSYGGDLIKVDPETRVGQKIGNFFPNTDSFIVAHPTQPEILYIAYAAKHVIYTYNIETGEHKLFAGAFGQSGWNDGIATDAEFNSPRQMSLDMEGNIYIADSGNHCIRMIDKNGIVTTPIGQPGEAGYADGSPDMALLNDPRGVAVNSEGDVYIADLGNRCIRKLTLQ

SEQ ID NO: 89793 - protein, 459 aa, Vitis vinifera
MEDLWKSRARSLQLRLRDRFRIAVDRHRRLPMFSTDGYFSSTLQRWLRRVRDFRRDSLPSSSAFYRKRVGKDIGAEEDSVFVRMLQALAVPVIGNVCYVFMHGLNRVQVYGAEKLHEVLLHRPENKPLITVSNHVASVDDPLVIASLLPPSVLLDARSLRWTMCATDRCFKNPVTSAFFQCVKVLPVSRGEGIYQKGMDMAVSKLNSGGWVHIFPEGSRSRDGGKTMGSAKRGVGRLVLDADNTPIVVPFVHTGMQEVMPIGANFPRIGQAVTVLIGDPIHFDDLLNEQQTQHMSRGKLYDAVSSRVSHRLQELKVQVDKLALEHSIQLQNHDMQTTERAAGILHQVDWESFGMGSYITSENDSSSRLEIQSPMKLNVTNTQEHAPSERYFGMGFSYEGGIVSRIRGYMDPTELMGFAARGLFLNRRAEEKLASIQEIRPLKAWKQFLEANILQQWSAC

SEQ ID NO: 89794 - protein, 208 aa, Ureaplasma parvum serovar 3 str. ATCC 700970
MAKFIKSAHYFDQYPIDKQFEICVIGRSNVGKSSLINALANKKIARTSNTPGRTQLVNFFDFNNFRLVDLPGYGFAKVSKEKQTDLAAIIDQYLGYRQNLCAVFQICDINVLTNDDVEMSRYFENQKYAHFVVLNKLDKVNKSYFNNNKHKIAKFLNISTDRLLCVSAQNNINIITLFALMKKVVIQAKQEKILSKKEEKMSSEEEIK

SEQ ID NO: 89795 - protein, 228 aa, Zea mays
MAANGGDELKLLGVWDSPYVNRVQIVLNLKGLSYEYVEEDLLSKSELLLNSNPVHKKVPVLIHAGKPVAESQAIVQYLDEAFPSGTFPSVLPAEPYARATARFWAAFVDDKVGSPWHTVLFAREHGKKADAASRIVAALETLEGAFEDCSGGRDYFGGDAIGFVDVVLGSYLGWFKVFEKMVGVRVLDVARTPLLAAWGERFAAAEAAKDVLPDDVDKVLEFLQKFLD

SEQ ID NO: 89796 - protein, 85 aa, Phalaenopsis sp. SM9108
RDLKWRTGVKIFPVHCHSSNGFQLTLPSLQSAYSIAEASNLRVKALLITNPSNPLGTTMPRSLLEDILNFISQKNIHLISDEIYS

SEQ ID NO: 89797 - protein, 206 aa, Oryza sativa
  misc_feature (31)..(31): Xaa can be any naturally occurring amino acid
  misc_feature (118)..(118): Xaa can be any naturally occurring amino acid
  misc_feature (186)..(186): Xaa can be any naturally occurring amino acid
WNQKNLFCGWYDADLSEKGNEEAKQAGKWLXEKGYTFDIAFTSVLKRAIKTLYNIQQELDLHWIPVQRHWRLNERMYGALQGKNKSETAAKYGEDQVKIWRRAYDIPPPELEESSEYXPRTDSKYKNLDPRVLPLTECLKDTVDRALPYWHDAIVPAIRSGQKVLIAAHGNSLRALIKYLDKVPDXEIVETHLPTGIPLVYELDAI

SEQ ID NO: 89798 - protein, 497 aa, Aspergillus nidulans FGSC A4
MKPTQVLRLAVAAPDVNPQTRKARSIPVLNPFDLYGRVFFFSWIGFLVAFLSWYAFPPLLSVTIKKDLHMSQDDVANSNIVALLGTFVMRFIAGPLCDRFGPRLVFVGLLICGAVPTAMAGLVTTPQGLIALRFFVGILGATFVPCQVWCTGFFDKNIVGTANSLAGGFGNAGGGITYFVMPAIYDSFVHDRGLTPHKAWRVSYIVPFIIIVSIALAMLFTCPDTPTGKWADREKTSGQSIVDLSSTPNASSANSINISSDEKKAVHPEVTDSEAQVHVRAGQIESSDAVIEAPTIKRYLSIALDPSALAVAVPYACSFGAELAINSILGAYYLLNFPLLGQTQSGRWASMFGLVNVVFRPMGGFIADLIYARTNSVWAKKMWLVVLGLAMSGMAILIGFLDPHRESVMFGLVVLMAFFIAASNGANFAIVPHVHPSANGIVSGIVGGMGNFGGIIFAIVFRYNGTQYHRSLWIIGFIILGCTLFFSWVRPVPKQNH

SEQ ID NO: 89799 - protein, 85 aa, Phalaenopsis sp. SM9108
RDLKWRTGAQIIPIRCSSTNSFRLTKTALDNAYRRATKLKLQVKGIVVTNPSNPLGTTMTSIELHTLVDFIEANNLHLICDEIYS

SEQ ID NO: 89800 - protein, 307 aa, Prunus mume
MGGGEDCMIIPVIDMQKFPDAEEYKKLREASEIWGCFRLINHKIPLALMKEMKAVVRSLLDLPMEIKQQNKDVIAGSGYMAPSKVNPLYEALGLYDLGSPEAVHTFCSKLDASSHQREIISKYAQAVYDQIVEIGHKLAESLGLENVDFLNGWPCQFRINKYNFKPESVGSSGVQIHTDSGFLTILQDDENVGGLEVMDKAGAFVPVDPCPGTLLVNLGDVAQAWSNGRLCNVRHRVQCREATIRVSIATFLLGPKDQEAVEAPPEFVDSEHPRLYAPFTYEDYRKLRLSSKLQAGEALALLRTTPS

SEQ ID NO: 89801 - protein, 458 aa, Bacillus subtilis subsp. subtilis str. 168
MTDDMTKDNINQQTLQRGLKNRHIQLIAIGGAIGTGLFLGSGKSIHFAGPSILFAYMITGIICFLIMRSLGELLLSNLNYHSFVDFVQDYLGDMAAFITGWTYWFCWISIAMADLTAVGLYTQYWLPGVPQWVPGLIALIILLIMNLATVKLFGELEFWFALIKVIAILALIVIGLVMIFKGFSTSSGVSSFTNLWSHGGLFPNGMHGFILSFQMVVFAFVGIELVGLTAGETENPEKVIPKAINNIPVRVLLFYIGALLVIMSIYPWDIINPSESPFVQVFVAVGIVGAASIINFVVLTSAASACNSAVFSTSRMVYSLAKDHNAPESMAKLTQRKVPRNALFFSAIVILIGVTLNYIMPEGVFTLITSISTVCFIYIWGITVICHMKYRKTRPELAKTNKFKLPLYPFTNYLILAFLAFVLVVLALAQDTRVSLFVTPVWFILLIVIYKVRKAKHQ

SEQ ID NO: 89802 - protein, 757 aa, Sulfitobacter sp. EE-36
MTDAPNLRQAALDYHAFPKPGKLEVRATKPLANGRDLARAYSPGVAEACLEIKADPTTAAHYTTRANLVGVVTNGTAVLGLGNIGALASKPVMEGKAVLFKKFANIDCFDIELDQNDPEKLAELVCALEPTFGAINLEDIKAPDCFTVERICRERMNIPVFHDDQHGTAIVVGAAVKNALFVAGKKFEDIKIVSTGGGAAGIACLNMLLKLGVKRENVWLCDIHGLVYEGREIDMNPIKSEYAQKSDLRDLADVIHDADLFLGLSGPGVLSPEMVQKMAPQPIIFALANPTPEIMPDLARAVAPDAIIATGRSDFPNQVNNVLCFPFIFRGALDVGATTINDEMKIACIDGIAALARATTSAEAAAAYQGEQLTFGPDYLIPKPFDPRLIGVVSTAVAKAAMDTGVATRPIEDLAAYRHKLDSSVFKSSMLMRPVFEAARVAPRRIVFAEGEDERVLRAAQAMVEETKERPILIGRPEVIERRIEKAGLTIKLGETVDLVNPENDPRYRDYWETYHNLMARRGVSPDIARAIMRTNTTAIGAVMVHREEADSLICGTFGEFRWHMNYIEQVLGRDGRRPHGALSLMILEDGPLFIADTQVHLHPTPEQIAEIAIGAARHVQRFGIEPKIALCSQSQFGNQGEGSGKRLRAALRLLDAGNHDFCYEGEMNIDAALDPELRSRLLPSNRMEGAANVLVFAHADAASGVRNILKMKGGGLEVGPILMGMGNRAHIVSPSITARGLLNVGAIAGTPVAEYG

SEQ ID NO: 89803 - protein, 177 aa, Triticum aestivum
MLRAGGSRLVAPGLRRLLGPGAGERAAPGLAAAGAGARAYHERVVDHYNNPRNVGSFDKDDPNVGTGLVGAPACGDVMKLQIRVDEGTGKIVDACFKTFGCGSAIASSSVATEWVKGKQMEEVVSIKNTEIAKHLSLPPVKLHCSMLAEDAIKAAVKDYGSKKAKLGDSPAEKAAEA

SEQ ID NO: 89804 - protein, 318 aa, Musa acuminata
MDSFPVIDMEELLGRERGAAMEILRDACEQWGFFEILNHGISHDLMDKVEKVNKEQYNKCREQKFNEFANKALENADSEIDHLDWESTFFQRHLPVSNISEIPDLDDQYRKAMKQFAAAIEKLAERLLDLLGANLELEKGYLKKAFSNGSKGPTFGTKVRSYPPCPRPDLVKGLRAHTDAGGIILLFQDDQISGLQFLKDGEWLDVPPMGHAIVVNLGDQLEVITNGKYKSVVHRVVAQTDGNRMSIASFYNPGSDTVIFPAPALVEKEAEEKKEVYPRFVFEDYMKLYVGHKFRAKEPRFEAMKAMEAVATHPIATS

SEQ ID NO: 89805 - protein, 610 aa, Oryza sativa
MEGSGQSDKGGHVTWTSSMSTYMLEYLEGIVASGNKTSSGFKQVHLKACAKALNDHFNINLTSDQITNHIRTWKRKYSKIADLRKLSAALWDDENFIISLDHKHYADHIKDHKADAEYLNKPIHNYGKMLVIFGNSLATGKYAKGSGDPLATESIPIDDDEEEEIGIGSAAATGSASRVHALNEENGASSSAPKPKKAKTDAAIEEEGLIGAFKSVGDKLAGAIVEAGKEAAKSNKELPDNLYESVHSIPGFEDTHLAHYHAHLVDNPPTARVFVTLEFAHKVDNKYVMQLIICTCNYPIFPSIPGRSVGLGAAAASEAMDASSVALYGQLKAAQPFFLLAGPNVIESEEHVLKMAKHIKGITTKLGLPLVFKSSFDKANRTSSKSFRGPGLEEGLKILEKVKATYDLPVVTDVHESHQCEAVGRVADIIQIPAFLCRQTDLLVAAAKTGKIINIKKGQFCAPSVMANSAEKIRLAGNQNVMVCERGTMFGYNDLIVDPRNFEWLREANCPVVADVTHALQQPAGKKLDGGGVASGGLRELIPCIARTSVAVGVDGIFMEVHDDPLNAPCDGPTQWPLRNLEELLEELIAIARVTKGKKPLKIDLTPFKE

SEQ ID NO: 89806 - protein, 378 aa, Aspergillus oryzae
MGVNFKVLALSALATISHASPLLYPRATDSNVTYVFTNPNGLNFTQMNTTLPNVTIFATGGTIAGSSADNTATTGYKAGAVGIQTLIDAVPEMLNVANVAGVQVTNVGSPDITSDILLRLSKQINEVVCNDPTMAGAVVTHGTDTLEESAFFLDATVNCRKPVVIVGAMRPSTAISADGPLNLLQSVTVATSPKARDRGALIVMNDRIVSAFYASKTNANTVDTFKAIEMGNLGEVVSNKPYFFYPPVKPTGKTEVDIRNITSIPRVDILYSYEDMHNDTLYSAIDNGAKGIVIAGSGSGSVSTPFSAAMEDITTKHNIPIVASTRTGNGEVPSSAESSQIASGYLNPAKSRVLLGLLLAQGKSIEEMRAVFERIGVA

SEQ ID NO: 89807 - protein, 212 aa, Bdellovibrio bacteriovorus HD100
MTPQSQPQETAVALIPYVIEQTSKGERSYDIYSRLLKDRIIILGTAVTDEVANSIIAQMLFLEVDNPEKPIHLYINSPGGSVSAGLAIYDFMQFVKCDVATYCMGMAASMGSLLLTAGTKGMRYSLPNTRIMIHQPLLSGGGLSGQVTDIEIHAKELVKTKEKLTRIYETHTGRDYDTLRAAMERDNFMDPYQAKEFGLLDHVVESRKAKKG

SEQ ID NO: 89808 - protein, 623 aa, Arabidopsis thaliana
MKLGLFTLSFLLILNLAMGRFVVEKNNLKVTSPDSIKGIYECAIGNFGVPQYGGTLVGTVVYPKSNQKACKSYSDFDISFKSKPGRLPTFVLIDRGDCYFTLKAWIAQQAGAAAILVADSKAEPLITMDTPEEDKSDADYLQNITIPSALITKTLGDSIKSALSGGDMVNMKLDWTESVPHPDERVEYELWTNSNDECGKKCDTQIEFLKNFKGAAQILEKGGHTQFTPHYITWYCPEAFTLSKQCKSQCINHGRYCAPDPEQDFTKGYDGKDVVVQNLRQACVYRVMNDTGKPWVWWDYVTDFAIRCPMKEKKYTKECADGIIKSLGIDLKKVDKCIGDPEADVENPVLKAEQESQIGKGSRGDVTILPALVVNNRQYRGKLEKGAVLKAMCSGFQESTEPAICLTEDLETNECLENNGGCWQDKAANITACRDTFRGRLCECPTVQGVKFVGDGYTHCKASGALHCGINNGGCWRESRGGFTYSACVDDHSKDCKCPLGFKGDGVKNCEDVDECKEKTVCQCPECKCKNTWGSYECSCSNGLLYMREHDTCIGSGKVGTTKLSWSFLWILIIGVGVAGLSGYAVYKYRIRSYMDAEIRGIMAQYMPLESQPPNTSGHHMDI

SEQ ID NO: 89809 - protein, 205 aa, Picea sitchensis
MQGALRSIQLHGGIFKNSILQHLRVAEPSFRSKIIARHESVSPARLEEHGFESTTIADILKGKGKSADGSWLWCTTDDTVYDAVKSMTQHNVGALLVVKPVEEKSIAGIITERDYLRKIIVQGRSSKTTKVGDIMTEENKLITVTSDTKVLKAMQLMTDNRIRHIPVVEGKSMLGMVSIGDVVRAVVDEHREELKRLNAFIQGGY

SEQ ID NO: 89810 - protein, 144 aa, Triticum aestivum
  misc_feature (69)..(69): Xaa can be any naturally occurring amino acid
  misc_feature (88)..(88): Xaa can be any naturally occurring amino acid
  misc_feature (116)..(116): Xaa can be any naturally occurring amino acid
  misc_feature (126)..(126): Xaa can be any naturally occurring amino acid
MAPTVMASSATSVAPFQGLKSTAGLPVSRRSNGASLGSVSNGGRIRCMQVWPIEGIKKFETLSYLPPLXAREALLKQVDYLIRSKWVXPCLEFSKVGFIFREHNASPGYYDGRYWXTMWKLPMFGXCTDATQVINEVEESRRST

SEQ ID NO: 89811 - protein, 447 aa, Arabidopsis thaliana
MEGRLANMWRVTVNESKFVETALQSELRVDGRGLYDYRKLTIKFGKEYGSSEVQLGQTHVMGFVTAQLVQPYKDRPNEGSLSIFTEFSPMADPSFEPGRPGESAVELGRIIDRGLRESRAVDTESLCVLAGKMVWSVRIDLHILDNGGNLVDAANIAALAALMTFRRPDCTVGGENGQEVIIHPLEEREPLPLIIHHLPIAFTFGFFNKGNIVVMDPTYVEEAVMCGRMTVTVNANGDICAIQKPGEEGVNQSVILHCLRLASSRAAATTKIIREEVEAYNCERSLQKVKRHPTLAKSEVSGPTVAVKEEHRKSSDQERAAEISREHVERLKLSTEEVRSSKEEEAANFKGGPSNWYSLECFTLWDPYSEAMDVDSLKVSLASRGDPVTKSSSTKKMNGSGNAQKVGVEISVEEVTGELGKKDTKHKDGEMTLKDAVKPKKKRKNKS

SEQ ID NO: 89812 - protein, 704 aa, Desulfovibrio vulgaris subsp. vulgaris str. Hildenborough
MSNNLYITATESKSGKSAVVLGMMQLLLRDVRKVAFFRPIINQASTDVRDHDINLILRHFGLDIAYEDTYAYSLQDARELINNGQHATLLDNILKKYKKLEDAYDFVLCEGTDFLGKDAAFEFELNADIAANLGCPVMVVANGQQKAARELIASTQLTIDLLDEKGLDVVTAVINRATVTEAEREEIIKSLECKVNCSNPLAVYVLPEESTLGKPTMNDVKKWLGAQVLYGHGRLDTLVDDYIIAAMQIGNFLDYVSQGCLVITPGDRSDIILSSLASRLSTAYPDISGLLLTGGLEPAANVHRLIEGWTGVPIPILSVKDHTYKTIQTLNELYGKIEPDNDRKINTALALFERHIDSSELGSRLINRKSSRITPKMFEFNLIEKAKRNRMRIVLPEGAEERILRAADILVRREVADIILLGDANTVGSRIGDLGLDMDGVQIVQPNLSPKFDEYVAAYHECRKKKGISMEQARDMMNDPTYFGTMMVHKGDADGMVSGAINTTAHTIRPAFEFIKTKPGVSIVSSVFLMCLKDRVLVFGDCAVNPNPTAEQLAEIAISASHTARIFGVDPRVAMLSYSTGSSGKGADVEKVIEATRIAKERAPELLLEGPLQYDAAIDMDVARTKLPGSTVAGQATVFIFPDLNTGNNTYKAVQRAAGAVAIGPVLQGLNKPVNDLSRGCTVADIVNTVAITAIQAQAEKGLI

SEQ ID NO: 89813 - protein, 123 aa, Triticum aestivum
  misc_feature (58)..(58): Xaa can be any naturally occurring amino acid
  misc_feature (72)..(72): Xaa can be any naturally occurring amino acid
  misc_feature (96)..(96): Xaa can be any naturally occurring amino acid
  misc_feature (121)..(121): Xaa can be any naturally occurring amino acid
MAPTVMASSATSVAPFQGLKSTAGLPVSRRSSSAGLSSVSNGGRIRCMQVWPIEGIKXFETLSYLPPSPRRXLLKQVDYLIRSKWVPCLQFNKVGXFSRGAKQFPPGNTMGQYWAMWELPXFG

SEQ ID NO: 89814 - protein, 422 aa, Ureaplasma parvum serovar 3 str. ATCC 700970
MNSLNKKSIKDLDVNGKTIVLHLDLNVVVDYENKRILNDRKLRASLPTINYLINHNAKIVILSHLGRIKTLADKQSGKYSLEIIVDELRNRVSKNVNRVVFSPLNYGETVVQMVNDLEERDILILENTRYCDISDEGEYVGLEWDGSEILGQFWGMLGDIFIDDAYGVAHRQLSSNYQTAKFAKKSALGFLIVNEINHLDIALEVPKSPYLALIGGNRVADKIAAIEVLCERADQVIIGGGLVYTFLYAQGYNVGLNLVERNMIDDCNNILEKYGKKILICFDFLCNNDFSDTRPIYRKIDEGLEGLYGLDIGKRSLKFIKHEIYRSKTILLNGPFGVIENIKNYAQGTTEICKSMAKQTTRGAYTIICDIDTSSHAEYLGLDKYINFISTGGGASLSYIEEGVLDGLETIDNVPLNVLKKE

SEQ ID NO: 89815 - protein, 210 aa, Oryza sativa
IKRISENASYRIANMAGEIAARRQRVRDSTGSDASKSAVVTITHKSNVLSQTDGLFRSTARAALEQARFRDGGIKIEEQIVDSMVYKLFRQPSTYDVIVAPNLYGDILSDGAAALVGSLGLVPSANVGDGFAMGEPCHGSAPDIEGQNIANPIATIRSVALMLEFLGQEDAAAIIYKAVDANLTEGKLLTPDMGGNAKTTEVTEDILRRL

SEQ ID NO: 89816 - protein, 299 aa, Glycine max
MASPTHFDDDFDFGDGFGGRHSGNKRSSPDYDDEDYDNDPFAPKKSKTKAEEASGVTTGMILSLRESLQNCKETLATYQNELEAAKSEIQSWHSTLKNEPSKSAGITPEPKMLINYLQTLKFSEESLREQLEKAKKKEAAFIVTFAKREQEIAELKSAVRDLKVQLKPPSMQSRRLLLDPAVHEEFTRLKNLVEEKDKKVKELQDNIAAVSFTPQSKMGKMLMAKCRTLQEENEEIGNQASEGKMHELGMKLALQKSQNSQLRSQFEGLQKHMEGLTNDVERSNEMVFTSFSFSIFFVI

SEQ ID NO: 89817 - protein, 473 aa, Prochlorococcus marinus str. MIT 9215
MSKSPQDVLSQIKDEGIELIDLKFADIHGKWQHLTLTSDMIEEDSFTEGLAFDGSSIRGWKAINASDMSMVPDASTAWIDPFYKHKTLSMICSIQEPRSGEPYDRCPRYLAQKAIKYLESTGIADTAFFGPEPEFFLFDDVRYDSKEGSCFYSVDTIEAPWNTGRIEEGGNLGYKIQYKEGYFPVSPNDTAQDIRSEMLLLMGELGIPTEKHHHEVAGAGQHELGMKFDSLINSADNVMTYKYVVRNVAKKYGKTATFMPKPVFNDNGTGMHVHQSLWKSGQPLFFGEGAYANLSQTARWYIGGILKHAPSFLAFTNPTTNSYKRLVPGFEAPVNLVYSEGNRSAAVRIPLTGPSPKAKRLEFRSGDALANPYLAFSVMMLAGIDGIKNQIDPGDGVDVDLFELPADELAKIDTVPSSLNDSLNALKADNEYLLAGGVFTEDFIDNFIDIKYEEVQQLRQRPHPHEFFMYYDA

SEQ ID NO: 89818 - protein, 271 aa, Sulfitobacter sp. EE-36
MKDTRIAKDGLVLLGCGKMGSAMLAGWLARGLPTSSVYVIDPKPSDWLKEQGVQLNVDLPKEPAVVLVAVKPQMMGDALPTLQAMGNGKTVFVSVAAGTTIATFEKTLGEQTPIVRAMPNTPAAISQGITAIVGNNHVDAKGMDEAEELLSAVGDVVRLEEESQIDAVTGVSGSGPAYVFHMIETMAAGGIAQGLSPELALKLATATVAGAGALAKSADEGPDQLRVNVTSPNGTTQAALDVLMNEQDGFPVLLKRAVAAAADRSRELSNG

SEQ ID NO: 89819 - protein, 224 aa, Geobacillus kaustophilus HTA426
MTVRDNLAAIRREIEAACARVGRDPAGVRIVAVTKYVDAERAMEVLDAGIADLGENRSDQLIEKHARIGNQATWHFIGTLQSRKVKDIIDKVDYIHSLDRLSLAKEIEKRAVRPVKCFVQVNVSGEVTKHGLAPEETIPFIEQLRAFSRIEVVGLMTMAPHTDDEAVLRACFRRLRMLKERVQALGMAHAPCTELSMGMSNDYTIAIEEGATFVRIGSALVGSL

SEQ ID NO: 89820 - protein, 394 aa, Prochlorococcus marinus str. MIT 9215
MTEAKLFPALNEANLSHFSKTYVPSRLLLGPGPSNAHPEVLSALSLNPIGHLDEAYISLMSDVRQLLRYTWQCNNRLTLPMSGTGSAAMEASIANFIEEGEKILIAKKGYFGDRLVDMAARYKAQVSVIEKPWGEAFTYEEIKYEIETKKPAIFAIVHAETSSGVLQPLDGIGDICRENNCLFLVDAVTSLGALELLVDEWKIDLAYSCSQKGLSCPPGLSPFTMNKRAEEKLSSRKTKVPNWYLDLSLLNKYWGSDRVYHHTAPVNMNFAIREGLRLIANEGLKNVWNRHNTNAKKLWNGLESLGMELHVPEEYRLPTLTTVKIPPAVDGDGFRNHLLRNFGIEIGNGLGELSGKVWRVGLMGFNSCEENVDRLLNLFDTELKKFSIFESSTF

SEQ ID NO: 89821 - protein, 397 aa, Streptococcus pyogenes M49 591
MPKLSKRVLEMKESVTLAAGARAKALKAQGRDVLNLTLGEPDFFTPKHIQDKAIESIQNGTASFYTNASGLTELKAAIATYLKNQYGYHLSPDQIVAGTGAKFILYAFFMAVLNPGDQVLIPTPYWVSYSDQVKMAEGQPIFVQGLEENQFKVTVDQLERARTSKTKVVLINSPSNPTGMIYGAEELRAIGEWAVHNDILILADDIYGSLVYNGNQFVPISTLSEAIRRQTITVNGVAKSYAMTGWRVGFAAGEPEIISAMSKIIGQTTSNLTTVSQYAAIEAFCGSQSSLEEMRLAFEERLNITYPLLCQVPGFEVVKPQGAFYFFPNVKKAMEMTGFSDVTSFANAILEEVGLAVVSGAGFGAPENVRLSYATDIETLKEAVRRLHVFMESNEIN

SEQ ID NO: 89822 - protein, 261 aa, Bacillus cereus E33L
MTIYIYRVNAFANNLTSGNPAYVVKTNEQKSEVWMQQLALEFNQPITAFVTLKKDNNYILRWFTPSQEISLCGHGTLASAHILWEENQVSKGSPIYFSTKSKNLEVKYLNEGIQMTFPSDPSAPIHIPNLLQQALSVPIKNVESNSDRYIVELENEELVKSIEPNFDLLSTLPSVGIVVTSLSSKYDFISRYFAPSIGVKEDFVTGSAHCGLAPYWNKRLEKKKFHAFQASKRGGELVIEYEDDITYITGKAYTIYKGILS

SEQ ID NO: 89823 - protein, 626 aa, Bacillus cereus ATCC 14579
MTICSVNNVTKSFGGNTIFENISLEIKNGERVGLVGRNGSGKTTIFGLLTGMESLDAGAIHMKKGTRIGHVAQIPKFDEVMTVYDVLSSAFKVEKELEKEMHALEKNMAVEQEQSALEKLMERYGVIQEKFAFLGGYEIEANIMKVANGLQVTDLFSRVFTELSGGEQTKVSLAYMLLQKPDLLLLDEPTNHLDLFAVEWLEQFLKEYTGTVIVISHDRYFLDEVVTKIFDLEDGEIHVYHTNYSQFVEEKEERLLQEFQAYQEQQKKIKKMKEAIKRLREWANQANPPNEGLHKRARNMERALERIEKLKRPILERKQMGLQFEGQERSGKDVVVMKEVSKGFAGRPLFEQANLHVRFQERAAIVGRNGTGKTTLLKLLLEEINPDVGEIRIGSSVKIGYLSQHTYGNVKSNVLEAFREYVAVTEGEARHILAKFLFYGPAVFKKVTQLSGGEKMRLRLAQLMYQDINFLILDEPTNHLDIESREVLEEALEQYNGTILAVSHDRYFLNKLFEKTYWIDECKLFEFAGNYAWARQKWEEKLEKQVIKQKRQGRKSVEMVPVKEKKARNLEEIENELMHVEEDIYAIECEMEHVADVERLEKLYEEKTMKELLRAKLYSELENIVE

SEQ ID NO: 89824 - protein, 87 aa, Glycine max
MDTQKGPSSSAAAVTSCRKKKNEEATFLEDPSDHIDAFINASMDEHKTCFKKTVQKMFGMSKAVAERDTNAAKEVESSLPLQTTLQD

SEQ ID NO: 89825 - protein, 148 aa, Polytrichum juniperinum
APHLLQFSRDILVNEGPRALYRGLIPSLLGIVPLTGIDLAAYETLKNMSRQFMPPDTEPGPLVHLGCGIVSGALGSTCVYPLQLVRARLQAQPLNAADRYKGMREVFSRTFQAEGIRGFYKGLLPNMLKVVPSASITYLVYEEMKTRL

SEQ ID NO: 89826 - protein, 242 aa, Oryza sativa Japonica Group
MCTLEQRGRVFVLTLTGDGEHRLGHSLIGSIRAAVSSVAAAAAAAGPGAALVTVADGRFFSNGLDIGPGGIPPSRVGELVVALRPLAADLLALPMPTVAAVTGHASAGGFLLTLCHDYRLMRADRGVLYMSEIDIGLPLPPYFVAILRAKITAAHALRDVTLRGRKLKAAEAKEMGIVDVVCPTAAETAAEAVKLAEQLAARKWNGNVYSSIRISMFPEACRSVGIVEESDEEKRNHFASKL

SEQ ID NO: 89827 - protein, 217 aa, Hordeum vulgare subsp. vulgare
MPGHRQSLAAASLKLPSLLLLWIFSWNWGHAVAKFDPANMTELQKHVSFFDRNKDGFITPTETIQGFVAIGCEYAFATAASAAIHGALAPQTTPAGTPLPHLTIYVENIHKAMHGSDSGVYDAKGRFLPQNFEELFKTYAILRPDALTLAEMHVMLFAKRDLDPISWAPPQVEWGLLFTLASDWLGFLHKDSVRGIYDGSLFIKLEKKWHPFQSAMR

SEQ ID NO: 89828 - protein, 299 aa, Triticum aestivum
  misc_feature (178)..(178): Xaa can be any naturally occurring amino acid
  misc_feature (251)..(251): Xaa can be any naturally occurring amino acid
  misc_feature (255)..(255): Xaa can be any naturally occurring amino acid
  misc_feature (260)..(260): Xaa can be any naturally occurring amino acid
  misc_feature (262)..(263): Xaa can be any naturally occurring amino acid
  misc_feature (276)..(276): Xaa can be any naturally occurring amino acid
  misc_feature (279)..(279): Xaa can be any naturally occurring amino acid
  misc_feature (281)..(281): Xaa can be any naturally occurring amino acid
  misc_feature (284)..(284): Xaa can be any naturally occurring amino acid
  misc_feature (286)..(286): Xaa can be any naturally occurring amino acid
  misc_feature (289)..(290): Xaa can be any naturally occurring amino acid
  misc_feature (292)..(292): Xaa can be any naturally occurring amino acid
  misc_feature (295)..(295): Xaa can be any naturally occurring amino acid
  misc_feature (297)..(298): Xaa can be any naturally occurring amino acid
MVISHASSSAGEAVYSTFSSRYVREELPRYRMPEGSIPKEAAYQIISDELMLDGNPRLNLASFVTTWMEPECGKLMMDSVNKNYVDMDEYPVTTELQNRCVNMIAHLFNAPIGEDETAIGVSTVGSSEAIMLAGLAFKRKWANKMKEQGKPCDKPNIVTGANVQVCWEKFARYFEVEXLKEVKLTEGYYVMDPKKAIEMVDENTICVAAILGSTLTGEYEDVKLLNDLLVEKNKKTGWNVPIHVDAASGGXIAPXFSRAXWXXLHGESITLVAQYXCVXGXGWXIXRSXXNXPKXLXXH

SEQ ID NO: 89829 - protein, 145 aa, Acidobacteria bacterium Ellin345
MSILKLCDQSPAFVSINASVADAITMMIDRHAGAVAVVEENHVVAGMFSERDVMRKFALSGRSAESTPVREYMSQYVVMGSPETTPAEALQVMIESRHRHLPIVDSDGKLLGVISIRHVLEAQVDLLTEQLRRSEEDRSASNTIQ

SEQ ID NO: 89830 - protein, 226 aa, Spinacia oleracea
WEQEGSTNAVLEGESDPEGAVSWGSETQVSDEGGVEGGQGFSEPPEEAKLFVGNLPYDVDSEKLAGIFDAAGVVEIAEVIYNRETDRSRGFGFVTMSTVEEAEKAVELLNGYDMDGRQLTVNKAAPRGSPERAPRGDFEPSCRVYVGNLPWDVDTSRLEQLFSEHGKVVSARVVSDRETGRSRGFGFVTMSSESEVNDAIAALDGQTLDGRAVRVNVAEERPRRAF

SEQ ID NO: 89831 - protein, 397 aa, Buchnera aphidicola str. Bp (Baizongia pistaciae)
MKHVLRKEKTLEISATLVLKDGTIFYGKSVGIQGETYGEIVFNTSMTGYQEILTDPSYSNQIITFTYPHIGNVGINKNDCESNVIHAKGLIVRDISSIYSNHRSQMSLLNYLLNQKIIVISNIDTRKLTRILRTTGSQYGYITTKKIHSIINVLKHINILDNPITNKDLVKQVSTKKFYIWKKNVNKQKNNNITNAKLKEKIWHVVVYDFGVKKNILNMLTHRNCYLTVIPADTSAEKVLQILPDGIFLSNGPGDPRSCTYALNAINAFLKINIPIFGICLGHQLLALASGAKIIKMKFGHHGSNHPVKELKSNTVMITSQNHNYTVDTNNLPKNINITHISLFDGSIQGLQRNDKHAFSFQGHPEASPGPHDSMILFDKFIKLMKKSYNSQQKTII

SEQ ID NO: 89832 - protein, 721 aa, Saccharophagus degradans 2-40
MKFEGQAIRLTPLDNGCVELNFDLQGESVNKFGQTVFKDLAEVLDLLESAKDVKGVLVTSAKSVFFVGADINEFGPIFAKGEEAIIEGVSSVNKLFSRFEDLPFPSVVAINGYALGGGLEFCLACDYRVMSTAAKIGLPETKLGIIPGWGGTVRLSRVAGVDVAVEWIAGGTENRPDAALKAGVVDGIVEPENLRDAALKVLADAVAGDLEITQRRAKKKGPLKHNDIESLLAFESSKAFVKAKAGRNYPAPIAAIESMQHGAKLGRDEAIPVETKLFAKMALTSVAESLIGLFQSDQLLGKKAKNWEKQSDKKVEHAAVLGAGIMGGGIAYQSAYRGVPIKMKDIAAAGVELGLKEATKLLAKRVDRGRMTNLEMGQVLSRIDGTLSYDNFDDVDVVVEAVVENPKVKRAVLAEVEDKISTDAILCSNTSTISISYLGEALKRPENFCGMHFFNPVHAMPLVEVIRGAKTSDRAIARTVAYANALGKKAIVVNDCPGFLVNRVLFPYFAGFAMLLRDGADFQQVDKVMERWGWPMGPAYLMDVVGIDTGVHAESVMAEGFPDRMAKTFKAASDILFESGRLGQKSDLGFYAYKEDKKGKPQKVMAEDTYELLKPHCAERKEFSDEEIIARMMVPMATELARCLEEGVVSSAAEADMALIYGLGFPPFRGGVFRWIDSIGIQAFIDMAAPLADLGLVYVPTDGMKALAAKNAKYYNQTQGA

SEQ ID NO: 89833 - protein, 381 aa, Silicibacter sp. TM1040
MRNSSRSKVDPFIVMDVMEAARKAEEQGRHIIHMEVGQPSTGAPEAARRALADALERDSMGYTVALGLPALRKRIAALYGEWYNVDLNPERVVITPGSSGAFILSFTALFDSGDRVGIGAPGYPSYRQILSALGMQPVDIQTAPEHRLQPVAADIRDQNLAGLMVASPANPTGTMLDKPALSALMEAAQAEGASFISDEIYHGIEYEAKAVTALEISDECYVINSFSKYFSMTGWRVGWMVVPEDHIRTVERIAQNMFICAPHASQVAALAAMDCRDELEANLAVYARNRALMLEGLPKAGFSKIAPPDGAFYVYADVSDLTQDSRAFAAEILEKAGVAVTPGLDFDPVRGATTLRFSYARSTADIEEGLARLRAFMEARG

SEQ ID NO: 89834 - protein, 212 aa, Saccharophagus degradans 2-40
MSNIDLSASSNLNVENTLVPMVVEQTARGERSYDIYSRLLKERVIFLVGQVEDHMANLVVAQMLFLEAENPDKDIHLYINSPGGSVTAGLSIYDTMQFIKPDVSTMCIGQACSMGAFLLTAGAKGKRFCLPNARTMIHQPSGGAQGQASDIHIQAQEILKLRERLNEIMAGHTGRGVEEIARDTERDRFMSAHESVEYGLIDKVLERRVGGE

SEQ ID NO: 89835 - protein, 337 aa, Magnetospirillum magnetotacticum MS-1
MPYKRITLTHFLLQEQRRLGGSGSFTALMTDIIFACKMISHEVNRGALAGNLGVAGSENVQGEEQKKLDVLANDIFLHMNALGGSYAGMASEELEDVHAVHGAADGKYLLLFDPLDGSSNIDVNISVGSIFSILKLPEGADAGSKDAFLQPGVKQVAAGYALYGSSTMMVLTTGNGVNGFTLDNNVGMFLLTHPNMTIPADTKEFAINASRERFWEPPVKRYIDECRQGKEGPRGKDFNMRWVASMVAEVHRILCRGGVFLYPADTENMKKGGKLRLMYEANPMAFIVEQAGGAATTGRGRMMEVQPTGLHQRVPVILGSKTEVERIGAYHTEYDAK

SEQ ID NO: 89836 - protein, 243 aa, Brassica napus
  misc_feature (217)..(217): Xaa can be any naturally occurring amino acid
MVSHQMEKASNGTSALETQTAELDQPAALRKIISVSSIAAGVQFGWALQLSLLTPYVQLLGIQHKWASLIWLCGPISGMLVQPIVGYHSDRCTSRFGRRRPFIVAGAGLVTVAVFLIGYAADLGHSMGDQINKPPRTRAIAIFALGFWILDVANNTLQGPCRAFLADLSAGNAKKTRTANAFFSFSMAVGNVLGYAAGSYRDLYKMVPFTMTESCDXLYCANLKTCFFLSITLLVLVRFGSLW

SEQ ID NO: 89837 - protein, 314 aa, Oryza sativa
MGSGSLLKVLAKNFDVLAGPLVALAYPLYASVKAIETKSPVDDQQWLTYWVMYSLITLFELTFASIIQWLPFWPSMKLIFICWLVLPYFNGAAFVYQNYVRPMFVKHQMVNIWYVPQKKGLFGKSDDFLTALDKFIEENGPEALKKLTNKAGKSSKQSGKSWKDSKSSKESKDSKSSKESKEPKPSKDSKQLKPPKVSKESKPLKDSKEDKKAVKEDKKATAKDSKEQKKALKDSKELKKALKDSKEQGSQKDSDELKPKSNKRVTFAEVEPEKELKASNSDWHPTSEYHSVYPEHNSWSSSFMIFEDENSYWN

SEQ ID NO: 89838 - protein, 575 aa, Oryza sativa
MVSDASKKKAAQKKAAAAAKRGDKAKAAITLSERTCTAVLTSHPLSRDIHIESLSLTFHGHDLLLDTDLELNYGRRYGLLGLNGCGKSCLLKAIGCRELPIPPHMDIYHLTHEIEASDMSALQAVISCDEQRLQLEKEAEILAAQDDGGGEALDRVYERLEAIDASTAEKRAAEILFGLGFNKHMQAKKTCDFSGGWRMRIALARALFMNPTILLLDEPTNHLDLEACVWLEETLKKFDRILVVISHSQDFLNGVCTNIIHMQNRKLKLYTGNYDQYVQTRAELEENQMKQYRWEQDQIASMKEYIARFGHGSAKLARQAQSKEKTLAKMERGGLTEKVVRDKVLTFRFTDVGTLPPPVLQFVEVTFGYTPDNLIYKNLDFGVDLDSRVALVGPNGAGKSTLLKLMTGDLIPLDGMVRRHNHLRIAQFHQHLAEKLDLDMSALQYMMKEYPGNEEERMRAAIGKFGLSGKAQVMPMRNLSDGQRSRVIFAWLAWREPHMLLLDEPTNHLDIETIDSLAEALNEWDGGLVLVSHDFRLINQVAQEVWVCEKQAVTRWEGDIMEFKEHLRSKAGVDD

SEQ ID NO: 89839 - protein, 436 aa, Oryza sativa Japonica Group
MAAASLIKAPVGQNPARMGAGRSSGGGGVVRCSLQGAVVGGRAEWQSSCAVLSSKVAALGAASPHAAAPSFVNGHVAPLVPEQQAAAEDGGAVLDLVPVSSVNGGGVAKNLPQPLRISDLSPAPMHGSQLRVAYQGVPGAYSEKAAGKAYPGCDAIPCDQFEVAFSAVELWIADRAVLPVENSLGGSIHRNYDLLLRHRLHIVGEVQLPVHHCLMALPGVRKECLTRVMSHPQALAQCEHTLTAMGLNVVREAFDDTAGAAEYVAANGLRDTAAIASSRAAELYGMEVLADGIQDDCGNVTRFVMLAREPIVPRTDRPFKTSIVFAHDKEGTSVLFKVLSAFAFRDITLTKIESRPHRHRPIRLVDDANVGTAKHFEYMFYVDFQASLAEPRAQNALAEVQEYTSFLRVLGSYPMDMTPMTAGSSSTVTSDDSSST

SEQ ID NO: 89840 - protein, 379 aa, Sorghum bicolor
MATAGKVIKCKAAVAWEAGKPLSIEEVEVAPPQAMEVRVKILFTSLCHTDVYFWEAKGQTPVFPRIFGHEAGGIIESVGEGVTDVAPGDHVLPVFTGECKECAHCRSAESNMCDLLRINTDRGVMIGDGKSRFSINGKPIYHFVGTSTFSEYTVMHVGCVAKINPEAPLDKVCVLSCGISTGLGASINVAKPPKGSTVAIFGLGAVGLAAAEGARIAGASRIIGVDLNPSRFEEARKFGCTEFLNPKDHKKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHSVPFTEINKAFDLMAKGEGIRCIIRMEN

SEQ ID NO: 89841 - protein, 597 aa, Prochlorococcus marinus str. MIT 9215
MSNIDLKRRTKIVATIGPATQSKEIITDLIIAGVTTFRLNFSHGDHKDHAERIKTIREVSKKLDIDIGILQDLQGPKIRLGRFKDGPVKVKKGDKFTLTSNDVECTNTIANVTYDKLSQEISEGKRILLDDGKIEMIVEKVDLKSNNLECIVTVGGVLSNNKGVNFPDVQLSVKALTEKDKEDLKFGLSEGVDWIALSFVRNPSDINEIKDLINKNGHSTPVVAKIEKFEAIDQIDTVLPLCDGVMVARGDLGVEMPAEEVPLLQKELIRKANTLGIPIITATQMLDSMASNPRPTRAEVSDVANAILDGTDAVMLSNETAVGDYPVEAVETMATIARRIERDYPLKAIESHLPSTIPNAISAAVSNIARQLDAGAIIPLTKSGSTARNVSKFRPPTPILATTTERSVARRLQLVWGVTPIVVKNDERTAKTFSLAMQIAQEMGILNQGDLVVQTAGTLTGISGSTDLIKVGLVRKIVSRGISIGEIGVTGKARIIKNNPDISLICPGEILFVPEELMKNIPLSKNIAGIVTNQNVNDVYALFNKNNKKISTICNLENIDNHQISNGDLITLQLNEGVIYKGQIEDDDDAIDKYKYV

SEQ ID NO: 89842 - protein, 397 aa, Chlamydophila abortus S26/3
MSFFHQLPTFAPDSILGLQKLFLEDEREEKVNLVIGSYEDPNKAYGGFSSVRKAQFSLLENEMNKGYLPISGLLSFNQQMESLVFGDDVNPSFVVGAQALGGTGALHLGAKIFAMAHPSAAVYIPEQTWGNHLRIFAQQGLDVLKYPYYSSESKTLVFDEMISVLKSAPKNSLVLLQCCCHNPTGMDLDENMWTRLAELMKERQLLPFFDTAYLGFGLGIEEDRKPIKIFIDSGHTVFVAACASKNFSLYGERVGYFAAYSRVVDDLDKISSCLEEKIRGEYSSPPRHGAKIVSTILSDASLKTEWLAELDTIRCSLQKTRTRFVQAMRNHIGHSFDFILSQKGFFGYPGFSLEQVLFLRLEKGIYTTSGARFNLNGITDNNIDHVVQSFAEAYQQA

SEQ ID NO: 89843 - protein, 182 aa, Physcomitrella patens subsp. patens
MASIVAASTVVAPAAFAAASSAVSTSEASSVKAFSGLKSATLFSSKAQTLSSVQNGSRVQCMQVWNPIGMTKFETFSYLPPLSDDAIAKQVEYMIQQNLIPCLEFDVNANGVSRTNNSSPGYYDGRYWTMWKLPMFGCQDSAQVLREIEECKKTFPGCFVRVLGFDNVKQVQICGFLVARPN

SEQ ID NO: 89844 - protein, 513 aa, Prochlorococcus marinus str. MIT 9215
MNDYFERILQAEVYEVAKKTPLEKAHNLSNTLNNEVFLKREDLQDVFSFKIRGAYNKMSKLSKSQLTQGVITSSAGNHAQGVALSALKLNCQATILMPITTPLVKVNAVKNLKAKVILFGDNYDETYKEAIRISNERNLCFIHPFDDPDVIAGQGTIAIELEQQLKEKPYAIYIAVGGGGLISGISLYIKKIWPEVKIIGVEPEDADAMTKSLEEEKIVELSSVGQFADGVAVKKIGKNTFDICRKYIDKMIRVNTDEICAAIKDVFEDTRSILEPAGALSIAGMKKDIFKTNYSNKKMVAIACGANMNFERLRFVAERAELGECKEVMLAVEIPEHAGSLIDFCKLLNNRNLTEFSYRMSNSKNAQIFVGVQVYGLNDKRNLLNIFRNSEYSYIDISDDELSKNHLRHMVGGRLPRNFKEMEYRNFVELLYRFEFPERPGALINFLNNMKSNWSISVFHYRNYGADVGKIVIGVLIDKNEISDWNKFVRILGYKFWDETQNDTYRLFLSASD

SEQ ID NO: 89845 - protein, 182 aa, Physcomitrella patens subsp. patens
MASIVAASTVVAPAAFAAASSAVMTSEASSVKAFSGLKSATLFSSKAQTLSSVQNGSRVQCMQVWNPIGMTKFETFSYLPPLSDDAIAKQVEYMIQQNLIPCLEFDVNANGVSRTNNSSPGYYDGRYWTMWKLPMFGCQDSAQVLREIEECKKTFPGCFVRVLGFDNVKQVQICGFLVARPN

SEQ ID NO: 89846 - protein, 122 aa, Picea sitchensis
MGKAVFFFFSGVLLVCVLSTVLIEPVAGSEMDAFEALWVSKPRPRCEGSIGECFEDEEMQMDSEINRRFLAGRTYVSYGALRSNSVPCSRRGSSYYNCGSTSQANPYKRSCTQITRCARSTS

SEQ ID NO: 89847 - protein, 337 aa, Alkalilimnicola ehrlichei MLHE-1
MAIKVAINGYGRIGRGVLRALYESGRSDELRIVAVNDLCELRTAAHLTRHDTTHGRFPGDVQTGEGELVVNGDRIRYTSERDPDRLPWEALGVDLVMECTGRFASREQAERHLRAGARKVLISAPGGPEVDATVCYGVNHDILRAEHTVVSNASCTTNCLAPIVQPLHRALGIEQGLLTTIHAYTNDQVLTDSPHADLRRARSATLSQVPTKTGATRALGLVLPEMAGRLDGYAMRVPTLNVSLVDLTFDAGRATSVEEVHEIIRAAAAGPMAGVLAVNDDPLVSIDFNHHPASAVFDATLTKVKGRLVKICAWYDNEWGFANRMLDTAVAMMRAAG

SEQ ID NO: 89848 - protein, 182 aa, Brassica napus
EAEMEKSRLEIEMNQKAMMEQNEANMEAMKLAEKHQKEKEKLHEKIMEMEAKLNETQELELEIEKLKGSTNVMKHMAGSDGDAELMEKMVKTQMELEARETALHDKIMAVTQKERMADDEYQEARKEMIQLWKENEDLVSGEKIRVKTMGHLDTKPFVLAVKKKLRCSEARAGLKAMELCSF

SEQ ID NO: 89849 - protein, 309 aa, Clostridium difficile 630
MNTLDETLLKEIISSNKKYTNYGQVASYIPELKNARRNDLGICIIDSENNLYSAGNCSTKFTIQSISKPIVLAMALMDNDWEDVFSNVGMEPSGDPFNSIMKLEINDTKKPCNPMINAGAIVTTSLINGSCLEEKEERMLSFFRKLAKNDNIGINYDVYKSEKMTGDRNRAMAYLLKSDGFIRGNVEDVLDLYFKQCSIEIDSVDLARIGINLANYGVDIENGEHLMSEMVSRIVKTFMMTCGMYDASGEFAIKVGIPAKSGVGGGIMASVPGRMGIGVYGPALDKKGNSVAGVKVLEELSNKLKLNIF

SEQ ID NO: 89850 - protein, 565 aa, Acidobacteria bacterium Ellin345
MSSNSQSQSLFSLPNWLTSYRSEWLRPDIIAGLTAAAVVIPKSMAYATIAGLPVQVGLYTAFLPMIIYAVLGTSRVLSVSTTTTIAILTAAEFAEVVPNGDAASLLRASATLTLLVGAMLVVACFLRLGFVANFISQPVLTGFKAGIGIVIVLDQVPKLLGVHIPRATFLKNVLATLRSIPETKLLTLGVSVTVIVLLVALEHFMPKSPAPLIGVAVGIAGAYFLHLSTHGVELVGRIPQGLPPVTLPALGMVEHLWPGALGIALMSFTETIAAGRAFAKSDEPWPQANRELMATGLANVGGALLGAMPGGGGTTQTAVNRLAGARTQVAELVTGAMTLVTMLLLAPMIALMPQATLAAVVIVYSVGLIKPAEFREILRVRRTEFLWAVIAMAGVVLVGTLKGILVAIIASLVALAYQVANPSVYVLGRKPGTNIFRPRSAEHPEDETYPGLLMVRPEGRIFFANAENLSHKVWVLIDEAKPNVVIVDMRAVFDLEYTALKMFTEGEKKQREYGMRLWLVGMNPHVFDMVQKSALGESLGREGMHLNLESAVAKYAEHASLPATV

SEQ ID NO: 89851 - protein, 305 aa, Methanosarcina barkeri str. Fusaro
MVKPEKFIPKAVEKISKEIKDGRAIIALSGGVDSSVCAELAHRAIGGRLQPIYIDTGLMRKGETERIKHIFSHMNLDIVYAKDRFLAALKGITDPEEKRKAIGETFIRVFEEEARKLEADYLIQGTIYPDRIESEGGIKSHHNVGGLPSVMDFKKIVEPIEDLYKDEVREVAWALKLPDEICERMPFPGPGLAVRILGEVTEEKLEVAREANSIVEEELLDRFCPWQTFAAVIGKGTGVKGDIRAYGWIIAVRAVGSRDGMTAEALELPWDVLKKLESRITSEIPKVARVVYDITPKPPATIEFE

SEQ ID NO: 89852 - protein, 421 aa, Amycolatopsis mediterranei
MALVVQKYGGSSLESADRIKRVAERIVATKKAGNDVVVVCSAMGDTTDELLDLAQQVNPAPPEREMDMLLTAGERISNSLVAMAIAAQGAEAWSFTGSQAGVVTTSVHGNARIIDVTPSRVTEALDQGYIALVAGFQGVAQDTKDITTLGRGGSDTTAVALAAALNADVCEIYSDVDGVYTADPRVVPDAKKLDTVTYEEMLELAASGSKILHLRSVEYARRYGVPIRVRSSYSDKPGTTVTGSIEEIPVEQALITGVAHDRSEAKITVTGVPDHTGAAARIFRVIADAEIDIDMVLQNVSSTVSGRTDITFTLSKANGAKAVKELEKVQAEIGFESVLYDDHVGKVSVVGAGMRSHPGVTATFCEALAEAGVNIEIINTSEIRISVLIRDAQLDDAVRAIHEAFELGGDEEAVVYAGSGR

SEQ ID NO: 89853 - protein, 539 aa, Zea mays
MSATQLLRRSRKLQSLQNAVGCENFFLFRHFSSGSGSFIAKENGVGKRTRGTRFSQQYQPTKELEPFSLGVNGNCTWRRASNSLTPSAASWLNGSFSCGQVVSARTFSSSADLPPHQEIGMPSLSPTMTEGNIAKWLKKEGDKVSPGEVLCEVETDKATVEMECMEEGYLAKIIHGDGAKEIKVGEVIAITVEEEGDIEKFKDYKPSSSAEPVAPAESKAQPEPSQPKVEEKKLTQAPEVKAPKIEEASQSGDRIFASPLARKLAEDNNVPLSSVKGTGPDGRIFKADIEDYLAKGGLREAFAAPGLGYVDIPNAQIRKVTANRLLASKQTIPHYYLTVDARVDKLVKLRGELNPLQDASGGKKISINDLVIKAAALALRKVPQCNSSWMNDFIRQYHNVNINVAVQTEHGLFVPVIRDADKKGLGTIAEEVKQLAQKARDNSLKPADYEGGTFTISNLGGPFGIKQFCAIINPPQSAILAIGSAEKRVIPGSADGLYEFGSFMSATLSCDHRVIDGAIGAEFLKAFKGYIENPTSMLL

SEQ ID NO: 89854 - protein, 322 aa, Methanosarcina barkeri str. Fusaro
MWRLAITRVFNDKFKNRFSDSYIMELKRENVLIEALPYMQEFYDSIMVIKVGGNAMVSAQIMEDIIKDIVLLRYVGIKPVIVHGGGPEITEKMGRMGKKAEFFQGLRITDDETMEIAKMVLVGNINTKIVSLIGVCGGKGIGLTGYDGRMILGHKQAAKKVLINGIETEVDIGWVGECEVINPDILHIVLENGYIPVISPIAVDAKGNALNINADIVAGDIAAALHAKKLILMTDVSGLLRDMNDPNSHISRVTLEDIDHLIAEGVIQGGMIPKLKGAAVAVKNGVEKAHIINGSVSHSMLLELFTDRGIGTMVYKFEKPKN

SEQ ID NO: 89855 - protein, 186 aa, Silicibacter sp. TM1040
MSALHIKKGATKHSAYNLRPNFSDTQERHTITVLVENEPGVLARVIGLFSGRGYNIDSLTVAEVDHTGHLSRITVVTTGTPQVIEQIKAQLGRIVPVHEVTDLTVAGPFVERELAIVKVVGEGEKRVEAMRLADIFRAKVVDTTLNSFIFEITGTPDKIDAFADLMRPLGMTKIARTGVAALLRGE

SEQ ID NO: 89856 - protein, 482 aa, Cylindrotheca fusiformis
MSGTDVATGAPAEWKKYQEYSLDVDPDQDDRATEIKLCNFSRPHMRAFHFSWIGFFIAFFIWFAIAPLLSEIQDTLDLDKKEVWTSSIVGVGGTIFMRFLLGPFCDKIGPRVLFTFVLCFASIPTVCTGFVNSATSLAVLRLFIGTAGGTFVMCQYWTSRMFTKQVVGTANALVGGWGNLGGGVTQLVMGSALFPLFKEIFKNEPDPAETAWRWVSIVPAVVAFAIGLLIFFYSDDAPKGNYNEMKKNGAMSDVSAAASFRTGALNLNTWFLFKQYACCFGVELTMNNTAALYFKEKFSLTTEEAAAIASIFGWMNLFARGAGGFLSDKANARMGMRGRLWTQTILLACEGALVLVFANTGSLTGAIVVMVFFSLFVQAAEGSSYGIVPYVDPPATGAIAGIIGAGGNTGAVAFGMGFRQLDYKDAFIIMGAVICASSVLSVFICIPGSSRMIGGEADDVGAKDPTLSVPQPDTEKTQDVNA

SEQ ID NO: 89857 - protein, 482 aa, Cylindrotheca fusiformis
MSGTDVATGAPAEWKKYQEYSLDVDPDQDDRATEIKLCNFSRPHMRAFHFSWIGFFIAFFIWFAIAPLLSEIQDTLDLDKKEVWTSSIVGVGGTIFMRFLLGPFCDKIGPRVLFTFVLCFASIPTACTGFVNSATSLAVLRLFIGTAGGTFVMCQYWTSRMFTKQVVGTANALVGGWGNLGGGVTQLVMGSALFPLFKEIFKNEPDPAETAWRWVSIVPAVVAFAIGLLIFFYSDDAPKGNYNEMKKNGAMADVSAAASFRTGALNLNTWFLFIQYACCFGVELTMNNAAALYFKEKFSLTTEEAAAIASIFGWMNLFARGAGGFLSDKANARMGMRGRLWTHTILLACEGALVLVFANTGSLTGAIVVMVFFSLFVQAAEGSSYGIVPYVDPPATGAIAGIIGAGGNTGAVAFGMGFRQLDYKDAFIIMGAVICASSVLSVFICIPGSSRMIGGEADDVGAKDPTLSVPQPDTEKTQDVNA

SEQ ID NO: 89858 - protein, 659 aa, Desulfovibrio vulgaris subsp. vulgaris str. Hildenborough
MNFTIQNLSKTFGGRDILSDFSLEVQSGVRLCICGPNGCGKSTLLRLVAGVDHPDGGRIILPKGCRLGYVEQELDESVLDTQLLHWVQDVLPDWNDFWEDWEAASASGDEAALKRLGARQAELEQVYGYNPEHRARAVLSGLGFSERKWLLPLRQLSGGWRERAKLARVLTAGADVLLLDEPTNHLDLEAVEWLETFLMEYKGALLFVAHDLVFMNKVGTHVLYLGGSKPLYRRGSFSQFVETQEEIEAQREREAQRLADEIGRKMAFVERFRAKATKARQAGSRQKMAKKLEKELENFQPEARRKSLAFKWPEPARADKTVLGVVDLDYAFPDGTRLWPRLSFNLYRGQKIALVGPNGCGKSTLLKIIGGRLERSGGTVAAGSLVRMGYFSQHQLETLNPDGTVLGEIRRLSDPRTTEEELMSVLGLFMLGQGYFERFVRSLSGGEKSRLVLATLFLSRANFLVLDEPTNHLDLESREALVEALDAYEGTILMVAHDRHLLSSVADEVWALGGDGITVFDQGFEAYDEARRAAGGGSLSDGETDAQRGGGNLNREELKRLKREQAEARNRLYKELKPRQDAYAKLEADLEKLLDEQGTVEAELADPDVYADGARASALLQRFGELQAASEKLLERMGELEPVIAELEAQRAALSTEAL

SEQ ID NO: 89859 - protein, 583 aa, Oryza sativa Japonica Group
MSVFTDAEPPWHCTGVVDAVEAAAGDSGSSCSSPATSASPCALPLGTWEWDRLAKTSVVSDWALNCSGGGPALVSLPASSFFTGNLVVVLPYRQVFMSVFTDAEPPWHCTGVVDAAAAAAADSGSSCSPPAASASPCALPPGTWEWDRPAETSVVSDWALNCGPALVSLPASSFFAGNLAGGFLLATLADTHLGRRKMLLLSLVTMSVAAALTAFSPNVWVYSALRFVSGFGRSMVGTSAMVLSTELDGKRWRNTVSAAGFVFFSVGFVSLPALAYTFREASWRNMYVWTSLPSLCYAVLLYLLVQESPRWLLVRGRKQEAIEAVRQIASLNGGGGGITTSSFSMLDACAVELGDGGEGMFATLHSIWERRRALRRLAAITAASFGVGMVYYGMPLNVGSLSPSNLYLSVAYNAVAELPSSILAWLLMGRWFNRRGSVVALTTASGLCSLAACVPAVVLPDGARMAAEVASFFASCTAYDMMLMYTIELFPTSVRNSAVGLVRQAVALGGVVAPVLVALGRETTSYWSSSFGVFGLAVGCLGLLVTCLPETRGRRLSDTMEEEEAAVLSSSGASDMDNNGELV

SEQ ID NO: 89860 - protein, 482 aa, Cylindrotheca fusiformis
MSGTDVATGAPAEWKKYQEYSLDVDPDQDDRATEIKLCNFSRPHMRAFHFSWIGFFIAFFIWFAIAPLLSEIQDTLDLDKKEVWTSSIVGVGGTIFMRFLLGPFCDKIGPRVLFTFVLCFASIPTACTGFVNSATSLAVLRLFIGTAGGTFVMCQYWTSRMFTKQVVGTANALVGGWGNLGGGVTQLVMGSALFPLFKEIFKNEPDPAETAWRWVSIVPAVVAFAIGLLIFFYSDDAPKGNYHEMKKNGAMADVSAAASFRTGALNLNTWFLFIQYACCFGVELTMNNAAVLYFKEKFSLTTEEAAAIASIFGWMNLFARGAGGFLSDKANARMGMRGRLWTQTILLACEGALVLVFANTGSLTGAIVVMVFFSLFVQAAEGSSYGIVPYVDPPATGAIAGIIGAGGNTGAVAFGMGFRQLDYKDAFIIMGAVICASSVLSVFICIPGSSRMIGGEADDVGAKDPTLSVPEPDTQKTQDVNA

SEQ ID NO: 89861 - protein, 356 aa, Marinobacter sp. ELB17
MSGSTMKIAVIPGDGIGKEVMPEGVRVLEAAALKYGFDMVFTDFEFASCEYYQTHGKMLPDDWKNQIAGHDAIFFGAVGWPDTVPDHVSLWGSLIQFRREFDQYVSLRPARLMRGVPSPLAGRKPGDIDMMIVRENTEGEYSSIGGKMFPGTDREIVMQETVMTRTGVDRILRYAFDLAERRGGRLTSATKSNGISITMPYWDERVAEMAKAYPAVTVDKYHIDILTALFVLHPDRFDVVVASNLFGDILSDLGPACTGTIGIAPSGNINPERKFPSLFEPVHGSAPDIAGQGIANPVGQIWAGAMMLDHLGHPEAAADIVRAIEKVLAEPGMRTRDLGGTAGTTDCGKSIANALN

SEQ ID NO: 89862 - protein, 373 aa, Pseudomonas putida GB-1
MAFNTIEELLEDYRQGKMVLLVDDEDRENEGDLLIAAERCDAQAINFMARQARGLICLTLTDEHCQRLGLEQMVPANGSVFSTAFTVSIEAATGVTTGISAADRARTVAAAMAPNAHPEDLVQPGHIFPLRAREGGVLTRAGHTEAGCDLARLAGFSPASVIVEVLNDDGTMARRPDLEVFAAQHGIKIGTIADLIHYRLSTEQTIKRIGERELPTVHGIFRLVSYEDRIEGGVHMAMVMGDIRREQPTLVRVHVIDPLRDLVGAEYAGPANWTLWAALQKVAEEGAGVVVILANHESSQALLERIPQLTQPVRPYQRGQSKVYSEVGTGAQILQDLGVGKLRHLGPPLKYAGLAGYELEVVQSIPFEPGLPS

SEQ ID NO: 89863 - protein, 356 aa, Marinobacter sp. ELB17
MKTYKIAAIPGDGIGIEVIDAGLRALTALAESDGGFKLDVTNFDWGSDRYKREGKFMPADGPDQLRAFDAILFGAVGAPDVPDHLTLWGLRLAICQPLDQYANVRPTRILPGIKSPLEGVCPGDLDWVIVRENSEGEYAGQGGRSHRGQSHETATEVSIFTRVGVERIMRYAFKLAQSRPRKLLTVVTKSNAQRYGMVLWDEVAAEVAGDYPDVKWDKMLVDAMTVRMTMKPKSIDTVVATNLQADILSDLAAALAGSIGIAPTANFNPEGVTPSMFEPIHGSAFDITGQGIANPVGTFWSASMMLEHLGETAAARRMMNAVEMVTADRDLHTPDLGGSATTDQITEAVIAAIRNN

SEQ ID NO: 89864 - protein, 629 aa, Prochlorococcus marinus str. MIT 9215
MLLSELSHPNQLHGLTVSQLEEIACQIRERHLQVVSTSGGHLGPGLGVVELTLALYQTLDLDFDKVVWDVGHQGYPHKLITGRFSQFDSLRQQNGVAGYLKRSESKFDHFGAGHASTSISAALGMAIARDRKGDNYKCVAVIGDGALTGGMALEAINHAGHLPNTPLVVVLNDNDMSISPPVGALSSYLNKVRHSPPLQFLSDSVQESVKNIPLIGKDIPEELKNIKGSVRRLAVPKVGAVFEELGFTYMGPIDGHDIGNLINTFNAAHKLKKPVLVHVVTTKGKGYPYAEADQVGYHAQSSFDLTTGKSIPSKKPKPISYSKIFGQTLLKICEQDSKVVGITAAMATGTGLDILQKNIPDQYIDVGIAEQHAVTLAAGMSCDGLKPVVAIYSTFLQRAFDQLIHDVGIQNLPVSFVLDRAGIVGADGPTHQGQYDISYMRSIPNFVLMAPKDESELQRMLITSINHKGPTALRIPRGSGLGVAVMDEGWEPLNIGEAEILEEGNDILIIAYGSMVASALETAELLKAKNINSCIVNARFVKPLDKKLIMPLASRIQKVVTMEEGTLIGGFGSAIVELFNDNEINIPVYRIGIPDVLVDHASPDQSKEKLGLMPNQMADNIIKKFDLNN

SEQ ID NO: 89865 - protein, 145 aa, Vibrio cholerae
LTLKPTMYIANVNENGFENNPYLDAVVEFAAKENASVVAVCAAIEAELSELEEEERDEFLADLGIEEPGLNRVIRSGYDLLNLQTYFTAGVKEVRAWTIPVGATAPQAAGKIHTDFERGFIRAEVIGYNDYIQFNGESGAKEAGK

SEQ ID NO: 89866 - protein, 364 aa, Geobacillus kaustophilus HTA426
MKRQLILEDGSFFVGEAFGSLKETTGEVVFNTGMTGYQEILTDPSYCGQIVTMTYPLIGNYGINRDDFEAIRPHVHGFIVKEACVKPSNWRGELTLDEYLKEKDIPGLAGIDTRKLTRLIRQYGTLKGMICGLDVDPVEAAAKLRAMEWPRDQVRRVSTKSAYPSPGRGERIVLIDFGMKHGILRELNKRNCDVIVLPYNATAEEVLGWHPDGVMLSNGPGDPKDVPEAIEMIRGILGKVPLFGICLGHQLFALACGANTEKMKFGHRGSNHPVKDLRTGKVAITSQNHGYTVTHESLSGTRLEVTHIALNDGTVEGLRHLDVPAFTVQYHPEASPGPEDANPLFDEFLALIREFNKKGEVIHA

SEQ ID NO: 89867 - protein, 302 aa, Streptococcus pyogenes M49 591
MAKAAGIPLGKMSSRQFSDGEIMINIEETVRGDDIYIIQSTSFPVNDNLWELLIMIDACKRASANTVNIVLPYFGYSRQDRVAKPREPITAKLVANMLTKAGIDRVVTLDLHAVQVQGFFDIPVDNLFTVPLFAERYSKLGLSGSDVVVVSPKNSGIKRARSLAEYLDSPIAIIDYAQDDSEREQGYIIGDVSGKKAILIDDILNTGKTFAEAAKILERSGATDTYAVASHGLFAGGAAEVLETAPIKEIIVTDSVKTKNRVPENVTYLSASDLIAEAIIRIHERRPLSPLFSYQPKGKNNA

SEQ ID NO: 89868 - protein, 471 aa, Bacillus cereus ATCC 14579
MKQIFQKKPIAKLMQESKQKTLARTLGALDLTMLGIGAIVGTGIFVLTGVVAAKHSGPAIILSFAIAALACAFAAFCYAEFASSVPVSGSVYTYTYATMGEVFAFLIGWDLMLEYLLATSAVANGWSAYFQSLLNGFGIHIPTILSSAPGTGKGGIIDLPAVLIILVMTVLLSRGVRESARVNNIMVFIKIAVVLIFIFAGFNYVKPENWTPFMPFGLNGVMAGAATVFFAFIGFDAVSTAAEEVKRPQRDLPIGIIASLLICTVLYIVVSLILTGIVPYGQLNISDPVAFALQFIGQDGLAGVISVGAITGITTVMLVMMYGQVRVSYAMSRDGLLPKRLAKVHPKFKTPFLNTWTTGIIAALISGLIDLNVLAHLVNMGTLSAFALVAVAVIVMRRTHPDLPRAFKAPLVPFLPALTVIFCLYLMLQLSGTAWISFGIWMVIGIAVYFLYSRKHSALNNSKKEEDVANL

SEQ ID NO: 89869 - protein, 76 aa, Zea mays
LILFGGQTTSRRLADRKTAKFQKNITRRGSVPETAVKKGKGNGYAAGPVVLGFFVFVVIGSSLFQIIRTATSGGMA

SEQ ID NO: 89870 - protein, 545 aa, Shewanella oneidensis MR-1
MTILTQSTTWQALSAHSQDIPHMRELFAADPARFTKMSLSSCGLFLDYSKNRATPETLNLLFALAQEAKLDAKIKAMFAGDIINTTEKRAVLHTALRNTAEQCIIAEGQDIVPEVQQTLNKMQQFVTSVTSGQWKGYTGKAITDIVSIGIGGSFLGPKIVSQALRPYWITGLNCHFVANVDGTSISEKLKLLDPETTLFIMSSKSFGTQETLTNTLTAKAWFLAKGGSQSDVAKHFAAVTSNVVKATGFGIDANNIFPMWDWVGGRYSLWSAIGLPIALLIGMDNFRALLKGAHQMDTHFANAPLTENMPVIMGLLSLWYGNFFNAQSHVVLTYDHYLRGLPAYFQQLDMESNGKSVTLNGTHVDYSTGPVIWGGEGTNGQHAYHQLLHQGTALIPADFIMPLQSHNPIGEHHDQLASNCFGQTQALMQGRTLDEALAELSKSALSNEEKLLIAKHKVMSGNKPSNTLLMDKLTPETLGALIALYEHRTFVQGAIWDINSFDQWGVELGKTLGNDVLTRIGADQEATVLDASSNGLINLYRRGKI

SEQ ID NO: 89871 - protein, 587 aa, Bacillus cereus E33L
MRGLFTGRFEGYSLGHFQKDLLSGMIVGVVAIPLAMSFAIASGVKPEYGIYTTCIAGILISLFGGSKYQIGGPTGAFVPILLGIVITYGYEDLLIAGLLAGIILCLMGIFKLGSLIKFIPRPVTIGFTSGIAVIIFTGQIASFLGLTGIKKHEEFAANLKEIFTHIGTTNVYSVITALICFLVILITPKILPKVPGSLVGVVISTVIATVFFSGHVPTIGTAYGTIPNTLPEFDIPEITLERIKQLIGPAFVIAMLGGIESLLSAVVADGMTNSKHNSNKELIGQGIANIVTPLFGGIPATGAIARTATNIKSGAVSPMSGVIHGGFVLFTLLLLAPYASHIPLASMAPILMVVAWNMSEQRHFVHILKMKTGDSLILLVTFLLTVFTSLTTAVEIGLILAIILFTKRMSNMLVISKVFPDHTKKNDKLLPHVVNKAHDCPQISIYTIEGPLFFGAAQTFEQNILATIHYKPKVLILRMGKVPFIDTTGESYFRNIIQHFKKQGGVLLISGIQSELKVTLDKNGLYAEIGEENFFDHTGEAINCALGHLNTKKCIGCKHFAFHECTGLSQQSQEVNTIKNKTKALEF

SEQ ID NO: 89872 - protein, 342 aa, Listeria monocytogenes str. 4b F2365
MLNEQQITRLLYRLQDPVLEASLEETEGVLEVQVLEETANIKIALADPAVETDHFVHNIEELLTQFGVNEINIELEYLPAAVIDRIFQARDNILSEASETKFLAIASGKGGVGKSTVSANLAIALAQQGKKVGLLDADIYGFSIPVLLGTTESPRKENGQIIPVETHGIQMISMDFFVEQGEPVIWRGPMLGKMIKMFLEEVRWGKLDYLLIDLPPGTGDVALDIHTLIPKCNELIVTTPHYAAASVASRAGYMAAKNNHKIIGVIENMSYLTLADGQVLKVFGQGGGEKVAADLETQLLIQLPIEQPEPNGNGYVSALFNSSSTSGKAYKTLAEKIIPYLS

SEQ ID NO: 89873 - protein, 2100 aa, Streptomyces hygroscopicus
MADSKTLTDYLKWVTADLYRTRERLAEVESASAEPIAIIGMACRFPGGVTSPEALWELVSSGTDAISGFPDDRGWDMEGFFDSDPAQEGTSYMREGGFLTNATGFDPAFFGISPREAVAMDPQQRLLLETTWEVLERAGIDPTSLRGSRTGVFTGLMANSYTTRVRRIPGELESYAGNGEAASVASGRVSYTFGFEGPAMSVDTACSSSLTALHLAVRALRSGECPLAVAGGVTVFATPRIFSDLSRQRGLARDGRCKAFSTSADGTGLSEGVGLLLVERLSDAQRLGHSVLGVVRGTAVNQDGASNGLTAPNGPAQQRVIKAALADARLTAADIDLIEAHGTGTKLGDPIEAQAIIATYGQDREQPLWMGSLKSNIGHSQAAAGVAGIIKIVMAMRHGVMPKTLHIDEPTPEVDWSAGTVELLAEARDWPGVDERPRRAGVSSFGVSGTNAHVILEQAPPAPEPTESAEPVEPSEAAGPSGPVGLELGPSGPVPWVLSAQNETALKDLARQLATVDGSVRDIAHSLISTRAALPHRAVVVGSTREEFATALEQITGHTPDGGKTVLVFPGQGSQWVGMGQRLWETSPLYRDTIHEIDTALSEYIDWSVTDILTSQPGAPTWDRVDVIQPVLFTTMTALATLWQHHGLTPDAIIGHSQGEIAAAYTAGALTLQDAARITTLRSKALLPLTGHGTMISVLAPPQTIQDIADPDHWNTRIWIAAHNAPNTTTITGDTQAITHLTQQLSHHRIMRWQLPGVDFAGHSGHIDQLHNQLQKILAPITPQKPTIPFYSTTDNTWITDTTLDADYWYRNLRQPVLFQPAINHLTNNGYTTYIETSPHPTLTPSIQETNPNTTTIHTLHSNQNDTHALLTALGHAHTHGHPITWHTLIPPTKTTPLPTYPFQHTHFWLNEKTADADVESAGLSRTDHPLLGATTTLAHSGETVLTGRLSLTHHGWIADHAVNGTPLLPGTALVDMALHAGDHTDHTTLDELIIHTPITLTHPTTIQLTTTPTHDDNTLNLTIYTRTAPEQPWIQHAAGTLTRANTAPSSPETIWPPTNAEPIPLDGTYQRLATTGLEYGPAFQGLHALWRRDSDNRLLADVRLPDTIDNTNSTDCTDGYGIHPALLDAALHALVAVSDGDEIRLPFAWTGVTLHATGATKLRVELDIDDDGTLSLSATDTSGQPVVTVDSLTTRPIDPAQLRARPRQTDDLYALDWLPWSGSVAPAPEFEQYEVPKVGDDVLADTHRITAQTLTRVQQHLAADTTTPLVVEATHDDLAGAAVWGLIRTAQTEHPGRIILIDTDNHPTSRDALASVVASGEPQARIRDGAITLPRLTTTAVTDALTPPADADAWHLDTSERGTLENLTLTGSDTATRNLLPGEVRVAVRAAGLNFRDVLIALGMYPGEATMGSEAAGIVLDIGPDITDLTPGDRVTGLFPNALANTAVADRRMITPIPASWSNTDAAAFPIVYLTAYYGLHDLAALKPGERVLIHAGTGGVGTAAIQLAQHLGAEVFATAHPTKWPHLRAMGLDDHHIATSRTPDFETTFHTTTQGQGIHVILNSLTDDLTDASLRLLTPNGRFIEMGKTDVRDTEEVARTHPGVTYRAFDIADDAGPDRIGAMLVELTGLFERGALRGLPVRCWDVRESVDAFRFMAQARHIGKVVLTIPHTPDGTILITGGTGNLGSLIAHHLVTTHGARDLILTSRQGPNAPGATELTNQLQQHGARIRTISCDLTDRTALTTLIDEIGPLTGVVHTAGALADTTIDHLNPDTLTTTLTPKANPAWWLHELTQDHDLALFVVFSSVAGVLGNAGQANYAAANSFLDALITHRRRQGLPGTSLAWGWWQREGGMTAHLTQADHDRMTRAGIHGLTDAEGTTLFDTALDRGLGAVAPVKLHLPTIARSGSVLPVLRALVRAARPTAGQAAVQDGTWADRVAAVAPEERRAVVLELVRAQAATVLGHSGAEHVSPTQAFKDSGFDSLTAVEFRNRVTTATGLRLPATLIFDHPTPNTLADHLLAQLAPAYTGPSLADLDGIEVTLRTLAEDGERRPAVVARLKQWLSTLGAAQPAADTALDLDAASAREIFDFLDGKAG

SEQ ID NO: 89874 - protein, 539 aa, Oryza sativa Japonica Group
MSGSAATLGMRCGSYGSLASAGGGRKGGGRGWGWRGGGEKERLQLLHRALRLVGRRRAGVLLLLAAASAAVFCSIFAVVKDDNASMIIANNYEVANTIQNSVYPSMTRPLMTSSDQFSASSVNKTELPNRLRLSFANFTHHPCEGFSVAPPLVDPKRTGPRPCDVCYVPVDQAFALMPPQPSPSPVLKNLSYVFEDNITANFSNQGSVFGGHPSLEQRNKSFDISESMTVHCGFVRGKKPGQGSGFDINDDDLLEMEKCHEETEAYVKNSSSLYRNNKVGLWRLVVVRNLPYEDPRRTGKIPKLLLHRLFPNVRFSVWIDAKLKLVVDPYLLLERFLWRKNATFAISRHYKRFDVFEEAEANKAAGKYDNASIDYQIEFYRNEGLTYYAPAKLPITSDVPEGCVIIREHIPITNLFTCLWFNEVDRFTSRDQISFSTVRDKIRARVGWMPEMFLDCERRNFVIQGYHRELLEQMIASGWKPPPTASEPSRKLRLGSRKAPPSKKSSMKRKRVKKSSSRRRLPKPITRMTDTTTWQKLGA

SEQ ID NO: 89875 - protein, 506 aa, Zea mays
MPAAAAPAPHTRTRTRSSGSPSAGIGPPLPYWGGAAVGAEEQRWRIGMDSAAAALLDSASASASSANAAGKEMPTARHIAHRTAHNMSSSSLRKKSDLALLRKVPCAPLRRLLDNLQEVLLATKLALLFPAVLLAIAARIFHFGQEWVFVLSLIGLVPLAERLSFLTEQVAFYIGPTVGGLLNATFGNVTEVIIAIFALYQGKVVVVKCSLLGSVLSNLLLVLGTSLFFGGLANLGTEQLYDKMQVDVSTGLLILGVLCHSLPLMLRYAVSSGEHAESSWDSGLELSRACSIVMLLAYVAYLFFQLKTHRQLFEPQPQEVEDDGDDSVSQDEAVLGFSSAMIWLGVMTLMTALLSEFVVSTIEAASESWELSVSFISVILIPIVGNAAEHAGAVIFAFKNNLDITLGVSLGSATQISMFVVPLSVLVAWIMGVPMDLDFNLLETGCLFLAILVTAFTLQDGSSHYLKGLLLVFCYIVISLCFFVLRQHGNGSNDDQLGVASKPWRI

SEQ ID NO: 89876 - protein, 283 aa, Listeria monocytogenes str. 4b F2365
MKTVKLNNGVEVPILGFGTYQITDAAEAEQAVKDAIKTGYRHIDTAQSYMNEEAVGRGIAASGVDRKELFITTKIWVENVSYKGVMSSFDRSLKRLGLDYIDLLLIHQPFNDVYGAWIAMEELQASGKIRAIGVSNFSPDRVIDLAAFNEVTPQVNQIEVNPFQQQAANLAVLRKEGVTIEAWAPFAEGKNDIFNNPVLTKIGAKYGKSAAQVILRWLVEQDIIVLAKSVKPERMAQNLAIFDFELTEADKGEIASLDQGESQFFSHADPEMVKWMASRKLNV

SEQ ID NO: 89877 - protein, 588 aa, Shewanella oneidensis MR-1
MDPHVSHSAHLFSLRIAHALNEACVKDRYSFKRFGQDLLAGLTVGIIAIPLAMALAIASGVPPQYGLYTAIVGGFIIAMTGGSRYSVSGPTAAFVVLLYPIAQQFGLAGLLIATVMSGMMLVAMAMLRLGRLILYIPESVTLGFTAGIGVVIATLQLKDFFGLQIEHMPEQYFAKLMALGQALPSLHLPSLFIAAATLATMLLWPRLKIPVPAHLPAIALGSILALILNAMGAEIETIGTRFHYQLTDGGIGSGIPAVLPHFEWPWLQTGPNGQAFEFNLAAFQALLPAAFAIAMLGAIESLLCAVVLDGMTGKRHSANSELLGQGIGNIIAPFFGGIPATAAIARSAANVKAGAQSPIASMIHALVVLIGLVALAGILAYLPMSAMAALLLVVAWNMSEAPKAVHLLKTAPTSDILVFLSCFSLTVIFDMVIAISVGIILAALLFMKEIAEMTKLYDISSNKRYVDQSLPADWAVLKINGPLFFAAADRIFAEIASLTQDKQVIVLYLDGVSILDAGGLAALSKLIEKCKLNQTKLLITDLQFQPIRTLAKAKIQPVEGVLKFYPTLREALTEAPSPELEATPEATD

SEQ ID NO: 89878 - protein, 635 aa, Methanosarcina barkeri str. Fusaro
MNSNGKSIAKIMGSILFILMISTSITAGAASCDNSVKFATDCEQANCSFANCSLANCSFANCSLVNCSSANCSLANCSSELCGCVSIVDGKQNIDCNKECTSCNCESVTDCEQANCSFANCSLTNCSLTNCSLVNCSFTNCSSTNCSSELCGCVDTSTEEKTCSNAADTSTEEKACSNAADTSTEEETCDNAVDTSADTSTEEKACSNAADTSTEEETCDNAVDTSAETSTEEKTCSNAADTSTEEETCDNAVDTSAETSTEEKTCSNAADTSTEEKTCSNAADTSTEEKTCSNAADTSTEEKTCSNAADTSTEEKTCSNAADTSTEEKTCSNAADTSTEEKTCDNAVDTSAETSTEEETCSNAADTSTEEKTCDNAVDTSAETSTEEKTCSNAADTSTEEETCDNAVDTSAETSTEEETCSNAADTSTEEKTCDNAVDTSAETSTEEKTCSNAADTSTEDKTCNNAAETSTEEETCDNAVDTSAETSTEEKTCSNAADTSTEEKTCDNAVDTSAETSTEEKTCSNAADTSTEEKTCSNAADTSTEEKTCSNAVDTSTEEEICDNAVDTSAETSTEEETCSNAADTSTEEKTCDNAVDTSAETSTEEKTCSNAADTSTEDKTCNNAAETSTEECK

SEQ ID NO: 89879 - protein, 307 aa, Geobacter metallireducens GS-15
MPVFDSDKVIEQIGNTPLQRLAKLEAPGSAAVYGKAEFFNPGGSVKDRICLAMIEAAEKDGSLKPGMTVVEPTSGNTGIGLSMICAIKGYKLVLTMPDTMTVERRRLLAAYGAELVLTPGAQGMRGAVQKAEELAAQPGHIMMQQFKNGANPEAHRRTTGPEIVRALSGQSIDAFVAGVGTGGTITGVGEVLKEHNAAVRIVAVEPDASPILSGGQPGPHKIQGIGAGFVPDVLNTKVYDEVIRVTNEDAYETVRRLAQEEGVLVGISSGANVFAALQVAKRLGPGKNVVTILCDTGERYLSTGVFD

SEQ ID NO: 89880 - protein, 636 aa, Saccharophagus degradans 2-40
MIKLENVSLQRGTKFLLEEASLTIHPGQKWGIIGSNGCGKSTLFQMLTGKLAEDAGSLSIPSDWRIAHMAQEVSAVKRCAEDYVLDGDKILRRIENDIANAQAKDDGEALAKGFAELEQVDGYTAQARAQRLLAGLGFKPADGKRDVSDFSGGWRIRLNLAQALMCPSDLLLLDEPTNHLDLDATLWLENWLKQYSGTLIIISHDRDFLDNVIGNIVSFENCKLVSYTGGYSDYEIQRAERLAQQAIAFSKQQERIAEIEQFVNRFRAKATKARQAQSRLKELDRMEKIAPAHVDSPFDFRFPKPEKLPQVLITLSEAAIGYSADAPIADKIEFGVLGSSRIGLLGHNGAGKTTLIKTLSNMIPLVGGQRSEGQHLRIGYFAQHQLESLDTKGTPLLHLRRLTPKETEQKMRDFLGSFGFHGDKALDTVGNFSGGEKARLALAIIAWQKPNLLLLDEPTNHLDLEMRHALTVALQAFEGAVIIVSHDRHLLRSTVEEFVLVDNGKVAEFDGDLEDYRNWLSNENKESKEAEAEASNKNEPNKADKKQLRQNAAALRDKLKPYTNAIKKLEKQMETLQEKLAKLEEELADPELYQTGGDKLKTLLKQQGELRSQLAETEEEWFIKSDELEALNAEVQ

SEQ ID NO: 89881 - protein, 405 aa, Silicibacter sp. TM1040
MTDASLTPPARPRVKMKPKSNARAIRHGFPWVYANELVTDRRTKKLAPGSLAVLEDEAGRSLGLVAVNPESKIIARMLDRNPEALIDAEWFAARLSRAAALRGQLYDAPFYRLVHAEADGLPGVVIDRFGEACVVQPNAAWAEAHLEALTQALGEVTGCTVILKNASGRTRGLEGLDDENAVLKGAAPEEPVPVVMNGATYMADLTGGQKTGLFYDQRDNHAFAARLVAPGAEVLDVFSHVGGFGLAMLAAGAGQATCVDGSAAALDLAAAGAAASGHGDRFTARQGDAFDVLAALGAEGAKFDVVICDPPAFAPSKQALEAGLRAYERVAKLAAPLVKPGGYLGLCSCSHAADLTRFRNASARGIGKGGRRGQLLHTGYAGADHPQMPQLAESGYLKAVFFRLD

SEQ ID NO: 89882 - protein, 394 aa, Marinobacter sp. ELB17
MFESLKQLPQDPILQLMQMFRDDTRPDKVDLGVGVYKDDAGKTPIMGSVHEAERRLLEGETTKSYVGPAGAAGFNAAMARLILGNGNSLIRDGRTSVIQTPGGCGALRMAAEFFRLCQPDTTVWVSTPTWANHMPLLGGAGLNIREYSYLNRETFTVDFPAMLETLEGARSGDVVLLHGCCHNPSGADLTFDQWKAVTQMIQRKGLLPFVDMAYQGLGEGLEEDAAGVRYLAGQVPEMVIAASCSKNFGLYRERTGALMLISATGLINTAATSQLLSVVRSHYSMPPAHGAAIVETILGDDALRAGWQSELSGMCDRILGLRHAFADALTPVGDFGFIARQRGMFSFLGITPEQVRQLREEHGIYMLESSRVNVAGLNDRVLPRVASAIRSVMQ

SEQ ID NO: 89883 - protein, 642 aa, Bacillus subtilis subsp. subtilis str. 168
MMILQANQLSKSFGADTILNNIKLEVRNRDRIAIVGRNGAGKSTLLKIIAGQLSYEKGEIIKPKDITMGYLAQHTGLDSKLTIKEELLTVFDHLKAMEKEMRAMEEKMAAADPGELESIMKTYDRLQQEFKDKGGYQYEADVRSVLHGLGFSHFDDSTQVQSLSGGQKTRLALGKLLLTQPDLLILDEPTNHLDIDTLTWLEHYLQGYSGAILIVSHDRYFLDKVVNQVYEVSRAESKKYHGNYSAYLDQKAAQYEKDLKMYEKQQDEIAKLQDFVDRNLARASTTKRAQSRRKQLERMDVMSKPLGDEKSANFHFDITKQSGNEVLRVQDLTISYENQPPLLTEVSFMLTRGESAALVGPNGIGKSTLLKTLIDTLKPDQGTISYGSNVSVGYYDQEQAELTSSKRVLDELWDEYPGLPEKEIRTCLGNFLFSGDDVLKPVHSLSGGEKARLALAKLMLQKANFLILDEPTNHLDLDSKEVLENALIDYPGTLLFVSHDRYFINRIATRVLELSSSHIEEYLGDYDYYTEKKTEQLELEKMNQQEETDKTPATVKSDSKRSYEEEKEWKKKERQRLRRIEEIETTVQTIEENISRNDELLCDPEVYQDHEKVQAIHADNEKLNQELESLLSEWEELSTEED

SEQ ID NO: 89884 - protein, 78 aa, Saccharophagus degradans 2-40
MSSIEERVKKIVAEQLGVKEEEVKNEASFVEDLGADSLDTVELVMALEEEFETEIPDEEAEKITTVQLAINYINENLA

SEQ ID NO: 89885 - protein, 332 aa, Oryza sativa Japonica Group
MEPDTDKLQSLQINPNKETNLVAVFKNDYVDDEDDEDMDPQVTLGFIEEPEGPEDWHLLLPQHFPNKAGGVPAWLDPVNLPSGKSRCCDFCGEPLRFVLQVVFHLYDKLQVYMQVYAPIQCKETAYHRTLFVFMCPSMACLLLDQHEQGKDRAGSQTWFCCWCGTWKGEKVCSRCRKSSYCSKKHQELHWRAKHKNECHQISGSHNASAIMPDAGKVFAGNIWPEYMVVDETEKVSCFASCENRSELLMEQGQSEEDDMTASLMDQFEIMPQLLHYFHVENEPDSLDWATIIVYTCKGSCDQNVSYMEEFVWVQLSPATTRTNQSTCPPAGL

SEQ ID NO: 89886 - protein, 67 aa, Olisthodiscus luteus
  misc_feature (10)..(12): Xaa can be any naturally occurring amino acid
  misc_feature (20)..(20): Xaa can be any naturally occurring amino acid
  misc_feature (44)..(48): Xaa can be any naturally occurring amino acid
AGAPVYLAAXXXYLTAEILXLAGNAARDNKKSRIIPRHVQLAVXXXXXLNKLLGNVTIAQGGVLPNI

SEQ ID NO: 89887 - protein, 253 aa, Helicobacter pylori J99
MAISIKSPKEIKALRKAGELTAQALALLEREVRPGVSLLELDKMAEDFIKSSHARPAFKGLYGFPNSVCMSLNEVVIHGIPTDYVLQEGDIIGLDLGVEVDGYYGDSALTLPIGAISPQDEKLLACSKESLMHAISSIRVGMHFKELSQILEGAITERGFVPLKGFCGHGIGKKPHEEPEIPNYLEKGVKANSGPKIKEGMVFCLEPMVCQKQGEPKILADKWSVVSVDGLNTSHHEHTIAIVGNKAVILTER

SEQ ID NO: 89888 - protein, 153 aa, Helicobacter pylori J99
MTERKGMEEINREEFQEVVVNIGRVTKVVKGGRRFRFNALVVVGNKNGLVGFGLGKAKEVPDAIKKAVDDAFKNLIHVTIKGTTIAHDIEHKYNASRILLKPASEGTGVIAGGSTRPIVELAGIKDILTKSLGSNNPYNVVRATFDALAKIKA

SEQ ID NO: 89889 - protein, 450 aa, Oenococcus oeni PSU-1
MNNLEKASRLIDEENNYYARSARINYYDLVINHAHGATLIDVDGNEYIDLLASASAINVGHTNERVVKAISRQAQKLIHYTPAYFHHVPGIELSKRLAELAPGNSPKMVSFGNSGSDANDAIIKFSRAYTSRQYIVSYMGSYHGSNYGSQSLSGTSLNMTRKIGPMLPGVVHVPYPDLYRRYAGETEHDVAIRYFNAFKAPFESFLPADETACVLVEPIQGDGGIVKAPEEYMQLVYKFCHDNGILFAVDEVNQGLGRTGKMWGIQQYKDIEPDLMSVGKSLASGMPLSAVVGKKDIMQSLDAPAHIFTTSGNPVCAAASLATLNVIRDDHLVEKSAKDGEYAKQRFLEMQRHHPIIGDVRMWGLNGGIELVKDPKTKEAENDAATKVIYYAFAHGVVIITLAGNILRFQPPLVISHKQLDKALQVLDDAFTAVEQNKVEVPKDTGKIGW

SEQ ID NO: 89890 - protein, 575 aa, Prochlorococcus marinus str. MIT 9215
MKETSPKSNNRTILDINESFKIEFDPISDALAAIRNGECIIVVDDERRENEGDLICAAQFATPQQINFMATEGRGLICLAMRGEKLDSLDLPLMVDRNTDENQTAFTISIDAGPENNVTTGISAEDRAKTIQVAINPNTKPDDLRRPGHIFPLRAKKGGVLKRAGHTEAAVDIAAMSGLYPAGVICEIQNPDGSMSRLPQLKQYAKQWGMKLISIADLISYRFQTERFVFRKSDAILPSIFGNFKAYGYINELDGSEHVALVKQKSKKLKEPVLVRMHSECLTGDAFGSLRCDCRPQLEAALSRIEKEEEGVVVYLRQEGRGIGLINKLKAYSLQDGGLDTVEANEKLGFPADLRNYGVGAQILTDLGIKKLKLLTNNPRKIAGLGGYGIEVIERVPLVICPNDNNAEYLSVKKTKLGHMIDEDNFKSRNIDPFISIFLDGEYKSIDLVPIKNNVIKFCSDHHINIKLESTPRLLAFWNRPKLVWRILHDQNRTNSNITDEEIKNIELFIQFLSNYENSSKTGIIVSRNIEQALHPKSSIKVINTKFTICNNEILYSSTRKFNLDKETFSIVFES

SEQ ID NO: 89891 - protein, 483 aa, Oenococcus oeni PSU-1
MSSIFQKMFRKEDPLVYQDKDSHLIRSLTTKDFLALGVGTIVSTSIFTLPGVVAAQHAGPAVSLSFLCAAIVAGIVAFAYAEMAAAMPFAGSAYSWINVVFGEFWGWIAGWALLAEYFIAVAFVASGLSANFQGLISPLGFKLPTTLSTASTGSNGGLMDLFAIIIILLVATLLSRGASQTARVENTLVILKVIAILVFIFVGVTAIKGQNYVPFIPKYHANTDGSAFGGWQGIYAGVSEIFLAYIGFDSIAANSAEAKNPQKTMPRGILGSLFIAVFLFISVALVLVGMFRYSDYANNAEPVGWALRQSGHEIIATIVQAVAVIGMFTALIGMMLAGSRLLYSFGRDGLLPKTLGKLSNNLPSHALIVLTVIGIALGAFFPFTFLAQLISAGTLIAFMFVSIGIYALRPREGKDIPEPSFKMPFYPVLPALGFLGALAIFWGLDIQAKIYALGWFIFGMIVYFGYWIKHSTAGSSKKTEKSN

SEQ ID NO: 89892 - protein, 214 aa, Physcomitrella patens
LSDIHCTQCLPIRLSLVLSSALSKFRESVAMASAVVSTVVAPVALGGASSCVGAPSESSSVKAFSGLKSATLFSGKTQKLSSVQNGSRVQCMQVWNPIGQPKFETFSYLPPLTDDQIAKQVDYMIQQNLIPCIEFDTVGSVSRTNFSGAGSSGYYDGRYWTMWKLPMFGCTDSSQVLREIQECKSQFPSCWVRVLGFDSKKQVQICGFLVSRPN

SEQ ID NO: 89893 - protein, 527 aa, Prochlorococcus marinus str. MIT 9215
MNGDLNSWDKFCNYLWFDNKLNIWLDISKISFTRKEIDNLEEKFIDVFSSINELENGAISNIDENRQVGHYWLRNPSISPSSKIEEEICADINEISEFGKQILNGDIKNKNNQKYTDVLWIGIGGSGLGPILITDSLQKSSRGLNFSYIDNVDPFLISERLEELSEKLSTTLFVVVSKSGGTPEPRIAMEIIKSHCENNSLEWNSNAIAITMKDSKLFKKATSENWLKIFNLQDWVGGRTSITSSVGLLPLALINENIFEFIRGASLMDEATRTVDFKNNPAALLSSAWYLTGDGIGKRDMVVLPYRDRLQVFSKYLQQLVMESLGKKFNRKGEVVNQGISVFGNKGSTDQHAYVQQLRDGIDNFFCIFIELLDSPSTSIFDKKENPKEYLSGFLQGTRSALSSENRQSITITLEKLNCFSLGALIALFERAVSFYAELVNINAYDQPGVEAGKKAAANIIEYQQKVRNLLDEGGEYSINDITSLFDNSVSEPIFFILREMCFGNDNYLVKGDWSNPNSLVIQKINS

SEQ ID NO: 89894 - protein, 78 aa, Sinorhizobium meliloti 1021
MSDIAERVKKIVIDHLGVDAEKVSEGASFIDDLGADSLDTVELVMAFEEEFGVEIPDDAADSILTVGDAVKFIEKAQA

SEQ ID NO: 89895 - protein, 320 aa, Zea mays
MGLGEAAGRLLAAVDWEREAYPAYDDFLALPVFVLFFPTVRYLLDRFVFEWVARRLINRNGHQSTNNETEEGRKKIRKFKESAWKCVYFLSGELLALSVTYNEPWFTNTRYFWVGPGEQVWPDQKIKSNGCALTLRLKLKAVYMYAAGFYTYSIFALMFWETRRSDFGVSMSHHVATVVLIVLSYVFRFARVGSIVLAIHDASDVFLEVGKMSKYSHCDWLANVSFLFFVISWVLLRLTYFPFWILRSTSYEVLLTLDKKKHNFDGPIYYYVFNSLLFSLLVLHIYWWVLIYRMLVRQIKTRNVGDDVRSDSEGEDDHED

SEQ ID NO: 89896 - protein, 489 aa, Vibrio cholerae O1 biovar eltor str. N16961
MGKATGFLEFGRELPKKIDPAERIKNNKEFVLNQEFGKKINQQASRCMDCGVPFCHNGCPIGNIIPEFNDAVYRDSWEEAWNILSSTNNFPEFTGRVCPAPCETACVLGINQDPITICNIEKTIVERAYQEGYAKPKTPRSRTGKTVAIIGSGPAGLAAAEQLNAAGHSVTVFERDEKVGGLLRFGIPDFKLGMDVIDRKINLMEQAGVKFVVNAHIGVDINAQQLRQEFDAVLLTGGSTVPRDLSIPGRDLKGVYFAMQFLAQNNRRANGMDLKGEEIHAKGKHVVVIGGGDTGSDCVGTSNRHGAASITQVEIMPIPPQKRPVNMPWPQYPMILRTSTSHEEGCERHWNILTKEFIGNEQGEVTGLRIADIVWKDAAPGERPSFDEVVGSERVIPCDMAFLAMGFLHPEPHGVLAQLGIKLDERGNVATQDFATNQKGVFAAGDMRTGQSLVVRCINEGRECARAVDTFLMGNTHLEAKADSLMLSA

SEQ ID NO: 89897 - protein, 266 aa, Oryza sativa
  misc_feature (30)..(30): Xaa can be any naturally occurring amino acid
AAADLGGVRSCVIPRPSEGSKQLLDQEDVXKVPQADSDRGITPEEFRLVKIHMSCRVRPSAHLAVVRQRVIATAVTYFRRVYTRKSMTEYDPRLVAPTCLYLASKVEESTVQARLLVFYIKKMCASDEKYRFEIKDILEMEMKLLEALDYYLVVYHPYRPLLQLLQDAGITDLTQFAWGIVNDTYKMDLILIHPPYMIALACIYIASVLKDKDITLWFEELRVDMNIVKNISMEILDFYDTYKIDPQRGLPEDKIAPVMNKLPSKA

SEQ ID NO: 89898 - protein, 471 aa, Vibrio cholerae O1 biovar eltor str. N16961
MMSQNVYQFIDVNRVDPAKKPLHIRKIEFVEIYEPFTKQQATAQADRCLDCGNPYCEWKCPVHNYIPQWLKLANEGRILEAADLAHQTNSLPEVCGRVCPQDRLCEGSCTLNADFGAVTIGNIEKYITDTAFEMGWKPDMSNVVWTDKKVAIIGAGPAGLAAADILVRNGVRPVVFDRYPEIGGLLTFGIPSFKLEKGVMENRRRIFSEMGIEFRLNVEVGQDITLQQLLDEYDAVFLGVGTYQYMRAGLANEDAPGVYDALPFLISNTYKVMELNNEAPFIDMAGKNVVVLGGGDTAMDCVRTSIRQGASRVICAYRRDEENMPGSRREVKNAKEEGVEFMFNLQPLGIEVNAQGQVTGVKVVKTALGEPDAAGRRKPEPVAGSEHVLPADAVIMAFGFQPHKMAWLEPFDVELDQWGRIKAPAKQTYQYQTTNPKIFAGGDAVRGSDLVVTAIDEGRKAAEGILDYLGV

SEQ ID NO: 89899 - protein, 289 aa, Mesembryanthemum crystallinum
MSNTCFTSSLHSPSILIPKSLFFSIPSKPTKIPLSLSLSSPQLSSFSLQKQTLSSTVVTYVAQTSEWDQEGTNAVLEEGSDQEPSWGNTEAQVSDFGSDEGEGFQEPPEDAKLFVGNLPFDVDSEKLAQIFEGAGVVEIAEVIYNRETDRSRGFGFVTMSTVEEAEKAVELYHKFEVNGRFLTVNKAAPRGSRPERAPREYEPSFRVYVGNLPWDVDDARLEQVFSEHGKVLSARVVSDRETGRSRGFAFVTMASESEMNEAIGALDGQTLEGRAIRVNVAEERPRRSF

SEQ ID NO: 89900 - protein, 315 aa, Buchnera aphidicola str. Bp (Baizongia pistaciae)
MSDMKLFSGNSVPKLAESIANKLYVNLGNASVGKFSDGEINVQINENVRGSDVFIIQSTCFPTNDNLMELVVMVDALRRASAGRITAVIPYFGYARQDRRVRSSRVPITAKVVADFFSSVGIDRVLTVDLHAEQIQGFFDVPVDNVFGSLILFEDMLKIDLKNPIVVSPDIGGVIRARAIAKLLHDTDMAIIDKRRPHINFSQVMHVIGEVFNRDCILVDDMIDTGGTLCQAAEALKKRGARRVFAYATHPIFSGNAVKNLQNSNIDEVVVCDTIPLSKIIQELPNVRTLTLSSMLAEAIRRISNEESISAMFEH

SEQ ID NO: 89901 - protein, 486 aa, Clostridium difficile 630
MFNELKTKENVYKNLINGKWVESNSRKPIEIYSPIDNSLVGKVQSMTKHEVDEVIKNTKESIKVWAEMPVYKRANIFHKAADLLLENIDEIANILVLEIAKDIKSARAEVERTADFLRYTADVGKNMEGEAISGDNFPGGTRNKMSYVSRVPLGTVLAISPFNYPVNLSMSKIAPALIGGNAVVLKPATQGAISALHVVEIMRKAGIPDGVLNTITGRGSEIGDYVVTHKGINFINFTGSTEVGQHISKISGMVPLLLELGGKDAAIVLEDADLDFAAKNIVSGAYSYSGQRCTAVKRILVQESVADKLVGKIKPLVEKLTIGNPMDEVVITPLIDNKATDFVQGLVDDALHKGAKLITGNVRKNNLFYPTLLDNVNVDMKIAWEEPFGPVLPIIRVKDINQAIEIANQSEYGLQSSVFTSDIDKAFYIADKLEVGTVQINNKTERGPDHFPFLGVKASGMGTQGVKYSIEAMTRPKAVVVNVREL

SEQ ID NO: 89902 - protein, 352 aa, Zea mays
MMASQAMVPLRQLFVDGEWRPPAQGRRLPVVNPTTEAHIGEIPAGTAEDVDAAVAAARAALKRNPGGAPANVACAIAKLGGSSAFVGKFGDDEFGHMLVNILKQNNVNSEGCLFDKHARTALAFVTLKHDGEREFMFYRNPSADMLLTEAELDLGLVRRARVFHYGSISLISEPCRSAHMAAMRAAKAAGVLCSYDPNVRLPLWPSPDAAREGILSIWKEADFIKVSDDEVAFLTRGDANDEKNVLSLWFDGLKLLVVTDGDKGCRYFTKDFKGSVPGFKVDTVDTTGAGDAFVGSLLVNVAKDDSIFHNEEKLREALKFSNACGAICTTKKGAIPALPTVATAQDLIAKAN

SEQ ID NO: 89903 - protein, 270 aa, Oryza sativa Japonica Group
MPAGQPHAHEPDGCGASHRRPQSPPSLPAEVVPAFAPPESEDEESWLCSSTLLSTLLYDLFLASFTAHPSLRAAVVADLLAARSRDPACVGFSQCLLNFKGFLAIQAHRVSHVLWAQQRRPLALALQSRVADVFAVDIHPAAVVGKGILLDHATGVVIGETAVVGDNVSILHHVTLGGTGKAVGDRHPKIGDGVLIGAGATILGNVKIGAGAKIGAGSVVLIDVPARNTAVGNPARLIGRKNGEVEKDEDMPGESMDHTSFIRQWSDYTI

SEQ ID NO: 89904 - protein, 715 aa, Buchnera aphidicola str. Bp (Baizongia pistaciae)
MTRTIMLVPIGKNIGLTTISLSVISAMKRCKFNVKFLKSAIEYSNTNYNIDDTSLILKDTQSLSYINPLIVDFINQFSLKQIKQRIVDYILSKVYAKKEKYDIFLIEGFDTKSHTYVLSNDINYYISKSINVEIVFVCAVDRSSQLDINNIVYIINNVFKKNKNINIRGVIINELCQKVRNDYGNVNLFDMFKSSVKKINFGDVKYDFLFQKNGIEVLGCVPWIHKLMEPSVKILCDKYLGANIIYDRCMNSQYIKTFIIYDTNEDIKNAKKFHRSLLIIPAISNDKIKEICVQINKNKILISAILLTNFLNVHDKCTDFIDQLKIANCTICSTPNDVFTVVSLLHKFNFKLDNKNYQLNIIENDMSRHINLDWIRSLKHSYQYNSICLPSLFIYNLKHLAKKFMKNILLPEGCELRIIKAASICSKNDIAYCTLLGNPKKIKNIAESNNIVLNSNIEIIDPKLIRKNYVERLCHLRRHHGITLAHANELVKDNSILSTLILESKKVDGLVSGSIGTTSSIILPALQLIKTSPGSSLISSVFFMLLSDYVTLYADCAVNINPDATQLAEIAIQSSNTARLFGIFPKVAMLSYATGCSGFGDTVDKVKEATRIVQERSPNLIVDGPIQYDAAINRSVAKLKCPHSLVAGNATVFIFPDLNSGNITYKAVQRSANILSIGPILQGINQPVNDLSRGSSVQDIVYTIAVTVLQSSLSH

SEQ ID NO: 89905 - protein, 181 aa, Ureaplasma parvum serovar 3 str. ATCC 700970
MKLNVTIEIPKNSNIKYEYDRATKEIMVDRILHGSMVYPHNYGFLKEALDYDGDELDVLVFADQAFQPGIKVPARVLGAMKMIDGGETDTKLLAVIDVDPRYKHINNFKDIPLHWLAEVQDFFENYKNLQNKKVKILGFEDEIWAQKEYEECVLLMKEYGHLKKDEFVTKMMKERPEKYIK

SEQ ID NO: 89906 - protein, 319 aa, Aspergillus nidulans FGSC A4
MSPPTVKLNSGYDMPLVGFGLWKVNNDTCADQVYEAIKAGYRLFDGACDYGNEVEAGQGVARAIKEGIVKRSDLFIVSKLWNSFHDGERVEPIARKQLSDWGIDYFDLYIVHFPVSLKYVDPEVRYPPGWENAEGKVELGKATIQETWTAMESLVDKGLARSIGISNFSAQLLLDLLRYARIRPATLQIEHHPYLTQERLVTFAQREGIAVTAYSSFGPLSFLELSVKQAEGAPPLFEHPVIKDIAEKHGKTPAQVLLRWATQRGIAVIPKSNNPARLLQNLDVVGFDLEDGELKAISDLDKGLRFNDPPNYGLPITIF

SEQ ID NO: 89907 - protein, 402 aa, Marinobacter sp. ELB17
MLKLDFHPSGRHFLQIPGPSPVPDRILRAMSLPTIDHRGPEFGALGLELLKKIQTIFKTTQPVIIYPASGTGAWEAALINTMSAGDHVLMFETGHFATLWEKMARRLGLQPEFLGLPGYEGWRAGVQADMIEERLRKDTGHTIKAVCVVHNETSTGVTSNIPAVRRAINAAGHPALLLVDTISGLACADYQHDAWGVDVTISGSQKGLMLPPGISFNALSDNAIAASKTSNLPKSFWAWDEILEANKNGYWPYTPNTNLLYGLNEALDMLLEEGLEQVLARHQRWGVGVRKAVEAWGLEVQCQEPDVYSPVLTGVVMPEGVDADAVRRLIYERFDLSLGMGLGKSKGKMFRIGHLGDCNDLTLIAALGGCEAGLKLSGVNLKGSGVLAALEYFSQNPPHHVN

SEQ ID NO: 89908 - protein, 472 aa, Xanthomonas oryzae pv. oryzae KACC10331
MHRHVHEPEILADPAAAQTAEHWRQRDLAVVWHPCTQMREHPHTLPLVPIARGEGAWLVGHDGRRYLDAVSSWWTNLFGHTEPRIGAAIARQAGELEQVMLAGFTHTPAVQLAEQLLEIAPRQAGRAPLSKVFYADNGSAGVEVALKMAFHSFHNRGEHRRTRFIALENGYHGETIGALSVGDIPLYRRVYAPLLLESMFTPSPDAYLAEPGQSAEDYALQAADALQALFEQSPGEICALILEPRVQCAGGMRMHHPAYLRRARALCDAHGAFLIADEIAVGFGRTGTLFACEQAGVMPDLLCLSKGLTGGFLPLSAVLATQQLYDAFLDDSRERAFLHSHSYTGNPLACAAALATLKIFADDDVIARNQPIAARMSELAAQIGEHPAVADVRQAGMIVAFELTRGGDKRTPFASAARVGLKAYRAALDKGVVLRPLGDVLYWMPPYCVDEAQLALLADTTRHAIAEAVACA

SEQ ID NO: 89909 - protein, 472 aa, Shigella flexneri 2a str. 301
METNIVEVENFVQQSEERRGSAFTQEVKRYLERYPNTQYVDVLLTDLNGCFRGKCKPVSSLYKLDTRRYLVASIFALNILGNVVEEAGLGQEMGEPDRTCVPVLGSLTPSAADPEFIGQMLLTMVDEDGAPFDVEPRNVLNRLWQQLRQRGLFPVVAVELEFYLLDRQRDAEGDLQPPCAPGTDDRNTQSQVYSVDNLNHFADVLNDIDELAQLQLIPADGAVAEASPGQFEINLYHTDNVLEACDDALALKRLVRLMAEKHKMHATFMAKPYEEHAGSGMHIHISMQNNRGENVLSDTEGEDSPLLKKMLAGMIDLMPSSMALLAPNVNSYRRFQPGMYVPTQASWGHNNRTVALRIPCGDRHNHRVEYHVAGADANPYLVMAAIFAGILHGLDNELPLQEEVEGNGLEQEGLPFPIRQSDALGEFIENDHLRRYLGERFCHVYHACKNDELLQFERLITETEIEWMLKNA

SEQ ID NO: 89910 - protein, 474 aa, Sulfitobacter sp. EE-36
MANAVGKITQVIGAVVDVQFEDHLPEILNAVVTENHGKKLILEVAQHLGENTVRTIAMDATEGLVRGQRVEDTGAPISIPVGNATLGRIMNVVGEAIDEKGDIQSAERRSIHADAPEFAEQSTTSEVLETGIKVIDLLAPYAKGGKIGLFGGAGVGKTVLIMELINNIAKVHSGYSVFAGVGERTREGNDLYHEMIESNVINPDDLEKSQVALVYGQMNEPPGARMRVALTGLTLAEQFRDQSGTDVLFFVDNIFRFTQAGSEVSALLGRIPSAVGYQPTLATDMGAMQERITSTKSGSITSVQAVYVPADDLTDPAPATSFAHLDATTVLDRSISEKGIYPAVDPLGSTSRLMDPSIVGEEHYNVARDVQGILQRYKSLQDIIAILGMDELSEDDKLTVARARKIERFLSQPFDVAKVFTGSDGKQVPLEETITSFKAVVAGEYDHLPEGAFYMVGGIEEVKAKAEKMAADAA

SEQ ID NO: 89911 - protein, 495 aa, Shigella flexneri 2a str. 301
MNFHHLAYWQDKALSLAIENRLFINGEYTAAAENETFETVDPVTQAPLAKIARGKSVDIDRAVSAARGVFERGDWSLSSPAKRKAVLNKLADLMEAHAEELALLETLDTGKPIRHSLRDDIPGAARAIRWYAEAIDKVYGEVATTSSHELAMIVREPVGVIAAIVPWNFPLLLTCWKLGPALAAGNSVILKPSEKSPLSAIRLAGLAKEAGLPDGVLNVVTGFGHEAGQALSRHNDIDAIAFTGSTRTGKQLLKDAGDSNMKRVWLEAGGKSANIVFADCPDLQKAASATAAGIFYNQGQVRIAGTRLLLEESIADEFLALLKQQAQNWQPGHPLDPATTMGTLIDSAHADSVHTFIREGEGKGQLLLDGRNAGLAAAIGPTIFVDVDPNASLSREEIFGPVLVVTRFTSEDQALQLANDSQYGLGAAVWTRDLSRAHRMSRRLKAGSVFVNNYNDGDMTVPFGGYKQSGNGRDKSLHALEKFTELKTIWISLEA

SEQ ID NO: 89912 - protein, 203 aa, Triticum aestivum
  misc_feature (167)..(167): Xaa can be any naturally occurring amino acid
MSDTKVYRASTTAPVNIAVVKYWGKRDAKLNLPTNSSLSVTLSQDDLRTLTTASCSSTFTDGDSLTLNGESSDISGARTQACFRELRSRRAALEQADSSLPKLSSYPLKIVSENNFPTAAGLASSAAGFAALVQAIAFLYELPDSPSDLSLIARQGSGSACRSLFGXYVAWRMGEKEDGSDSKADLVAPASHWPEMRALILVA

SEQ ID NO: 89913 - protein, 339 aa, Nostoc punctiforme PCC 73102
MNLPTASRLQFTPDLNICRILNGMWQVSGAHGRINPQAAIETMFKYLDAGFTTWDLADHYGPAEDFIGEFRCQLIDTRGKDALSKVQAFTKWVPRPGKMTKKLVEENIDISLRRMNVESLDLMQFHWWEYQDKNYLDALKYMAELQTEGKIKHLGLTNFDTENLKLITEAGIKIVSNQVQFSLIDRRPEVNMAEFCQQHDIKLFTYGTLCGSLLSENYLGKPEPRGSDLSTASLKKYKNMIDAWGGWQLFQELLAILKEIANKHKVSISNVAVRYILDQPTVGGVIVGARLGVSEHIEDNAKVFSFSLDADDRDRISAVSRQSRDLYQLIGDCGDEYRR

SEQ ID NO: 89914 - protein, 172 aa, Populus trichocarpa
MANPRVFFDMSVGGQPAGRIVMELFADIVPKTAENFRALCTGEKGVGKSGKPLHYKGSSFHRVIPNFMCQGGDFTAGNGTGGESIYGAKFADENFVKKHTGPGVLSMANAGPGTNGSQFFVCTVKTEWLDGKHVVFGQVVEGLDVVKAIEKVGSGSGKTSKPVAIADCGQLS

SEQ ID NO: 89915 - protein, 341 aa, Oenococcus oeni PSU-1
MTVKIGINGFGRIGRLAFRRIMELQDKASDIEVVAINDLTTPSMLAYLLKYDTTHGTLNADVSANDDTSTLTVNGKDYHIYSEKDARNLPWVKNDGVEYVLECTGFYTSKEKAQAHIDAGAKRVLISAPAGKIPTIVYGVNQDTLTSSDTIVSAGSCTTQSLAPMARLLQDKFGIEVGTMTTIHAYTSTQMILDGPRSSKKRTNRTAASNTIPHSTGAAKAIGLVVPEVDGKLNGHAQRVAVVDGSVTELTTILSKKVTPEEVNDAFKEYTKGNESFGWNEDEIVSSDIINDTHGAVYDPTQLEVITAGDKQLVKTVSWYDNEYGFTSNMVRTLLHFAKLE

SEQ ID NO: 89916 - protein, 442 aa, Chlamydophila abortus S26/3
MDELTTDFDTLMSQLNDVHLTTVVGRITEVVGMLIKAVVPNVRVGEVCLVKRYGMEPLVTEVVGFTQNFAFLSPLGELTGVSPSSEVIPTGLPLYIRAGNGLLGRVLNGLGEPIDSEIKGPLVDVNETYPVFRAPPDPLHREKLRTILSTGVRCIDGMLTVARGQRIGIFAGAGVGKSSLLGMIARNAEEADVNVIALIGERGREVREFIEGDLGEEGMKRSVIVVSTSDQSSQLRLNAAYVGTAIAEYFRDQGKTVVLMMDSVTRFARALREVGLAAGEPPARGGYTPSVFSTLPRLLERSGASDKGTITAFYTVLVAGDDMNEPVADEVKSILDGHVVLSNALAQAYHYPAIDVLASISRLLTAIVPEEQRRIIGKAREVLAKYKANEMLIRIGEYRRGSDREVDFAIDHIDKLNRFLKQDIHEKTNYEEASQQLRAIFR

SEQ ID NO: 89917 - protein, 453 aa, Oryza sativa
MADGASANPGDPPSPASARSGQRKHVPDWLNSPIWSAPPPPARHRAPSPPRPPPPPPPPAQPAPPPPPPARSGGGGGGSDDGSDGDGDDEGAASSSRPHLVPEFTVALGRKVVDLAELRRLACQGVPDAAGVRPVVWKLLLGYLPTDHALWAYELEKKRSQYSAFKDELLVNPSEVTRRMEEMTISKGNRHNSEGTGVLPRAEIVHDEHPLSLGKTSVWNQFFQESETIEQIDRDVKRTHPEMQFFNGDSSDALSNQESLKRILTIFAKLNPGIRYVQGMNEVLAPLYYVFKNDPEENNAESAEPDAFFCFVELLSGFRDNFCKQLDNSVVGIRSTISKLSQLLKRHDEELWRHLEVVTKVNPQFYAFRWITLLLTQEFKFRDCIHIWDALLGDPEGPQATLLRICCAMLFLVRRRLLAGDFTANLKLLQSYPPTNIDHLLHIANKLRGPIPY

SEQ ID NO: 89918 - protein, 214 aa, Alkalilimnicola ehrlichei MLHE-1
MSDERREGLAPEIEATGLVPMVVEQSARGERAYDIYSRLLKERVIFLVGPVEDHMANLIVAQLLFLESENPDKDIHIYINSPGGAVTAGLAIYDTMQFIKPDVSTVCIGQAASMGALLLTGGTKGKRYALPNSRMMIHQPLGGFQGQATDVDIHAREILDMRDRLNRIMAHHTGQDMETIARDTDRDNFMSPDTACEYGLVDAVLADRKALDQA

SEQ ID NO: 89919 - protein, 461 aa, Physcomitrella patens subsp. patens
MASSAALTALASGQEVLRSGVTQKFSGLRVAAFPLKKDNVALYVKGKSTSVMSVATDVSRFESVTMAPADPILGVSEAFKKDNSEKKLNLGVGAYRTEDLQPYVLEVVKKAEKKMLEGGDNKEYLPIEGLAAFNKATAELLLGADNAAIKENRVATVQGLSGTGSLRLGAAFIQRYFPGITVYISSPTWGNHKNIFNDAGVPWKEYRYFDPKTVGLDFDGMMEDIENAPEGSIILLHGCAHNPTGIDPTPDQWEKIADLIQQKNHMAFFDVAYQGFASGSLDDDASSVRKFVARGMEVFVAQSYSKNLGLYAERVGAINAIVSSADVAARVKSQLKRIARPMYSNPPVHGARIVANVVGEPTMFDEWRAEMQMMAGRIKTVRQRLYDELSTKDKSGKDWSFVLKQIGMFSFTGLNKAQSDNMTDKWHVYMTKDGRISLAGLNLAKCAYLADAIIDSYYNIQ

SEQ ID NO: 89920 - protein, 350 aa, Candida albicans SC5314
MSQTERKLIINTAGGAAANMKQKEIPSTKNDAQKVSTLGGFLAGGVAACMAVTFTNPIELIKTRMQLQGELVKKSKDAVVLYKNPLQAFAVIYRNEGIRGLQQGLACGYYYQLALNGCRIGFYEPSRFYLSKAFAPSHIMPDGQVKQSLSINVLAGFVSGASGAVLASPMFLIKTRMQSFSASNTGGAAVGQQTFYKNTWDGFSQIYHSEGIKGLYRGVDAAILRTGAGSAAQLPTYYLTKSFLLKHGLAKENSFSLNFISSIMAGLGVAIVMNPWDVVLTRMYNQKGNLYSGPIDCFKKTIAAEGAMALYKGFWAQLFRIGPHTILTLLFMEQCMKGMVSIEKKLRSFN

SEQ ID NO: 89921 - protein, 326 aa, Glycine max
MGVRSWPLVLFSLCLFCNSGLSIATTFREEEHQEISYEFGTKLDAVPVVNPTTPGTANSFPTLNPTTTPQAPGSTGQTTPTTPYMTPINPYTNPTTPKTSPTNPYSNPTTPTMAPPSPTTTTTTPTTPTTPTTTASSGGQWCIASQSAAENTLKVALDYACGYGADCSAIQPGASCYNPNTLKDHASYAFNDYYQKNPAPTSCAFGGTATLTNKDPSNGNCRYTSSKTPSMSPPTPTYVSPPNPPSTMTPTTPTTMTPSAPSTMTPTTPGIMTPTAPGMTTIPGGASVYGTGPAGSPNTATSASHSEVLLLTLFGLWASIRVEIYI

SEQ ID NO: 89922 - protein, 448 aa, Bacillus subtilis
MTHDLIEKSKKHLWLPFTQMKDYDENPLIIESGTGIKVQDINGKEYYDGFSSVWLNVHGHRKKELDNAIKKQLGKIAHSTLLGMTNVPATQLAETLIDISPKKLTRVFYSDSGAEAMEIALKMAFQYWKNIGKPEKQKFIAMKNGYHGDTIGAVSVGSIELFHHVYGPLMFESYKAPIPYVYRSESGDPDECCDQCLRELEQLLKEHHEEIAALSIESIVQGASGMIVMPEGYLAGVRELCTTYDVLMIVDEVATGFGRTGKMFACEHENVQPDLMAAGKGITGGYLPIAVTFATEDIYKAFYDDYENLKTFFHGHSYTGNQLGCAVALENLALFESENIVEQVAEKSKKLHFLLQDLHALPHVGDIRQLGFMCGAELVRSKETKEPYPADRRIGYKVSLKMRELGMLTRPLGDVIAFLPPLASTAEELTEMVAIMKQAIHEVTSLEN

SEQ ID NO: 89923 - protein, 161 aa, Salinibacter ruber
EKRQENWVDRLVSVNRVSKVVKGGRRFSFNTVVVVGNEDGLVGTGLGKANEVSSAISKGADDAKKNVIRVPMRDGTIPHKVVGKQDAGKVLLKPASPGTGVIAGGGVRAVLECAGYRNVLTKSLGTSNPHNQVKATINALAETEDALEVARRRDIPLEKVF

SEQ ID NO: 89924 - protein, 199 aa, Buchnera aphidicola str. Bp (Baizongia pistaciae)
MVLVTYPAPDFTASAISCNGDIINNFNFKEFTNNQTSILFFWPMDFTFVCPSEIIAFNQELSKFKKRNVKLIGVSIDSVYVHHAWRNTLSHNGQIDKINFTMVSDLKREIQRSYGIEHPQLGVALRATFLIDKNRIIRHQTINDLPFGRNISETLRMIDALHFYEKYGEVCPANWKKGDTGIKTTQEGIHKYLEKISKK

SEQ ID NO: 89925 - protein, 405 aa, Acidobacteria bacterium Ellin345
MKPSKTATANPPIHLTPRGAARIRAGHVWVYRSDLKDQKPKAEPGSLVAVLDEKGRILGDALYSSSSQIAIRMFAVGREETYAVELPEIVSNRVAAAISYRDEVLQQTEACRLVFSEADFLPGLIVDRYNDILTMQVLTQAMDREDLRRAVMDSLREHFPNSTIFERVDERIRELEKLPAKESGVVGKPQKGNAKTATIFNMNGLRFHYDVSGQKTGAFLDQRENYAAAAQYARGDALDVFTYQGGFALHLYQNCRRVTGVDMSRPALEVAEENATLNEYNLEWIEANAFDYLKDQSVGGRAYDTIVLDPPAFAKTAKNFDTAIRGYKELNLRALKMLRAGGTLISCSCSFHVSEADFMEMLGTAAADAHRRVRILEKRNAAKDHPILMGVPETNYLKCIIARVD

SEQ ID NO: 89926 - protein, 379 aa, Vibrio cholerae O1 biovar eltor str. N16961
MSKSALLVLEDGTVFRGVSIGADGISVGEVVFNTSMTGYQEILTDPSYSQQIVTLTYPHIGNTGTNSEDEESTAIHAQGLVIRDLPLIASNFRSEQSLSDYLKSQNIVGIADIDTRKLTRILREKGAQNGCIMAGDNLDEALALAKAKEFPGLKGMDLAKVVSTKEAYAWKQGSWTLEGGLPEAKADSELPYHVVAYDFGAKRNILRMLVDRGCRLTVVPAQTSAEDVLALNPDGVFLSNGPGDPEPCTYAIEATRVFLEKNIPVFGICLGHQILALASGAKTVKMKFGHHGANHPVKDLDRGVVMITSQNHGFAADEATLPDNLRATHKSLFDGSLQGIHRTDKPAFSFQGHPEASPGPHDAAPLFDHFIELIKQFRA

SEQ ID NO: 89927 - protein, 494 aa, Rhodospirillum rubrum ATCC 11170
MASQSASAPITPVILSGGSGSRLWPLSRALYPKQFLPLVSELTMIQETALRASGERFTAPLVICNDEHRFIVAEQLRAAACQPTAIILEPVGRNTAPAVAVAALKLLESASDPIMLVMPSDHVIQNADAFLAAIDQAAPAARAGALVTFGITPNAPETGYGYIKAGGSFAPFTGVLRVERFVEKPNLQTAESYLAEGSYLWNSGIFLFSAKAYLAELGRTNSKIIEACSQALAQGQRDLSFCRLDAAAFAASPADSIDYAVMEKTANAAVFPVEMGWSDLGAWSALWEIGPKDAQDNVALGDVLLQDVEGSYIRSDHRLVAVAGLCNVVVVATDDAVLVIDRGKVQDVKQIVERLKKANRDEHALHSTVHRPWGHYRGIDRGERFQVKRIVVQPGERLSLQMHHHRAEHWIVVTGTALVTRGAETFLLHENESTYIRAGQTHRLENPGKVPLHLIEVQSGGYLGEDDIVRFEDGYGRTLPQKEPPLISLENKTE

SEQ ID NO: 89928 - protein, 1088 aa, Debaryomyces hansenii CBS767
MSYNPYRLRNYGGGYSNNGYRQRHYYSDYNESSYNSSYRDQYDRNGSYSGSKGRHYNSGTSRNAPPPSSSAYSSDSSSRTYANSSSSGPAKIPVGPKSLTIDGSTNGDLPTAGTQKHNIPPTNAISGTDATTGVNPNDSNFTQLLLHQDLLKQIEFSGEIDSKRNYKVIYDPELDKSLSKAERKTKQKKIRFNGESLSSHDVTDPRKSSTGSTSAYFLKPNKKSKKFPFKQLPQPKFIYDKDSLGPPPQNEIVVWDLPSTTSEVYLSNFFKSYGDSIKDLKFINDPLNAVPLGIATCKFQGNPDKSMRIAKKFIANVRINHTKIDGAELKIALNDNDNKLLDDKIKVAQDKLRISRIKIEEEEKKRLKKQQAIEDQKRRETEKAAKEKKLQESANSSHESRFKPNTTTLSIRHHNEVIPGVFLPRELRKYIRDRPYIFINDKYVPTRKVSSQDIKKVLNKYDWTRVLPDRSGFFVVFNSIKECERCFINEDGRKFFEYKMFMELALPENFNESSSLTSNNDNTDLSASNRKQNDVVEEASNMLIKEFQNFLAKDIRERVIAPVVLDLLSHDKYPKLVEELKAKELATKKAASPIVTNAVRQVKLKPNVLSSLAIKSKPQAILPSFRKKKDLPNAGLNSANKAKKNVIPMQHALNYDHESDESDEDDSTRSTTPLTPTLKRERSPTVSSVSNDNDIEDKLEDIQKPLKKKQKKTKLHQSFLYDSASDEDMEAVSEEKEVEKDESEGEEDIDYSHIDKIYQPTEDYPRPVYEEVPRFPSDPLDLDALQSIIKDDEDITLLQTALADVTSESNIKNMEYWAWKQKDIKAKAGVQEISEDLEVIGPLDSRFDSKSGAFKSEGYRKIPDADKIEYLPHRRKIHKPIKTIQHDDDELNANNSTTNNNSNNIQSSRVNRANNRRFAADISAQKQMLGSETDILNLNALTKRKKPVSFARSAIHNWGLYALEPIAAKEMIIEYVGESIRQQVAEHRERSYLKTGIGSSYLFRIDENTVVDATKKGGIARFINHCCNPSCTAKIIKVEGKKRIVIYALRDIEANEELTYDYKFEKETNDAERIRCLCGAPGCKGYLN

SEQ ID NO: 89929 - protein, 105 aa, Arabidopsis thaliana
  misc_feature (30)..(30): Xaa can be any naturally occurring amino acid
  misc_feature (63)..(63): Xaa can be any naturally occurring amino acid
  misc_feature (93)..(93): Xaa can be any naturally occurring amino acid
  misc_feature (98)..(98): Xaa can be any naturally occurring amino acid
THTSKRLKSFYTSPLSPSLDLRTRAANTNXNARQIFHSLGNPTVEVDIHTSNGIKVTTAFPSXATTGIYDALELRDGRSDYLGKGISKAVNNXNDSIXPTLIRKD

SEQ ID NO: 89930 - protein, 327 aa, Rhodopirellula baltica SH 1
MKAIVLHSFGGLESFELCDVPKPVPRAGQVLVRVHATSINPLDYQVRRGDYHDLVQLPAITGHDVSGVVEEVGAGVTTFSPGDEVWYTPQIFDGPGSYAEYHVAAESIIGKKPASLSHLEAASLTLVGGTVWEALIVRAVLRVGESILVHGGAGGVGHVAIQLAKAIGAKVFTTVRDANARFARSMGADVIIDYQKEDYVDCIMRETDGRGVDVVFDTIGGDTLSRSPDALAQLGRVVTIVDTALPQNVIQAWGKNASYHFVFTRQNRGKLDELSALVERGQLKPHVGAVYSLADIPLAQARLESSNNGVQGKIAIAIDDRIRESME

SEQ ID NO: 89931 - protein, 253 aa, Desulfovibrio vulgaris subsp. vulgaris str. Hildenborough
MLPRTAATGHTLHECLPDSRRLLPANSPCPPRRQGVHHMTTGVLWVVLFACLAACAPARNGQATSSVTAATATRQTTVQGGAQAALQNAPVIRPGDEAPDFDLPAVDGTRLRLASFRGHKAVVLSFVPAAFTPVCSSQWAGYGMLKPRFEALGAIVVGIAADNVPSLAAWTREMGTDAAGHPSPLWFPVVSDFWPHGAVTMRYGLLRPEGIAERALVLIDKAGVVRLVEVSDIDKRPPLDNLFKALERLAAGN

SEQ ID NO: 89932 - protein, 474 aa, Streptomyces sp. CHR28
MLQAHTGYDLAIVGSGGGAFAAAIAARNKGRRVVMVERGTTGGTCVNVGCVPSKALLAAAEARHGARAASRFPGLQATEPALDFPALIGGKDALVEQLRAEKYTDLAAEYGWQIVHGTAAFADGPVLEVSLNDGGTTTIEAAHYLIATGSAPTAPPIDGLDQVDYLTSTTAMELQQLPEHLLVLGGGYVGLEQAQLFARLGSRVTLAVRSRLASREEPEISAGIEDVFREEGFAVHTRTQLRAVRRDGDGILATLTGPGGEQQVRASHLLIATGRRPVTDGLGLERVGVKTGERGEVVVDEYLRTDNPRIWAAGDVTGHPDFVYVAAAHGTLVADNALDGAERTLDYTALPKVTFTSPAIASVGMTDAQLAEAGIACQCRTLPMEYVPRALANRDTRGLVKLIAERGTGKLLGAHVLADGAGDIITAATYAITAGLTVDQLARTWHPYLTMAEALKLAAQTFTSDVAKLSCCAG

SEQ ID NO: 89933 - protein, 353 aa, Bacillus subtilis subsp. subtilis str. 168
MTHTVPQNMKAAVMHNTREIKIETLPVPDINHDEVLIKVMAVGICGSDLHYYTNGRIGNYVVEKPFILGHECAGEIAAVGSSVDQFKVGDRVAVEPGVTCGRCEACKEGRYNLCPDVQFLATPPVDGAFVQYIKMRQDFVFLIPDSLSYEEAALIEPFSVGIHAAARTKLQPGSTIAIMGMGPVGLMAVAAAKAFGAGTIIVTDLEPLRLEAAKKMGATHIINIREQDALEEIKTITNDRGVDVAWETAGNPAALQSALASVRRGGKLAIVGLPSQNEIPLNVPFIADNEIDIYGIFRYANTYPKGIEFLASGIVDTKHLVTDQYSLEQTQDAMERALQFKNECLKVMVYPNR

SEQ ID NO: 89934 - protein, 378 aa, Lactococcus lactis subsp. lactis Il1403
MKEMLIMTPGPTEVAENVRLARAKATTNPDIDLAFYDFYKKTCSKLAQFLKTKNDVRVLAGEGILGLEAACASLTEKGDRVLVLDNGIFGHGFSDFIELYGGEAILLESSGKEAFSLEILEKFLEKDHDFKYATVVHCDTPSGVLNDLSSICPLLKKYGILTVVDSVAAMGGEELQVDKWQIDIALGGSQKVISAPPGLTIASISTEAYQAMTERKSPIASFYCNLLTFKDYYEKKWFPYTMPISDIYGLDQAIDNLLADQEILKRHAMIGHATRQAIENSPLELYLQNGYSNTVSVIKVPEGLNDQEILRKMRENYRVMITGSFDHLAGKVLRIGHMGENARPNKVAYSLYALQKVLEDFGIAFKNNLQEDFLEALN

SEQ ID NO: 89935 - protein, 320 aa, Bacillus subtilis subsp. subtilis str. 168
MRSHSVVCIGELLIDFFCTDVDVDLMEGRQFLKSAGGAPANVSAAIAKLGGDAAFSGKVGKDPFGYFLKRTLDAVHVDTSMLVMDEKAPTTLAFVSLKQNGERDFVFNRGADALFTLEDIDQEKLNEAKILHFGSATALLSDPFCSAYLRLMSIAKDNGQFISFDPNYREDLWRGRVSEFVSVAKKAIAVSDFVKVSDEELEIISGVKDHEKGVAILHEIGANIVAVTLGKSGTLLSNGKDREIIPSIPVTSIDSTGAGDAFVGAALYQLANTDQIQSVDADFVKLREIVAFANKVGALVCTKIGAIDALPSLDEIGVSL

SEQ ID NO: 89936 - protein, 389 aa, Marinobacter sp. ELB17
MSDQNPIFIPGPTNIPDRLRFAMNVQSSDHRSPGFVETLSPLLQDCKKVFNTQSGEVILFPASGTGGWEAAICNTLSPGDKVLIARYGMFSRRWIEMCQRHGLDVQIIECPWGSGAPANEFKRALSADTQHKIKAVLVVHNETATGVTSDIDAVRQAMDSCFHPALLLVDCVSSLASMPFEMDNWGVDIAVSGSQKGFMLITGMAILAVSQKALVAMETAKLSCAFFDFRAMMTANAQGGFPYTPPLQLIYGLKESLKMLFEEGLDNVYARHFRLAEGVRQAAHAWGMALCAQSPDLYSNTVTAIYVPEGLNSNELTDHTFAKYGVSFGIGLGEMHGKAFRIGHLGSLTDSMVLSGLATIEMAMADLDYPIELGTGVRAAQNHFRATIA

SEQ ID NO: 89937 - protein, 362 aa, Bradyrhizobium sp. BTAi1
MKAAVLMEVNKPLVIEDISVPKPGPREVLIRTAVAGLCHSDLHFIEGLYPHPLPAVLGHESAGIVEQVGSDVTYVKPGDHVVTCLSVFCGTCDNCTTGRPVLCTDTTVKMPPGASNRLSWGRSEKLHQFLNLSSFAEQMLVHENAIVKIRPDMPLDLAALIGCGVITGYGAVVNTARVTAGETVAVIGCGGVGMAAINGAEIAGAGRIIAIDTNPAKLQLATKLGATDIINPADGDVVAQVRELTKGGVHHAFEVLGRKETAEQAFAMLAPGGTATIVGMIPFGQKIELHGFDFLRERRIQGSSMGSNHFRVDMPRLVEFYLRGRLHLEDWISAKLKLSEINEGFANMKAGKTLRSVIVFDA

SEQ ID NO: 89938 - protein, 283 aa, Oryza sativa Japonica Group
MEPDTDKLQSLQINPNKETNLVAVFKNDYVDDEDDEDMDPQVTLGFIEEPEGPEDWHLLLPQHFPNKAGGVPAWLDPVNLPSGKSRCCDFCGEPLRFVLQVYAPIQCKETAYHRTLFVFMCPSMACLLLDQHEQGKDRAGSQTWFCCWCGTWKGEKVCSRCRKSSYCSKKHQELHWRAKHKNECHQISGSHNASAIMPDAGKVFAGNIWPEYMVVDETEKVSCFASCENRSELLMEQGQSEEDDMTASLMDQFEVDDDNRCWASFLERISREQDQVLSEMCHQ

SEQ ID NO: 89939 - protein, 218 aa, Populus trichocarpa
MAFHSLDFETSIEFTWAPLLVELKKEAGNKRILHLDLIEENARYWRNVDVLVFDSAHWWTHSDQWSSWDYYMEKQTLFQSMNPMVAYQKGLTTWARWIDLNLDPRKTRVIFRSISPRHNRENGWKCYNQRQPLAFSSHQHVPESFVVLKEVLRKMSFPVYLQDITAMSALRRDGHPSVYRRAISQQARQHPSGFSSDCSHWCLPGVPDIWNEMLSALL

SEQ ID NO: 89940 - protein, 158 aa, Populus trichocarpa
METAICGRIALSPNHVFNPKPGDKNSVCRGPCANRGILMAISTTCSGKGGGLLEKPVIERTTPGRESEFDLRKSKKMAPPYRVMLHNDNYNKREYVVQVLMKVIPGMTLDNAVNIMQEAHYNGLSVVIICAQADAEEHCMQLRGNGLLSSIEPASGGC

SEQ ID NO: 89941 - protein, 589 aa, Phaseolus vulgaris
MSSISLKENGGEVSVKKDYSNGGGVRDLYGEDSATEDHLITPWTFSVASGCSLLRDPRYNKGLAFTEGERDAHYLRGLLPPSVFNQELQEKRLMHNLRQYEVPLHRYMALMDLQERNERLFYKLLIDNVAELLPVVYTPTVGEACQKYGSIFRRPQGLYISLKEKGKILEVLKNWPEKSIQVIVVTDGERILGLGDLGCQGMGIPVGKLSLYTALGGVRPSSCLPVTIDVGTNNEKLLNDEFYIGLRQRRATGQEYATFLDEFMRAVKQNYGEKVLVQFEDFANHNAFDLLEKYSSSHLVFNDDIQGTASVVLAGLLASLKLVGGTLADHTFLFLGAGEAGTGIAELIAVEVSKQTKAPVEETRKKIWLVDSKGLIVSSRLESLQQFKKPWAHEHEPVKGLLEAVKAIKPTVLIGSSGAGKTFTKEVVETMASLNEKPLILALSNPTSQSECTAEEAYTWSKGRAIFASGSPFDPVEYEGKLFVPGQANNAYIFPGFGLGLIMSGAIRVRDEMLLAASEALAAQVSEENYDKGLIYPPFTNIRKISANIAAKVAAKAYDLGLASHLKRPKDLVKYAESCMYSPGYRSYR

SEQ ID NO: 89942 - protein, 441 aa, Rhodopseudomonas palustris CGA009
MKALAEQIGDIDSVNTYGRVVGVRGLMVEIAGPIHAMSVGARIVVETGANREIPCEVIGFTGNNAIVMPFAGLEGVRRGCRAIIANSAAQVRPSPHWLGRVVNALGEPIDGKGPLVQGPSPMQFRNQPPPAHSRKRVGMPLDLGVRALNTFLTCCRGQRMGIFAGSGVGKSVLLSMLARNVDAAVSVIGLIGERGREVQEFLQDDLGEEGLARSVVVVATSDEPALMRRQAAYLTLAIAEYFRDNDKDVLCLMDSVTRFAMAQREIGLSAGEPPTAKGYTPTVFTELPKLLERAGPGLGEGTITGIFTVLVDGDDHNEPVADAVRGILDGHIVMQRSIAERGRYPAINVLKSVSRTMPKSADPVYLPMIKRARQIMATYADMEELIRLGAYRPGSSAEVDEAVRLHEPLEDFLRQGKDEATSLQSGYVQLEQILSNSETER

SEQ ID NO: 89943 - protein, 385 aa, Oenococcus oeni PSU-1
MALNNTELDEILAIHSKNVGVLDVKADMDVESRQDLGKAYTPGVAALSKIIERNPGLKDKYTISGKLVAVVTDGSAVLGLGNIGTAAGLPIVEGKSLLYKDLANVNAIPVAIDQVPVDEFVQTVKNFSNTFAGIHLEDIAAPRCFEIEEKLKQTLDIPVYHDDQEGTAIVVLAGLINAAKVVGKNLKDLRIVINGIGAAGVATARLLFSIGIKKLTLVDIHGVVKADDSDYNKYQRKLAKDINLNISGQTLDNVIDQQDVFIGLSDGDVLSADQVKRMSSKPIVFALANPLPEINPEIAQTAGAQVIATGSAQYLNQVNNVLVFPGLYKGLLTYGIKQVDYKIEEVVAKALASMVENPTSDKIVPGVFEAGVVVTVANALKTFAG

SEQ ID NO: 89944 - protein, 201 aa, Physcomitrella patens subsp. patens
MTAQSAEDLATVLEQQKIHSDEPTIEDAKDDDDDEDDDDDEFDALDGDDAAGGKSKQSRGEKKSRKAMQKLGMKPVTEVTRVTIKKSKNILFVISKPDVFKSPASDTYVIFGEAKIEDLSSQLQSQAAEQFKVPEAANFEAKSAPSAAAEADDEGDFDETGVEPKDIELVMTQAGVSRAKAVKALKSTDGDIVSAIMNLTG

SEQ ID NO: 89945 - protein, 196 aa, Candida albicans SC5314
MAPVVQQPAPSFKKTAVVDGVFEEVTLEQYKGKWVLLAFIPLAFTFVCPSEIIAYSEAVKKFAEKDAQVLFASTDSEYTWLAWTNVARKDGGIGKVDFPVLADTNHSLSRDYGVLIEEEGVALRGIFLIDPKGVLRQITINDLPVGRSVEESLRLLEAFQFTEKYGEVCPANWHPGDETIKPSPEASKEYFNKVNK

SEQ ID NO: 89946 - protein, 363 aa, Buchnera aphidicola str. Bp (Baizongia pistaciae)
MGFKCGFVGLPNVGKSTLFNYLTKLNIPADNYPFCTIKSNVGIVPVLDNRLNKIAQVVCSNKIIPATIELVDIAGLVKGAYKGEGLGNQFLDHIRDTNVIMHIVRCFENRYVTHIYGSVDPVRDVQIINLELILSDIEVCKNRMCKLEINKLSHNKQVNKELLILKKCVYHLEKSKSLRSLNLTEEEIFVINYLRLITLKPVVYIFNISIDQSRNLYKREIFDIIKNEHNAKTVNVCLDLMQSSKNDVSAYDHLSLKYKQLFNKMLKNVIWAGFNALNLITFFTAGKKEVHAWTTTNNLFIFQSVKCIHTDLSKGFIRAQVISYDDFIKYKGEKRSKELGKIRIEGKRYVICDGDIIHVLYNV

SEQ ID NO: 89947 - protein, 161 aa, Salinibacter ruber
EKRQENWVDRLVSVNRVSKVVKGGRRFSFNTVVVVGNEDGLVGTGLGKANEVSSAISKGADDAKKNVIRVPMRDGTIPHKVVGKQDAGKVLLKPASPGTGVIAGGGVRAVLECAGYRNVLTKSLGTSNPHNQVKATINALAETEDALEVARRRDIPLEKVS

SEQ ID NO: 89948 - protein, 224 aa, Bartonella henselae str. Houston-1
MPRSHLIAPSLLASNFSKLGQEVFDVIDAGADWIHLDIMDGHFVPNITFGPDVVKALRPLTKAIFDVHLMIAPADPYLEAFAKAGADIITIHAEAGLHLHRSLQKIKEIGKKAGIAINPSTPEHVLEYLLDQLDLILVMTVNPGFGGQNFIPEIKDKIKRIKSMIANRPIDLEVDGGITVDTIGITAKAGANVFVAGSAIYKDGNKELYKTRINALRQAATLSQ

SEQ ID NO: 89949 - protein, 251 aa, Solanum lycopersicum
EGKVAIITGAASGIGEASARLFVEHGARVVVADIQDELGQKVVDSIGSDKASYRHCDVTDEKQVEETVAYAVEKYGTLDIMFSNVGTLNFCSVLDMDVLAFDETMAINVRIALAVKHAAKVMVDKKIRGSIICNASLEGILAGAASLAYIASKHAVVGIIKAAARELGPHGIRVNGVSPYGIATPLVTKAYGLDAALLEEAIYGNGHLKGVKLSTMHVAQSALFLASDESAYTSGQNLAVDGGLSSILKLQ

SEQ ID NO: 89950 - protein, 816 aa, Buchnera aphidicola str. Bp (Baizongia pistaciae)
MKILKFGGTSLSNSELFFHVATIIENNLNNEQIAIVLSAPGNTTNLLEIAINQTINNKNIIPIVQKIEKNFLKLINDIYQVEQKLLYEKIKNNIENKLLELKNLLQGINLLRQCPDKIRAKIISSGEYLSISIMNSILISRGYNTTIIDPVKKLLTKEDTYLNATVNIKISKFRILSMKIPKHHIILMPGFTAGNKQGELVTLGRNGSDYSATILSVCLNSTMCEIWTDVNGVYTCDPKLVSDAKLLTSLSYREAIELSYLGAKILHPNTIYPIQKFKIPCTIKNTHNPSSIGTKISCNHVKNKNLITGVTYLENVHMFSISCLYSKNIETIIPKIFSCMSLSKIWIILTIQTSSQNTISFCILKTMTNTALHVLHKALYLELKHKLLKPIKVEKKLTLISVISSDILNNTKITEKVFSILKHVNINTLAISKGASKNSISIVVKHDDGILGVRALHKGIFNKNCTAEIFLIGIGRVGQTFLKQIIEQKNWLKSKNIDLKICGIANSKNFILNLDGINPKNWKRDLNLSKKSFNFKHLLNSIQNYYLINPIIVDCTSDKNIANQYISFINCGFHIVTPNKKANTTNWKYYEDIRLAAQKEKKKFFYETNVGAGLPVIENLKNLLRTGDTLIHFKGILSGSLSFIFGKLEDNISLSEATKQAQSLGFTEPNPKDDLSGIDVARKLLILAREVGYKLELKDIKIEPLLPKEFNNISNTTDFITKLKELDQIFCNRVKKARKLGKRLRFVGIINQKGNCQVKIDEVDHNDPLYNIKNGENALAFYSKYYQPIPLVLRGYGAGNNVTASGIFSDVLRILL

SEQ ID NO: 89951 - protein, 207 aa, Ureaplasma parvum serovar 3 str. ATCC 700970
MNTKSPILILIAGASGSGKTTFANEIIARIPKNTTSVVICQDSYYISNSQLNKKERRLINYDHPSSFEWELMREQLSDIKKRKKIKVPIYDYKTEIRLDKTIDISDVDVIVLEGIYAIYDDVINQIADLKIFIETPKDECLIRRILRDVNERNRSFESVITQWRSTVSPMYDQFVEPSKKNANVSVLWNEHNRVALHLIHKWINNIH

SEQ ID NO: 89952 - protein, 522 aa, Haloarcula marismortui ATCC 43049
MDGGTYWWGTRTVPIMSTDDSRRHYIDGEWTTGTGDETFTSQNPATGEALASFHRGTEDDVDHALAAAEDAYDEWRSLSHIDRAEYLWDIYHELRDRHEELGEIVTMECGKEISEGLADVTESWHMVEWAAGNARHPHGDVVPSEIASKDAYMRRKPKGVVGCITPWNFPVAIPFWHLAVTLVEGNTVVWKPAEQTPWCAHIIAEMFEDSGIPDGVFNLVQGYGDAGNAIVEDDRVETVLFTGSAEVGHKIASKVGGEPGKIAACEMGGKNAVVVTDEADLDVAVHSAVMSSFKTTGQRCVSSERLIVHEDLYDEFKERFVDIAEDIAVGDPLEEDTFMGPLIEEDQVEKFKRYNDLAREEGANVLVDRADLGAEEIPDGHEEGHWVGPFVYEVDYDEDLRCINEEVFGPHVALLEYSGDFDEALEMHNSVDYGLAGAIISEDYRQINQFRDEAEIGLAYGNLPCIGAEVHLPFGGVKKSGNGLPSGREVIEAVTERTAWTLNNSKDIEMAQGLSADIITDE

SEQ ID NO: 89953 - protein, 517 aa, Methanosarcina barkeri str. Fusaro
MLHMTQAKKPLMLIILDGWGYREAREGNAILAARTPNLDHLIEEYPWCFLEASGEAVGLPEGQMGNSEVGHLNIGAGRIVYQDLTRINFSIRKGDFFKNPAFLGAISNAKANDSSLHLMGLVSYGGVHSYMAHIHALIKLAQQEGVKKVYIHAFLDGRDVPPKAALKDIEELDAFCKENGNAKIATISGRYYAMDRDKRWDRTKLAYDALTMGVAPYKTPDAETAVSEAYKRGETDEFVKPTVITDSEGKPEAVIKDNDSIIFFNFRPDRARQLTWAFVNKDFENFPREKHPKVYYVCMAQYDETLDLPIAFPPEELENVLGEVLSKQGLAQLRIAETEKYAHVTFFLNGGQEKCYEGEDRCLIPSPKIATYDLKPEMSAYEVTEEVIGRIRSGKYDVIVLNFANMDMVGHTGIFEAAVKAVEAVDSCVGKIATVLKEVGGVAIITADHGNAEQMENPTTEEPHTAHTSNPVKCIYFGNDEVKGLKNGKLCDLAPTLLELLKIRKPEEMTGESLIIK

SEQ ID NO: 89954 - protein, 218 aa, Oryza sativa Japonica Group
MADSAAAAAGPHHHHRLPSSSSASPPPPQPDPGGKRQRRPSVRLSGSIPLPSHLPHPRRIPITPASRSRKPLHLQPHHPKPEHEEDDNDHNPSNPASADADADDLVLAAAFPRKPRSLEAVQGESVAAAAAAAEEEEAAAEGEVVDVVEWLWGIGMGRYAAAFEAHEVDGEVLPCLTMDDLRDMGIGAVGARRKLYCAIQRLPPPPALPPPPPPPPRR

SEQ ID NO: 89955 - protein, 279 aa, Zea mays
  misc_feature (31)..(31): Xaa can be any naturally occurring amino acid
  misc_feature (172)..(172): Xaa can be any naturally occurring amino acid
  misc_feature (210)..(210): Xaa can be any naturally occurring amino acid
MSMFYTAGLTFLTRWRNRMIKSRAAVAFEAXRNPLEIVEVDVAMPKAGEVLLRVVASGVCHTDAYTLSGADPEGIFPSILGHEGGAVVEAIGEGVTSVAVGDHVIPLYTPECGKCKFCLSGKTNLCQAIRATQGKGLMPDGTSRFSYKGQPIFHYMGTSTFSEYTVLPEISXVAKIPKEAPLEKVCLLGCGVTTGIGAVINTAKVKPGDXVAIFGLGGIGLSAVIGAVKAKAGRIIAIDINPAKFEIAKQLGATDCINPKDYDRPIQDVIVDLTDGGKG

SEQ ID NO: 89956 - protein, 172 aa, Zea mays
  misc_feature (21)..(21): Xaa can be any naturally occurring amino acid
  misc_feature (35)..(35): Xaa can be any naturally occurring amino acid
  misc_feature (56)..(56): Xaa can be any naturally occurring amino acid
  misc_feature (102)..(102): Xaa can be any naturally occurring amino acid
  misc_feature (112)..(112): Xaa can be any naturally occurring amino acid
MNLSIPNPSTGRQKKLEINEXPKLRGFYDLKISHXHTGDALGEECKGNAFKSMAVXHKSGSPMKLGILTSGRARLLLHRGAPCFRRYVMRNGERKMKNCPRXCIVEHNDLSXTIHMLIDRKGENDLSGLADTENPMMRRPKRTSMIRKLVDLAYDDNVHEYENAYRRDLHYR

SEQ ID NO: 89957 - protein, 199 aa, Glycine max
MAEEEKPNGEEQVKDNNNNNLYDAVQRLILEPSKIKASLIPLFPEASRTYSRQLLHWSRQGSPLRRILFISIGIVALVALSGLVAFTLFFLAATVNAIFVSLLISLAVAGGFLVLFFAFVTAIYIGALSLAIFAISTVTFWAVVAIIITAGWVGFLYTVWLVTSKSLGLAKQSLSVTGSAITTYSAAWGTRNLADKNSI

SEQ ID NO: 89958 - protein, 469 aa, Bacillus subtilis subsp. subtilis str. 168
MNQSQSGLKKELKTRHMTMISIAGVIGAGLFVGSGPVIHSTGPGAVVSYALAGLLVIFIMRMLGEMSAVNPTSGSFSQYAHDAIGPWAGFTIGWLYWFFWVIVIAIEAIAGAGIIQYWFHDIPLWLTSLILTIVLTLTNVYSVKSFGEFEYWFSLIKVVTIIAFLIVGFAFIFGFAPGSEPVGFSNLTGKGGFFPEGISSVLLGIVVVIFSFMGTEIVAIAAGETSNPIESVTKATRSVVWRIIVFYVGSIAIVVALLPWNSANILESPFVAVLEHIGVPAAAQIMNFIVLTAVLSCLNSGLYTTSRMLYSLAERNEAPRRFMKLSKKGVPVQAIVAGTFFSYIAVVMNYFSPDTVFLFLVNSSGAIALLVYLVIAVSQLKMRKKLEKTNPEALKIKMWLFPFLTYLTIIAICGILVSMAFIDSMRDELLLTGVITGIVLISYLVFRKRKVSEKAAANPVTQQQPDILP

SEQ ID NO: 89959 - protein, 104 aa, Xanthomonas oryzae pv. oryzae KACC10331
MLVMDGPRLVGIVSERHYARKVVLRDRSSSTTSVAEIMSAEVVTVSPSDTVERCMQLMTDGRFRHLPVVENGRVQGVISIGDLVKAVIEAQQQDIDQLQRYIAS

SEQ ID NO: 89960 - protein, 490 aa, Oryza sativa
MAVIALKCPDVEVVVVDISAARIDAWNSDALPIYEPGLDDVVRRCRGRNLFFSSDVERHVGEADIVFVSVNTPTKARGLGAGKAADLTYWESAARMIAAVATSDKVVVEKSTVPVKTAEAIEKILDHNGRDGVGFQILSNPEFLAEGTAIRDLLAPDRVLIGGRETAAGRAAVQALKDVYTRWVPEERILTTNLWSAELSKLAANAFLAQRISSVNAMSALCEATGADVAEVAYAVGKDSRIGAKFLNASVGFGGSCFQKDILNLVYICECNGLPEVANYWKQVIKGFKSPAIATTMSKDIYSLTPFQVIKINDYQKSRFVNRVVSSMFNTVAGKKIAVLGFAFKKDTEDTRETPAIDVCKGLIGDKAKVSIYDPQVTEDQVQRDLAMSKFDWDHPVHLQPMSPTAIKQVSVAWDAYESARPAHGVCILTEWDEFRSLDYARIYGGMQKPAFVFDGRNVVDAEKLREIGFIVYSIGKPLDAWLKDMPAVA

SEQ ID NO: 89961 - protein, 252 aa, Pyrus communis
MPIRNIAVGRPEETYHPDALRAALAEFISTLIFVFAGEGSGMAFAKLTDDAANTPAGLVAAALAHAFGLFVAVSISANISGGHVNPAVTFGAFIGGNISLLRGILYWIAQLLGATVACGLLKFVTNGQTTAAFSLSSGVGVWNAFVFEIVMTFGLVYTVYATAIDPKNGSVGTIAPIAIGFIVGANILAGGAFDGASMNPAVSFGPALVSWSWENHWVYWAGPLIGAGLAGLIYEFVFIGNSGHEQLPSTDY

SEQ ID NO: 89962 - protein, 328 aa, Sinorhizobium meliloti
MGAPRILVTGGAGYIGSHTAKLLRLEGIEPIVYDNLTTGNRSAVRWGPFVLGDILDGNHLVEVLEYHRPDAVIHFAASAYVGESVADPAKYYNNNVRGTLSLLDACRRTGVDKVIFSSSCATYGVPAVLPIHETTPQDPINPYGKTKLMAEHMLADYAAAFKLNYVALRYFNACGADPEGDLGEWHDPETHLIPQALMAAAGTISHLEIFGEDYDTPDGTCVRDYIHVSDLASAHVLAYRHLAKGGENLAINVGTGRGFSIREVLRAIVEVTGRDVPVVFRRRRFGDPPTLYADGGLACRTLGFLPRYSDLETIVRTAAPIFGLEARS

SEQ ID NO: 89963 - protein, 120 aa, Glycine max
  misc_feature (20)..(20): Xaa can be any naturally occurring amino acid
  misc_feature (33)..(33): Xaa can be any naturally occurring amino acid
PAFSIPNGWRGLDIGPDFVXSFREALGSSPTLXWKGPMGGFGFSKFSFGPRVFSKKLVSLSGKGGAPIIGGGDFFPPLEKVGVFSVFSPIFPGGGARLGFLEGKKLPGVLVFYEPVPVPG

SEQ ID NO: 89964 - protein, 388 aa, Streptococcus pyogenes MGAS315
MKNQLGQLALEQAKTFGGKLEVQPKVDITNKHDLSIAYTPGVAGVSSAIAKDKTLAYDLTTKKNTVAVISDGTAVLGLGDIGPEAAMPVMEGKAALFKAFAGVDAIPIVLDTKDTEEIISIVKALAPTFGGINLEDISAPRCFEIEQRLIKECHIPVFHDDQHGTAIVVLAAIFNSLKLLQKSLDEVSIVVNGGGSAGLSITRKLLAAGATKVTVVDKFGIINEQEADQLAPHHLDIAKVTNREFKSGTLEDALEGADIFIGVSAPGVLKAEWISKMAARPVIFAMANPIPEIYPDEALEAGAYIVGTGRSDFPNQINNVLAFPGIFRGALDARAKTITVEMQIAAAKGIASLVPGDALSTTNIIPDAFKEGVAEIVAKSVRSVVLKS

SEQ ID NO: 89965 - protein, 290 aa, Streptococcus pyogenes M49 591
MDKLARIDEAIRRYYKTTSNGVSEELIDAILYSVDSGGKRIRPLILLEMIEGFGVSLQNAHFDLAAALEMIHTGSLIHDDLPAMDNDDYRRGRLTNHKQFGEATAILAGDSLFLDPFGLIAQAELNSEVKVALIQELSLASGTFGMVGGQMLDMKGENQALSLPQLSLIHLNKTGKLLTFPFKAAALVTEQAITVRQQLEQAGMLIGHAFQIRDDILDVTASFEDLGKTPKKDLFAEKATYPSLLGLEASCQLLTESLDQALKIFQTLESDVGFKPQIITKLIEGLRLNA

SEQ ID NO: 89966 - protein, 349 aa, Streptococcus pyogenes MGAS315
MKAATYLSTGNLQLIDKPKPVIIKPTDAIVQLVKTTICGTDLHILGGDVPACKEGTILGHEGIGIVKEVGDAVTNFKIGDKVIISCVTSCHTCYYCKRGLSSHCEDGGWILGHLINGTQAEYVHIPHADGSLYHAPDTIDDEALVMLSDILPTSYEIGVLPSHVKPGDNVCIVGAGPVGLAALLTVQFFSPANIIMVDLSQNRLEAAKTFGATHTICSGSSEEVKTIIDDITNGRGVDISMECVGYPATFDICQKIISVGGHIANVGVHGKPVDFNLDELWIKNITLNTGLVNANTTEMLLNVLKTGKIDATRLITHHFKLSEVEKAYETFKHAGANNALKVIIDNDIS

SEQ ID NO: 89967 - protein, 217 aa, Oryza sativa
MASSSDPWVREYSEASRLADDVTSMIADRGSLPQSGPEIMRHTSAIRRKITILGTRLDSLEALLSRIPPKSITDKELHKRQDMLSNLKSRAKQMATSFNMSNFANREDLLGQSKKAADDMSRVAGLDNQGIVSLQRQVMKEQDEGLEKLEETVLSTKHIALAVNEELTLHTRLIDDLDDHVDVTNSRLQRVQKRLAILNKRVKVFQRCGCSHLISVS

SEQ ID NO: 89968 - protein, 502 aa, Glycine max
MFSSRGNMAMASPSSIFSVYASMTASIMLLRSVTNDLIPQPFRGYLTNAFRYFFKARCKVLTLTIEEYCSGIARNHVYDAAEVYLSTKITPENERLNISKSPKEKKLTIRLEKGEELVDWFNGIKLNWKLICSESEKSNSSNDHSRNNPTRTEKKYFELSFEKKHKEMVLGSYLPFILEKDKEMKDEERVLKMHTLNTSYGYGGFKWDSINLDHPSTFETLALEAEQKSAIMEDLNRFVRRREYYRKVGRAWKRGYLLYGPPGTGKSSLIAAMANYLKFDIYDLQLDNLVTDSDLRKLLLATANRSILVIEDIDCSVDLPGRRHGDGRKQPDVQLSLCGLLNFIDGLWSSCGDERIIILTTNHKERLDPALLRPGRMDMHIHMSYCSYHGFKVLASNYLDIAPDHRLVGEIEGLIEDMQITPAQVAEELMKSEDADTALEGFLKLLKRKKMEGDVCENDGSDKTELHQSKRSKVGCKQKRPVCISKRKNGVGTQRRTRGRPL

SEQ ID NO: 89969 - protein, 416 aa, Buchnera aphidicola str. Bp (Baizongia pistaciae)
MDKQVVMPDIGTDLVEVIEILVKIGDQVKKDDSLITVEGQKASIEIPASHTGTIKNIIVHIGEKITTGSLIAILNGIDDNVKSKNDSSSYSFKNSKNTSTNSNLGNVNNNINNRTILVHATPTVRRLARKFDIKLENITGTGRKGRILKEDVISYKNISLFNDIKKSLKKTNVNYYKDNVTCDDFKSIELTRTQIRSSKNLLKSWLTIPHVTQFDESDITELENFRQKYNSDLKDKSKKLTILIFVIKAVSKALEMFPKFNGRLINKDNRIAIVLNEHINIGIVVDTDDGLLVPVINRVNKKNISSISNDLRIISERARSRKLNFSDIKEYGSFTISNLGGIGGTNFTPIIKYPELAILGISRALIKPYWNSHAFIPKLMLPLSLSYDHRAIDGVAAVRFITFVKKMLTDIRFLMI

SEQ ID NO: 89970 - protein, 475 aa, Buchnera aphidicola str. Bp (Baizongia pistaciae)
MISKKVDTQVVIIGSGPSGYSAAFRCSDLGLNVVLIEQYYSLGGVCLNVGCIPSKYLLHIAKVIKDVKKLSRIGISFEKLDINLKEIQCNQKKIIESFSSGISNLARKRNVRIIFGYAKFLDANSIFVQGEHDSYVVSFNKIVIATGSLSKKLSYIPYDDIRIWNSSFAVSIPSIPKKLLIIGGGIIGLEMATIYSALGSNVDIIDNSHDILPHLDRDVIDIFKRSVNHDYNIFFNSNVIKIVQEKNGLLVHIAENDNKNKRFELYDIILVAIGRVPNTDMLDISKVGLKTDNNGFIKVNEQFCTNIPNIYAIGDVIGQPMLAHKGTHEGHIVAEVISGKKHYFNPFVIPCVSYTEPEIAWVGITENEARKNNINYEVSSVLWNTLGRAVSSQCSEGVTKLIFDKKTNKIIGGCIVGSNAGELLGEISLAIEMGCDAEDLALTIHAHPTLYESINLSAQIFQGTITDLINKKIKK

SEQ ID NO: 89971 - protein, 71 aa, Oryza sativa
  misc_feature (13)..(13): Xaa can be any naturally occurring amino acid
  misc_feature (36)..(36): Xaa can be any naturally occurring amino acid
  misc_feature (41)..(41): Xaa can be any naturally occurring amino acid
  misc_feature (57)..(57): Xaa can be any naturally occurring amino acid
ASLHSLVRRLPAXMSQMKFQDDFLMEYNDTLLMTYXAMFTXVQAQMNELVEKFNATXERSTARRGGRGAFM

SEQ ID NO: 89972 - protein, 288 aa, Shewanella oneidensis MR-1
MTIEACIGQTPLVRLQRLDCGSSTVLLKLEGNNPAGSVKDRAALNMINQAELRQEIAPGDTLIEATSGNTGIALAMAAAIKGYKMILIMPSNSTQERKDAMQAYGAELLLVDNMEAARDLALALQAEGKGKVLDQFNNQDNANAHFLTTGPEIWQQSQGKITHFVSSMGTTGTIMGVSKYLKSRNPDITIVGLQPADGSSIPGIRRWPQEYLPGIFDAARVDLMMDIEEQDAKAMARALAREEGICAGVSSGGAVYAALELARQYPGSVVVAIVCDRGDRYLSSGLFS

SEQ ID NO: 89973 - protein, 431 aa, Glycine max
  misc_feature (146)..(146): Xaa can be any naturally occurring amino acid
MQNHRLKQQQQQQQQQQALMQQALLQQQSLYHPGLLAPPQIEPYPSGNLPPGFDPSTCRSVYVGNIHTQVTEPLLQEVFAGTGPVEACKLIRKDKSSYGFIHYFDRRSAALAILSLNGRHLFGQPIKVNWAYASGQREDTSAFFFXFAGHYNIFVGDLSPEVTDATLFACFSVYPSCSDARVMWDQKTGRSRGFGFVSFRNQQDAQSSINDLTGKWLGSRQIRCNWATKGAGGNEEKQNSDAKSVVELTNGSSEDGKETSNSDAPENNPQYTTVYVGNLAPEVTQLDLHRHFHALGAGVMEEVRVQRDKGFGFVRYSTHAEAALAIQMGNAQSLLCGKPIKCSWGSKPTPPGTASNPLPPPAAASLPGLSATDLLAYERQLAISKMGGVHALMHPQGQHHLKQAAAIGASQAIYDGGFQNVAAAQQMMYYQ

SEQ ID NO: 89974 - protein, 464 aa, Mycosphaerella graminicola
MAKLYQNVDSAQLQRDADDCLLTYGTDFHPEIITNAEGQSITTASGHRMLDWTSGQMSTLIGHANPEIVETIHAHARNLDHLFSGMLSPPVISLAKRLTSVTPPGLDKALFLSTGGESNEAAIRLAKFYTGKFEIVGLASSWHGVTSGAIAAQYHAGRAGYGPNMPGNIALPTPNSYRSIFRHPDGSHDWKTELEYGFDLVDKQSCGSLAALILEPILSSGGMLVLPPGYLKAVKQHCERRGMLLIIDEAQTGIGRAGDMFAFQHFAEDDGVVPDILTLSKTLGNGLPLSAVVTSNKIASFAKENNFLFYTTHINDPLPAAVGDKVLEIVIRDHLVERSREMGKVFQERLRALQSRYGCIGDVRGRGLMAGVEIVADRVTKEGDIDLGAAIGKRMTENGLWAQLSTMASFGGVFRLAPPLTTTDEELMAGLDIIEEAFASTPGTKPLYERDVAAAYDSQVDARL

SEQ ID NO: 89975 - protein, 376 aa, Zea mays
NSARGNILNNAGVTLIEGRGKIVDPHTVSVNGKLYTAKHILVSVGGRPSMPDIPGIEHVIDSDAALDLPSKPEKIAIVGGGYIALEFAGIFNGLKSEVHVFIRQKKVLRGFDEEVRDFVAEQMSLRGITFHTEQSPQAITKSNDGLLSLKTNKENFGGFSHVMFATGRRPNSKNLGLEAVGVEMDKNGAIVVDEYSRTSVDSIWAVGDVTNRVNLTPVALMEGGAFAKTVFGNEPTKPDYRAIPSAVFSQPPIGQVGLTEEQAIEEYGDVDVFVANFRPLKATLSGLPDRVLMKILVCATSNKVVGVHMCGDDAPEIIQGIAIAVKAGLTKQDFDATIGIHPTSAEEFVTMRSPTRKIRKSSTDQVESKDEVVSKQ

SEQ ID NO: 89976 - protein, 298 aa, Fusobacterium nucleatum subsp. nucleatum ATCC 25586
MEAYMEKIYGVIDVTSGYANGKTKNPKYQDLHSSGHAETVHVKYDASKVNLSTLLKYYFKIIDPTSVNKQGNDRGSQYRTGIYYVNQNDKSVIQDEIKEQQKKYSQKIVVEVLPLKEYYLAEEYHQDYLKKNPNGYCHIDLSKADDIIVDEKKYPKLSEKELRMKLNSKQYEVTQNGDTERAFQNDYWDFFDKGIYVDITTGEPLFSSTDKYASQCGWPSFVKPIVPEVVTYHNDTSFNMIRTEVRSRSGKAHLGHVFDDGPRDRGGKRYCINSAAIQFIPYAEMEAKGYGYLLPLVK

SEQ ID NO: 89977 - protein, 398 aa, Magnetospirillum magnetotacticum MS-1
MNIHEYQGKQVLAKYGVAVLKGGVAYTPDEAVQVAKDLGGPIYVVKSQIHAGGRGAGRFKNDPNGKGGVRVVKSIDEVRANVDQMLGQVLITKQTGPAGKEVKRVYIEQGCDIKRELYLSMLVDRATCRVTIVASTEGGMEIEEVAHNHPEKILKVAIDPVEGFQQYHGRKIAFSLGLEGKQVNTCVKFVGALYKAFMDLDCSIVEINPLVVTGAGELIALDAKVNFDDNALFRHKDIEELRDESEEDPAELEAARHSLNYIKLDGQIGCMVNGAGLAMATMDIIKLYGSEPANFLDVGGGATKERVTTAFKLILSDPNVEGILVNIFGGIMRCDVIAEGVVAAAREVSLNVPLVVRLEGTNVELGKKIMAQSGLPIIAADNLADAAEKVVKAVKEAA

SEQ ID NO: 89978 - protein, 403 aa, Vitis vinifera
MYKNQLQELAQRSCFNLPSYTCIREGPDHAPRFKATVNFNGEIFESPNYCTTLRQAEHSAAEVALNSLSNRGPSHSLAARILDETGVYKNLLQEIAQRVGAPLPQYTTFRSGLGHLPVFTGTVELAGITFTGEPAKNKKQAEKNAAMAAWSSLKQLAKEAASSSSETENNDELEQITIARALLNYRLKEKMAIANSPSGTLSFPKKFPIQNSRLFSPQLPPVATSKILPLICQKTPPRNRPPSPTANDDPRQQHQVKNPVPPSQPLALDVRAVRPQRFPAAGAVPYVPIRQFRTPYHGIAPPVTIRNAVPVFSAPPSGLPPQVIRAPHMRIAPPVCVRQAVPVFAAPPVRKEDPLVVRKEDPSAASLPSLPTKSPAHVEETGSATANDLQEFEAVKSLEQLKI

SEQ ID NO: 89979 - protein, 472 aa, Silicibacter sp. TM1040
MTLDIPFDNTYAQLAPEFYTRQAPTPVKAPRLLAFNDALATLLGIARGTDAELAQVFGGNELPEGADPLAQLYAGHQFGTYNPQLGDGRAVLLGEVVGTDGLRRDIQLKGSGPTPYSRRGDGRAWLGPVLREYVVSEAMHALGIPTTRALAAVETGETVWREGGLPGAVLTRVASSHLRVGTFQIFAARGNTEALRSLTEYAIARHYPEAKGALGLLRAVRDAQVELVSAWMSVGFIHGVMNTDNSSIAGETIDYGPCAFMDVYHPNRVFSSIDRTGRYAYGNQPQIAVWNLAQLATALIQLEDDPESVLEEATEIVHAMPELLEDAWLRRFRAKIGLREVAEGDLELVSDLLGIMAQGQADFTNTFRGLLDGTARDQFLEPEAFDVWESRWKDRLSREADPEALMARSNPVLIPRNHRIEQMIAAAVGGDYASFERLMDALSHPFEAREDYADLRRPPAEDEVVQATFCGT

SEQ ID NO: 89980 - protein, 445 aa, Silicibacter sp. TM1040
MTEFSSMDLPKHLHTRMEAMGFNTPTPIQARAIPHALNGQDVLGLAQTGTGKTAAFGVPLVAQMLEYGRKPAAGTVRGLILAPTRELANQIAETLRGLTEGSPLKTGLVVGGVSINPQIHRLSKGTDILVATPGRLLDILDRKALDLGSCDFLVLDEADQMLDLGFIHALRKIAALLPEERQTMLFSATMPKQMNEIANAYLKSPVRIEVTPPGKPAAKVTQSVHFIAKAEKLSLLKELLSAHDGERTLVFGRTKHGMEKLMKVLDKAGFKAAAIHGNKSQGQRERALKAFKSGEITVLVATDVAARGLDIPDVKYVYNYELPNVPDAYVHRIGRTARAGKDGQAVAFCAPDEIGDLKAIQKTMGITIPVASGRAWEELPDPAAKPARGGGRGRPGGGGGGRGKGGGKPGGGRRRFGGGKSAAPSGGAGESRGAAGAGGRQRRKS

SEQ ID NO: 89981 - protein, 236 aa, Brassica napus
MAVADDGKLNIEEHPPLWGSRSVDCFEKLEQIGEGTYGQVYMAKDIKTGEIVALKKIRMDNEKEGFPITAIREIKILKKLHHENVVELKEIVTSPGRDTDDQGKPDNNKYKGGIYMVFEYMDHDLTGLADRPGLRFTIPQIKCYMRQLLTGLHYCHAHQILHRDIKGSNLLIDNEGQLKLADFGLARMYSQDHSGNLTNRVITLGYRPPELLLGGTKYGPAIDMWSVGCIFAELLY

SEQ ID NO: 89982 - protein, 438 aa, Solanum lycopersicum
MASSNCLHAILLCSLLFITSTIAQNQTSFRPKGLIIPVTKDASTLQYLTQIQQRTPLVPISLTLDLGGQFLWVDCDQGYVSSSYKPARCGSAQCSLGGASGCGECFSPPRPGCDNNTCGLLPDNTVTGTATSGELASDVVSVESSNGKNPGRSVSDKNFLFVCGATFLLQGLASGVKGMAGLGRTKISLPSQFSAEFSFPRKSALCLTSSSNSKGVVLFGDGPYFFLPNRQFSNNDFQYTPLFINPVSTASAFSSGQPSSEYFIGVKSIKINQKVVPINTTLLSIDNQGVGGTKISTVNPYTILETSLYNAITNFFVKELANVTRVAVVAPFRVCFDSRDIGSTRVGPAVPSIDLVLQNANVVWTIFGANSMVQVSENVLCLGVLDGGVNAGTSIVIGGHTIEDNLLQFDHAASRLGFTSSILFRQTTCANFNFTSIA

SEQ ID NO: 89983 - protein, 390 aa, Zea mays
MSVLTCVIESMGSSCSRSHSFDEAEAAENAKSADIDRRILQETKAEQHIHKLLLLGAGESGKSTIFKQIKLLFQTGFDEAELRSYTSVIHANVYQTIKILYEGAKELAQVEPDSSKYVLSPDNQEIGEKLSEIGARLEYPSLNKERVQDVRKLWQDPAIQETYSRGSILQVPDCAQYFMENLDKLSEEDYVPTKEDVLHARVRTNGVVETQFSPLGESKRGGEVYRLYDVGGQRNERRKWIHLFEGVNAVIFCAAISEYDQMLFEDETKNRMMETKELFDWVLKQRCFEKTSFMLFLNKFDIFERKIQKVPLSVCEWFKDYQPTAPGKQEVEHAYEFVKKKFEELYFQSSKPDRVDRVFKIYRTTALDQKLVKKTFKLIDESMRRSREGT

SEQ ID NO: 89984 - protein, 159 aa, Glycine max
MVTELINANPIIYEKKERRAPSAPSAPHDEYAVEPIDQQEVFDHIRDIKDPEHPYSLEELKVITEEAVEVDDQRNYVRVTFTPTVEHCSMATVIGLCLRVKLMRSLPSRYKVDIRVAPGSHATEAAVNKQLNDKERVAAALENPNLLNMVDDCLASSYD

SEQ ID NO: 89985 - protein, 408 aa, Physcomitrella patens subsp. patens
PIVTVGEVEKHEKQLTEEEAVTEYLESVGIDPSSFDELYLQLQLPASLDIVRERVMFLQKIGLTVEDINDYPIMLGYSVKRNFIPVLTYLESLGVTSNSLPILVRKYPQILHTSVVIDLQPHVEYLEGLGIQRADIGSVLTHYPEIFGFKIEGTISTSTAYLVMLGVNPRKMGSILTEMPQILGMRVGNNIKRKVDFLKRFGLTSSDIAKMIETRPQFLGLSLEDQMQPVLNNLVEIGVTQDTVGRVIMQFPDILGLDVKLKLAERLTWLTSEVGISADSLGEVIAKLPQILIINTTKANERVEFLRQAGFSSDVGSMVTNCPQLLAASIDKSLEPNLAYLVGKMRRKLEEVVEFPAYLLYNLEETIQPRHEEITKRSMECSLAWMLNCTDDVFQQRITLEYAEQSTQ

SEQ ID NO: 89986 - protein, 358 aa, Brassica napus
MGTYLSSPKTDKLSEDGENDKLRYGLSSMQGWRATMEDAHAAILDLDDKTSFFGVYDGHGGKVVAKFCAKYLHQQVLSNEAYGAGDIETSLQRAFFRMDDMMQGQRGWRELAVLGDKMNKFSGMIEGFIWSPRSGDANNQPDNWPLEDGPHSDFAGPTSGCTACVALIKDKKLFVANAGDSRCVISRKGQAYNLSKDHKPDLEVEKERILKAGGFIHAGRINGSLNLTRAIGDMEFKQNKFLPSEKQMVTADPDINTLDLCDDDDFLVVACDGIWDCMSSQQLVDFIHEQLKSETKLSTVCEKVVDRCLAPDTASGEGCDNMTIILVQVKKSNNNPSEPEPEEETKPQPSQDEPSSSS

SEQ ID NO: 89987 - protein, 517 aa, Blumeria graminis
MSESIGPTRTLKRKNVKGLALSAPPRIVAPSDGDSQQPGGIGGENTRQTSQLEIGIEYKLDLKREDLEVLKDLGHGNGGTVSKVRHMATGTVMARKIIHVEANKEMRRRIVRELQIMHETNSEYIVTFYGAFLSETNDVIMCMEYMDVGALDRVSRKFGPVRVDVLGKIAEATLGGLTYLYTKHHIMHRDIKPSIILINSKGQIKLCDFGVSGELVNSVADTFVGTSTYMAPERIQGQKYTVKSDVWSFGLSIMELAIGKFPFDTSEQLSDDEGAPAGILDLLQQIVYEPAPRLPKSEAFPQILEDMIQKCMAKEPQERPTPQELYEREPFVQAAKRTPVNLKEWAVGLMEKDNRKSHLGPQLSPSTQQLLRSCDSPTAMRLNSPNNALPTPTSGDIPIGGDVRSAATSPTHEDSTNHSRLSTKLSSSQSRSHSGSSSQNSRHVSNNSATLAIPDRQSNIPSGKGVVFTSTKLPIRPAPSGPLPPPPVPRKEGTESDLRNLNRRQATFGNNGYGPGF

SEQ ID NO: 89988 - protein, 326 aa, Streptococcus pyogenes MGAS315
MTERYADKQIKLFSLTSNLPIAEKIAKAAGIPLGKMSSRQFSDGEIMINIEETVRGDDIYIIQSTSFPVNDNLWELLIMIDACQRASANTVNIVLPYFGYSRQDRVAKPREPITAKLVANMLTKAGIDRVVTLDLHAVQVQGFFDIPVDNLFTVPLFAERYSKLGLSGSDVVVVSPKNSGIKRARSLAEYLDSPIAIIDYAQDDSEREQGYIIGDVSGKKAILIDDILNTGKTFAEAAKILERSGATDTYAVASHGLFAGGAAEVLETAPIKEIIVTDSVKTKNRVPENVTYLSASDLIAEAIIRIHERRPLSPLFSYQPKGKNNA

SEQ ID NO: 89989 - protein, 455 aa, Blumeria graminis
MPGQSTPRARPSPQLKLSTPKKSSHTPLELQQTHHLVDRHGISISNIQSAGGGSESSEAHSRSGSFGLLDGRGSVPVSAGSQYSALSFAQNGLRHLQGTPDPSSAVGSLYSERSEIGVGVERDGSLNELDSFARLSLERARTLDVEELDDEGWRIASTENRIQELSSLGEGAGGAVTKCILRGGKTIFALKIITTNPDPDVKKQIVRELGFNKDCANEHICRYYGAFVEPSTATISIAMEFCEGGSLDSIYREVRKLGGRTGEKVLGKIAEGVLNGLTYLHGKKIIHRDIKPSNILLCRDGQVKLCDFGVSGEFGTKGDANTFIGTSYYMAPERITGQSYTITSDVWSTGVTLLEVAQHRFPFPADGTEVQPRAGLIDLLTYIVRQPVPKLKDEPEAGIKWSDNFKYFIECCLEKTPSRRASPWRMLEHPWMIEMQSKRVHMAHFLATVWGWEEK

SEQ ID NO: 89990 - protein, 489 aa, Nicotiana glutinosa
MGFENEKNNSILSKLATNEEHGENSPYFDGWKAYDNDPFHPLKNPNGVIQMGLAENQLCFDLIEEWIKRNPNASICTTEGIKSFRAIANFQDYHGLTEFRRAIAKFMEKTRGGRVTFDPERVVMAGGATGANETIIFCLADAGDAFLVPSPYYPAFNRDLRWRTGVQLIPIPCDSSNNFQITTKAVKEVYENAQKSNIKVKGLILTNPSNPLGTTLDRDTLKNLLTFTNQHNIHLVCDEIYAATVFSTPQFVSIAEIVNDEMRHCNKDLVHIVYSLSKDMGLPGFRIGIVYSFNDTVVSCARKMSSFGLVSTQTQYLLAEMLSDEKFVSNFLTESSKRLAKRHKHFTNGLEQVGIKCLRSNAGLFCWMDLRPLLKESNFDAEMSLWRVIINDVKLNVSKGSSFDCQEPGFFRVFFANMDDETVDIALRRIRRFVSVKRTGDETTAMERKQQWKKNNLRLSFSKRMYDESVNLSPLSSPIPHSPLVRART

SEQ ID NO: 89991 - protein, 97 aa, Zea mays
MAGRSFLIRSPKEEESDAAVREAVLLGAKNAAIAGTVVAVPTLVGCRVLPWAKANLNYTAQALIISAACIAGFFITAAKTILRNARQNTIGKLDKST

SEQ ID NO: 89992 - protein, 194 aa, Prochlorococcus marinus str. MIT 9215
MSLRVGQEAPDFSATAVYDQEFKEITLSGLRGKWVVLFFYPLDFTFVCPTEITAFSDRYNDFSALNTEILGVSVDSKHCHLAWIQTPRNEGGIGDINYPLVSDLKREICQAYNVLNDDGEADRGLFLINPQGVVMHMTVNKAPVGRNVDETLRILQGYQYVAANPDEVCPANWTPGEKTMLEDPKGSKEYFSAL

SEQ ID NO: 89993 - protein, 385 aa, Physcomitrella patens subsp. patens
MTSDDKIEATERDVQILQELPDHLAMECLARVPLDNLHGVSKTWEDVIYDPYFQRLRAANGSTQLDWIYALVQMQDKSFKWRALDPHSSRWHDLPPPPHDMEFQLFNPGCIGVSYTVQCVSTSSKLVMIAGVKARKDGQPRMTVEPALDHPYIFDTRTSLWKRGSPFKVPRKWCVCGVVDEKVYVASGSGKDWSQELSKSAEVYNLENDKWEALQNLSTSKFSGEAMNAVSNNNKLYFVSGRGVFSKEGVVYDIITQSWSEMSPGLKQGWKGPCVAVNGKFYLIETPAGKLKVYAPERDEWDIIMVDSRLANLEVLIGTKGKIVAIEAASLKDDETNPGVLRVIDIASDAPQILDIPVQEGQVVCVQVLAMMNQPSKLERGQSYF

SEQ ID NO: 89994 - protein, 838 aa, Zea mays
MPDWRVREFEGKFTDEFAHSNNNKHESGVEAPGVTSSKKLKHAVAGEKIQGVIPGINSSDPQKCNSENIQHENRIVSQNINSAGDCIGDCKDSSNAFSSREENTIAETRCPTDDWNSCQFALSNGSSILNNHIAPQDSLTYGDNDLNYIDWPGIDNFEDVDTLFRRSDFTYDPQQLENTDGLSWLPSSDAVYSSDVALQQGFDSSYSDYDILDDLSAFQCAEDKSLPSVGPSSDLCDNQFNDTYLFSEQKNANAYGEQIYQEDVMELLPTDQICSGHENIDMGIEMLSLGSFKTGAILSKLKHTVAGEKIQGVIPGINSSDPQKCNSENIQHENRIVSQNINSAGDCIGDCKDSSNAFSSREENTIAETRCPTDDWNSCQFALSNGSSILNNHSAPQDSLTYGDNDLNYIDWPGIDNFEDVDTLFRRSDFTYDPQQLENTDGLSWLPSSDAVYSSDVALQQGFDSSYSDYDILDDLSAFQCAEDKSLPSVGPSSDLCDNQFNDTYLFSEQKNANAYGEQIYQEDVMELLPTDQICSGHENIDMLQGGNQYSSEHTIQGIEDKKFSIASTSQLSSSQNLLKQRHHLDSNSPSNITYEAYEEKFGPSSGSFAQRNLKVQKKTMNMQPTQPINDNVMNRHPQTLTRSASYPCENNESERRGLGKRTLGDPQVTMGTSMVVDGSFVSSMSSDISVEESSFRQLQNAVSQLDVQTKLCIRDGLYRLARSAQHRQVIPNMMSSNEDNPDIKDLQNAETLRKFVDPRSIETQTNPIDRSIALLLFHQSSDHAAVAVDDASSLKPPAGSKHHQGPAANQNQGLIPDSSVYSPGDGAPKDVQSLDKF

SEQ ID NO: 89995 - protein, 211 aa, Triticum aestivum
MKPAVEGDERAAEIARIKAAAAAAKKSAEEVVDVDDEGEDDEGDEEEEAVDGDDDDDEVDDDGEDDDDEGVEGEEKGSAPQQVVDISDEDDGGGDEEEGGDDDDDDDDDDDDEEDDDEVDEEEEPEEELGTEYLVQPLGRAEDEEHSSDFEPEENGDGAEDEEIEDDDAEDGEDSVKAQSSSKRKRSGAEDEDDDDGDDDGDDDEKPPSKR

SEQ ID NO: 89996 - protein, 425 aa, Silicibacter sp. TM1040
MSTIIDIHAREILDSRGNPTVEVDVVLEDGTMGRAAVPSGASTGAYEAVEKRDGDKSRYMGKGVLEAVAAVNGEIADELVGFDATEQVSIDRAMIELDGTENKGRLGANAILGVSMAVAKAAADFTTQPLYRYVGGAAARILPVPMMNIINGGEHADNPIDIQEFMIMPVAAENIRDAVRMGSEVFHTLKKELSAAGLSTGIGDEGGFAPNIASSREALDFILKSIEKAGYKPGEEIYLALDCAATEYYKDGKYVLSGEGKTLTSEENAAYLAALVNDYPIISIEDGMSEDDWDGWKALTDQIGDKVQLVGDDLFVTNPVRLAEGIERGCANSMLVKVNQIGSLTETLQAVDMAHRARYTNVMSHRSGETEDATIADLAVATNCGQIKTGSLARSDRLAKYNQLIRIEETLGEIAEYAGRSILKG

SEQ ID NO: 89997 - protein, 413 aa, Oceanobacter sp. RED65
MFKKISVIGLGYIGLPTAAVIASKGIEVIGVDVNEHAVNTINEGKIHIVEPGLEDMVKQDVEKGLLKAYLEPQEADAFLIAVPTPFKGEDHTPNLDYIEAASKAVAKVLKTGDLVILESTSPVGATEKMAAWIAEVRPDLKVSGVNADNEVDIFIAHCPERVLPGHVIRELEENDRVIGGLDEASTERATALYKTFVKGECIATNARTAEMAKLTENASRDVQIAFANELSLICDKQGIDVWELIELANRHPRVNILQPGAGVGGHCIAVDPWFIVNQNPEDAKIIHQARKTNDYKPNWVVEKIEEAVKDIENPTIACLGLAFKPDIDDLRESPALQITEKLAAKGYNILAVEPNVDALPKSLVGLENVHLVSLEEAIQETNVVGILVKHKEFTGEYFSVPTLDFVNSGGKSL

SEQ ID NO: 89998 - protein, 313 aa, Silicibacter sp. TM1040
MPARKIIIDTDPGQDDAVAILLALASPENIDLLGITAVAGNVPLELTQKNARIVCEVAKRQDVKVFAGRAAPLERPLVTAEHVHGGTGLDGPELFDPEMPLQDQNGVDFIIETLRREPAGTVTLCPLGPLTNIAAAFRAAPDVVERVQEIVLMGGAYFEVGNITPAAEFNIYVDPEAAHEVLSSGIKITMMPLDVTHKALTTRARVEAFRALQSPVGAFTADMLDFFERFDVEKYGSEGGPLHDPCVIAYLIDPALFSGRHINVEIETASALTLGMTVADWWGVTDRPANALFIGDIDADGFFSLLTNRLARL

SEQ ID NO: 89999 - protein, 242 aa, Brassica napus
  misc_feature (213)..(213): Xaa can be any naturally occurring amino acid
  misc_feature (238)..(238): Xaa can be any naturally occurring amino acid
MGFMVDTQQEGGEQHQWSCIRNLVRRKQVDSSNGKAEHQLAKALTFPHLIAVGVGSTIGAGVYILVGTVAREHSGPALAFSFLIAGVSAALSAFCYAELSSRFPSAGSAYHYSYICIGEGVAWLIGWALILEYTIGGSTVARGISPNLAMIFGGEDCLPAILARHQIPGLDIVVDPCAAVLVFIVTGLLCIGVKESTFAQGIITTVNVFVMIXVIVAGTYLCFKTGWAGYQLPSGYFXYGVD

SEQ ID NO: 90000 - protein, 584 aa, Fusobacterium nucleatum subsp. nucleatum ATCC 25586
MNYSMPKYFQNMPQVGKALANIDEANENAVKEIEAAIADSVAAMQDSGTSDEKIHDKGQMTALERVAELVDEGTWYPLNTLYNPENFETGTGIVKGLGRIGGKWAVVVASDNKKIVGAWVPGQADNLLRASDTAKCLGIPLVYVLNCSGVKLDEQEKVYANRRGGGTPFFRNAELQQLGIPVIVGIYGTNPAGGGYHSISPTILIAHKDANMAVGGAGIVGGMNPKGYIDMEGAIQIAEATMAAKKVEVPGTIHVHYDKTGFFREVYDDEIGVIDGIKKYMDYLPAYDLEFFRVDEPTEPALDPNDLYSIIPMNQKKIYNIYDVIGRLFDNSEFSEYKKGYGPEVVTGIAKVDGLLVGVIANAQGLLMNYPEYREKAVGIGGKLYRQGLIKMSEFVTLCSRDRLPIVWLQDTSGIDVGNPAEEAELLGLGQSLIYSIENSHVPQIEITIRKGSAAAHYVLGGPQGNNTNAFSLGTAATEVYVMNGETAASAMYSRRLAKDYKAGKDLQPTIDKMNQLINEYTAKSRPAYCAKTGMVDEIVPLYDLRGYISAFANAVYQNPKSICAFHQMILPRAIREFETYTKK

SEQ ID NO: 90001 - protein, 575 aa, Schizosaccharomyces pombe
MVQSPTSYHACSNNQSPFPHSHHPPLHNPLPVSCQPVLRPPPVPQVPSHWYPVSLPSPNLPHQPISKPPVIPNLPKLQVHPNRLPHPIHNHPYSSPTSYPPPLCPATYCPSNPPQLAPATAIAPSSQSSQHKSVNYSVTPSSINNHTAVPLSPTLAVWLPMTQPTFQPPSANVYQPASNANQVITPVSISDYRPPKKRKRAAWPPYKKVDRVNVPVVHDTTAFDPSTFDDDDGHYKVVPNSKFANRYTVVRLLGHGTFGKVIQCYDQSTGRHCAIKVTRAIPKYREASLIELRVLQTIAHSDPTNENKCIQLRDYFDYRKHICIVTDLFGWSVFDFLKNNNYIPFPLKHIQMLSQQLFKSVAFLHSLGLVHTDLKPENVLLVSNASRTIRLPYRNYSQKVLNSCEIRLIDFGSATFEDEYHSSVVSTRHYRAPEIILGLGWSYPCDVWSIGCILVELFTGQALFQTHEDSEHLCMMEKILGPFDRNMISRSSRTSQRFFKSDGKVRYPLSNTPKKSINYLQSLQTLEQIFAVSSPEVALLLDLLKKVFVYDPKRRITAKEALWHPFFTQPISSNL

SEQ ID NO: 90002 - protein, 220 aa, Solanum lycopersicum
MAFKKTLAQRLSNVYKTTGFSISASRISSSSMSPRKLVPPHPDDKIAPDPGNNGIIRRFIHRRLIGTSPATSPDLRSLPTGESLIEKIREMDVNKSRIKLDGFLPPLEMRPEPEPEVTTEGNLTVADAKKLFKVSQLEMVKLRLKQTEKNCVSYPEFVQICSGISSSNDSGIELAKILDDSGTVLVLGNVVFLRPDQVVKTLQSLLPIPATTIPKDPQMM

SEQ ID NO: 90003 - protein, 174 aa, Chlamydomonas reinhardtii
MTDKQSAKVFVGGLSWETTGEKLRAYMENFGSVREAFVSYNRNNGRPRGFGFVVFESPEVADKVVATKHMIDRREVEAKRAVPKEDAPEEKQQGSAPQRTKKIFVGGLAPTVDEAQLRQHFSDFGTVEDAVVMYDHENKRPRGFGFVTFAEEEAVERVFSHGAVQTIADKPIEV

SEQ ID NO: 90004 - protein, 131 aa, Flaveria ramosissima
SNGGRVQCMKVWPPLGKKKYETLSYLPDLTEAQLAKEVDYLLRNKWVPCLEFELEHGFVYRENARSPGYYDGRYWTMWKLPMFGCTDSAQVMKELQECKKEYPQAWIRIIGFDNVRQVQCISFIASKPDGF

SEQ ID NO: 90005 - protein, 115 aa, Prochlorococcus marinus str. MIT 9215
MKSWKCIENCGACCKFDLKERSDLADKLNKEDIALINSMTAKDGWCKNLDRKNKKCLIYETRPHFCRVNEFSTAFKGYLKSGDKFLIDCCKQHISSNYGYESKEMKTFKIAISGK

SEQ ID NO: 90006 - protein, 334 aa, Geobacillus stearothermophilus
AVKVGINGFGRIGRNVFRAALKNPDIEVVAVNDTGGANTLAHLLKYDSVHGRLDAEVSVNGNNLVVNGKEIIVKAERDPENLAWGEIGVDIVVESTGRFTKREDAAKHLEAGAKKVIISAPAKNEDITIVMGVNQDKYDPKAHHVISNASCTTNCLAPFAKVLHEQFGIVRGMMTTVHSYTNDQRILDASHKDLRRARAAAESIIPTTTGAAKAVALVLPELKGKLNGMAMRVPTPNVSVVDLVAELEKEVTVEEVNAALKAAAEGELKGILAYSEEPLVSRDYNGSTVSSTIDALSTMVIDGKMVKVVSWYDNETGYSHRVVDLAAYIASKGL

SEQ ID NO: 90007 - protein, 153 aa, Brassica napus
  misc_feature (100)..(100): Xaa can be any naturally occurring amino acid
  misc_feature (142)..(142): Xaa can be any naturally occurring amino acid
MGLLESVKSIDWELESPPVYRDFRVLPLFAVFFPSVRFLLDRFVFEKWAKHLIYGKQRQNLGDDATERNKKIRKFKESAWKCVYYLSAEILALSVTYNEXWFMNTKYFGVGPGDQSWPDQQTKLKLKLLYMFGAGFYTYSIXALIFWETRRLI

SEQ ID NO: 90008 - protein, 716 aa, Chlamydomonas reinhardtii
MSSDAHYQSAASLVQTVQRYLTKTKSQELLIRSTTLISIYLLAFCIRLFSVLRYESVIHEFDPYFNYRSTIKLVTEGFYEFWNWFDAESWHPLGRVVGGTVYPGLMWTAAILYKVSSFLTACIKLRDICVFTAPFFAGNTAMVAYLFGKELKDTETGLVAAALMAIVPGYISRSVAGSFDNEAVAIFALTTCFYLWVCAVNRGTIASGVFAAFAYLYMAASWGAYVFISNLIPLYIIIMFFIGRYSRRLYVAYTTFWAVGGILAMQIRFIGFNHVLSNELLSWNAVFAALQVWELIVFLRAKLGDRKFGQLAYLLALGAVGAGAGAVVILIASGKLNPWTGRFWTLLDPTYAKKFIPIVASVSEHQPTTWASYIFDLHVLVFAAPAGLYFCFKKLTDGTIFLTVFALTAIYFSGIMVRLMLVAAPAFVLLSAISISNTLASASRELRLHAAATEAAKRAAAGADEDPLPSRPAANWAILGLTALAMMSYAGHCIWVTSEAYSSPSIVLISGWGPHRHVLDDFREAYYWLRHNTKPDAKIMSWWDYGYQITAMGNRTVIVDNNTWNNTHIATVGRAMASNETEAYKIMRQLDVDYALVIFGGMSGYSSDDINKFLWMVRIGGGVYPDHIKEANYLNNGDYTVSERGTPTMLNSLMYKMSYYDFGNIMTEHNKGTGYDRVRGYEIGQKDISLDHLDEAFTSEHWIVRIYKVKDLENRF

SEQ ID NO: 90009 - protein, 131 aa, Flaveria palmeri
SNGGRVQCMKVWPPVGKKKYETLSYLPELTEAQLAKEVDYLIRNKWVPCLEFELEHGFVYRENASSPGYYDGRYWTMWKLPMFGCTDSAQVMKELQECKKEYPQAWIRIIGFDNVRQVQCVSFISPKPTGF

SEQ ID NO: 90010 - protein, 109 aa, Nostoc punctiforme PCC 73102
MSIYVGNLSYEVTQDALSTVFAEYGSVKRVQLPTDRETGRLRGFAFVEMSSEDEETKAIESLDGAEWMGRDLKVNKAKPREDRGGGGSFGGNRGGGGGGYNRGGGGGRY

SEQ ID NO: 90011 - protein, 131 aa, Flaveria palmeri
SNGGRVQCMKVWPPVGKKKYETLSYLPELTEAQLAKEVDYLIRNKWVPCLEFELEHGFVYRENASSPGYYDGRYWTMWKLPMFGCTDSAQVMKELQECKKEYPQAWIRIIGFDNVRQVQCVSFIASKPTGF

SEQ ID NO: 90012 - protein, 218 aa, Populus trichocarpa
MAASFSISRLILSSPTQISTTAATAKSFLSSLPLKPNRLPKPLRTTTRKFSTISATISVGDKLPEATLSYFDSEGELQTTTISSLTSGKKSILFAVPGAFTPTCSQKHLPGFVEKSAELKSKGVDTIACISVNDAFVMKAWKEDLGIKDDGVLLLSDGNGDFTKAIGCELDLSDKPVGLGVRSRRYALLAEDGVVKVLNLEEGGAFTSSGAEDMLKAL

SEQ ID NO: 90013 - protein, 212 aa, Zea mays
  misc_feature (55)..(55): Xaa can be any naturally occurring amino acid
  misc_feature (118)..(118): Xaa can be any naturally occurring amino acid
SDSTHLPHPLDSFPALATSYATTARSGLGSSSKLPWAAAALREQLNALLSSMFAXSGLVDEQFQQLQMLQEDGGTPGFVAEVVTLFCDDADRIISELAALLYALFVPFCSMHTKRIYXLALALLCDLHFACSDQPIVDFDKVDAYVHQLKGSSASVGAQKVKFTCMQFRQLCQDKNRDGCIMALAVVRNEFYDLRNKFQTMLQLEQQTQAQQ

SEQ ID NO: 90014 - protein, 487 aa, Brassica napus
MGETAAANNHHHHHGHQVFDASVPPQPAFKCFDDDGRLKRTGTVWTASAHIITAVIGSGVLSLAWAIAQLGWVAGPAVMLVFSLVTLYSSTLLSDCYRTGDAVSGKRNYTYMGAVRSILGGFKFKICGLIQYLNLFGIAVGYTIAASISMMAIKRSNCFHKSGGKDPCHMSSNPYMIIFGVTEILLSQVPDFDHIWWISIVAAVMSFTYSAIGLALGIVQVAANGVFKGSLTGISIGTVTQTQKIWRTFQALGDIAFAYSYSVVLIEIQDTVRSPPSESTTMKKATKISIAVTTIFYMLCGSMGYAAFGDAAPGNLLTGFGFYNPFWLLDIANAAIVVHLIGAYQVFSQPIFAFVEKSVSERFPDSDLLTKELQIKIPGFRSPYKTNVFRVVFRCCFVVLTTVISMLMPFFNDVVGILGALGFWPLTVYFPVEMYIKQRKVEKWSTRWVCLQMLSVACLVISVVAGVGSIAGVMLDLKVYKPFQSTY

SEQ ID NO: 90015 - protein, 459 aa, Oceanobacter sp. RED65
MKISIFGGGYVGLVQAAVLSEVGHDVTCVDINPRKVDALNRGLIPIYEPGLDVLVKQGLSKGLLTFTIDAEEAIQHATAIFIAVGTPPDEDGSADLQHVLKVAETIAQYMNEYKVIINKSTVPVGTGARVKSVVREQLKSRNVICEFDVVSNPEFLKEGAAVADCQRPDRIVIGVESDKAANIMREIYEHFNRNHEKIIQMDIRSAELTKYAANCMLATKISFMNEMANLAEKLGADIESVRQGIGSDPRIGYHFIYPGCGYGGSCFPKDINALLNTSRQVSYDAKILKAVDRVNQKQKQVLFNKLHQVFNGDLVGRTIALWGLSFKPETDDTREATSLVLINALLEAGVAVQAYDPQARAEVGNIYGDQEELTLTDKKEDALIAADALVIVTEWKEFRSPNFELIQQSLNYPIIVDGRNLYSPQKMKQLGFIYYGVGRGESIKKQPAVIMTAPKEMVQ

SEQ ID NO: 90016 - protein, 335 aa, Pseudomonas aeruginosa
AFNMHNRNLLSLMHHSTRELRYLLDLSRDLKRAKYTGTEQQHLKRKNIALIFEKTSTRTRCAFEVAAYDQGANVTYIDPNSSQIGHKESMKDTARVLGRMYDAIGYRGFKQEIVEELAKFAGVPVFNGLTDEYHPTQMLADVLTMREHSDKPLHDISYAYLGDARNNMGNSLLLIGAKLGMDVRIAAPKALWPHDEFVAQCKKFAEESGAKLTLTEDPKEAVKGVDFVHTDVWVSMGEPVEAWGERIKELLPYQVNMEIMKATGNPRAKFMHCLPAFHNSETKVGKQIAEQYPNLANGIEVTEDVFESPYNIAFEQAENRMHTIKAILVSTLADI

SEQ ID NO: 90017 - protein, 292 aa, Haloarcula marismortui ATCC 43049
MSHPFHIVDVFAQERYAGNQLAVVTDAGDLHKDEMQAIAAEMDYSETTFVTGEPTDGAWPVRIFTPAAEIPFAGHPTLGTAQVIRDHLADGNPETVTLDLPVGEVPVEVRERDGRETLWMTQQAPEFGEQLAHEDLAAVLGLPADRLDHDWPVEIVSTGLATIVVPVADRDALGAIDLDRDAYDAVTGDRDAKNVLAVCREPRSDDNDLAVRVFAPFYNVLEDPATGSSNGCLAAYLARHEMLGSPAVEARVEQGYEMGRPSLLHLSTDGSGEDISVRVGGSVVAVARGDLL

SEQ ID NO: 90018 - protein, 333 aa, Methanosarcina acetivorans C2A
MVTFLEKISERAKKLNKTIALPETEDIRTLQAAAKILERGIANVVLVGDEADIKALAGDLDLSKAKIVNPKTYEKKDEYINTFYELRKHKGITPETAAEVMSDYVYFAVMMAKLGEVDGVVSGAAHSSSDTLRPAVQIVKTAPGAALASAFFIIAVPDCEYGSDGTFLFADSGMVEIPSVEDVANIAVISAKTFELLVQDTPYVAMLSYSTKGSAHSKLTEATVAATKLAQELAPDVAIDGELQVDAAVVPKVAASKAPGSPVAGKANVFIFPDLNAGNIAYKIAQRLAKAEAYGPITQGLAKPINDLSRGCSDEDIVGAVAITCVQAAAQDK

SEQ ID NO: 90019 - protein, 258 aa, Triticum aestivum
  misc_feature (111)..(111): Xaa can be any naturally occurring amino acid
  misc_feature (130)..(130): Xaa can be any naturally occurring amino acid
  misc_feature (132)..(132): Xaa can be any naturally occurring amino acid
RQPWYPVPPKFPGGILWTQQRSAPQVSPGWRAPGTPDLGLKGVRKFFFPPSSPPRRLKFPSVRVCVSRFRIQTAASGRLRPPGERPGEKNMITLQELRTAEEFEVEEAVAXMESQTIRHMIEDACADNGXPXLPNVNSKILSKVIEYCNKHVQPKPADGAAAGAGASDASAAAPAAPAEDLKNWDAEFVKVDQATLFDLILAANYLNIKGLLDLTCQTVADMIKGKTPEEIRKTFNIKNDFTPEEEEEIRRENQWAFE

SEQ ID NO: 90020 - protein, 403 aa, Haloarcula marismortui ATCC 43049
MLSFEDVLAAQDTVSETARHTPLDYSHTFSAMTGADIHLKLELFQRTGSFKIRGATNRIASLSDAEREAGVVTASAGNHAQGVALAATRIGVDSKIVMPERAPVSKVKATRSYGGNVVLHGRDYDAAAEHAHELEREEGRTYVHAFDDEKVMAGQGTIGLEIYEDLPGVDTVVVPIGGGGLISGIATALKGKDERIRVIGVQAEGASSVAESLEKGHRIERDSVETIADGIATRTVGEQTFEVISDRVDEVVTVSDSEIAVALTTLLERSKTLAEGAGAVALAAVMEEKFDFEDDETIVPALCGGNIDLNTLTNVIMRGLVETGRYLKIRTVLQDRPGALEELVEVLSREQVNIYGIEHDRTSRDVAMSSAEVELDLETRGHDHVAELIDALTDEGYEVDVLV

SEQ ID NO: 90021 - protein, 220 aa, Triticum aestivum
  misc_feature (8)..(8): Xaa can be any naturally occurring amino acid
  misc_feature (10)..(10): Xaa can be any naturally occurring amino acid
  misc_feature (29)..(29): Xaa can be any naturally occurring amino acid
SNPSVTTXEXIDKAVHKMIIDAGAYPSPXGYGGFPKSVCTSVNECMCHGIPDSRELKDGDIINIDVTVYLNGFHGDTSKTFFCGEVDEAAKRLVKVTEECMLRGISACKHGVSFKKIGRRISEHAERHGFGVVEQFVGHGVGRVFHSQPIIYHQRNNMPGQMVEGQTFTIEPILTMGGSSIECDMWEDGWTAVTTDGSLAAQFEHTILITRTGAEILTKC

SEQ ID NO: 90022 - protein, 387 aa, Zea mays
  misc_feature (74)..(74): Xaa can be any naturally occurring amino acid
MDAKKPYMLAITTVAIYTGMYVVSKAAFNQGMNSFVFVFYRQAAASLLLLPIALVLESAYYILPNSFLPIIRRXRKNVRSMSSGLILKLFLLALIWNTLGMNLCNASVTLTSATVASATGNSTPVITFCLALLLRMEVVKLRSVSGIAKVTGVALCLAGALVIALYTGPSLSPVNRHHRASGGAHGFKAPTRGGTWVTGTFLMLLSNVTWSLWTVLQGALLKEYPNKLLVTTSQCLFSTAQSFVVAAVAERDFSKWALKLDVSLIAVAYTGFLVTGVSYYLQAWCVQIKGPVFLAVWNPLCFVLTIFCSSFFLGENVHLGSIVGGILLVCGLYSVLWGKTLEVHQTVESGDNTVGEVQNGQEEKNHQQKVLEKGRQEEASMTAPGVV

SEQ ID NO: 90023 - protein, 361 aa, Zea mays
MKALILVGGFGTRLRPLTLSFPKPLVDFANKPMILHQIEALKEVGVTEVVLAINYRPEVMINFLKDFEDKLGITITCSQETEPLGTAGPLALARDKLADGSGEPFFVLNSDVISEYPFAELIKFHKSHGGEATIMVTKVDEPSKYGVVVMEEATGRVERFVEKPKIFVGNKINAGIYLLNPSVLDRIELRPTSIEKEVFPQIAADQQLYAMVLPGFWMDVGQPRDYITGLRLYLDSLRKKSAARLAAGAHVVGNVLVHESAKIGEGCLIGPDVAIGPGCVVEDGVRLSRCTVMRGVRIKKHACISNSIIGWHSTVGQWARIENMTILGEDVHVCDEVYSNGGVVLPHKEIKSSILKPEIVM

SEQ ID NO: 90024 - protein, 131 aa, Flaveria palmeri
SNGGRVQCMKVWPPVGKKKYETLSYLPELTEAQLAKEVDYLHRNKWVPCLEFELEHGFVYRENASSPGYYDGRYWTMWKLPMFGCTDSAQVMKELQECKKEYPQAWIRIIGFDNVRQVQCVSFIASKPTGF

SEQ ID NO: 90025 - protein, 501 aa, Xanthomonas oryzae pv. oryzae KACC10331
MRESVPRVSLLIDGELVVSAGTHWQDVVNPADQSVLAQVPFATADEVAAAVAAASRAFVTWRKTPIGTRARIFLKYQQLIREHMPELAALLSAEQGKTLADAEGDVFRGLEVVEHAAAIGNLQLGELANNVANGVDTYSLLQPLGVCAGITPFNFPAMIPLWMFPMAIATGNTFVLKPSEQDPMVTMRLVELALEAGIPKGVLNVVHGGEDVVNALCDHPDIKALSFVGSTKVGTHVYQRASLAGKRVQCMMGAKNHAVVLPDANRGQTLNAMVGAAFGAAGQRCMAASTLVLVGDARAWIPELVAKAKRLKIGAGNAPGTEVGPLISCAARARVEALIASGVEQGAMLELDGRAPQVPGFEQGNFVGPTIFSGVTPGMRIYDEEIFGPVLVILEAATLDEAIALINANPNGNGTALFTQSGAAARRFQEDIDVGQVGINVPIPVPVPLFSFTGSRASKLGDLGPYGKQVVMFYTQTKTVTARWFDDETLGHGVNTTISLK

SEQ ID NO: 90026 - protein, 247 aa, Streptomyces aureofaciens
MRFQAAVLHSYEDPFTVEEVALRTEPAADEILVEIAGTGMCRTDLAVRRSAGRSPLPAVLGHEGAGVVVRTGSGPDTTIDVGDHVVLSFDSCGHCRNCRGAAPAYCDSFASLNLFGGREEVPPRLTDATGKALAPRWFGQSSFAEYALVPARNAVRVDPALPIELLGPLGCGFLTGPGAVLNTFGAGPGDTLTVLGAGPVGLAAVMAATAAGALTVAVDRHPQRLALAERFGAIALPAGTAGLPERI

SEQ ID NO: 90027 - protein, 395 aa, Frankia sp. CcI3
MHSTATTFLELGGILFCLGVLGHLALRISVSPIPLYLVGGLAFGRGGLLPLGASEEFIGVGAEIGVVLLLLTLGLEYTADELLSGLRRQAPAGVLDLALNATPGVVAAFLLGWGPTAAVVLGGVTAISSSGIIAKVLGDLGRLGNRETPVVLSVLVLEDLAMAVYLPVLTALLAHHTFVRGSLTVAIALGVLVAVLYIALRHSEKVTRLVFNPKAHRNDEILLLRALGLALFVAGVAQRMQVSAAVGAFLVGIALSGPVAEGAEEVLRPLRDLFAAVFFVFFGMQTDPAEIPPALLTGSLLAIAGVATKVMTGWWAARSAGIGTMGRFRAGAALVARGEFSIVIAGLAVAAGLEPRLGPLAACYVLLMAVLGPLAARFVEPVIRTARRLQAARSP

SEQ ID NO: 90028 - protein, 356 aa, Haloarcula marismortui ATCC 43049
MRTCSVCDREYPRAEPWRCSCGAPLDYAMQPLPDSQPGQFSRTSGVWDFAKFLPMDERVSLGEGWTPLVDAPGWDATFKLESLHPTGSFKDRGAATVIAEALEVGADRVLEDSSGNAGLAVASYAARAGLDAEIYVPASAKDAKVRRIERTGADVVRVEGSRESVTEACIDAVEDGAGWYASHAWNPAFFAGTATAAYEIAAQRDWSVPDAVVTPLGHGTLFLGLYRGFQALEQAGWTDAIPRILGTQAVGYSPIADDDEGGTVPDDAAANDLADGIHIRDPPRGRQIRHAIDETDGAAVAVSAAATERERDRLGAAGFHVEPTCATATAALPEFRERGELQDGDDVVVALTGRND

SEQ ID NO: 90029 - protein, 633 aa, Silicibacter sp. TM1040
MPFDMRDAMLRIENITYSVEGRPLMEEASASIPTGHKVGVVGRNGTGKSTLFRLIRGELALEGGTITLPSKARIGGVAQEVPSSEVSLIDTVLAADTERAALMAEADTATDGTRIAEIQTRLVDIDAWSAEARAASILKGLGFDDQDQLRPCSDFSGGWRMRVALAAVLFAQPDLLLLDEPTNYLDLEGALWLESYIARYPHTVLIVSHDRGLLNRAVSAILHLEDRKLTLYQGPYDTFAETRAARIAVAQSEAQKQENRRAHLQSFVDRFRAKASKAKQAQSRLKMIEKMKPISTPQEAALRAFSFPEPEEMSPPIIQIEGGITGYGDVEILRRLNLRIDQDDRIALLGKNGQGKSTLSKLLSDRLPLMAGKMVRSSKLRIGYFAQHQVDELYINETPLDHLRRLRPDEPPAKWRARLAGFGLGAQQAEVEVKRLSGGQKARLSLLLATLDAPHMLILDEPTNHLDIESREALVEALTAYSGAVILVSHDMHLLSMVADRLWLVSEGTVKPYDGDLDSYREMLLARDKPAAKAATVAASAAEKRTEKPKRASRDQLLALRSEVRKSEARVEKLSEMREKLDAKLADPALYESGKQADIEVWQKKHAECIEALERAEAIWMDALEKLELAETS

SEQ ID NO: 90030 - protein, 140 aa, Silicibacter sp. TM1040
MALERTFSIIKPDATRRNLTGAINAKFEEAGLRIVAQKRIHMTKAQAGKFYAVHAERPFYDELCEFMSSAPVVVQVLEGEGAIAKNREIMGATNPADAAPGTIRAEFAESVGENSVHGSDAPETAAEEIAYFFSGLELVG

SEQ ID NO: 90031 - protein, 849 aa, Oryza sativa Japonica Group
MELGRPGCPVDRLPDSPRHERGAARCLLGTGANPKVWCDRLEGVMRRVLSRPLSALESLPTVIVHKIQPTLDAISPGQELAAGDKLVSSNGRFALGFFQTDSNKSSSNSTPNIYLGIWFNTVPKFTPVWVANGENPVADLASCKLLVSSDGNLAIVATTHAKNSSMVWSSKANIPTNTTHAVLLDDGNLVLRSTSTTNASSTILWQSFDHPTDTVLQGGKIGWNNATGVNRRLVSRKNTVDQAPGMYSFELLGHNGPTSMVSTFNSSNPYWSSGDWNGRYFSNIPETVGQTWLSLNFTSNEQEKYIEYAIADPTVLSRTILDVSGQLKALVWFEGSRDWQTIFTAPKSQCDVYAFCGPFTVCNDITFPSCTCMKGFSVQSPEDWELDDRTGGCVRNTPLLCNSNKTAAGTADKFYPMTSVQLPDKAQSIGAATSADECAAACLSSCSCTAYSYGEGGCSVWHDKLLNVRQQGNGVLYLRLSAKEVLESRRNNRWGVILGASIGASTAALGLIFLLMIWIRKGKRYNLTMDNVQGGMGIIAFRYVDLQHATKNFSEKLGAGSFGSVFKGSLSDSTIIAVKRLDGARQGEKQFRAEVSSIGIIQHVNLVKLIGFCCEGDRRLLVYEHMPKSSLDAHLFPSSGAVLSWTIRYQIALGVARGLAYLHSSCRDCIIHCDIKPENILLDSSFTPKVADFGMAKFLGRDFSHVVTTMRGTIGYLAPEWISGTAITSKVDVYSYGMVLLEIISGSRNSSKQSSRDGVHEACFPVQVARNLLNRDIDSLVDANLHGEVKLEQVERVCKVACWCIQDNEFDRPTMSEVLQFLEGLSEVETPPMPRLLHTLAGGLDSKIM

SEQ ID NO: 90032 - protein, 693 aa, Xanthomonas oryzae pv. oryzae KACC10331
MLPGFDGLRFSHWQAELREDGVVVLSLDRQDAPVNAFSQEVLLELGALVERLALEPPKGVVLRSGKANGFIAGADLKEFQQFDHKGTVNDAIHRGQQVFQKLAELPCPTVAAIHGFCMGGGTEIALACRYRVASDDGSTRVGLPETKLGIFPGWGGSARLPRLIGAPAAMDLMLSGRTVSAKAARAIGLVDKVAAPAVLVDAAAALALAGTTRPFQQRATAWATNTLLARKILAPQMRKQVARKARKEHYPAPYALITVWERAGGSGIQARLAAERKAVVKLASTPTARNLIRIFFLTERLKALGGKDAAGAAATPIRHVHVIGAGVMGGDIAAWAAYKGFDVTLQDREQRFIETALTRGGELFAKRVKDDAKRPAVAARLRGDLAGAGVTQADLVIEAIIENPQAKRDLYQLIEPQLKPDALLTTNTSSIPLTELRGHIQRPAQFAGLHYFNPVAMMPLVEIVQHDGLDPANAARLAAFCKALDKFPVPVAGTPGFLVNRVLFPYLLEAATAYAEGIPGPVLDKTAVKFGMPMGPIELIDTVGLDVAAGVGAELAPFLHLPIPAALITVEAGKRGKKDGQGLYTWENGRAVKPEVASGHTAPADLEDRLILPLLNEAVACLHDGVVADADLLDAGVIFGTGFAPFRGGPIQHIRSVGADALLERLQALHARYGERFAPRPGWDSPVLREAVV

SEQ ID NO: 90033 - protein, 476 aa, Lactobacillus sakei subsp. sakei 23K
MAENEMKRELKTRHLSMIALGGSIGTGLFVTSGSAIAKAGPGGALLAYCGIGIMVFFLMTSLGEMATYLPVSGSFSTYATRFVDPALGFALGWNYWFNWAITLAVDVSTAALVMQFWLPDMPGWIFSLVALLLIFLINITSVKSFGETEYWFALIKVITVIIFLGVGVLTIFGIMGGHRTGLSNFTIKKAPFVGGLPMMLSVFVVAGFSFQGTELIGITAGESKTPEKSIPKAIKQVFWRILLFYILSIFVIACLIPYTSPSLLGASETNIAVSPFTLVFKRAGLASAASIMNAVILTSVLSAANSGMYASSRMLWSMAEDGYAAKIFAKTNKRGIPVMALIGTTIIGALTFMTSVFGTRIYLFLVAASGLTGFIAWLGIAISHYRFRRAFKVQGHQLSELKYHARWFPFGPIFAFLLCVIVIIGQDIQAFAHFDWTAIGISYMSIPLFIILYSYYKIRYKTKVIPLEKVDLSKHR

SEQ ID NO: 90034 - protein, 490 aa, Schizosaccharomyces pombe
MSPKQEEYEVERIVDEKLGRNGAVKLYRIRWLNYSSRSDTWEPPENLSGCSAVLAEWKRRKRRLKGSNSDSDSPHHASNPHPNSRQKHQHQTSKSVPRSQRFSRELNVKKENKKVFSSQTTKRQSRKQSTALTTNDTSIILDDSLHTNSKKLGKTRNEVKEESQKRELVSNSIKEATSPKTSSILTKPRNPSKLDSYTHLSFYEKRELFRKKLREIEGPEVTLVNEVDDEPCPSLDFQFISQYRLTQGVIPPDPNFQSGCNCSSLGGCDLNNPSRCECLDDLDEPTHFAYDAQGRVRADTGAVIYECNSFCSCSMECPNRVVQRGRTLPLEIFKTKEKGWGVRSLRFAPAGTFITCYLGEVITSAEAAKRDKNYDDDGITYLFDLDMFDDASEYTVDAQNYGDVSRFFNHSCSPNIAIYSAVRNHGFRTIYDLAFFGIKDIQPLEELTFDYAGAKDFSPVQSQKSQQNRISKLRRQCKCGSANCRGWLFG

SEQ ID NO: 90035 - protein, 101 aa, Phaseolus vulgaris
MASSMISSPAVTTVNRAGAGAGMVAPFTGLKSLGGFPSRKMNNDITSVANNGGRVQCIQVWPTVGKKKFETLSYLPPLTKQQLAKEVDYLLRKGWVPCLEF

SEQ ID NO: 90036 - protein, 468 aa, Nostoc punctiforme PCC 73102
MRVCVIGTGYVGLVTGACLAHIGHDVICVDNNEEKVKLMKSGQSPIFEPGLSEIMQSAIQTQKIHFTSDLAAGVSHGEILFIAVGTPPLPTGESDTRYVEAVARGIGENLNGGYKVIVNKSTVPIGSGDWVRMLVLDGIVERQKTLVPAGGVPSDEKLSEFAAEFDVVSNPEFLREGSAVHDTFNPDRIVLGGNSQRAVALMEQLYDPIVQRKYAEDQSLPPVPILATDLSSAEMIKYAANAFLATKISFINEVANICDRVGADVTQVAKGIGLDSRIGNKFLQAGIGWGGSCFPKDVSALIHTADDYGYEAQLLKSAVSVNERQRLIALEKLQQVLKILKGKTVGLLGLTFKPDTDDLRDAPALILIEQLNRLGAKVKAYDPIISQTGMRHGLSGVLVETDAERLADGCDALVLVTEWQQFSTLDYLKMAKLMAHPVIIDGRNFLDPETLIRAGFQYVGVGRQRVRS

SEQ ID NO: 90037 - protein, 728 aa, Arabidopsis thaliana
MDGMKLSFPPESPPLSVIVALSLSASPVTIDSSAAATTVPSFVFSDGRKLNGATVLLRYVGRSAKKLPDFYGNNAFDSSQVSILCINMKIDEWVDYASVFSSGSEFENACGRVDKYLESSTFLVGHSLSIADVAIWSALAGTGQRWESLRKSKKYQSLVRWFNSILDEYSEVLNKVLATYVKKGSGKPVAAPKSKDSQQAVKGDGQDKGKPEVDLPEAEIGKVKLRFAPEPSGYLHIGHAKAALLNKYFAERYQGEVIVRFDDTNPAKESNEFVDNLVKDIGTLGIKYEKVTYTSDYFPELMDMAEKLMREGKAYVDDTPREQMQKERMDGIDSKCRNHSVEENLKLWKEMIAGSERGLQCCVRGKFNMQDPNKAMRDPVYYRCNPMSHHRIGDKYKIYPTYDFACPFVDSLEGITHALRSSEYHDRNAQYFKVLEDMGLRQVQLYEFSRLNLVFTLLSKRKLLWFVQTGLVDGWDDPRFPTVQGIVRRGLKIEALIQFILEQGASKNLNLMEWDKLWSINKRIIDPVCPRHTAVVAERRVLFTLTDGPDEPFVRMIPKHKKFEGAGEKATTFTKSIWLEEADASAISVGEEVTLMDWGNAIVKEITKDEEGRVTALSGVLNLQGSVKTTKLKLTWLPDTNELVNLTLTEFDYLITKKKLEDDDEVADFVNPNTKKETLALGDSNMRNLKCGDVIQLERKGYFRCDVPFVKSSKPIVLFSIPDGRAAK

SEQ ID NO: 90038 - protein, 456 aa, Salmonella enterica subsp. enterica serovar Paratyphi A str.
MDSQQHSEQLKRGLKNRHIQLIALGGAIGTGLFLGSASVIQSAGPGIILGYAIAGFIAFLIMRQLGEMVVEEPVAGSFSHFAYKYWGGFAGFASGWNYWVLYVLVAMAELTAVGKYIQFWYPEIPTWASAAAFFVIINAINLTNVKVFGEMEFWFAIIKVIAVIAMILFGAWLLFSDTAGPQATVRNLWEQGGFLPHGWTGLVMMMAIIMFSFGGLELVGITAAEADNPEQSIPKATNQVIYRILIFYIGSLAVLLSLLPWTRVTADTSPFVLIFHELGDTFVANALNIVVLTAALSVYNSCVYCNSRMLFGLAQQGNAPKALLNVDKRGVPVSSILVSAVVTALCVLLNYLAPESAFGLLMALVVSALVINWAMISLAHMMFRRAKQQQGVKTRFPALFYPFGNVLCLLFMAAVLIIMLMTPGMAISVWLIPVWLLILGVGYLCKEKTAKTVKAH

SEQ ID NO: 90039 - protein, 521 aa, Candidatus Pelagibacter ubique HTCC1002
MSLSNNLSKILIIDFGSQFTQLIARRVRELGVFSEIVSHKKIKIAQITKDNIAGIILSGGPLNVYENDKFKFDKKILKLGIPILGICFGHQILSKLLGGKVKKSKHREFGLATINKVSNSTLTKNFFNKNNRSDVWMSHADQVSKMPKNFKIIASTKNSKLTIIENIKENFYGVQFHPEVTHTNKGKILLRNFVFLICKIKKNWSSKDQKLKLINEIKEQVGDNKVICGLSGGVDSSVVAQLLSKAIGKNLTCIFVNNGLLRKNEEIQVVNTFKKKLKINLIYVNAEKEFIRKLTNVSDPEKKRKIIGNLFIKIFERYANRIKNVKFLAQGTLYPDLIESKSVTGSQTSKIKSHHNVGGLPKRMKLKLVEPLKFLFKDEVRKLGLELNLSNDIISRHPFPGPGLAIRMPGIITNEKIKILKEADFYFIKALREHGLYDKIWQAYAALLPVKTVGVMGDNRTYEHICLLRAITSEDGMTADFFDFPKGFMQSISNQIINNIRGINRVVYDVTSKPPSTIELE

SEQ ID NO: 90040 - protein, 629 aa, Salmonella enterica subsp. enterica serovar Paratyphi A str.
MAIEIKVPDIGTDEVEITEILVKVGDKVEAEQSLITVEGDKASMEVPSPQAGVVKEIKVSVGDKTETGALIMIFDSADGAADAAPAKAEEKKEAAPAAAPAAAAAKDVHVPDIGSDEVEVTEVMVKVGDTVEAEQSLITVEGDKASMEVPAPFAGTVKEIKVNTGDKVSTGSLIMVFEVAGEAGAAAPAKAEAAPAAAAPAAATGVKDVNVPDIGGDEVEVTEVMVKVGDKVAAEQSLITVEGDKASMEVPAPFAGTVKEIKISTGDKVKTGSLIMVFEVEGAAPAAAPAKQEAAAPAPAAKAEKPAAPAAKAEGKSEFAENDAYVHATPLIRRLAREFGVNLAKVKGTGRKGRILREDVQAYVKDAIKRAEAAPAAAGGGIPGMLPWPKVDFSKFGEVEEVELGRIQKISGANLSRNWVMIPHVTHFDKTDITDLEAFRKQQNAEAEKRKLDVKYTPVVFIMKAVAAALEQMPRFNSSLSEDGQRLTLKKYINIGVAVDTPNGLVVPVFKDVNKKSVTELSRELTTISKKARDGKLTAGEMQGGCFTISSIGGLGTTHFAPIVNAPEVAILGVSKSAMEPVWNGKEFVPRLMMPISLSFDHRVIDGADGARFITIINNMLSDIRRLVM
